US011453907B2

(12) United States Patent
Zhang et al.

(10) Patent No.: US 11,453,907 B2
(45) Date of Patent: *Sep. 27, 2022

(54) CRISPR EFFECTOR SYSTEM BASED CORONAVIRUS DIAGNOSTICS

(71) Applicants: THE BROAD INSTITUTE, INC., Cambridge, MA (US); MASSACHUSETTS INSTITUTE OF TECHNOLOGY, Cambridge, MA (US)

(72) Inventors: Feng Zhang, Cambridge, MA (US); Jonathan Gootenberg, Cambridge, MA (US); Omar Abudayyeh, Cambridge, MA (US); Julia Joung, Cambridge, MA (US); Alim Ladha, Cambridge, MA (US); Han Altae-Tran, Cambridge, MA (US); Guilhem Faure, Cambridge, MA (US)

(73) Assignees: THE BROAD INSTITUTE, INC., Cambridge, MA (US); MASSACHUSETTS INSTITUTE OF TECHNOLOGY, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/894,670

(22) Filed: Jun. 5, 2020

(65) Prior Publication Data
US 2021/0292824 A1   Sep. 23, 2021

Related U.S. Application Data

(60) Provisional application No. 63/019,406, filed on May 3, 2020, provisional application No. 63/018,487, filed on Apr. 30, 2020, provisional application No. 62/993,494, filed on Mar. 23, 2020, provisional application No. 63/032,470, filed on May 29, 2020.

(51) Int. Cl.
| | |
|---|---|
| *C12Q 1/6844* | (2018.01) |
| *C12N 9/22* | (2006.01) |
| *C12Q 1/6806* | (2018.01) |
| *C12N 9/12* | (2006.01) |
| *C12N 9/78* | (2006.01) |
| *B01L 3/00* | (2006.01) |
| *B01L 7/00* | (2006.01) |

(52) U.S. Cl.
CPC ...... *C12Q 1/6844* (2013.01); *B01L 3/502715* (2013.01); *B01L 7/52* (2013.01); *C12N 9/1276* (2013.01); *C12N 9/22* (2013.01); *C12N 9/78* (2013.01); *C12Q 1/6806* (2013.01); *B01L 2300/0816* (2013.01); *C12N 2310/20* (2017.05); *C12Q 2600/156* (2013.01); *C12Q 2600/16* (2013.01); *C12Y 207/07049* (2013.01); *G01N 2333/165* (2013.01)

(58) Field of Classification Search
None
See application file for complete search history.

(56) References Cited

U.S. PATENT DOCUMENTS

| | | | |
|---|---|---|---|
| 7,312,053 B2 | 12/2007 | Tada et al. | |
| 9,470,699 B2 | 10/2016 | Peeters | |
| 9,556,466 B2 | 1/2017 | Lee et al. | |
| 10,253,365 B1* | 4/2019 | Doudna | C12N 9/22 |
| 10,266,886 B2* | 4/2019 | Abudayyeh | C12Q 1/6816 |
| 10,266,887 B2* | 4/2019 | Abudayyeh | C12N 9/22 |
| 2004/0197797 A1 | 10/2004 | Inoko et al. | |
| 2005/0100885 A1* | 5/2005 | Crooke | C12N 15/1131 435/5 |
| 2009/0104218 A1 | 4/2009 | Tettelin et al. | |
| 2012/0053329 A1 | 3/2012 | Yamamoto | |
| 2014/0142160 A1 | 5/2014 | Lee et al. | |
| 2015/0011430 A1 | 1/2015 | Saxonov | |
| 2015/0211058 A1 | 7/2015 | Carstens | |
| 2017/0081659 A1 | 3/2017 | Felgner et al. | |
| 2017/0312751 A1 | 11/2017 | Glezer et al. | |
| 2018/0274017 A1 | 9/2018 | Abudayyeh et al. | |
| 2018/0298445 A1 | 10/2018 | Abudayyeh et al. | |
| 2018/0305773 A1 | 10/2018 | Abudayyeh et al. | |
| 2018/0363026 A1 | 12/2018 | Desharnais et al. | |
| 2021/0095271 A1* | 4/2021 | Li | A61P 35/00 |
| 2021/0108267 A1 | 4/2021 | Zhang et al. | |
| 2021/0292824 A1 | 9/2021 | Zhang et al. | |

FOREIGN PATENT DOCUMENTS

| | | | | |
|---|---|---|---|---|
| CN | 101864483 A | | 10/2010 | |
| CN | 102747148 A | | 10/2012 | |
| CN | 106544444 A | | 3/2017 | |
| CN | 111187856 A | * | 5/2020 | ........... C12Q 1/6884 |

(Continued)

OTHER PUBLICATIONS

Wang et al. (Wang II) "Rapid and Sensitive Detection of Severe Acute Respiratory Syndrome Coronavirus by Rolling Circle Amplification" 43(5) Journal of Clinical Microbiology 2339-2344 (Year: 2005).*

Spiess et al., "Trehalose Is a Potent PCR Enhancer: Lowering of DNA Melting Temperature and Thermal Stabilization of Taq Polymerase by the Disaccharide Trehalose" 50(7) Clinical Chemistry 1256-1259 (Year: 2004).*

Supporting Covid-19 Research, https://www.neb.com/covid-19/solutions-available-from-new-england-biolabs-supporting-covid-19-research, May 21, 2020, 4 pages.

Abudayyeh et al., "A Cytosine Deaminase for Programmable Single-base RNA Editing", Science, vol. 365, Issue 3451, Jul. 26, 2019, 8 pages.

(Continued)

*Primary Examiner* — Nancy J Leith
(74) *Attorney, Agent, or Firm* — F. Brent Nix, Esq.; Johnson, Marcou, Isaacs & Nix, LLC

(57) ABSTRACT

Systems and methods for rapid diagnostics related to the use of CRISPR effector systems and optimized guide sequences for detection of coronavirus, including multiplex lateral flow diagnostic devices and methods of use, are provided.

13 Claims, 46 Drawing Sheets

Specification includes a Sequence Listing.

(56) References Cited

FOREIGN PATENT DOCUMENTS

| WO | 2011/133952 A2 | 10/2011 |
|---|---|---|
| WO | 2013/080154 A1 | 6/2013 |
| WO | 2014/093622 A2 | 6/2014 |
| WO | 2017/219027 A1 | 12/2017 |
| WO | 2018/107129 A1 | 6/2018 |
| WO | 2018/204764 A1 | 8/2018 |
| WO | 2018/170340 A1 | 9/2018 |
| WO | 2019/051318 A1 | 3/2019 |
| WO | 2019/071048 A1 | 4/2019 |
| WO | 2019/071051 A1 | 4/2019 |
| WO | 2019/126577 A2 | 6/2019 |
| WO | 2019/126716 A1 | 6/2019 |
| WO | 2020087631 A1 | 5/2020 |
| WO | 2021/087203 A1 | 5/2021 |

OTHER PUBLICATIONS

Abudayyeh et al., "C2C2 is a Single-Component Programmable RNA-Guided RNA-Targeting CRISPR Effector", Science, vol. 353, No. 6299, Aug. 5, 2016, 23 pages.
Abudayyeh et al., "RNA Targeting with CRISPR-Cas13a", Nature, vol. 550, No. 7675, Oct. 4, 2017, 30 pages.
Anzalone et al., "Search-and-replace Genome Editing Without Double-Strand Breaks or Donor DNA", Nature, vol. 576, No. 7785, Dec. 5, 2019, 30 pages.
Becker et al., "Microfluidics-Enabled Diagnostic Systems: Markets, Challenges, and Examples", Methods in Molecular Biology, vol. 1547, 2017, 3-21.
Ben-Assa et al., "SARS-CoV-2 On-the-spot Virus Detection Directly from Patients", Department of Cell Biology and Cancer Science, Rappaport Faculty of Medicine, Technion, May 7, 2020, 13 pages.
Bhadra et al., "High-surety Isothermal Amplification and Detection of SARS-COV-2, including with Crude Enzymes", Department of Molecular Biosciences, College of Natural Sciences, The University of Texas at Austin, Austin, TX 78712, USA, May 7, 2020, 15 pages.
Broughton et al., "CRISPR-Cas12-Based Detection of SARS-CoV-2", Nature Biotechnology, Apr. 16, 2020, 8 pages.
Carr et al., "Genome Engineering", Nature Biotechnology, vol. 27, No. 12, Dec. 9, 2009, 1151-1162.
Chen et al., "CRISPR-Cas12 a Target Binding Unleashes Indiscriminate Single-Stranded DNase Activity", Science, vol. 360, Issue 6387, Apr. 27, 2018, 5 pages.
Cox et al., "RNA Editing with CRISPR-Cas13", Science, vol. 358, No. 6366, Nov. 24, 2017, 23 pages.
Czurratis et al., "A Novel Concept for Long-term Pre-storage and Release of Liquids for Pressure-driven Lab-on-a-chip Devices", Journal of Micromechanics and Microengineering, vol. 25, No. 4, Feb. 25, 2015, 10 pages.
Ding et al., "All-in-One Dual CRISPR-Cas12a (AIOD-CRISPR) Assay: A Case for Rapid, Ultrasensitive and Visual Detection of Novel Coronavirus SARS-CoV-2 and HIV virus", Retrieved from: bioRxiv preprint doi: https://doi.org/10.1101/2020.03.19.998724, Mar. 21, 2020, 19 pages.
Ding et al., "Efficacy and Safety of Early Prone Positioning Combined with HFNC or NIV in Moderate to Severe ARDS: A Multi-Center prospective Cohort Study", Critical Care, vol. 24, No. 28, 2020, 8 pages.
Doman et al., "Evaluation and Minimization of Cas9-lndependent Off-arget DNA Editing by Cytosine Base Editors", Nature Biotechnology, vol. 38, No. 5, May 2020, 620-628.
Du et al., "Coupling Sensitive Nucleic Acid Amplification with Commercial Pregnancy Test Strips", Angewandte Chemie International Edition in English, vol. 56, No. 4, Jan. 19, 2017, 12 pages.
East-Seletsky et al., "Two Distinct RNase Activities of CRISPR-C2c2 Enable Guide-RNA Processing and RNA Detection", Nature, vol. 538, No. 7624, Oct. 13, 2016, 17 pages.
Gaudelli et al., "Programmable Base Editing of A•T to G•C in Genomic DNA without DNA Cleavage", Nature, vol. 551, No. 7681, Nov. 23, 2017, 37 pages.
Gootenberg et al., "Multiplexed and Portable Nucleic Acid Detection Platform with Cas13, Cas12a, and Csm6", Science, vol. 360, No. 6387, Apr. 27, 2018, 14 pages.
Gootenberg et al., "Nucleic Acid Detection with CRISPR-Cas13a/C2c2", Science, vol. 356, No. 6336, Apr. 28, 2017, 6 pages.
Goto et al., "Colorimetric Detection of Loopmediated Isothermal Amplification Reaction by using Hydroxy Naphthol Blue", BioTechniques, vol. 46, No. 3, 2009, 167-172.
Green et al., "Toehold Switches: De-Novo-Designed Regulators of Gene Expression", Cell, vol. 159, No. 4, Nov. 6, 2014, 28 pages.
Gruber et al., "The Vienna RNA Websuite", Nucleic Acids Research, vol. 36, 2008, W70-W74.
Guo et al., "SARS-CoV-2 Detection with CRISPR Diagnostics", Cell Discovery, vol. 6, No. 34, 2020, 4 pages.
Guo et al., "The Origin, Transmission and Clinical Therapies on Coronavirus Disease 2019 (COVID-19) Outbreak—an Update on the Status", Military Medical Research, vol. 7, No. 11, 2020, 10 pages.
Kashir et al., "Loop Mediated Isothermal Amplification (lamp) Assays as a Rapid Diagnostic for Covid-19", Medical Hypotheses, vol. 141, Apr. 23, 2020, 22 pages.
Kellner et al., "SHERLOCK: Nucleic Acid Detection with CRISPR Nucleases", Nature Protocols, vol. 14, Sep. 23, 2019, 29 pages.
Komor et al., "Programmable Editing of a Target Base in Genomic DNA without Double-Stranded DNA Cleavage", Nature, vol. 533, No. 7603, May 19, 2016, 25 pages.
Kumar et al., "Deconstructing Transcriptional Heterogeneity in Pluripotent Stem Cells", Nature. vol. 516, Dec. 4, 2014, 56-61.
Lalli et al., "Rapid and Extraction-free Detection of SARS-CoV-2 from Saliva with Colorimetric LAMP", Department of Genetics, May 11, 2020, 25 pages.
Lamb et al., "Rapid Detection of Novel Coronavirus (COVID-19) by Reverse Transcription-Loop-Mediated Isothermal Amplification", Retrieved as on Jul. 27 : https://doi.org/10.1101/2020.02.19.20025155, Feb. 24, 2020, 17 pages.
Li et al., "Design and Assessment of Engineered CRISPR-Cpf1 and Its Use for Genome Editing", Nature Protocols, vol. 13, No. 5, May 2018, 48 pages.
Li et al., "Synthetic Oligonucleotides Inhibit CRISPR-Cpf1-Mediated Genome Editing", Cell Reports, vol. 25, No. 12, Dec. 18, 2018, 26 pages.
Liang et al., "Development and Characterization of Stable Anaerobic Thermophilic Methanogenic Microbiomes Fermenting Switchgrass at Decreasing Residence Times", Biotechnology for Biofuels, vol. 11, No. 243, 2018, 18 pages.
Lucia et al., "An Ultrasensitive, Rapid, and Portable Coronavirus SARS-CoV-2 Sequence Detection Method Based on CRISPR-Cas12", INPA-National Scientific and Technical Research Council {CONICET}—Argentina, Mar. 2, 2020, 10 pages.
Makarova et al., "Evolutionary Classification of CRISPR-Cas Systems: A Burst of Class 2 and Derived Variants", Nature Reviews Microbiology, vol. 18, Feb. 2020, 67-83.
Miyamoto et al., "Method for Colorimetric Detection of Double-stranded Nucleic Acid using Leuco Triphenylmethane Dyes", Analytical Biochemistry, vol. 473, Mar. 2015, 30 pages.
Myhrvold et al., "Field-deployable Viral Diagnostics using CRISPR-Cas13", Science, vol. 360, Issue 6387, Apr. 27, 2018, 6 pages.
Nagamine et al., "Accelerated Reaction by Loop-mediated Isothermal Amplification using Loop Primers", Molecular and Cellular Probes, vol. 16, Issue 3,, Jun. 2002, 223-229.
Notomi et al., "Loop-mediated Isothermal Amplification of DNA", Nucleic Acids Research, vol. 28, No. 12, Jun. 2000, 7 pages.
Osterdahl et al., "Detecting SARS-CoV-2 at Point of Care: Preliminary Data Comparing Loop-mediated Isothermal Amplification (LAMP) to PCR", Department of Ageing & Health, Guy's and St Thomas' NHS Foundation Trust, London, UK, Apr. 4, 2020, 9 pages.
Pardee et al., "Paper-Based Synthetic Gene Networks", Cell, vol. 159, No. 4, Nov. 6, 2014, 28 pages.
Pardee et al., "Rapid, Low-Cost Detection of Zika Virus Using Programmable Biomolecular Components", Cell, vol. 165, No. 5, May 19, 2016, 24 pages.

(56) References Cited

OTHER PUBLICATIONS

Park et al., "Development of Reverse Transcription Loop-mediated Isothermal Amplification (RT-LAMP) Assays Targeting SARS-CoV-2", Center for Convergent Research of Emerging Virus Infection, Korea Research Institute of Chemical Technology, Daejeon 34114, Republic of Korea, Mar. 24, 2020, 20 pages.
Park et al., "Development of Reverse Transcription Loop-Mediated Isothermal Amplification Assays Targeting Severe Acute Respiratory Syndrome Coronavirus 2 (SARS-CoV-2)", The Journal of Molecular Diagnostics, vol. 22, No. 6, Jun. 2020, 729-735.
Richter et al., "Phage-assisted Evolution of an Adenine Base Editor with Improved Cas Domain Compatibility and Activity", Nature Biotechnology, 2020, 18 pages.
Riddihough et al., "The CRISPR-Cas Evolutionary Mix", Science, vol. 353, Issue 6269, Aug. 5, 2016, 553-555.
Shirato et al., "Development of Fluorescent Reverse Transcription Loop-mediated Isothermal Amplification (RT-LAMP) using Quenching Probes for the Detection of the Middle East Respiratory Syndrome Coronavirus", Journal of Virological Methods, vol. 258, May 12, 2018, 41-48.
Shmakov et al., "Discovery and Functional Characterization of Diverse Class 2 CRISPR-Cas Systems", Molecular Cell, vol. 60, No. 3, Nov. 5, 2015, 385-397.
Zhang et al., "Rapid Molecular Detection of SARS-CoV-2 (COVID-19) Virus RNA Using Colorimetric LAMP", Retrieved as on Jul. 27, 2020: doi: https://doi.org/10.1101 /2020.02.26.20028373., Feb. 29, 2020, 14 pages.
Shmakov et al., "Diversity and Evolution of Class 2 CRISPR-Cas Systems", Nature Reviews Microbiology, vol. 15, No. 3, Mar. 2017, 30 pages.
Smargon et al., "Cas 13B is a Type VI-B CRISPR-Associated RNA-Guided RNAse Differentially Regulated by Accessory Proteins Csx27 and Csx28", Molecular Cell, vol. 65, No. 4, Feb. 16, 2017, 30 pages.
Smith et al., "Blister Pouches for Effective Reagent Storage on Microfluidic Chips for Blood Cell Counting", Microfluidics and Nanofluidics, vol. 20, No. 163, Nov. 23, 2016, 14 pages.
Tanner et al., "Visual Detection of Isothermal Nucleic Acid Amplification using pH-sensitive Dyes", BioTechniques, vol. 58, Feb. 2015, 59-68.
Teng et al., "Repurposing CRISPR-Cas12b for Mammalian Genome Engineering", Cell Discovery, vol. 4, No. 63, Nov. 27, 2018, 15 pages.
Thi et al., "Screening for SARS-CoV-2 Infections with Colorimetric RT-Lamp and Lamp Sequencing", Schaller Research Groups, Center of Infectious Diseases, Department of Virology, Heidelberg University Hospital, Heidelberg, Germany, May 9, 2020, 28 pages.
Tian et al., "Potent Binding of 2019 Novel Coronavirus Spike Protein by a SARS Coronavirus-Specific Human Monoclonal Antibody", Emerging Microbes & Infections, vol. 9, No. 1, 2020, 382-385.
Urdea et al., "Requirements for High Impact Diagnostics in the Developing World", Nature, vol. 444, 2006, 73-79.
Wang et al., "One-pot Detection of COVID-19 with Real-time Reverse-transcription Loop-mediated Isothermal Amplification (RT-Lamp) Assay and Visual RT-Lamp Assay", Key Laboratory of Biomarker Based Rapid-detection Technology for Food Safety of Henan Province, Xuchang University, Xuchang 461000, China, Apr. 22, 2020, 7 pages.
Wang et al., "Protein Kinase D1 is Essential for Ras-induced Senescence and Tumor Suppression by Regulating Senescence-Associated Inflammation", Proceedings of the National Academy of Sciences, vol. 111, No. 21, May 27, 2014, 7683-7688.
Whitman et al., "Test Performance Evaluation of SARS-CoV-2 Serological Assays", Retrieved as on Jul. 27, 2020 doi: https://doi.org/10.1101/2020.04.25.20074856, May 17, 2020, 28 pages.
Wu et al., "Genome Composition and Divergence of the Novel Coronavirus (2019-nCoV) Originating in China", Cell Host and Microbe, vol. 27, Issue 3, Mar. 11, 2020, 325-328.
Wyllie et al., "Saliva Is More Sensitive for SARS-CoV-2 Detection in COVID-19 Patients than Nasopharyngeal Swabs", Retrieved from-medRxiv preprint doi:https://doi.org/10.1101/2020.04.16.20067835, Apr. 22, 2020, 12 pages.
Yang et al., "Engineering and Optimizing Deaminase Fusions for Genome Editing", Nature Communication, vol. 7, Issue 13330,, Nov. 2, 2016, 11 pages.
Yang et al., "Rapid Detection of SARS-CoV-2 Using Reverse transcription RT-LAMP method", Retrieved as on Jul. 27, 2020 "https://doi.org/10.1101/2020.03 02.20030130", Mar. 3, 2020, 25 pages.
Yu et al., "Rapid Colorimetric Detection of COVID-19 Coronavirus using A Reverse Transcriptional Loop-mediated Isothermal Amplification (RT-LAMP) Diagnostic Platform: iLACO", Applied Biology Laboratory, Shenyang University of Chemical Technology, 110142, Shenyang, China, Feb. 24, 2020, 19 pages.
Yu et al., "Rapid Detection of COVID-19 Coronavirus Using a Reverse Transcriptional Loop-Mediated Isothermal Amplification (RT-LAMP) Diagnostic Platform", Clinical Chemistry, May 21, 2020, 3 pages.
Zetsche et al., "Cpf1 is a Single RNA-Guided Endonuclease of a Class 2 CRISPR-Cas System", Cell, vol. 163, No. 3, Oct. 22, 2015, 759-771.
International Application No. PCT/US2020/022795 filed Mar. 13, 2020, all enclosed pages cited.
Broughton James P., A protocol for rapid detection of the 2019 novel coronavirus SARS-CoV-2 using CRISPR diagnostics: SARS-CoV-2 DETECTR; Mammoth Biosciences Feb. 2020; all enclosed pages cited.
Giuffrida, et al., "Integration of Isothermal Amplification Methods in Microfluidic Devices: Recent Advances," Biosensors and Bioelectronics, 90 (2017), all enclosed pages cited.
Gorgannezhad, et al., Microfluidic-Based Acid Amplification Systems in Microbiology, Micromachines (Basel). Jun. 2019; 10(6): 408, all enclosed pages cited.
Li, et al., HOLMESv2: A CRISPR-Cas12b-Assisted Platform for Nucleic Acid Detection and DNA Methylation Quantitation, ACS Synth Biol. Oct. 18, 2019; 8 (10): 2228-2237. doi: 10.1021/accsynbio.9b00209.
NCBI accession No. MW308137.1, Nov. 30, 2020.
Non-Final Office action of co-pending U.S. Appl. No. 16/894,664 dated Dec. 11, 2020; all enclosed pages cited.
Li, et al., "CRiSPR-Cas12b-assisted Nucleic Acid Detection Platform," bioRxiv preprint doi: https://doi.org/10.1101/362889; Jul. 6, 2018, all enclosed pages cited.
Non-Final Office Action from corresponding U.S. Appl. No. 16/894,678 dated Jan. 11, 2021, all enclosed pages cited.
Sentamat, et al., "One-step RNA extraction for RT-qPCR detection of 2019-nCoV," bioRxiv preprint https://doi.org.10.1101/2020.04.02.023384, Oct. 21, 2020, all enclosed pages cited.
Schermer, et al., "Rapid SARS-CoV-2 testing in primary material based on a novel multiplex RT-Lamp assay," PLoS One, vol. 15, No. 11: e0238612, Nov. 2, 2020, all enclosed pages cited.
Schellenberg, et al. "Extraction-free RT-Lamp to detect SARS-CoV-2 is less sensitive but highly specific compared to standard RT-PCT in 101 samples," Journal of Clinical Virology, vol. 136: 104764, Feb. 16, 2021, all enclosed pages cited.
International Search Report and Written Opinion of corresponding International Application No. PCT/US2021/017985 dated Jul. 20, 2021, all enclosed pages cited.
Final Office Action of corresponding U.S. Appl. No. 16/894,664 dated Aug. 6, 2021, all enclosed pages cited.
Invitation to Pay Additional Fees for corresponding International Application No. PCT/US2021/017985 dated May 3, 2021, all enclosed pages cited.
Final Office Action from corresponding U.S. Appl. No. 16/894,678 dated Apr. 16, 2021, all enclosed pages cited.
Final Office Action from corresponding U.S. Appl. No. 16/894,664 dated Apr. 28, 2021, all enclosed pages cited.
Non-Final Office Action of co-pending U.S. Appl. No. 16/894,678 dated Sep. 29, 2021, all enclosed pages cited.

(56) References Cited

OTHER PUBLICATIONS

Final Office Action of U.S. Appl. No. 16/894,664 dated Feb. 17, 2022, all enclosed pages cited.
Final Office Action of co-pending U.S. Appl. No. 16/894,678 dated Apr. 7, 2022, all enclosed pages cited.

* cited by examiner

|  | | SAR-CoV-2 infection status | | | Predictive value |
| --- | --- | --- | --- | --- | --- |
| | | Pos. | Neg | Total | |
| SHERLOCK Lateral flow | Pos. | 35 (True pos.) | 0 (False pos.) | 35 | PPV = 100% |
| | Neg. | 1 (False neg.) | 15 (True neg.) | 16 | NPV = 94% |
| | Total | 36 | 15 | | |
| | | Sensitivity 97% | Specificity 100% | | |

Lysis: 10 min at 22 °C

| Patient | 1 | 2 | 3 | 4 | 5 | 6 | 7 | 8 | 9 | 10 | 11 | 12 |
|---|---|---|---|---|---|---|---|---|---|---|---|---|
| Positive NP swabs | | | | | | | | | | | | |
| Ct (CDC N1) | 31.5 | 24.5 | 20.5 | 24.6 | 24.9 | 23.1 | 20.7 | 19.5 | 26.6 | 20.4 | 25.3 | 18.3 |
| Ct (CDC N2) | 33.5 | 25.0 | 21.2 | 25.5 | 25.7 | 24.1 | 21.8 | 20.6 | 27.1 | 21.0 | 26.3 | 18.8 |

B

Lysis: 10 min at 60 °C

| Patient | 1 | 2 | 3 | 4 | 5 | 6 | 7 | 8 | 9 | 10 | 11 | 12 |
|---|---|---|---|---|---|---|---|---|---|---|---|---|
| Positive NP swabs | | | | | | | | | | | | |
| Ct (CDC N1) | 33.8 | 24.7 | 20.4 | 24.6 | 24.9 | 23.2 | 20.8 | 19.6 | 26.8 | 20.3 | 25.4 | 18.5 |
| Ct (CDC N2) | 35.1 | 25.2 | 21.3 | 25.6 | 25.7 | 24.1 | 21.7 | 20.8 | 27.3 | 20.9 | 26.4 | 19.0 |

FIG. 28

| Patient | P1 | P2 | P3 | P4 | P5 | P6 | P7 | P8 | P9 | P10 | P11 | P12 | P13 | P14 | P15 | P16 | P17 | P18 | P19 | P20 | P21 | P22 |
|---|---|---|---|---|---|---|---|---|---|---|---|---|---|---|---|---|---|---|---|---|---|---|
| Positive NP swabs | | | | | | | | | | | | | | | | | | | | | | |
| Ct (CDC N1) | 32.7 | 23.4 | 20.2 | 23.6 | 24.2 | 23.1 | 20.2 | 19.6 | 24.3 | 16.4 | 24.6 | 17.2 | 32.7 | 27.3 | 22.0 | 20.2 | 35.6 | 27.7 | 19.4 | 18.6 | 29.1 | 20.0 |
| Ct (CDC N2) | 34.3 | 24.7 | 21.7 | 24.9 | 25.3 | 24.3 | 21.2 | 20.2 | 25.3 | 19.4 | 25.8 | 18.4 | 33.7 | 28.7 | 22.6 | 21.7 | 36.2 | 28.8 | 20.3 | 19.5 | 30.1 | 20.7 |

| Patient | P23 | P24 | P25 | P26 | P27 | P28 | P29 | P30 | P31 | P32 | P33 | P34 | P35 | P36 | P37 | P38 | P39 | P40 | P41 | P42 | P43 |
|---|---|---|---|---|---|---|---|---|---|---|---|---|---|---|---|---|---|---|---|---|---|
| Positive NP swabs | | | | | | | | | | | | | | | | | | | | | |
| Ct (CDC N1) | 32.1 | 32.2 | 30.3 | 28.5 | 24.6 | 35.8 | 37.3 | 35.2 | 28.3 | 26.0 | 28.7 | 36.2 | 27.1 | 18.6 | 32.7 | 34.6 | 27.6 | 27.4 | 28.5 | 28.6 | 30.7 |
| Ct (CDC N2) | 33.4 | 32.7 | 31.1 | 29.4 | 25.6 | 39.0 | 38.4 | 36.4 | 29.2 | 27.3 | 30.3 | 39.0 | 28.0 | 19.2 | 33.9 | 35.8 | 29.0 | 28.5 | 29.3 | 29.6 | 31.7 |

| Patient | N1 | N2 | N3 | N4 | N5 | N6 | N7 | N8 | N9 | N10 | N11 | N12 | N13 | N14 | N15 |
|---|---|---|---|---|---|---|---|---|---|---|---|---|---|---|---|
| Negative NP swabs | | | | | | | | | | | | | | | |

Lysis: 5 min at 95 °C

| Patient | 1 | 2 | 3 | 4 | 5 | 6 | 7 | 8 | 9 | 10 | 11 | 12 |
|---|---|---|---|---|---|---|---|---|---|---|---|---|
| Positive NP swabs | | | | | | | | | | | | |
| Ct (CDC N1) | 32.7 | 23.4 | 20.2 | 23.6 | 24.2 | 23.1 | 20.2 | 19.6 | 24.3 | 18.4 | 24.6 | 17.2 |
| Ct (CDC N2) | 34.3 | 24.7 | 21.7 | 24.9 | 25.3 | 24.3 | 21.2 | 20.2 | 25.3 | 19.4 | 25.8 | 18.4 |

Lysis: 5 min at 95 °C

| Patient | 13 | 14 | 15 |
|---|---|---|---|
| Negative NP swabs | | | |

| Patient | 16 | 17 |
|---|---|---|
| Negative NP swabs | | |

SAR-CoV-2 infection status

| | | Pos. | Neg. | Total | Predictive value |
|---|---|---|---|---|---|
| STOPCovid Lateral flow | Pos. | 35 (True pos.) | 0 (False pos.) | 36 | PPV=100% |
| | Neg. | 1 (False neg.) | 15 (True neg.) | 16 | NPV=94% |
| | Total | 36 | 15 | | |

Sensitivity 97%  Specificity 100%

FIG. 42A

| Patient | 1 | 2 | 3 | 4 | 5 | 6 | 7 | 8 | 9 | 10 | 11 | 12 |
|---|---|---|---|---|---|---|---|---|---|---|---|---|
| Positive NP swabs | | | | | | | | | | | | |
| Ct (CDC N1) | 32.7 | 23.4 | 20.2 | 23.6 | 24.2 | 23.1 | 20.2 | 19.6 | 24.3 | 18.4 | 24.6 | 17.2 |
| Ct (CDC N2) | 34.3 | 24.7 | 21.7 | 24.9 | 25.3 | 24.3 | 21.2 | 20.2 | 25.3 | 19.4 | 25.8 | 18.4 |

| Patient | 13 | 14 | 15 | 16 | 17 | 18 | 19 | 20 | 21 | 22 |
|---|---|---|---|---|---|---|---|---|---|---|
| Positive NP swabs | | | | | | | | | | |
| Ct (CDC N1) | 32.7 | 27.3 | 22.0 | 20.2 | 35.8 | n.d. | 27.7 | 19.4 | 18.6 | 29.1 |
| Ct (CDC N2) | 33.7 | 28.6 | 22.6 | 21.7 | 36.2 | n.d. | 28.8 | 20.3 | 19.5 | 30.0 |

Lysis: 5 min at 95 °C

| Patient | 13 | 14 | 15 |
|---|---|---|---|
| Negative NP swabs | | | |

| Patient | 16 | 17 |
|---|---|---|
| Negative NP swabs | | |

| | | SAR-CoV-2 infection status | | | |
|---|---|---|---|---|---|
| | | Positive | Negative | Total | Predictive value |
| Lateral Flow Readout | Positive | 61 (True positive) | 0 (False positive) | 61 | PPV = 100% |
| | Negative | 2 (False negative) | 15 (True negative) | 17 | NPV = 88% |
| | Total | 63 | 16 | | |
| | | Sensitivity 97% | Specificity 100% | | |

FIG. 42B

SEQ ID NO: 61994

CRISPR EFFECTOR SYSTEM BASED CORONAVIRUS DIAGNOSTICS

CROSS REFERENCE TO RELATED APPLICATIONS

This application claims the benefit of U.S. Provisional Application Nos. 62/993,494 filed Mar. 23, 2020, 63/018,487 filed Apr. 30, 2020, 63/019,406 filed May 3, 2020 and 63/032,470 filed May 29, 2020. The entire contents of the above-identified applications are hereby fully incorporated herein by reference.

STATEMENT REGARDING FEDERALLY SPONSORED RESEARCH

This invention was made with government support under grant nos. HL141201 and MH110049 awarded by National Institutes of Health. The government has certain rights in the invention.

REFERENCE TO AN ELECTRONIC SEQUENCE LISTING

The contents of the electronic sequence listing ("BROD_5155WP_ST25.txt"; Size is 13,420,039 bytes, it was created on Jun. 5, 2020) is herein incorporated by reference in its entirety.

TECHNICAL FIELD

The subject matter disclosed herein is generally directed to rapid single-reaction coronavirus diagnostics including the use of CRISPR effector systems and thermostable CRISPR Cas proteins.

BACKGROUND

Nucleic acids are a universal signature of biological information. The ability to rapidly detect nucleic acids with high sensitivity and single-base specificity on a portable platform has the potential to revolutionize diagnosis and monitoring for many diseases, provide valuable epidemiological information, and serve as a generalizable scientific tool. Although many methods have been developed for detecting nucleic acids (Du et al., 2017; Green et al., 2014; Kumar et al., 2014; Pardee et al., 2014; Pardee et al., 2016; Urdea et al., 2006), they inevitably suffer from trade-offs among sensitivity, specificity, simplicity, and speed.

Sensitive and rapid detection of nucleic acids is important for clinical diagnostics and biotechnological applications. Particularly when responding to outbreaks, such as the novel coronavirus, which has been referred to as 2019-nCoV and SARS-CoV-2, which causes COVID 2019, time is of the essence. Sabeti, Early Detection Is Key to Combating the Spread of Coronavirus, Time (Feb. 6, 2020). The 2019-nCoV has killed hundreds in a 2-month time span, and response to the escalating outbreak, particularly where there are indications that both symptomatic and asymptomatic patients with 2019-nCov may transmit the disease. Wang, et al., A precision medicine approach to managing Wuhan Coronavirus pneumonia, Prec. Clin. Med, doi:10.1093/pcmedi/pbaa002. Current coronavirus testing kits sent to states and other countries do not work properly, according to the U.S. Centers for Disease Control and Prevention. Grady, "Coronavirus Test Kits Sent to States, 30 Countries Are Flawed, C.D.C. Says," New York Times, Feb. 12, 2020. Moreover the test being used provides results in four hours from initial sample processing to results. cdc.gov/media/releases/2020/p0206-coronavirus-diagnostic-test-kits.

Highly accurate test results at better processing speds, particularly that are field-depoloyable would aid in addressing the outbreak. Currently, the novel coronavirus SARS-CoV-2 has resulted in an international public health emergency, spreading to over 180 countries and infecting more than 300,000 individuals. Testing for the presence of the virus is of utmost importance to both reduce the basic reproductive rate of the virus (R0) and inform best clinical practices for affected patients. However, understanding the full extent of the virus outbreak has remained challenging due to bottlenecks in the diagnosis of infection.

Previously, Applicants developed a platform for nucleic acid detection using CRISPR enzymes called SHERLOCK (Specific High Sensitivity Enzymatic Reporter unLOCKing) (Gootenberg, 2018; Gootenberg, 2017), which combines pre-amplification with the RNA-guided RNase CRISPR-Cas13 (Abudayyeh, 2016; East-Seletsky, 2016; Shmakov, 2015; Smargon, 201; Shmakov, 2017) and DNase CRISPR-Cas12 (Zetsche, 2015 599; Chen, 2018) for sensing of nucleic acids via fluorescence or portable lateral flow.

SUMMARY

In certain example embodiments, a single reaction composition for detecting the presence of a target polynucleotide in a sample is provided, comprising: an extraction-free polynucleotide isolation solution; one or more thermostable Cas proteins possessing collateral activity; at least one guide polynucleotide comprising a sequence capable of binding a target polynucleotide and designed to form a complex with the one or more Cas proteins; isothermal amplification reagents; and a detection construct comprising a polynucleotide component, wherein the Cas protein exhibits collateral nuclease activity and cleaves the polynucleotide component of the detection construct once activated by the target sequence.

In certain embodiments, at least of the one or more Cas proteins is a Type V Cas. In an aspect, the Cas protein is a Cas12b is selected from Table 2A or Table 2B, which may be a thermostable Cas12b, a *Brevibacillus* sp. SYSU G02855 (Br) Cas12b or *Alicyclobacillus acidiphilus* (Aac) Cas12b. In an aspect, the guide polynucleotide comprises sequence selected from Aac guide types 1 to 5 (SEQ ID NOs: 61957-61961) or BrCas12bcrRNA design 1 to 3 (SEQ ID NO: 61970-61972).

The compositions may further comprise amplification reagents for amplification of the coronavirus target sequence. In an aspect the amplification reagents are LAMP reagents. In an aspect, the isothermal amplification reagents comprise optimized LAMP primers and amplification reagents. In an aspect, the optimized LAMP primers are selected from SEQ ID NOs. 1-40,499, and 61,983-61,988. In certain embodiments, the guide polynucleotide is selected from SEQ ID NOs: 40,500-61,643 and SEQ ID NO: 61,989. In an aspect, the guide polynucleotides are optimized guide polynucleotides.

In certain embodiments, the guide polynucleotide comprises a spacer specific for the N gene or S gene of SARS-CoV-2. The compositions may further comprise one or more additives to increase reaction specificity or kinetics, and/or polynucleotide binding beads.

Methods for detecting a target nucleic acid in a sample are also provided, comprising distributing a sample or set of samples into individual discrete volumes, each individual discrete volume comprising a composition as disclosed herein, incubating the sample or set of samples at conditions sufficient to allow lysis of a cell or virus via reagents of the extraction-free polynucleotide isolation solution; amplifying the target polynucleotides using isothermal amplification, wherein isolation of target polynucleotides between the incubating and amplifying steps is not required; an detecting amplified target polynucleotides by binding of the CRISPR-Cas complex to the target polynucleotides, wherein binding of the target polynucleotides activates cleavage of the detection construct thereby generating a detectable signal.

A cartridge can be provided comprising at least a first and second ampoule, a lysis chamber, an amplification chamber and a sample receiving chamber, the first ampoule fluidically connected to the sample receiving chamber, the sample receiving chamber further connected to the lysis chamber, the lysis chamber connected via a metering channel to the second ampoule and the amplification chamber. In certain embodiments, the first ampoule comprises an extraction-free polynucleotide isolation solution and the second ampoule comprise isothermal amplification reagents amplifying a target polynucleotide or isothermal amplification reagents and a CRISPR-Cas collateral detection system for amplifying and detecting a target polynucleotide. In an aspect, wherein the extraction-fee polynucleotide isolation solution and/or the lysis well comprises polynucleotide binding bead.

A device designed to receive the one or more cartridges as disclosed herein is provided, which may further comprise a one or more motors connected to a plunger for rupturing of the first and second ampoule of the cartridge and configured within the device to align with the first and second ampule of the inserted cartridge, a heating element configured to align with the amplification chamber of the inserted cartridge, an optical detector configured to align with the amplification chamber of the inserted cartridge, and a display. The device may comprise a graphical user interface for programming the device and/or readout of the results of the assay. A system comprising a docking station and two or more devices as disclosed herein is provided, wherein the docking station is configured to receive the two or more devices.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

FIG. 2B Detection of synthetic COVID-19 sequence using a two-step SHERLOCK reaction (25 min RPA followed by 30 min Cas13 reaction). Readout using lateral flow strip.

FIG. 3A—Quick Extract at a final concentration of 5% did not negatively affect the RT-qPCR reaction FIG. 3B RNA samples prepared using Quick Extract supported similarly sensitive detection of coronavirus as QIAmp Viral RNA Miniprep.

FIG. 27—POC-SHERLOCK COVID-19 detection results for patient samples tested in FIG. 19. The results yield a sensitivity of 97% and specificity of 100%.

FIG. 28—COVID-19 POC-SHERLOCK detection with SARS-CoV-2 positive patient nasopharyngeal swabs. (A) POC-SHERLOCK COVID-19 detection of 12 different SARS-CoV-2 positive patient nasopharyngeal swabs with three replicates for each sample. Prior to POC-SHERLOCK, nasopharyngeal swabs were lysed using QE for 5 minutes at 22° C. Listed below are Ct values determined by RT-PCR using the CDC N1 and N2 assays. (B) POC-SHERLOCK COVID-19 detection of 12 different SARS-CoV-2 positive patient nasopharyngeal swabs with three replicates for each sample. Prior to POC-SHERLOCK, nasopharyngeal swabs were lysed using QE for 5 minutes at 60° C. Listed below are Ct values determined by RT-PCR using the CDC N1 and N2 assays.

FIG. 31B shows three views of a quad-dock for a front loading device, showing USB port located at the back of each cavity; FIG. 31C shows stacking docs for 8 devices, on the left, a side profile, center front view, and rights, low profile feet on the botto of the dock.

FIG. 34B top loading device quad-dock, USB port located in each cavity (left), quad dock with four top loading devices in closed lid orientation (upper right), quad dock with four top loading devices with one device in open lid orientation (lower right); FIG. 34C top loading device octo-dock, rear view showing single rear power inlet (upper left), All 8 devices in octo-dock in open orientation (upper right), USB-C port located in each device cavity (lower left), and status display LED strip on octo dock with 8 devices in closed orientation (lower right).

Figure 35B:
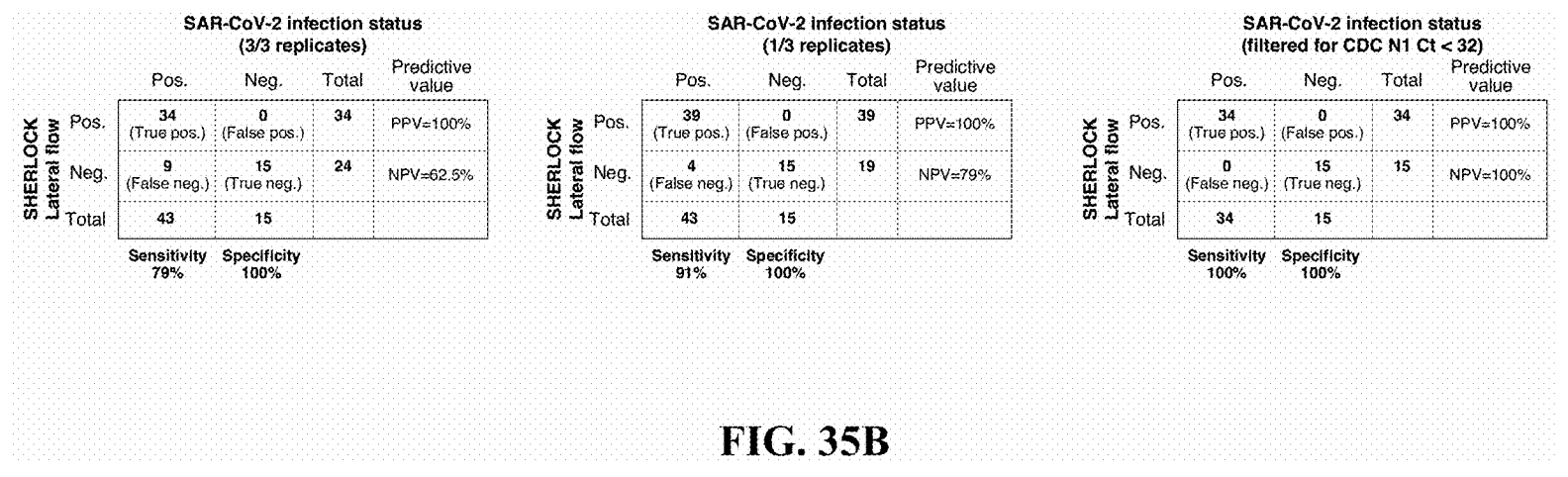

FIG. 35A-35B—Expanded patient cohort testing from an example embodiment showing results of patient nasopharyngeal swab samples (FIG. 35A) with calculated predictive values, sensitivity and specificity (FIG. 35B)

FIG. 38A NaCl beads; FIG. 38B KCl beads.

Figure 1:
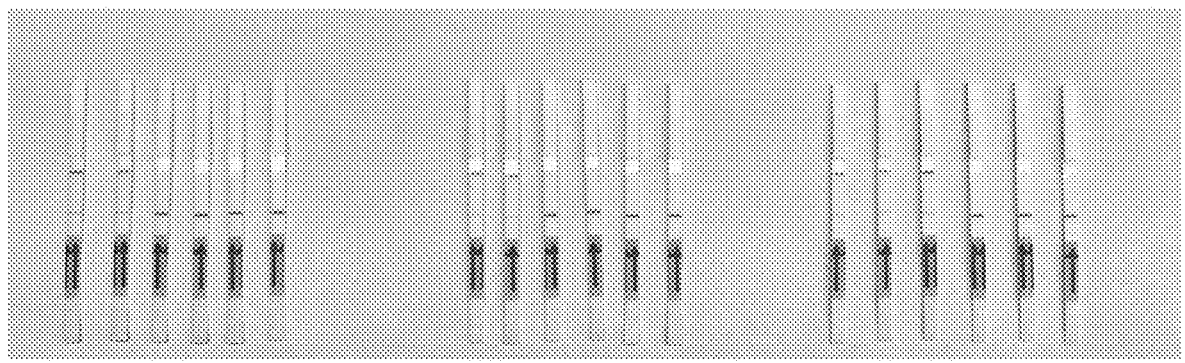
FIG. 1—includes lateral flow assay detection for three n2019-CoV targets, left, middle and right groups. Testing for each target shown with decreasing concentrations from left to right, with far right at 0 concentration S protein (left), middle, synthetic S (synthego) and right (Orflab).

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M.

Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratry Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

Overview

Embodiments herein are directed to systems and methods of detecting the presence of a target nucleic acid in a sample. In certain example embodiments, the systems and methods provide for single reaction (one-pot) detection of target nucleic acids. In certain example embodiments, extraction, amplification, and detection may take place under a single set of reaction buffer and reagent conditions. In certain example embodiments, detection is achieved using isothermal amplification (e.g. LAMP) only. In other example embodiments, detection of nucleic acids can utilize Cas proteins to provide improved reaction sensitivity and/or specificity. In certain other example embodiments, isothermal amplification may be utilized with a thermostable CRISPR-Cas protein, with the combination of thermostable protein and isothermal amplification utilized to further improve reaction conditions and times for detection and diagnostics. Advantageous quick extraction approaches for the extraction of nucleic acids from a sample are also provided. Design of reaction conditions and reagents are provided for the identification of primers and reaction conditions, including concentration and content of reagents and additives, that enhance the detection systems and methods disclosed herein. Advantageously, the systems and methods can be provided in lateral flow or self-contained cartridge devices for rapid, point-of-care diagnostics. In certain embodiments, the detection assay can be provided on a cartridge or chip. A device system can be configured to receive the cartridge and conduct an assay.

In certain example embodiments, the Cas protein may be a Type V CRISPR-Cas, a Type VI CRISPR-Cas, or combination thereof. In certain example embodiments, the Type V or Type VI Cas protein is a thermostable case protein with a nuclease activity above at least 50° C. In certain example embodiments, the Cas protein is a Cas12b protein. In certain other example embodiments, the Cas12b is *Alicyclobacillus acidiphilus* (AapCas12b). In certain other example embodiments, the Cas12b protein is *Brevibacillus* sp. SYSU G02855 (BrCas12b). In certain example embodiments, the Cas protein, may be paired with the novel guide designs disclosed herein.

Systems and method disclosed herein include approaches to detection isothermal amplification for detection of target nucleic acids. In certain example embodiments, isothermal amplification approach is loop-mediated isothermal amplification (LAMP). Design of optimal systems, including primers, reagents and additives to be used with isothermal amplification approaches are also provided. Optionally, CRISPR-Cas systems as disclosed herein can be used with isothermal amplification approaches, including LAMP, that can enhance sensitivity and/or specificity.

Methods of designing optimal reaction conditions, including optimized guides and primers, are also provided. As used herein, the terms optimized guides and/or optimized primers can include the optimization of reaction conditions, additives and/or reagents for use in the methods and systems herein. In an aspect, methods can comprise identifying the type of amplification reaction and designing optimal primers in accordance with the methods disclosed herein. Methods may also comprise identifying optimum CRISPR-Cas systems, including identification of the Cas protein for the reactions conditions. For example, the Cas protein may be identified based on its thermostability, cutting preferences, or other desired characteristics. Preferred guide molecules may similarly be identified. Once one or more primers and/or guides are identified, salt concentrations and other additives can be titrated and selected for further investigation. Additional reaction conditions, additives and reagents can be identified to optimize the use of one-pot methodology, lyophilization of reagents, and use in the devices disclosed herein. The additives may facilitate reaction time, increase of the signal to noise ratio, enhance specificity of binding or other variables that enhance the specificity, sensitivity and/or kinetics of the reaction.

In certain example embodiments, the system comprises a Type V CRISPR-Cas system, one or more guide polynucleotides comprising a guide sequence capable of binding a target sequence and designed to form a complex with the Type V Cas protein, and a detection construct comprising a polynucleotide component. The Type V Cas proteins of the present systems and methods exhibits collateral nuclease activity, cleaving the polynucleotide component of the detection construct once activated by the target sequence, which can generate a detectable signal.

In certain example embodiments, the system comprises a Type VI CRISPR-Cas system, one or more guide polynucleotides comprising a guide sequence capable of binding a target sequence and designed to form a complex with the Type VI Cas protein, and a detection construct comprising a polynucleotide component. The Type VI Cas proteins of the present systems and methods exhibits collateral RNase activity, cleaving the polynucleotide component of the detection construct once activated by the target sequence, which can generate a detectable signal.

Embodiments disclosed herein provide systems utilized in multiplex lateral flow devices and methods of use. In certain preferred embodiments, the guides utilized are designed to be highly active guide molecules, allowing for rapid and highly sensitive detection of coronavirus. In certain example embodiments, the systems can utilize general capture of antibody that was not bound by intact reporter RNA as described in Gootenberg et al., Science 360, 439-444 (2018).

In other embodiments, the presently disclosed system can be designed for detecting two or more targets. When utilized with a lateral flow approach, two or more separate detection lines consisting of deposited materials that capture detection construct and a molecule specific to the deposited material, allows visualization of detectable signal (e.g. gain or loss) at detection lines due to collateral activity and cleavage of corresponding reporter oligonucleotide. Utilizing guide design that allows for design of highly active guide RNAs for use with the specific Cas protein of the systems for target sequences, for example, coronavirus is also provided. In certain embodiments, the time from processing of a sample in the current methods and using the presently claimed systems, from receipt of sample to detectable signal is less than 120 minutes, 110 minutes, 100 minutes, 90 minutes, 75 minutes, 60 minutes, 45 minutes, or 30 minutes.

Single Lysis Reaction Compositions

In certain aspects, embodiments disclosed herein are directed to compositions and kits that consolidate extraction-free isolation and amplification of target nucleic acids into a single reaction volume. In certain example embodiments, the extraction-free polynucleotide isolation reagents can be used to extract nucleic acids from cells and/or viral particles. In contrast to existing protocols, the extraction-free polynucleotide isolation solution does not require isolation of the nucleic acid prior to further amplification. The extraction-free polynucleotide isolation reagents may be mixed with amplification reagents such as standard RT-PCR amplification reactions. An example extraction-free polynucleotide isolation solution is described in Example 3.

In certain example embodiments, the extraction-free polynucleotide isolation solution is combined with amplification reagents into a single volume. In certain example embodiments, the amplification reagents are isothermal amplification reagents. In certain other example embodiments, the isothermal amplification reagents are LAMP isothermal amplification reagents. In certain example embodiments, the LAMP isothermal amplification reagents may include primers for the target nucleic acids discussed in further detail below. In certain example embodiments, the LAMP amplification reagents include primer sets selected from SEQ ID Nos: 1-40499.

TABLE 1

Index to LAMP Primers

| Name | % GC | Accession | Common Name | Created | Created Date | Description |
|---|---|---|---|---|---|---|
| NC_000117 | 41.30% | NC_000117.1 | | Wed Aug 03 00:00:00 EDT 2016 | Wed Aug 03 00:00:00 EDT 2016 | Chlamydia trachomatis D/UW-3/CX chromosome, complete genome |
| NC_001489 | 37.90% | NC_001489.1 | | Mon Aug 13 00:00:00 EDT 2018 | Mon Aug 13 00:00:00 EDT 2018 | Hepatitis A virus, complete genome |
| NC_003977 | 48.50% | NC_003977.2 | | Mon Aug 13 00:00:00 EDT 2018 | Mon Aug 13 00:00:00 EDT 2018 | Hepatitis B virus (strain ayw) genome |
| NC_038882 | 58.40% | NC_038882.1 | isolate H77 | Tue Apr 21 00:00:00 EDT 2020 | Tue Apr 21 00:00:00 EDT 2020 | Hepatitis C virus (isolate H77) genotype 1, complete cds |
| NC_004102 | 58.20% | NC_004102.1 | | Thu Jul 11 00:00:00 EDT 2019 | Thu Jul 11 00:00:00 EDT 2019 | Hepatitis C virus genotype 1, complete genome |
| NC_009823 | 56.90% | NC_009823.1 | | Wed May 22 00:00:00 EDT 2019 | Wed May 22 00:00:00 EDT 2019 | Hepatitis C virus genotype 2, complete genome |
| NC_009824 | 55.60% | NC_009824.1 | | Wed May 22 00:00:00 EDT 2019 | Wed May 22 00:00:00 EDT 2019 | Hepatitis C virus genotype 3, genome |
| NC_009825 | 56.20% | NC_009825.1 | | Wed May 22 00:00:00 EDT 2019 | Wed May 22 00:00:00 EDT 2019 | Hepatitis C virus genotype 4, genome |
| NC_009826 | 57.10% | NC_009826.1 | | Wed May 22 00:00:00 EDT 2019 | Wed May 22 00:00:00 EDT 2019 | Hepatitis C virus genotype 5, genome |
| NC_009827 | 55.40% | NC_009827.1 | | Wed May 22 00:00:00 EDT 2019 | Wed May 22 00:00:00 EDT 2019 | Hepatitis C virus genotype 6, complete genome |
| NC_030791 | 56.80% | NC_030791.1 | | Tue May 28 00:00:00 EDT 2019 | Tue May 28 00:00:00 EDT 2019 | Hepatitis C virus genotype 7, complete genome |
| NC_001653 | 58.80% | NC_001653.2 | | Mon Aug 13 00:00:00 EDT 2018 | Mon Aug 13 00:00:00 EDT 2018 | Hepatitis delta virus, complete genome |
| NC_001434 | 57.90% | NC_001434.1 | | Mon Aug 13 00:00:00 EDT 2018 | Mon Aug 13 00:00:00 EDT 2018 | Hepatitis E virus, complete genome |
| NC_038504 | 57.60% | NC_038504.1 | | Tue Jun 04 00:00:00 EDT 2019 | Tue Jun 04 00:00:00 EDT 2019 | Hepatitis E virus rat/R63/DEU/2009, complete genome |
| NC_001837 | 57.90% | NC_001837.1 | | Mon Aug 13 00:00:00 EDT 2018 | Mon Aug 13 00:00:00 EDT 2018 | Hepatitis GB virus A, complete genome |
| NC_001655 | 50.60% | NC_001655.1 | | Thu May 23 00:00:00 EDT 2019 | Thu May 23 00:00:00 EDT 2019 | Hepatitis GB virus B, complete genome |
| NC_012959 | 54.90% | NC_012959.1 | | Mon Aug 13 00:00:00 EDT 2018 | Mon Aug 13 00:00:00 EDT 2018 | Human adenovirus 54, complete genome |
| NC_001460 | 46.50% | NC_001460.1 | | Mon Aug 13 00:00:00 EDT 2018 | Mon Aug 13 00:00:00 EDT 2018 | Human adenovirus A, complete genome |
| NC_001664 | 42.40% | NC_001664.4 | | Fri Jan 18 00:00:00 EST 2019 | Fri Jan 18 00:00:00 EST 2019 | Human betaherpesvirus 6A, variant A DNA, complete virion genome, isolate U1102 |
| NC_002645 | 38.30% | NC_002645.1 | | Mon Aug 13 00:00:00 EDT 2018 | Mon Aug 13 00:00:00 EDT 2018 | Human coronavirus 229E, complete genome |
| NC_006577 | 32.10% | NC_006577.2 | HCoV-HKU1 | Mon Aug 13 00:00:00 EDT 2018 | Mon Aug 13 00:00:00 EDT 2018 | Human coronavirus HKU1, complete genome |
| NC_005831 | 34.50% | NC_005831.2 | HCoV-NL63 | Mon Aug 13 00:00:00 EDT 2018 | Mon Aug 13 00:00:00 EDT 2018 | Human Coronavirus NL63, complete genome |
| NC_006213 | 36.80% | NC_006213.1 | HCoV-OC43 | Thu Feb 21 00:00:00 EST 2019 | Thu Feb 21 00:00:00 EST 2019 | Human coronavirus OC43 strain ATCC VR-759, complete genome |
| NC_007605 | 59.50% | NC_007605.1 | Epstein-Barr virus | Mon Aug 13 00:00:00 EDT 2018 | Mon Aug 13 00:00:00 EDT 2018 | Human gammaherpesvirus 4, complete genome |
| NC_026817 | 54.90% | NC_026817.1 | | Mon Aug 13 00:00:00 EDT 2018 | Mon Aug 13 00:00:00 EDT 2018 | Human genital-associated circular DNA virus-1 isolate 349, complete genome |
| NC_001806 | 68.30% | NC_001806.2 | Herpes simplex virus 1 | Mon Aug 13 00:00:00 EDT 2018 | Mon Aug 13 00:00:00 EDT 2018 | Human herpesvirus 1 strain 17, complete genome |
| NC_001798 | 70.40% | NC_001798.2 | Herpes simplex virus 2 | Mon May 16 00:00:00 EDT 2016 | Mon May 16 00:00:00 EDT 2016 | Human herpesvirus 2 strain HG52, complete genome |
| NC_001348 | 46.00% | NC_001348.1 | HHV-3 | Mon Aug 13 00:00:00 EDT 2018 | Mon Aug 13 00:00:00 EDT 2018 | Human herpesvirus 3, complete genome |
| NC_009334 | 59.50% | NC_009334.1 | Epstein-Barr virus type 2 | Mon Aug 13 00:00:00 EDT 2018 | Mon Aug 13 00:00:00 EDT 2018 | Human herpesvirus 4, complete genome |
| NC_006273 | 57.50% | NC_006273.2 | HHV-5; HCMV | Mon Aug 13 00:00:00 EDT 2018 | Mon Aug 13 00:00:00 EDT 2018 | Human herpesvirus 5 strain Merlin, complete genome |
| NC_000898 | 42.80% | NC_000898.1 | HHV-6B | Mon Aug 13 00:00:00 EDT 2018 | Mon Aug 13 00:00:00 EDT 2018 | Human herpesvirus 6B, complete genome |
| NC_001716 | 36.20% | NC_001716.2 | HHV-7 | Mon Aug 13 00:00:00 EDT 2018 | Mon Aug 13 00:00:00 EDT 2018 | Human herpesvirus 7, complete genome |
| NC_009333 | 53.80% | NC_009333.1 | Kaposi's sarcoma-associated herpesvirus | Tue Jun 04 00:00:00 EDT 2019 | Tue Jun 04 00:00:00 EDT 2019 | Human herpesvirus 8 strain GK18, complete genome |
| NC_001802 | 42.10% | NC_001802.1 | HIV-1 | Mon Aug 13 00:00:00 EDT 2018 | Mon Aug 13 00:00:00 EDT 2018 | Human immunodeficiency virus 1, complete genome |

TABLE 1-continued

Index to LAMP Primers

| Name | % GC | Accession | Common Name | Created | Created Date | Description |
|---|---|---|---|---|---|---|
| NC_001722 | 45.70% | NC_001722.1 | HIV-2 | Mon Aug 13 00:00:00 EDT 2018 | Mon Aug 13 00:00:00 EDT 2018 | Human immunodeficiency virus 2, complete genome |
| NC_001676 | 41.90% | NC_001676.1 | | Mon Aug 13 00:00:00 EDT 2018 | Mon Aug 13 00:00:00 EDT 2018 | Human papillomavirus 54, complete genome |
| NC_013035 | 38.50% | NC_013035.1 | | Mon Aug 13 00:00:00 EDT 2018 | Mon Aug 13 00:00:00 EDT 2018 | Human papillomavirus 116, complete genome |
| NC_001356 | 40.30% | NC_001356.1 | | Mon Aug 13 00:00:00 EDT 2018 | Mon Aug 13 00:00:00 EDT 2018 | Human papillomavirus - 1, complete genome |
| NC_001352 | 48.40% | NC_001352.1 | | Mon Aug 13 00:00:00 EDT 2018 | Mon Aug 13 00:00:00 EDT 2018 | Human papillomavirus - 2, complete genome |
| NC_001357 | 40.40% | NC_001357.1 | | Mon Aug 13 00:00:00 EDT 2018 | Mon Aug 13 00:00:00 EDT 2018 | Human papillomavirus - 18, complete genome |
| NC_001694 | 46.30% | NC_001694.1 | | Mon Aug 13 00:00:00 EDT 2018 | Mon Aug 13 00:00:00 EDT 2018 | Human papillomavirus - 61, complete genome |
| NC_027779 | 37.50% | NC_027779.1 | | Mon Aug 13 00:00:00 EDT 2018 | Mon Aug 13 00:00:00 EDT 2018 | Human papillomavirus isolate SE379, complete genome |
| NC_026946 | 36.80% | NC_026946.1 | | Mon Aug 13 00:00:00 EDT 2018 | Mon Aug 13 00:00:00 EDT 2018 | Human papillomavirus KC5, complete genome |
| NC_001457 | 38.50% | NC_001457.1 | | Mon Aug 13 00:00:00 EDT 2018 | Mon Aug 13 00:00:00 EDT 2018 | Human papillomavirus type 4, complete genome |
| NC_001355 | 40.90% | NC_001355.1 | | Mon Aug 13 00:00:00 EDT 2018 | Mon Aug 13 00:00:00 EDT 2018 | Human papillomavirus type 6b, complete genome |
| NC_001595 | 39.50% | NC_001595.1 | | Mon Aug 13 00:00:00 EDT 2018 | Mon Aug 13 00:00:00 EDT 2018 | Human papillomavirus type 7 genomic DNA |
| NC_001596 | 41.00% | NC_001596.1 | | Mon Aug 13 00:00:00 EDT 2018 | Mon Aug 13 00:00:00 EDT 2018 | Human papillomavirus type 9, complete genome |
| NC_001576 | 45.90% | NC_001576.1 | | Mon Aug 13 00:00:00 EDT 2018 | Mon Aug 13 00:00:00 EDT 2018 | Human papillomavirus type 10 genomic DNA |
| NC_001526 | 36.50% | NC_001526.4 | | Mon Aug 13 00:00:00 EDT 2018 | Mon Aug 13 00:00:00 EDT 2018 | Human papillomavirus type 16, complete genome |
| NC_001583 | 38.60% | NC_001583.1 | | Mon Aug 13 00:00:00 EDT 2018 | Mon Aug 13 00:00:00 EDT 2018 | Human papillomavirus type 26, complete genome |
| NC_038889 | 40.40% | NC_038889.1 | | Fri Aug 24 00:00:00 EDT 2018 | Fri Aug 24 00:00:00 EDT 2018 | Human papillomavirus type 30 genomic DNA |
| NC_001586 | 41.00% | NC_001586.1 | | Mon Aug 13 00:00:00 EDT 2018 | Mon Aug 13 00:00:00 EDT 2018 | Human papillomavirus type 32, complete genome |
| NC_001587 | 38.20% | NC_001587.1 | | Mon Aug 13 00:00:00 EDT 2018 | Mon Aug 13 00:00:00 EDT 2018 | Human papillomavirus type 34, complete genome |
| NC_001354 | 46.90% | NC_001354.1 | | Mon Aug 13 00:00:00 EDT 2018 | Mon Aug 13 00:00:00 EDT 2018 | Human papillomavirus type 41, complete genome |
| NC_001690 | 36.80% | NC_001690.1 | | Mon Aug 13 00:00:00 EDT 2018 | Mon Aug 13 00:00:00 EDT 2018 | Human papillomavirus type 48, complete genome |
| NC_001591 | 41.10% | NC_001591.1 | | Mon Aug 13 00:00:00 EDT 2018 | Mon Aug 13 00:00:00 EDT 2018 | Human papillomavirus type 49, complete genome |
| NC_001691 | 36.80% | NC_001691.1 | | Mon Aug 13 00:00:00 EDT 2018 | Mon Aug 13 00:00:00 EDT 2018 | Human papillomavirus type 50, complete genome |
| NC_001593 | 40.10% | NC_001593.1 | | Mon Aug 13 00:00:00 EDT 2018 | Mon Aug 13 00:00:00 EDT 2018 | Human papillomavirus type 53, complete genome |
| NC_001693 | 37.00% | NC_001693.1 | | Mon Aug 13 00:00:00 EDT 2018 | Mon Aug 13 00:00:00 EDT 2018 | Human papillomavirus type 60, complete genome |
| NC_001458 | 40.40% | NC_001458.1 | | Mon Aug 13 00:00:00 EDT 2018 | Mon Aug 13 00:00:00 EDT 2018 | Human papillomavirus type 63, complete genome |
| NC_039089 | 44.40% | NC_039089.1 | | Fri Aug 24 00:00:00 EDT 2018 | Fri Aug 24 00:00:00 EDT 2018 | Human papillomavirus type 71 DNA, complete genome |
| NC_034616 | 37.70% | NC_034616.1 | | Sat Aug 25 00:00:00 EDT 2018 | Sat Aug 25 00:00:00 EDT 2018 | Human papillomavirus type 85 isolate 114B, complete genome |
| NC_010329 | 40.10% | NC_010329.1 | | Mon Aug 13 00:00:00 EDT 2018 | Mon Aug 13 00:00:00 EDT 2018 | Human papillomavirus type 88, complete genome |
| NC_004104 | 46.70% | NC_004104.1 | candHPV90 | Mon Aug 13 00:00:00 EDT 2018 | Mon Aug 13 00:00:00 EDT 2018 | Human papillomavirus type 90, complete genome |
| NC_004500 | 40.00% | NC_004500.1 | | Mon Aug 13 00:00:00 EDT 2018 | Mon Aug 13 00:00:00 EDT 2018 | Human papillomavirus type 92, complete genome |
| NC_005134 | 40.30% | NC_005134.2 | | Mon Aug 13 00:00:00 EDT 2018 | Mon Aug 13 00:00:00 EDT 2018 | Human papillomavirus type 96, complete genome |
| NC_008189 | 43.10% | NC_008189.1 | HPV101 | Mon Aug 13 00:00:00 EDT 2018 | Mon Aug 13 00:00:00 EDT 2018 | Human papillomavirus type 101, complete genome |
| NC_008188 | 41.60% | NC_008188.1 | HPV103 | Mon Aug 13 00:00:00 EDT 2018 | Mon Aug 13 00:00:00 EDT 2018 | Human papillomavirus type 103, complete genome |
| NC_012213 | 42.60% | NC_012213.1 | | Tue Jun 04 00:00:00 EDT 2019 | Tue Jun 04 00:00:00 EDT 2019 | Human papillomavirus type 108, complete genome |
| NC_012485 | 38.30% | NC_012485.1 | | Mon Aug 13 00:00:00 EDT 2018 | Mon Aug 13 00:00:00 EDT 2018 | Human papillomavirus type 109, complete genome |
| NC_012486 | 37.50% | NC_012486.1 | | Mon Aug 13 00:00:00 EDT 2018 | Mon Aug 13 00:00:00 EDT 2018 | Human papillomavirus type 112, complete genome |
| NC_014185 | 37.70% | NC_014185.1 | | Mon Aug 13 00:00:00 EDT 2018 | Mon Aug 13 00:00:00 EDT 2018 | Human papillomavirus type 121, complete genome |
| NC_016157 | 38.00% | NC_016157.1 | | Mon Aug 13 00:00:00 EDT 2018 | Mon Aug 13 00:00:00 EDT 2018 | Human papillomavirus type 126, complete genome |
| NC_014952 | 36.00% | NC_014952.1 | | Tue Jun 04 00:00:00 EDT 2019 | Tue Jun 04 00:00:00 EDT 2019 | Human papillomavirus type 128, complete genome |
| NC_014953 | 37.30% | NC_014953.1 | | Tue Jun 04 00:00:00 EDT 2019 | Tue Jun 04 00:00:00 EDT 2019 | Human papillomavirus type 129, complete genome |
| NC_014954 | 37.00% | NC_014954.1 | | Tue Jun 04 00:00:00 EDT 2019 | Tue Jun 04 00:00:00 EDT 2019 | Human papillomavirus type 131, complete genome |
| NC_014955 | 37.90% | NC_014955.1 | | Mon Aug 13 00:00:00 EDT 2018 | Mon Aug 13 00:00:00 EDT 2018 | Human papillomavirus type 132, complete genome |
| NC_014956 | 38.10% | NC_014956.1 | | Tue Jun 04 00:00:00 EDT 2019 | Tue Jun 04 00:00:00 EDT 2019 | Human papillomavirus type 134, complete genome |
| NC_017993 | 36.80% | NC_017993.1 | | Mon Aug 13 00:00:00 EDT 2018 | Mon Aug 13 00:00:00 EDT 2018 | Human papillomavirus type 135, complete genome |

TABLE 1-continued

Index to LAMP Primers

| Name | % GC | Accession | Common Name | Created | Created Date | Description |
|---|---|---|---|---|---|---|
| NC_017994 | 38.50% | NC_017994.1 | | Mon Aug 13 00:00:00 EDT 2018 | Mon Aug 13 00:00:00 EDT 2018 | Human papillomavirus type 136, complete genome |
| NC_017995 | 37.60% | NC_017995.1 | | Mon Aug 13 00:00:00 EDT 2018 | Mon Aug 13 00:00:00 EDT 2018 | Human papillomavirus type 137, complete genome |
| NC_017996 | 39.70% | NC_017996.1 | | Mon Aug 13 00:00:00 EDT 2018 | Mon Aug 13 00:00:00 EDT 2018 | Human papillomavirus type 140, complete genome |
| NC_017997 | 38.20% | NC_017997.1 | | Mon Aug 13 00:00:00 EDT 2018 | Mon Aug 13 00:00:00 EDT 2018 | Human papillomavirus type 144, complete genome |
| NC_021483 | 37.90% | NC_021483.1 | HPV154 | Mon Aug 13 00:00:00 EDT 2018 | Mon Aug 13 00:00:00 EDT 2018 | Human papillomavirus type 154 isolate PV77, complete genome |
| NC_033781 | 36.20% | NC_033781.1 | | Mon Aug 13 00:00:00 EDT 2018 | Mon Aug 13 00:00:00 EDT 2018 | Human papillomavirus type 156 isolate GC01, complete genome |
| NC_038522 | 37.70% | NC_038522.1 | | Fri Aug 24 00:00:00 EDT 2018 | Fri Aug 24 00:00:00 EDT 2018 | Human papillomavirus type 161 isolate KC1, complete genome |
| NC_028125 | 37.70% | NC_028125.1 | | Mon Aug 13 00:00:00 EDT 2018 | Mon Aug 13 00:00:00 EDT 2018 | Human papillomavirus type 163 isolate KC3, complete genome |
| NC_019023 | 38.30% | NC_019023.1 | | Mon Aug 13 00:00:00 EDT 2018 | Mon Aug 13 00:00:00 EDT 2018 | Human papillomavirus type 166 isolate KC9, complete genome |
| NC_022892 | 35.80% | NC_022892.1 | | Mon Aug 13 00:00:00 EDT 2018 | Mon Aug 13 00:00:00 EDT 2018 | Human papillomavirus type 167 isolate KC10, complete genome |
| NC_038523 | 37.80% | NC_038523.1 | HPV 172 | Fri Aug 24 00:00:00 EDT 2018 | Fri Aug 24 00:00:00 EDT 2018 | Human papillomavirus type 172, complete genome |
| NC_038524 | 38.90% | NC_038524.1 | | Fri Aug 24 00:00:00 EDT 2018 | Fri Aug 24 00:00:00 EDT 2018 | Human papillomavirus type 175 isolate SE87, complete genome |
| NC_023891 | 38.20% | NC_023891.1 | | Mon Aug 13 00:00:00 EDT 2018 | Mon Aug 13 00:00:00 EDT 2018 | Human papillomavirus type 178, complete genome |
| NC_022095 | 36.80% | NC_022095.1 | | Mon Aug 13 00:00:00 EDT 2018 | Mon Aug 13 00:00:00 EDT 2018 | Human papillomavirus type 179 complete genome, isolate SIBX16 |
| NC_038914 | 36.90% | NC_038914.1 | | Fri Aug 24 00:00:00 EDT 2018 | Fri Aug 24 00:00:00 EDT 2018 | Human papillomavirus type 184 complete genome, isolate SIBX17 |
| NC_039086 | 38.90% | NC_039086.1 | | Mon Aug 13 00:00:00 EDT 2018 | Fri Aug 24 00:00:00 EDT 2018 | Human papillomavirus type 187 isolate ACS447, complete genome |
| NC_027528 | 37.70% | NC_027528.1 | | Mon Aug 13 00:00:00 EDT 2018 | Mon Aug 13 00:00:00 EDT 2018 | Human papillomavirus type 201 isolate HPV201, complete genome |
| NC_038525 | 37.80% | NC_038525.1 | | Fri Aug 24 00:00:00 EDT 2018 | Fri Aug 24 00:00:00 EDT 2018 | Human papillomavirus type 204 isolate A342, complete genome |
| NC_001531 | 42.40% | NC_001531.1 | | Mon Aug 13 00:00:00 EDT 2018 | Mon Aug 13 00:00:00 EDT 2018 | Human papillomoavirus type 5, complete genome |
| NC_003461 | 37.20% | NC_003461.1 | | Mon Aug 13 00:00:00 EDT 2018 | Mon Aug 13 00:00:00 EDT 2018 | Human parainfluenza virus 1, complete genome |
| NC_001796 | 34.50% | NC_001796.2 | | Mon Aug 13 00:00:00 EDT 2018 | Mon Aug 13 00:00:00 EDT 2018 | Human parainfluenza virus 3, complete genome |
| NC_038311 | 37.40% | NC_038311.1 | | Fri Aug 24 00:00:00 EDT 2018 | Fri Aug 24 00:00:00 EDT 2018 | Human rhinovirus 1 strain ATCC VR-1559, complete genome |
| NC_038312 | 39.90% | NC_038312.1 | HRV-A1 | Tue Jun 04 00:00:00 EDT 2019 | Tue Jun 04 00:00:00 EDT 2019 | Human rhinovirus 3, complete genome |
| NC_001490 | 40.60% | NC_001490.1 | | Mon Aug 13 00:00:00 EDT 2018 | Mon Aug 13 00:00:00 EDT 2018 | Human rhinovirus 14, complete genome |
| NC_001617 | 39.00% | NC_001617.1 | | Mon Aug 13 00:00:00 EDT 2018 | Mon Aug 13 00:00:00 EDT 2018 | Human rhinovirus 89, complete genome |
| NC_009996 | 42.80% | NC_009996.1 | | Mon Aug 13 00:00:00 EDT 2018 | Mon Aug 13 00:00:00 EDT 2018 | Human rhinovirus C, complete genome |
| NC_038878 | 43.40% | NC_038878.1 | | Fri Aug 24 00:00:00 EDT 2018 | Fri Aug 24 00:00:00 EDT 2018 | Human rhinovirus NAT001 polyprotein gene, complete cds |
| NC_001436 | 53.50% | NC_001436.1 | | Mon Aug 13 00:00:00 EDT 2018 | Mon Aug 13 00:00:00 EDT 2018 | Human T-lymphotropic virus 1, complete genome |
| NC_026438 | 44.80% | NC_026438.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 1 polymerase PB2 (PB2) gene, complete cds |
| NC_026435 | 42.00% | NC_026435.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 2 polymerase PB1 (PB1) gene, complete cds; and nonfunctional PB1-F2 protein (PB1-F2) gene, complete sequence |

TABLE 1-continued

Index to LAMP Primers

| Name | % GC | Accession | Common Name | Created | Created Date | Description |
|---|---|---|---|---|---|---|
| NC_026437 | 44.20% | NC_026437.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 3 polymerase PA (PA) gene, complete cds |
| NC_026433 | 40.80% | NC_026433.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 4 hemagglutinin (HA) gene, complete cds |
| NC_026436 | 46.30% | NC_026436.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 5 nucleocapsid protein (NP) gene, complete cds |
| NC_026434 | 42.10% | NC_026434.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 6 neuraminidase (NA) gene, complete cds |
| NC_026431 | 47.10% | NC_026431.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 7 matrix protein 2 (M2) and matrix protein 1 (M1) genes, complete cds |
| NC_026432 | 43.60% | NC_026432.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 8 nuclear export protein (NEP) and nonstructural protein 1 (NS1) genes, complete cds |
| NC_007361 | 43.40% | NC_007361.1 | A/goose/Guangdong/1/1996(H5N1) | Mon Aug 13 00:00:00 EDT 2018 | Mon Aug 13 00:00:00 EDT 2018 | Influenza A virus (A/Goose/Guangdong/1/96(H5N1)) neuraminidase (NA) gene, complete cds |
| NC_007360 | 46.80% | NC_007360.1 | A/goose/Guangdong/1/1996(H5N1) | Mon Aug 13 00:00:00 EDT 2018 | Mon Aug 13 00:00:00 EDT 2018 | Influenza A virus (A/Goose/Guangdong/1/96(H5N1)) nucleocapsid protein (NP) gene, complete cds |
| NC_007357 | 44.30% | NC_007357.1 | A/goose/Guangdong/1/1996(H5N1) | Mon Aug 13 00:00:00 EDT 2018 | Mon Aug 13 00:00:00 EDT 2018 | Influenza A virus (A/Goose/Guangdong/1/96(H5N1)) polymerase (PB2) gene, complete cds |
| NC_007362 | 41.70% | NC_007362.1 | A/goose/Guangdong/1/1996(H5N1) | Mon Aug 13 00:00:00 EDT 2018 | Mon Aug 13 00:00:00 EDT 2018 | Influenza A virus (A/goose/Guangdong/1/1996(H5N1)) hemagglutinin (HA) gene, complete cds |
| NC_007359 | 43.80% | NC_007359.1 | A/goose/Guangdong/1/1996(H5N1) | Mon Aug 13 00:00:00 EDT 2018 | Mon Aug 13 00:00:00 EDT 2018 | Influenza A virus (A/goose/Guangdong/1/1996(H5N1)) polymerase (PA) and PA-X protein (PA-X) genes, complete cds |
| NC_007358 | 44.10% | NC_007358.1 | A/goose/Guangdong/1/1996(H5N1) | Mon Aug 13 00:00:00 EDT 2018 | Mon Aug 13 00:00:00 EDT 2018 | Influenza A virus (A/goose/Guangdong/1/1996(H5N1)) polymerase (PB1) and PB1-F2 protein (PB1-F2) genes, complete cds |
| NC_007363 | 47.90% | NC_007363.1 | A/goose/Guangdong/1/1996(H5N1) | Mon Aug 13 00:00:00 EDT 2018 | Mon Aug 13 00:00:00 EDT 2018 | Influenza A virus (A/goose/Guangdong/1/1996(H5N1)) segment 7, complete sequence |
| NC_007364 | 41.40% | NC_007364.1 | A/goose/Guangdong/1/1996(H5N1) | Mon Aug 13 00:00:00 EDT 2018 | Mon Aug 13 00:00:00 EDT 2018 | Influenza A virus (A/goose/Guangdong/1/1996(H5N1)) segment 8, complete sequence |
| NC_004905 | 47.30% | NC_004905.2 | A/Hong Kong/1073/99(H9N2) | Mon Aug 13 00:00:00 EDT 2018 | Mon Aug 13 00:00:00 EDT 2018 | Influenza A virus (A/Hong Kong/1073/99(H9N2)) segment 5, complete sequence |
| NC_004907 | 47.80% | NC_004907.1 | A/Hong Kong/1073/99(H9N2) | Mon Aug 13 00:00:00 EDT 2018 | Mon Aug 13 00:00:00 EDT 2018 | Influenza A virus (A/Hong Kong/1073/99(H9N2)) segment 7, complete sequence |
| NC_004906 | 43.30% | NC_004906.1 | A/Hong Kong/1073/99(H9N2) | Mon Aug 13 00:00:00 EDT 2018 | Mon Aug 13 00:00:00 EDT 2018 | Influenza A virus (A/Hong Kong/1073/99(H9N2)) segment 8, complete sequence |
| NC_007378 | 42.50% | NC_007378.1 | A/Korea/426/1968(H2N2) | Mon Aug 13 00:00:00 EDT 2018 | Mon Aug 13 00:00:00 EDT 2018 | Influenza A virus (A/Korea/426/1968(H2N2)) segment 1, complete sequence |
| NC_007375 | 42.70% | NC_007375.1 | A/Korea/426/968(H2N2) | Mon Aug 13 00:00:00 EDT 2018 | Mon Aug 13 00:00:00 EDT 2018 | Influenza A virus (A/Korea/426/1968(H2N2)) segment 2, complete sequence |
| NC_007376 | 42.40% | NC_007376.1 | A/Korea/426/1968(H2N2) | Mon Aug 13 00:00:00 EDT 2018 | Mon Aug 13 00:00:00 EDT 2018 | Influenza A virus (A/Korea/426/1968(H2N2)) segment 3, complete sequence |

TABLE 1-continued

| Index to LAMP Primers | | | | | | |
|---|---|---|---|---|---|---|
| Name | % GC | Accession | Common Name | Created | Created Date | Description |
| NC_007374 | 41.60% | NC_007374.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 4, complete sequence |
| NC_007381 | 46.40% | NC_007381.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 5, complete sequence |
| NC_007382 | 43.40% | NC_007382.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 6, complete sequence |
| NC_007377 | 47.50% | NC_007377.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 7, complete sequence |
| NC_007380 | 43.40% | NC_007380.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 8, complete sequence |
| NC_007373 | 42.50% | NC_007373.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 1, complete sequence |
| NC_007372 | 42.20% | NC_007372.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 2, complete sequence |
| NC_007371 | 41.70% | NC_007371.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 3, complete sequence |
| NC_007366 | 42.00% | NC_007366.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 4, complete sequence |
| NC_007369 | 45.80% | NC_007369.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 5, complete sequence |
| NC_007368 | 42.70% | NC_007368.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 6, complete sequence |
| NC_007367 | 46.70% | NC_007367.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 7, complete sequence |
| NC_007370 | 41.70% | NC_007370.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 8, complete sequence |
| NC_002023 | 43.70% | NC_002023.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 1, complete sequence |
| NC_002021 | 42.10% | NC_002021.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 2, complete sequence |
| NC_002022 | 42.00% | NC_002022.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 3, complete sequence |
| NC_002017 | 41.60% | NC_002017.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 4, complete sequence |
| NC_002019 | 46.40% | NC_002019.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 5, complete sequence |
| NC_002018 | 42.70% | NC_002018.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 6, complete sequence |
| NC_002016 | 47.20% | NC_002016.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 7, complete sequence |
| NC_002020 | 44.30% | NC_002020.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 8, complete sequence |
| NC_026422 | 44.90% | NC_026422.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 1 polymerase PB2 (PB2) gene, complete cds |
| NC_026423 | 44.20% | NC_026423.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 2 polymerase PB1 (PB1) and PB1-F2 protein (PB1-F2) genes, complete cds |

TABLE 1-continued

| Index to LAMP Primers | | | | | | |
|---|---|---|---|---|---|---|
| Name | % GC | Accession | Common Name | Created | Created Date | Description |
| NC_026424 | 44.30% | NC_026424.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 3 polymerase PA (PA) and PA-X protein (PA-X) genes, complete cds |
| NC_026425 | 41.80% | NC_026425.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 4 hemagglutinin (HA) gene, complete cds |
| NC_026426 | 46.60% | NC_026426.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 5 nucleocapsid protein (NP) gene, complete cds |
| NC_026429 | 43.60% | NC_026429.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 6 neuraminidase (NA) gene, complete cds |
| NC_026427 | 47.50% | NC_026427.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 7 matrix protein 2 (M2) and matrix protein 1 (M1) genes, complete cds |
| NC_026428 | 41.90% | NC_026428.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 8 nuclear export protein (NEP) and nonstructural protein 1 (NS1) genes, complete cds |
| NC_004908 | 42.50% | NC_004908.1 | A/Hong Kong/1073/99(H9N2 | Mon Aug 13 00:00:00 EDT 2018 | Mon Aug 13 00:00:00 EDT 2018 | Influenza A virus ha gene for Hemagglutinin, genomic RNA, strain A/Hong Kong/1073/99(H9N2) |
| NC_004909 | 42.60% | NC_004909.1 | A/Hong Kong/1073/99(H9N2 | Mon Aug 13 00:00:00 EDT 2018 | Mon Aug 13 00:00:00 EDT 2018 | Influenza A virus na gene for neuraminidase, genomic RNA, strain A/Hong Kong/1073/99(H9N2) |
| NC_004912 | 44.00% | NC_004912.1 | A/Hong Kong/1073/99(H9N2 | Mon Aug 13 00:00:00 EDT 2018 | Mon Aug 13 00:00:00 EDT 2018 | Influenza A virus pa gene for polymerase PA, genomic RNA, strain A/Hong Kong/1073/99(H9N2) |
| NC_004911 | 43.50% | NC_004911.1 | A/Hong Kong/1073/99(H9N2 | Mon Aug 13 00:00:00 EDT 2018 | Mon Aug 13 00:00:00 EDT 2018 | Influenza A virus pb1 gene for polymerase Pb1, genomic RNA, strain A/Hong Kong/1073/99(H9N2) |
| NC_004910 | 43.20% | NC_004910.1 | A/Hong Kong/1073/99(H9N2 | Mon Aug 13 00:00:00 EDT 2018 | Mon Aug 13 00:00:00 EDT 2018 | Influenza A virus pb2 gene for polymerase Pb2, genomic RNA, strain A/Hong Kong/1073/99(H9N2) |
| NC_002205 | 38.50% | NC_002205.1 | B/Lee/1940 | Mon Aug 13 00:00:00 EDT 2018 | Mon Aug 13 00:00:00 EDT 2018 | Influenza B virus (B/Lee/1940) segment 2, complete sequence |
| NC_002206 | 39.20% | NC_002206.1 | B/Lee/1940 | Mon Aug 13 00:00:00 EDT 2018 | Mon Aug 13 00:00:00 EDT 2018 | Influenza B virus (B/Lee/1940) segment 3, complete sequence |
| NC_002207 | 41.80% | NC_002207.1 | B/Lee/1940 | Mon Aug 13 00:00:00 EDT 2018 | Mon Aug 13 00:00:00 EDT 2018 | Influenza B virus (B/Lee/1940) segment 4, complete sequence |
| NC_002208 | 42.00% | NC_002208.1 | B/Lee/1940 | Mon Aug 13 00:00:00 EDT 2018 | Mon Aug 13 00:00:00 EDT 2018 | Influenza B virus (B/Lee/1940) segment 5, complete sequence |
| NC_002209 | 41.60% | NC_002209.1 | B/Lee/1940 | Mon Aug 13 00:00:00 EDT 2018 | Mon Aug 13 00:00:00 EDT 2018 | Influenza B virus (B/Lee/1940) segment 6, complete sequence |
| NC_002210 | 38.80% | NC_002210.1 | B/Lee/1940 | Mon Aug 13 00:00:00 EDT 2018 | Mon Aug 13 00:00:00 EDT 2018 | Influenza B virus (B/Lee/1940) segment 7, complete sequence |
| NC_002211 | 41.30% | NC_002211.1 | B/Lee/1940 | Mon Aug 13 00:00:00 EDT 2018 | Mon Aug 13 00:00:00 EDT 2018 | Influenza B virus (B/Lee/1940) segment 8, complete sequence |
| NC_002204 | 39.10% | NC_002204.1 | B/Lee/1940 | Mon Aug 13 00:00:00 EDT 2018 | Mon Aug 13 00:00:00 EDT 2018 | Influenza B virus RNA 1, complete sequence |
| NC_006310 | 39.80% | NC_006310.2 | C/Ann Arbor/1/50 | Mon Aug 13 00:00:00 EDT 2018 | Mon Aug 13 00:00:00 EDT 2018 | Influenza C virus (C/Ann Arbor/1/50) HEF gene for hemagglutinin-esterase-fusion, complete cds |
| NC_006312 | 38.60% | NC_006312.2 | C/Ann Arbor/1/50 | Mon Aug 13 00:00:00 EDT 2018 | Mon Aug 13 00:00:00 EDT 2018 | Influenza C virus (C/Ann Arbor/1/50) M1, CM2 genes for matrix protein, CM2 protein, complete cds |
| NC_006309 | 35.60% | NC_006309.2 | C/Ann Arbor/1/50 | Mon Aug 13 00:00:00 EDT 2018 | Mon Aug 13 00:00:00 EDT 2018 | Influenza C virus (C/Ann Arbor/1/50) P3 gene for polymerase 3, complete cds |
| NC_006308 | 35.60% | NC_006308.2 | C/Ann Arbor/1/50 | Mon Aug 13 00:00:00 EDT 2018 | Mon Aug 13 00:00:00 EDT 2018 | Influenza C virus (C/Ann Arbor/1/50) PB1 gene for polymerase 1, complete cds |

TABLE 1-continued

Index to LAMP Primers

| Name | % GC | Accession | Common Name | Created | Created Date | Description |
|---|---|---|---|---|---|---|
| NC_006307 | 36.80% | NC_006307.2 | C/Ann Arbor/1/50 | Mon Aug 13 00:00:00 EDT 2018 | Mon Aug 13 00:00:00 EDT 2018 | Influenza C virus (C/Ann Arbor/1/50) PB2 gene for polymerase 2, complete cds |
| NC_006311 | 38.40% | NC_006311.1 | C/Ann Arbor/1/50 | Mon Aug 13 00:00:00 EDT 2018 | Mon Aug 13 00:00:00 EDT 2018 | Influenza C virus (C/Ann Arbor/1/50) segment 5, complete sequence |
| NC_006306 | 37.50% | NC_006306.2 | C/Ann Arbor/1/50 | Mon Aug 13 00:00:00 EDT 2018 | Mon Aug 13 00:00:00 EDT 2018 | Influenza C virus (C/Ann Arbor/1/50) segment 7, complete sequence |
| NZ_LT591897 | 52.10% | NZ_LT591897.1 | | Sat Apr 04 00:00:00 EDT 2020 | Sat Apr 04 00:00:00 EDT 2020 | Neisseria gonorrhoeae strain WHO F chromosome 1 |
| NC_001803 | 33.20% | NC_001803.1 | | Mon Aug 13 00:00:00 EDT 2018 | Mon Aug 13 00:00:00 EDT 2018 | Respiratory syncytial virus, complete genome |
| NC_004718 | 40.80% | NC_004718.3 | | Mon Aug 13 00:00:00 EDT 2018 | Mon Aug 13 00:00:00 EDT 2018 | SARS coronavirus, complete genome |
| NZ_LN831034 | 38.50% | NZ_LN831034.1 | | Thu Apr 02 00:00:00 EDT 2020 | Thu Apr 02 00:00:00 EDT 2020 | Streptococcus pyogenes strain NCTC8198 chromosome 1 |

In certain example embodiments, the LAMP amplification reagents may include primers to SARS-COV2. In certain example embodiments, the primers are SEQ ID NOS: 61983-61988 from Table 6. LAMP reagents may further comprise colorimetric and/or fluorescent detection reagents, such as hydroxy napthol blue (see, e.g. Goto, M., et al., Colorimetric detection of loop-mediated isothermal amplification reaction by using hydroxy naphthol blue. Biotechniques, 2009. 46(3): p. 167-72) leuco triphenylmethane dyes (see, e.g. Miyamoto, S., et al., Method for colorimetric detection of double-stranded nucleic acid using leuco triphenylmethane dyes. Anal Biochem, 2015. 473: p. 28-33) and pH-snesitive dyes (see, e.g. Tanner, N. A., Y. Zhang, and T. C. Evans, Jr., Visual detection of isothermal nucleic acid amplification using pH-sensitive dyes. Biotechniques, 2015. 58(2): p. 59-68); as well as fluorescent detection (see, e.g. Yu et al., *Clinical Chemistry*, hvaa102, doi:10.1093/clinchem/hvaa102 12 May 2020), including use of quenching probes (see, e.g. Shirato et al., *J Virol Methods*. 2018 August; 258:41-48. doi: 10.1016/j.jviromet.2018.05.006).

In certain embodiments, extraction-free polynucleotide isolation solution and isothermal amplification reagents may be lyophilized in a single reaction volume, to be reconstituted by addition of a sample to be assayed. In certain other embodiments, the extraction-free polynucleotide isolation solution and isothermal amplification reagents may be lyophilized and stored on a cartridge or lateral flow strip, as discussed in further detail below.

In certain example embodiments, the single lysis reaction compositions and kits may further comprise one or more Cas proteins possessing collateral activity and a detection construct. Pairing with one or more Cas proteins may increase sensitivity or specificity of the assay. In certain example embodiments, the one or more Cas proteins may be thermostable Cas proteins. Example Cas proteins are disclosed in further detail below.

In certain example embodiments, the single lysis amplification reaction compositions and kits may comprise optimized primers and/or one or more additives. In an aspect, the design optimizes the primers used in the amplification. In particular aspects, the isothermal amplification is used alone. In another aspect, the isothermal amplification is used with CRISPR-Cas systems. In either approach, design considerations can follow a rational design for optimization of the reactions, which provides optimized primers and/or guides. Optimization of the methods as disclosed herein can include first screening primers to identify one or more sets of primers that work well for a particular target, Cas protein and/or reaction. Once the primers have been screened, titration of magnesium concentration can be performed to identify an optimal magnesium concentration for higher signal to noise readout. Once an optimum magnesium concentration is identified, additional additives are screened at around 20-25% of the reaction, and once additives are identified, these additives, such as those additives identified in FIG. 17, can be evaluated and varied in concentration to identify optimal reaction kinetics for specific reaction parameters. In an example, varying additives with specific primers, target, Cas protein (when CRISPR system is used), temperature, and other additive concentrations within the reaction can be identified. Optimization can be made with the goal of reducing the number of steps and buffer exchanges that have to occur in the reaction, simplifying the reaction and reducing the risks of contamination at transfer steps. In an aspect, addition of inhibitors, such as proteinase K can be considered so that buffer exchanges can be reduced. Similarly, optimizing the salt levels as well as the type of salt utilized can further facilitate and optimize the one-pot detections disclosed herein. In an aspect, potassium chloride can be utilized rather than sodium chloride when such amplification approaches are used with bead concentration in a lysis step.

In certain embodiments, the compositions and kits may further comprise nucleic acid binding bead. The bead may be used to capture, concentrate or otherwise enrich for particular material. The bead may be magnetic, and may be provided to capture nucleic acid material. In another aspect, the bead is a silica bead. Beads may be utilized in an extraction step of the methods disclosed herein. Beads can be optionally used with the methods described herein, including with the one-pot methods that allow for concentration of viral nucleic acids from large volume samples, such as saliva or swab samples to allow for a single one-pot reaction method. Concentration of desired target molecules can be increased by about 10-fold, 50-fold, 100-fold, 200-fold, 500-fold, 800-fold, 1000-fold, 1500-fold, 2000-fold, 2500-fold, 3000-fold, or more.

Magnetic beads in a PEG and salt solution are preferred in an aspect, and in embodiments bind to viral RNA and/or DNA which allows for concentration and lysis concurrently. Silica beads can be used in another aspect. Capture moieties such as oligonucleotide functionalized beads are envisioned for use. The beads may be using with the extraction reagents, allowed to incubate with a sample and the lysis/extraction-free polynucleotide isolation solution, thereby concentrating target molecules on the beads. When used with a cartridge device detailed elsewhere herein, a magnet can be activated and the beads collected, with optional flushing of the extraction-free polynucleotide isolation solution and one or more washes performed. Advantageously, the beads can be used in the one-pot methods and systems without additional washings of the beads, allowing for a more efficient process without increased risks of contamination in multi-step processes. Beads can be utilized with the isothermal amplifications detailed herein, and the beads can flow into an amplification chamber of the cartridge or be maintained in the pot for the amplification step. Upon heating, nucleic acid can be released off the beads.

Example CRISPR-Cas Systems

CRISPR Cas for use in the embodiments disclosed herein may comprise a Type V Cas protein, a Type VI Cas protein, or a combination thereof. In certain embodiments, the Cas proteins are thermostable Cas proteins. Example thermostable Cas proteins can be selected from Table 2A or Table 2B, comprising Cas12 thermostable Cas proteins; other representative Cas12 and Cas13 proteins can be identified from Cas systems isolated from organisms that inhabit similar microenvironments. In certain example embodiments, the Cas is AapCas12b. In other example embodiments, the Cas is BrCas12b. In an aspect, two or more CRISPR effector systems are provided which may be RNA-targeting effector proteins, DNA-targeting effector proteins, or a combination thereof. The RNA-targeting effector proteins may be a Type VI Cas protein, such as Cas13 protein, including Cas13b, Cas13c, or Cas13d. The DNA-targeting effector protein may be a Type V Cas protein, such as Cas12a (Cpf1), Cas12b (C2c2), or Cas12c (C2c3).

Thermostable Proteins

In certain example embodiments, the protein selected may be more thermostable at higher temperatures. Exemplary proteins may comprise any Cas protein with collateral effect when used with particular methodologies disclosed herein. In an aspect, the Cas protein is a thermostable protein. The thermostable Cas protein may be a Type V or a Type VI protein, for example, a Cas12 or Cas13 protein. In embodiments, the thermostable protein, upon activation, comprises collateral cleavage. A thermostable protein as used herein comprises a protein that retains catalytic activity at a temperature at or above 32° C., 33° C., 34° C., 35° C., 36° C., 37° C., 38° C., 39° C., 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C. In certain example embodiments, the protein is thermostable at or above 55° C.

Methods for identification of thermostable proteins are detailed herein, and may comprise identifying Cas proteins from thermophilic bacterial species. Upon identification of a particular Cas protein from a species, Cas proteins form similar species may be identified.

In certain embodiments, the thermostable CRISPR-Cas protein is a Cas 12 protein from Table 2A or 2B, or at least 80% identity to a polypeptide from Table 2A or 2B. SEQ ID Nos: 61644-61990.

In an embodiment, the thermostable Cas protein is a Cas12 protein selected from a protein in Table 2A, more preferably from Table 2B.

TABLE 2A

Cas 12 proteins
Cas 12 proteins (65C) Ga0209381_1004188 | GENOME_ACCESSION
(66C)_a0212093_1 | Ga0212093_1006934 | GENOME_ACCESSION
3300022548 | Ga0212092_1000015 | GENOME_ACCESSION
a0117933_1071983 | Ga0117933_1071983 | GENOME_ACCESSION
a0212092_1024084 | Ga0212092_1024084 | GENOME_ACCESSION
a0212093_1001507 | Ga0212093_1001507 | GENOME_ACCESSION
a0212120_1000874 | Ga0212120_1000874 | GENOME_ACCESSION
a0212125_1004414 | Ga0212125_1004414 | GENOME_ACCESSION
a0212125_1006348 | Ga0212125_1006348 | GENOME_ACCESSION
ABHJ01000011.1_o | *Hydrogenivirga* sp. 128-5-R1-1 1102927038514
AGIV01000002.1_o | *Rhodothermus marinus* SG0.5JP17-171 Rhoma_Contig848_C
BDSM01000053.1_o | *Microcystis* sp. 0824 DNA
BFBB01000008.1_o | *Leptospira* sp. YH101 DNA
BHZK01000001.1_o | *Parageobacillus thermoglucosidasius* TG4 DNA
CP000240.1_organ | *Synechococcus* sp. JA-2-3B'a(2-13)
CP001229.1_organ | *Sulfurihydrogenibium azoreuse* Az-Fu1
CP011339.1_organ | *Microcystis panniformis* FACHB-1757
CP020382.1_organ | Rhodothermaceae bacterium RA chromosome
CP040694.1_organ | *Elizabethkingia* sp. JS20170427COW chromosome
DCUT01000059.1_o | TPA_asm
DHGN01000237.1_o | TPA_asm
FQUK01000003.1_o | *Thermomonas hydrothermalis* strain DSM 14834 genome assembly
Ga0063162_1014580 | GENOME_ACCESSION
Ga0065719_107896 | GENOME_ACCESSION
Ga0065719_116807 | GENOME_ACCESSION
Ga0067045_1002454 | GENOME_ACCESSION
Ga0067045_1004962 | GENOME_ACCESSION]
Ga0068669_1023596 | GENOME_ACCESSION
Ga0068707_1002163 | GENOME_ACCESSION
Ga0068707_1009867 | GENOME_ACCESSION
Ga0068707_1024093 | GENOME_ACCESSION
Ga0071330_1110381 | GENOME_ACCESSION
Ga0072682_101461 | GENOME_ACCESSION
Ga0073928_10004924 | GENOME_ACCESSION
Ga0073932_1022770 | GENOME_ACCESSION
Ga0079044_1002244 | GENOME_ACCESSION
Ga0079639_1009487 | GENOME_ACCESSION
Ga0099914_10727 | GENOME_ACCESSION
Ga0101790_149349 | GENOME_ACCESSION
Ga0102924_1013089 | GENOME_ACCESSION
Ga0103818_10095 | GENOME_ACCESSION
Ga0105154_1006902 | GENOME_ACCESSION
Ga0105158_1004615 | GENOME_ACCESSION
Ga0114945_10008792 | GENOME_ACCESSION
Ga0116141_10037070 | GENOME_ACCESSION
Ga0116143_10029534 | GENOME_ACCESSION
Ga0116146_1004071 | GENOME_ACCESSION
Ga0116159_1001590 | GENOME_ACCESSION
Ga0116160_1008286 | GENOME_ACCESSION
Ga0116161_1004008 | GENOME_ACCESSION
Ga0116167_1006930 | GENOME_ACCESSION
Ga0116184_10002336 | GENOME_ACCESSION
Ga0116185_1015740 | GENOME_ACCESSION
Ga0116188_1022712 | GENOME_ACCESSION
Ga0116210_1003377 | GENOME_ACCESSION
Ga0123519_10000481 | GENOME_ACCESSION
Ga0123519_10002165 | GENOME_ACCESSION TABLE 2A-continued Cas 12 proteins
Cas 12 proteins Ga0123519__10002912 | GENOME__ACCESSION
Ga0123519__10003344 | GENOME__ACCESSION
Ga0123519__10003852 | GENOME__ACCESSION
Ga0123519__10021143 | GENOME__ACCESSION
Ga0123519__10027137 | GENOME__ACCESSION
Ga0123519__10057643 | GENOME__ACCESSION
Ga0123519__10064432 | GENOME__ACCESSION
Ga0124943__1106748 | GENOME__ACCESSION
Ga0124945__1030784 | GENOME__ACCESSION
Ga0133944__1001807 | GENOME__ACCESSION
Ga0134095__1000962 | GENOME__ACCESSION
Ga0137716__10003017 | GENOME__ACCESSION
Ga0137716__10003038 | GENOME__ACCESSION
Ga0137716__10003531 | GENOME__ACCESSION
Ga0137716__10006890 | GENOME__ACCESSION
Ga0137716__10009026 | GENOME__ACCESSION
Ga0137716__10009341 | GENOME__ACCESSION
Ga0137716__10027208 | GENOME__ACCESSION
Ga0137716__10032400 | GENOME__ACCESSION
Ga0137716__10033855 | GENOME__ACCESSION
Ga0137716__10038387 | GENOME__ACCESSION
Ga0137716__10042212 | GENOME__ACCESSION
Ga0137716__10061480 | GENOME__ACCESSION
Ga0172363__10016551 | GENOME__ACCESSION
Ga0172365__10006450 | GENOME__ACCESSION
Ga0172382__10012866 | GENOME__ACCESSION
Ga0180300__10000403 | GENOME__ACCESSION
Ga0180301__10011215 | GENOME__ACCESSION
Ga0180435__10008691 | GENOME__ACCESSION
Ga0180446__1198 | GENOME__ACCESSION
Ga0181613__1004254 | GENOME__ACCESSION
Ga0181613__1005053 | GENOME__ACCESSION
Ga0181858__1004277 | GENOME__ACCESSION
Ga0182014__10001887 | GENOME__ACCESSION
Ga0186994__110 | GENOME__ACCESSION
Ga0187028__105 | GENOME__ACCESSION
Ga0187073__104 | GENOME__ACCESSION
Ga0187107__1033 | GENOME__ACCESSION
Ga0187121__108 | GENOME__ACCESSION
Ga0187143__105 | GENOME__ACCESSION
Ga0187864__10009485 | GENOME__ACCESSION
Ga0190309__1003062 | GENOME__ACCESSION
Ga0190334__1000016 | GENOME__ACCESSION
Ga0190361__1000443 | GENOME__ACCESSION
Ga0190361__1001609 | GENOME__ACCESSION
Ga0190361__1003780 | GENOME__ACCESSION 27
Ga0190361__1003780 | GENOME__ACCESSION 31
Ga0190363__1000125 | GENOME__ACCESSION
Ga0194111__10067953 | GENOME__ACCESSION
Ga0207429__10023 | GENOME__ACCESSION
Ga0207433__10006213 | GENOME__ACCESSION
Ga0207433__10011113 | GENOME__ACCESSION
Ga0207433__10012523 | GENOME__ACCESSION
Ga0207433__10020534 | GENOME__ACCESSION
Ga0207433__10021674 | GENOME__ACCESSION
Ga0207433__10022806 | GENOME__ACCESSION
Ga0207433__10030792 | GENOME__ACCESSION
Ga0207433__10045901 | GENOME__ACCESSION
Ga0207433__10075234 | GENOME__ACCESSION
Ga0207433__10075916 | GENOME__ACCESSION
Ga0207433__10082276 | GENOME__ACCESSION
Ga0207747__1007959 | GENOME__ACCESSION
Ga0207868__1000002 | GENOME__ACCESSION
Ga0208151__102415 | GENOME__ACCESSION
Ga0208195__1004385 | GENOME__ACCESSION
Ga0208357__1002034 | GENOME__ACCESSION
Ga0208429__100128 | GENOME__ACCESSION
Ga0208429__100584 | GENOME__ACCESSION
Ga0208429__100770 | GENOME__ACCESSION
Ga0208461__1008711 | GENOME__ACCESSION
Ga0208609__100002 | GENOME__ACCESSION
Ga0208683__103187 | GENOME__ACCESSION
Ga0208683__103849 | GENOME__ACCESSION
Ga0208683__104403 | GENOME__ACCESSION
Ga0208940__1001448 | GENOME__ACCESSION
Ga0209012__1000842 | GENOME__ACCESSION
Ga0209012__1001252 | GENOME__ACCESSION TABLE 2A-continued Cas 12 proteins
Cas 12 proteins Ga0209012_1015334 | GENOME_ACCESSION
Ga0209018_1000172 | GENOME_ACCESSION
Ga0209101_1000507 | GENOME_ACCESSION
Ga0209101_1006392 | GENOME_ACCESSION
Ga0209102_1000334 | GENOME_ACCESSION
Ga0209102_1003688 | GENOME_ACCESSION
Ga0209143_1000788 | GENOME_ACCESSION
Ga0209143_1002248 | GENOME_ACCESSION
Ga0209143_1006289 | GENOME_ACCESSION
Ga0209162_1014546 | GENOME_ACCESSION
Ga0209171_10000726 | GENOME_ACCESSION
Ga0209172_10015399 | GENOME_ACCESSION
Ga0209201_1007464 | GENOME_ACCESSION
Ga0209207_1001084 | GENOME_ACCESSION
Ga0209207_1006579 | GENOME_ACCESSION
Ga0209224_1000001 | GENOME_ACCESSION
Ga0209225_1002268 | GENOME_ACCESSION
Ga0209399_10016114 | GENOME_ACCESSION
Ga0209410_1010848 | GENOME_ACCESSION
Ga0209467_1000554 | GENOME_ACCESSION
Ga0209507_1000982 | GENOME_ACCESSION
Ga0209513_1002134 | GENOME_ACCESSION
Ga0209542_10001012 | GENOME_ACCESSION
Ga0209542_10007289 | GENOME_ACCESSION
Ga0209669_100016 | GENOME_ACCESSION
Ga0209669_101200 | GENOME_ACCESSION
Ga0209750_1000252 | GENOME_ACCESSION
Ga0209827_10659006 | GENOME_ACCESSION
Ga0209980_10011112 | GENOME_ACCESSION
Ga0210049_1040060 | GENOME_ACCESSION
Ga0210051_1028938 | GENOME_ACCESSION
Ga0210057_1032582 | GENOME_ACCESSION
Ga0214474_1011027 | GENOME_ACCESSION
Ga0255343_1026926 | GENOME_ACCESSION
Ga0255346_1002844 | GENOME_ACCESSION
Ga0255355_1000451 | GENOME_ACCESSION
Ga0255811_11272827 | GENOME_ACCESSION
Ga0255812_10127107 | GENOME_ACCESSION
Ga0272445_1000517 | GENOME_ACCESSION
Ga0272446_1000057 | GENOME_ACCESSION
Ga0272446_1000164 | GENOME_ACCESSION
Ga0272446_1001728 | GENOME_ACCESSION 137
Ga0272446_1001728 | GENOME_ACCESSION 249
Ga0272446_1001929 | GENOME_ACCESSION
Ga0272446_1017314 | GENOME_ACCESSION
Ga0272447_1003507 | GENOME_ACCESSION
Ga0272448_1000001 | GENOME_ACCESSION
Ga0272448_1000002 | GENOME_ACCESSION
Ga0272448_1000009 | GENOME_ACCESSION
Ga0272448_1000011 | GENOME_ACCESSION
Ga0272448_1000062 | GENOME_ACCESSION
Ga0272448_1000167 | GENOME_ACCESSION
Ga0272448_1002516 | GENOME_ACCESSION
Ga0272448_1011735 | GENOME_ACCESSION
Ga0272448_1059621 | GENOME_ACCESSION
Ga0272448_1067731 | GENOME_ACCESSION
Ga0272449_1002236 | GENOME_ACCESSION
Ga0272449_1004365 | GENOME_ACCESSION
Ga0272449_1006528 | GENOME_ACCESSION
Ga0272449_1019852 | GENOME_ACCESSION
Ga0302046_10000852 | GENOME_ACCESSION
Ga0302192_10026063 | GENOME_ACCESSION
Ga0302246_1000265 | GENOME_ACCESSION
Ga0302251_1001844 | GENOME_ACCESSION
Ga0302253_1002416 | GENOME_ACCESSION
Ga0307340_100872 | GENOME_ACCESSION
Ga0308310_1004946 | GENOME_ACCESSION
Ga0308310_1013800 | GENOME_ACCESSION
Ga0308411_10001123 | GENOME_ACCESSION
Ga0308411_10021369 | GENOME_ACCESSION
Ga0308414_1002480 | GENOME_ACCESSION
Ga0308414_1007395 | GENOME_ACCESSION
Ga0308414_1018540 | GENOME_ACCESSION
Ga0308415_1006042 | GENOME_ACCESSION
Ga0308419_1006240 | GENOME_ACCESSION
Ga0308419_1011938 | GENOME_ACCESSION
Ga0310136_000087 | GENOME_ACCESSION TABLE 2A-continued

| Cas 12 proteins |
| --- |
| Cas 12 proteins |

Ga0310138_009337 | GENOME_ACCESSION
Ga0310146_00181 | GENOME_ACCESSION
Ga0310828_1006812 | GENOME_ACCESSION
Ga0311022_13670299 | GENOME_ACCESSION
Ga0315269_0011078 | GENOME_ACCESSION
Ga0315269_0014929 | GENOME_ACCESSION
Ga0315269_0030078 | GENOME_ACCESSION
Ga0315277_10001015 | GENOME_ACCESSION
Ga0315280_10009663 | GENOME_ACCESSION
Ga0315280_10032046 | GENOME_ACCESSION
Ga0315282_10006339 | GENOME_ACCESSION
Ga0315282_10053614 | GENOME_ACCESSION
Ga0315285_10079970 | GENOME_ACCESSION
Ga0315288_10142264 | GENOME_ACCESSION
Ga0315298_1000517 | GENOME_ACCESSION
Ga0315298_1001941 | GENOME_ACCESSION
Ga0315298_1005332 | GENOME_ACCESSION
Ga0315298_1007399 | GENOME_ACCESSION
Ga0315298_1007594 | GENOME_ACCESSION
Ga0315298_1015991 | GENOME_ACCESSION
Ga0315903_10087816 | GENOME_ACCESSION
Ga0334883_1024988 | GENOME_ACCESSION
Ga0334884_1015165 | GENOME_ACCESSION
Ga0370516_000963 | GENOME_ACCESSION
Ga0370516_004838 | GENOME_ACCESSION
Ga0370516_008232 | GENOME_ACCESSION
Ga0370516_009639 | GENOME_ACCESSION
Ga0370516_018229 | GENOME_ACCESSION
Ga0370516_020865 | GENOME_ACCESSION
Ga0373397_000168 | GENOME_ACCESSION
Ga0373621_000479 | GENOME_ACCESSION
Ga0373621_007959 | GENOME_ACCESSION
Ga0373621_010685 | GENOME_ACCESSION
Ga0373621_017562 | GENOME_ACCESSION
Ga0373621_020135 | GENOME_ACCESSION
Ga0373621_023545 | GENOME_ACCESSION
Ga0373621_050562 | GENOME_ACCESSION
Ga0373637_0010996 | GENOME_ACCESSION
Ga0373637_0021496 | GENOME_ACCESSION
Ga0373637_0024972 | GENOME_ACCESSION
Ga0373637_0031827 | GENOME_ACCESSION
Ga0373637_0034837 | GENOME_ACCESSION
Ga0373637_0065620 | GENOME_ACCESSION
Ga0374803_055 | GENOME_ACCESSION
GCA_000092125.1 | *Meiothermus silvanus* DSM 9946 plasmid pMESIL02
GCA_000444055.1 | *Alicyclobacillus acidoterrestris* ATCC 49025 contig_23
GCA_000444055.1 | *Alicyclobacillus acidoterrestris* ATCC 49025 contig_26
GCA_000832185.1_ASM83218v1 | *Bacillus thermoamylovorans* strain B4167 NODE_88
GCA_002951815.1_ASM295181v1 | *Sulfobacillus thermotolerans* strain Kr chromosome
GCA_004343255.1_ASM434325v1 | *Laceyella sacchari* strain DSM 43356 Ga0244645_102
GCA_006503695.1 | *Tepidiphilus succinatimandens* strain DSM 15512 Scaffold2
GCA_006503695.1_ASM650369v1 | *Tepidiphilus succinatimandens* strain DSM 15512 Scaffold2
GCA_900116805.1 | *Alicyclobacillus macrosporangiidus* strain DSM 17980 genome assembly
GCA_900129915.1 | *Tepidibacter thalassicus* DSM 15285 genome assembly
JGI12383J13903_1002647 | GENOME_ACCESSION
JGI24108J20142_1001595 | GENOME_ACCESSION
JGI24721J44947_10029740 | GENOME_ACCESSION
JGI24721J44947_10039167 | GENOME_ACCESSION
JGI26463J51803_1000081 | GENOME_ACCESSION
KE386988.1_organ | *Desulfatirhabdium butyrativorans* DSM 18734 genomic scaffold G492DRAFT_scaffold00017.17
KE387196.1_organ | *Tuberibacillus caliclus* DSM 17572 genomic scaffold H532DRAFT_scaffold00011.11
LGRA01000008.1_o | *Azospirillum* sp. TSO35-2 Contig02
LNAA02000020.1_o | Oscillatoriales cyanobacterium MTP1 Contig_26
mgm4742482.3 | NODE_1674_length_13888_cov_4.96582_ID_49155357 | GENOME_ACCESSION
MHOL01000010.1_o | Candidatus Staskawiczbacteria bacterium RIFCSPHIGHO2_01_FULL_34_27 rifcsphigho2_01_scaffold_2126
MHPA01000001.1_o | Candidatus Staskawiczbacteria bacterium RIFCSPLOWO2_01_FUL_38_12b rifcsplowo2_01_scaffold_12327
MTKY01071110.1_o | Anaerobic digester metagenome soeholt_digester_71110
MVGR01000004.1_o | *Microcystis aeruginosa* KW Contig4
NICF_comb_assmDRAFT_10010420 | GENOME_ACCESSION
NJDI01000010.1_o | *Archaeoglobales archaeon* ex4484_92 ex4484_82_scaffold_1630_length_14867_count_1478
OGCG01005283.1_o | hot springs metagenome genome assembly
OGCG01007631.1_o | hot springs metagenome genome assembly
OKRQ01000045.1_o | freshwater metagenome genome assembly
OQOO01000421.1_o | human oral metagenome genome assembly
OQUW01.1 | hot springs metagenome genome assembly

TABLE 2A-continued

| Cas 12 proteins |
|---|
| Cas 12 proteins |

OQUW01000094.1_o | hot springs metagenome genome assembly
OQUW01000235.1_o | hot springs metagenome genome assembly
OQUW01001775.1_o | hot springs metagenome genome assembly
ORXB01007227.1_o | sediment metagenome genome assembly
OVXJ01001238.1_o | sediment metagenome genome assembly
QNAW01000106.1_o | Thermodesulfobacteria bacterium isolate B8_G2 B8_Guay2_scaffold_12966
UOVV01006324.1_o | compost metagenome genome assembly
UPSJ01002360.1_o | activated sludge metagenome genome assembly
YNPsite07_CeleraDRAF_scf1119010704098 | GENOME_ACCESSION
Ga0065721_10050166 | GENOME_ACCESSION: BioRi_2199352012_$F_3300005286 GENOME_ID: 23829 CONTIG_ID: 14524
Ga0255812_10583625 | GENOME_ACESSION: IMG_3300023203_$F_3300023203 GENOME_ID: 30040 CONTIG_ID: 32030
Ga0265297_10015673 | GENOME_ACESSION: Munlanlwell13791_2_$F_3300029288 GENOME_ID: 280701 CONTIG_ID: 15672
Ga0315280_10014676 | GENOME_ACESSION: YL17G06_40_MG_2_&F_3300031862 GENOME_ID: 281631 CONTIG_ID: 14675
Ga0206102_1000160 | GENOME_ACESSION: 1B1Ametagenome_2_$F_3300020149 GENOME_ID: 20785 CONTIG_ID: 159
Ga0207869_1001742 | GENOME_ACESSION: HigsolAR5DSPAdes_$F_3300025517 GENOME_ID: 27181 CONTIG_ID: 1741
Ga0209347_1001125 | GENOME_ACESSION: AutmicBR23SPAdes_$F_3300027640 GENOME_ID: 23478 CONTIG_ID: 1124
*Alicyclobacillus kakegawensis* NBRC 103104 DNA, contig: AK2_CON0027_0001, whole genome shotgun
sequence | GENOME_ACESSION: GCA_001552655.1_ASM155265v1_genomic GENOME_ID: 98642 CONTIG_ID: 26
FNOJ0100000035.1
*Alicyclobacillus hesperidium* strain DSM 12489 genome assembly, contig: Ga0074806_135, whole genome shotgun sequence |
GENOME_ACESSION: GCA_900107035.1_IMG-taxon_2634166329_annotated_assembly_genomic GENOME_ID: 184129 CONTIG_ID: 49
OQOO010000421.1
human oral metagenome genome assembly, contig: NODE_421_length_10358_cov_14.800155, whole genome shotgun
sequence | GENOME_ACESSION: OQOO01.1 GENOME_ID: 9995 CONTIG_ID: 420
bioreactor metagenome genome assembly, contig: NODE_247_length_93349_cov_7.384563, whole genome shotgun
sequence | GENOME_ACCESSION: OWPA01.1 GENOME_ID: 12159 CONTIG_ID: 246
PGUZ01000040.1
*Bacillus* sp. V3-13 contig_40, whole genome shotgun sequence | GENOME_ACCESSION:
GCA_002860165.1_ASM286016v1_genomic GENOME_ID: 150146 CONTIG_ID: 56
RHHN01000007.1
*Brevibacillus agri* strain NRRL NRS 1219 contig_7, whole genome shotgun sequence |
GENOME_ACCESSION: GCA_003710885.1_ASM371088v1_genomic GENOME_ID: 202321 CONTIG_ID: 115
RHHS01000035.1
*Brevibacillus gelaini* strain DSM 100115 contig_35, whole genome shotgun sequence |
GENOME_ACESSION: GCA_003710935.1_ASM371093v1_genomic GENOME_ID: 202324 CONTIG_ID: 28
AacCas12b
AapCas12b
BrCas12b

TABLE 2B

| Cas 12 proteins |
|---|
| Cas 12 proteins |

(65C) Ga0209381_1004188 | GENOME_ACCESSION
a0212093_1001507 | Ga0212093_1001507 | GENOME_ACCESSION
DCUT01000059.1_o | TPA_asm: Syntrophaceae bacterium UBA2207 UBA2207_contig_83649, whole
genome shotgun sequence | GENOME_ACESSION: GCA_002328545.1_ASM232854v1_genomic
GENOME_ID: 131523 CONTIG_ID: 133
FQUK01000003.1_o | *Thermomonas hydrothermalis* strain DSM 14834 genome assembly
Ga0067045_1002454 | GENOME_ACCESSION
Ga0067045_1004962 | GENOME_ACCESSION]
Ga0116159_1001590 | GENOME_ACCESSION
Ga0116160_1008286 | GENOME_ACCESSION
Ga0116161_1004008 | GENOME_ACCESSION
Ga0116167_1006930 | GENOME_ACCESSION
Ga0116184_10002336 | GENOME_ACCESSION
Ga0123519_10002912 | GENOME_ACCESSION
Ga0123519_10003852 | GENOME_ACCESSION
Ga0137716_10027208 | GENOME_ACCESSION
Ga0172382_10012866 | GENOME_ACCESSION
Ga0180435_10008691 | GENOME_ACCESSION
Ga0182014_10001887 | GENOME_ACCESSION
Ga0187107_1033 | GENOME_ACCESSION
Ga0187864_10009485 | GENOME_ACCESSION
Ga0208195_1004385 | GENOME_ACCESSION
Ga0208357_1002034 | GENOME_ACCESSION
Ga0208609_100002 | GENOME_ACCESSION
Ga0209012_1001252 | GENOME_ACCESSION
Ga0209018_1000172 | GENOME_ACCESSION
Ga0209507_1000982 | GENOME_ACCESSION
Ga0209513_1002134 | GENOME_ACCESSION
Ga0255346_1002844 | GENOME_ACCESSION
Ga0255812_10127107 | GENOME_ACCESSION

TABLE 2B-continued

Cas 12 proteins
Cas 12 proteins

Ga0272448_1000001 | GENOME_ACCESSION
Ga0272448_1000009 | GENOME_ACCESSION
Ga0272448_1000167 | GENOME_ACCESSION
Ga0272448_1002516 | GENOME_ACCESSION
Ga0302246_1000265 | GENOME_ACCESSION
Ga0302251_1001844 | GENOME_ACCESSION
Ga0302253_1002416 | GENOME_ACCESSION
Ga0310136_000087 | GENOME_ACCESSION
Ga0315298_1005332 | GENOME_ACCESSION
Ga0315298_1015991 | GENOME_ACCESSION
Ga0334884_1015165 | GENOME_ACCESSION
Ga0373637_0010996 | GENOME_ACCESSION
Ga0373637_0024972 | GENOME_ACCESSION
Ga0373637_0031827 | GENOME_ACCESSION
GCA_000444055.1 | *Alicyclobacillus acidoterrestris* ATCC 49025 contig_26
GCA_000832185.1_ASM83218v1 | *Bacillus thermoamylovorans* strain B4167 NODE_88
GCA_002951815.1_ASM295181v1 | *Sulfobacillus thermotolerans* strain Kr chromosome
GCA_004343255.1_ASM434325v1 | *Laceyella sacchari* strain DSM 43356 Ga0244645_102
GCA_900116805.1 | *Alicyclobacillus macrosporangiidus* strain DSM 17980 genome assembly
KE386988.1_organ | *Desulfatirhabdium butyrativorans* DSM 18734 genomic scaffold G492DRAFT_scaffold00017.17
KE387196.1_organ | *Tuberibacillus calidus* DSM 17572 genomic scaffold H532DRAFT_scaffold00011.11
LNAA02000020.1_o | Oscillatoriales cyanobacterium MTP1 Contig_26
OQUW01000094.1_o | hot springs metagenome genome assembly
OQUW01001775.1_o | hot springs metagenome genome assembly
Ga0255812_10583625 | GENOME_ACESSION: IMG_3300023203_$F_3300023203 GENOME_ID: 30040 CONTIG_ID: 32030
Ga0065721_10050166 | GENOME_ACCESSION: BioRi_2199352012_$F_3300005286 GENOME_ID: 23829 CONTIG_ID: 14524
Ga0265297_10015673 | GENOME_ACESSION: Munlanlwell13791_2_$F_3300029288 GENOME_ID: 280701 CONTIG_ID: 15672
Ga0315280 10014676 | GENOME_ACESSION: YL17G06_40_MG_2_$F_3300031862 GENOME_ID: 281631 CONTIG_ID: 14675
Ga0206102_1000160 | GENOME_ACESSION: 1B1Ametagenome_2_$F_3300020149 GENOME_ID: 20785 CONTIG_ID: 159
Ga0207869_1001742 | GENOME_ACESSION: HigsolAR5DSPAdes_$F_3300025517 GENOME_ID: 27181 CONTIG_ID: 1741
Ga0209347_1001125 | GENOME_ACESSION: AutmicBR23SPAdes_$F_3300027640 GENOME_ID: 23478 CONTIG_ID: 1124
*Alicyclobacillus kakegmvensis* NBRC 103104 DNA, contig: AK2_CON0027_0001, whole genome shotgun sequence | GENOME_ACESSION: GCA_001552655.1_ASM155265v1_genomic GENOME_ID: 98642 CONTIG_ID: 26
FNOJ0100000035.1
*Alicyclobacillus hesperidum* strain DSM 12489 genome assembly, contig: Ga0074806_135, whole genome shotgun sequence | GENOME_ACESSION: GCA_900107035.1_IMG-taxon_2634166329_annotated_assembly_genomic GENOME_ID: 184129 CONTIG_ID: 49
OQOO010000421.1
human oral metagenome genome assembly, contig: NODE_421_length_10358_cov_14.800155, whole genome shotgun sequence | GENOME_ACESSION: OQOO01.1 GENOME_ID: 9995 CONTIG_ID: 420
bioreactor metagenome genome assembly, contig: NODE_247_length_93349_cov_7.384563, whole genome shotgun sequence | GENOME_ACCESSION: OWPA01.1 GENOME_ID: 12159 CONTIG_ID: 246
PGUZ01000040.1
*Bacillus* sp. V3-13 contig_40, whole genome shotgun sequence | GENOME_ACCESSION: GCA_002860165.1_ASM286016v1_genomic GENOME_ID: 150146 CONTIG_ID: 56
RHHN01000007.1
*Brevibacillus agri* strain NRRL NRS 1219 contig_7, whole genome shotgun sequence | GENOME_ACCESSION: GCA_003710885.1_ASM371088v1_genomic GENOME_ID: 202321 CONTIG_ID: 115
RHHS01000035.1
*Brevibacillus gelatini* strain DSM 100115 contig_35, whole genome shotgun sequence | GENOME_ACESSION: GCA_003710935.1_ASM371093v1_genomic GENOME_ID: 202324 CONTIG_ID: 28
AacCas12b
AapCas12b
BrCas12b In certain embodiments, the CRISPR-Cas protein is a Cas12b from a thermostable species, for example *Alicyclobacillus acidiphilus* (Aap). Cas 12a proteins can be identified from similar organisms as identified in any of BROD_5090P4_Cas12b_sequences.txt. In certain embodiments, the thermostable CRISPR-Cas protein is a Cas13a. In an aspect, the Cas13a thermostable protein is from FIG. 1A of U.S. Provisional Application 62/967,408, filed Jan. 29, 2020, entitled "Novel CRISPR Enzymes and Systems" which were identified from stable anaerobic thermophilic methanogenic microbiomes fermenting switchgrass, supporting their thermostability. See, Liang et al., Biotechnol Biofuels 2018; 11: 243 doi: 10.1186/s13068-018-1238-1. Similarly, the 0J26742_10014101 clusters with the verified thermophilic sourced Cas13a sequences detailed in FIG. 1A of U.S. Provisional Application 62/967,408, filed Jan. 29, 2020, entitled "Novel CRISPR Enzymes and Systems". The nucleic acid identified at loci 123519_10037894 was identified from a study focusing on 70° C. organism. In certain example embodiments, the Cas13 orthologue has at least two HEPN domains and at least 80% identity to a polypeptide encoded by the nucleic acid sequence 0123519_10037894 or 0J26742_10014101.

Figure 4:
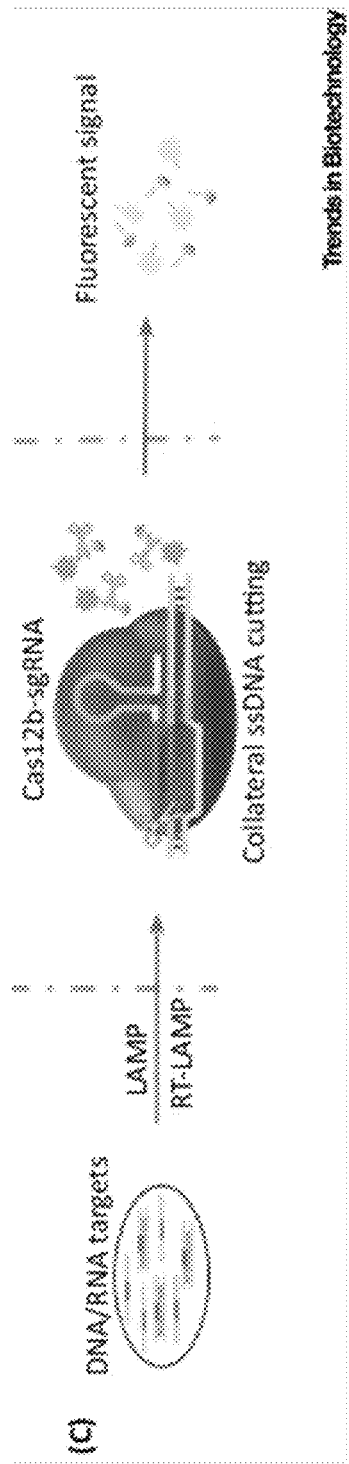
FIG. 4—Schematic for developing a one pot RT-LAMP Cas12b SHERLOCK reaction.
Figure 5:
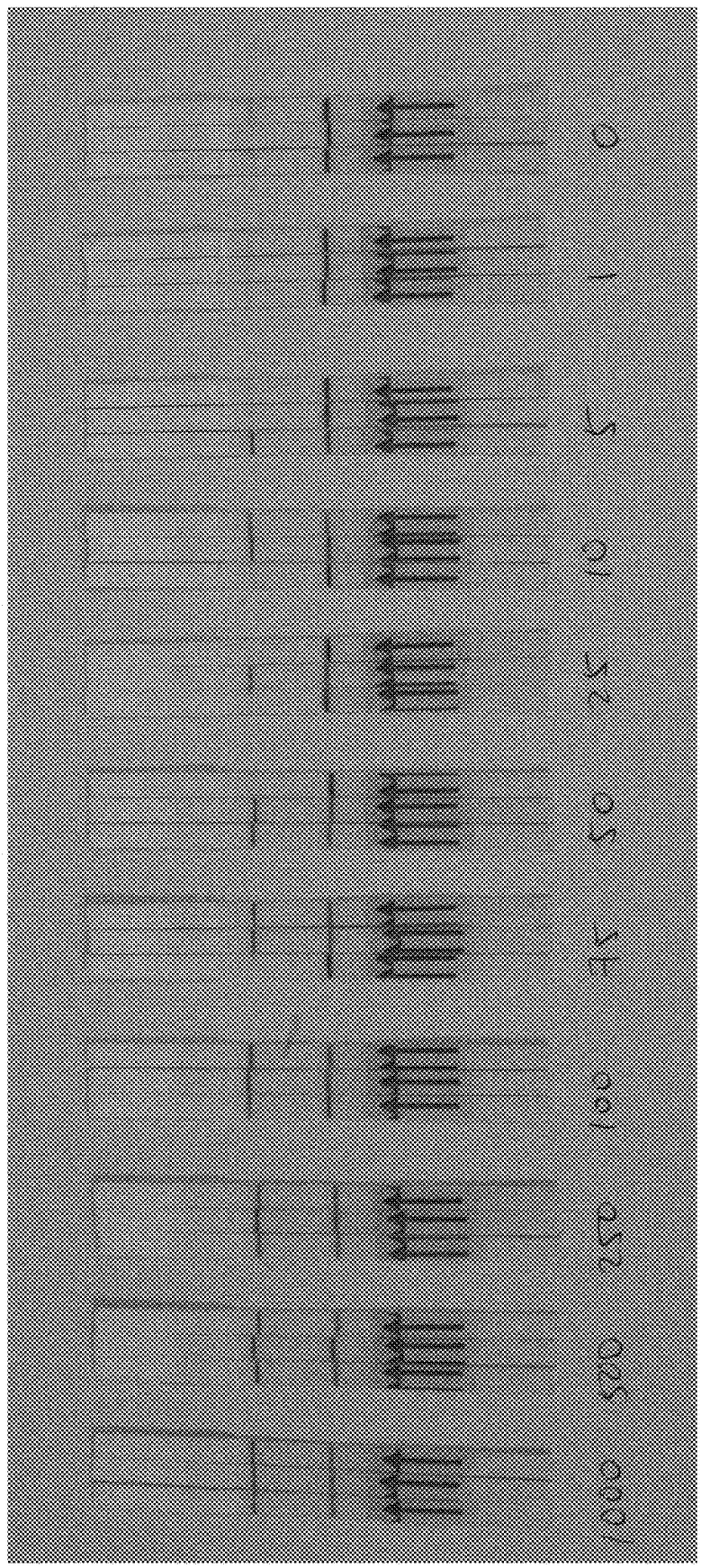
FIG. 5—Figure shows results obtained for assessing limit of detection by lateral flow assay at 60° C. for 60 minutes. The limit of detection was 100 molecules per reaction.

Certain example embodiments disclosed herein provide are based on low-cost CRISPR-based diagnostic that enables single-molecule detection of DNA or RNA with single-nucleotide specificity (Gootenberg, 2018; Gootenberg, et al, Science. 2017 Apr. 28; 356(6336):438-442 (2017); Myhrvold, et al., Science 360, 444-448 (2018)). Nucleic acid detection with SHERLOCK relies on the collateral activity of Type VI and Type V Cas proteins, such as Cas13 and Cas12, which unleashes promiscuous cleavage of reporters upon target detection (Gooteneberg et al., 2018) (Abudayyeh, et al., Science. 353(6299) (2016); East-Seletsky et al. *Nature* 538:270-273 (2016); Smargon et al. *Mol Cell* 65(4):618-630 (2017)). Certain embodiments disclosed herein, are capable of single-molecule detection in less than an hour and can be used for multiplexed target detection when using CRISPR enzymes with orthogonal cleavage preference, such as Cas13a from *Leptotrichia wadei* (LwaCas13a), Cas13b from *Capnocytophaga canimorsus* Cc5 (CcaCas13b), and Cas12a from *Acidaminococcus* sp. BV3L6 (AsCas12a); *Alicyclobacillus acidiphilus* (Aap) Cas 12b and *Brevibacillus* sp. SYSU G02855 (BrCas12b); (Gootenberg, 2018; Myhrvold et al. *Science* 360(6387):444-448 (2018); Gootenberg, 2017; Chen et al. *Science* 360(6387): 436-439 (2018); Li et al. *Cell Rep* 25(12):3262-3272 (2018); Li et al. *Nat Protoc* 13(5):899-914 (2018)). Guide molecules used herein are designed using a model for high activity-based Cas guide selection for coronavirus would facilitate design of optimal diagnostic assays, especially in applications requiring high-activity guides like lateral flow detection, and enable guide RNA design for in vivo RNA targeting applications with Cas13 has also been detailed in U.S. Provisional Applications 62/818,702 filed Mar. 14, 2019, now PCT/US20/22795 and 62/890,555, filed Aug. 22, 2019, now PCT/US20/22795, both entitled CRISPR Effector System Based Multiplex Diagnostics, incorporated herein by reference in their entirety, and, in particular, Examples 1-4, Tables 1-8 and FIG. 4A of U.S. Provisional Application 62/890,555.

Embodiments disclosed herein utilize Cas proteins possessing non-specific nuclease collateral activity to cleave detectable reporters upon target recognition, providing sensitive and specific diagnostics, including single nucleotide variants, detection based on rRNA sequences, screening for drug resistance, monitoring microbe outbreaks, genetic perturbations, and screening of environmental samples, as described, for example, in PCT/US18/054472 filed Oct. 22, 2018 at [0183]-[0327], incorporated herein by reference. Reference is made to WO 2017/219027, WO2018/107129, US20180298445, US 2018-0274017, US 2018-0305773, WO 2018/170340, U.S. application Ser. No. 15/922,837, filed Mar. 15, 2018 entitled "Devices for CRISPR Effector System Based Diagnostics", PCT/US18/50091, filed Sep. 7, 2018 "Multi-Effector CRISPR Based Diagnostic Systems", PCT/US18/66940 filed Dec. 20, 2018 entitled "CRISPR Effector System Based Multiplex Diagnostics", PCT/US18/054472 filed Oct. 4, 2018 entitled "CRISPR Effector System Based Diagnostic", U.S. Provisional 62/740,728 filed Oct. 3, 2018 entitled "CRISPR Effector System Based Diagnostics for Hemorrhagic Fever Detection", U.S. Provisional 62/690,278 filed Jun. 26, 2018 and U.S. Provisional 62/767,059 filed Nov. 14, 2018 both entitled "CRISPR Double Nickase Based Amplification, Compositions, Systems and Methods", U.S. Provisional 62/690,160 filed Jun. 26, 2018 and 62/767,077 filed Nov. 14, 2018, both entitled "CRISPR/CAS and Transposase Based Amplification Compositions, Systems, And Methods", U.S. Provisional 62/690,257 filed Jun. 26, 2018 and 62/767,052 filed Nov. 14, 2018 both entitled "CRISPR Effector System Based Amplification Methods, Systems, And Diagnostics", U.S. Provisional 62/767,076 filed Nov. 14, 2018 entitled "Multiplexing Highly Evolving Viral Variants With SHERLOCK" and 62/767,070 filed Nov. 14, 2018 entitled "Droplet SHERLOCK." Reference is further made to WO2017/127807, WO2017/184786, WO 2017/184768, WO 2017/189308, WO 2018/035388, WO 2018/170333, WO 2018/191388, WO 2018/213708, WO 2019/005866, PCT/US18/67328 filed Dec. 21, 2018 entitled "Novel CRISPR Enzymes and Systems", PCT/US18/67225 filed Dec. 21, 2018 entitled "Novel CRISPR Enzymes and Systems" and PCT/US18/67307 filed Dec. 21, 2018 entitled "Novel CRISPR Enzymes and Systems", U.S. 62/712,809 filed Jul. 31, 2018 entitled "Novel CRISPR Enzymes and Systems", U.S. 62/744,080 filed Oct. 10, 2018 entitled "Novel Cas12b Enzymes and Systems" and U.S. 62/751,196 filed Oct. 26, 2018 entitled "Novel Cas12b Enzymes and Systems", U.S. 715,640 filed August 7, 2-18 entitled "Novel CRISPR Enzymes and Systems", WO 2016/205711, U.S. Pat. No. 9,790,490, WO 2016/205749, WO 2016/205764, WO 2017/070605, WO 2017/106657, and WO 2016/149661, WO2018/035387, WO2018/194963, Cox D B T, et al., RNA editing with CRISPR-Cas13, Science. 2017 Nov. 24; 358(6366):1019-1027; Gootenberg J S, et al., Multiplexed and portable nucleic acid detection platform with Cas13, Cas12a, and Csm6., Science. 2018 Apr. 27; 360 (6387):439-444; Gootenberg J S, et al., Nucleic acid detection with CRISPR-Cas13a/C2c2., Science. 2017 Apr. 28; 356(6336):438-442; Abudayyeh 00, et al., RNA targeting with CRISPR-Cas13, Nature. 2017 Oct. 12; 550(7675):280-284; Smargon A A, et al., Cas13b Is a Type VI-B CRISPR-Associated RNA-Guided RNase Differentially Regulated by Accessory Proteins Csx27 and Csx28. Mol Cell. 2017 Feb. 16; 65(4):618-630.e7; Abudayyeh O O, et al., C2c2 is a single-component programmable RNA-guided RNA-targeting CRISPR effector, Science. 2016 Aug. 5; 353(6299): aaf5573; Yang L, et al., Engineering and optimising deaminase fusions for genome editing. Nat Commun. 2016 Nov. 2; 7:13330, Myhrvold et al., Field deployable viral diagnostics using CRISPR-Cas13, Science 2018 360, 444-448, Shmakov et al. "Diversity and evolution of class 2 CRISPR-Cas systems," Nat Rev Microbiol. 2017 15(3):169-182, each of which is incorporated herein by reference in its entirety.

In general, a CRISPR-Cas or CRISPR system as used herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a Cas13 protein, a tracrRNA is not required. Cas13 has been described in Abudayyeh et al. (2016) "C2c2 is a single-component programmable RNA-guided RNA-targeting CRISPR effector"; Science; DOI: 10.1126/science.aaf5573; and Shmakov et al. (2015) "Discovery and Functional Characterization of Diverse Class 2 CRISPR-Cas Systems", Molecular Cell, DOI: dx.doi.org/10.1016/j.molcel.2015.10.008; which are incorporated herein in their entirety by reference. Cas13b has been described in Smargon et al. (2017) "Cas13b Is a Type VI-B CRISPR-Associated RNA-Guided RNases Differentially Regulated by Accessory Proteins Csx27 and Csx28," Molecular Cell. 65, 1-13; dx.doi.org/10.1016/j.molcel.2016.12.023., which is incorporated herein in its entirety by reference.

In certain embodiments, protospacer flanking site, or protospacer flanking sequence (PFS) directs binding of the effector proteins (e.g Type VI) as disclosed herein to the target locus of interest. A PFS is a region that can affect the efficacy of Cas13a mediated targeting, and may be adjacent to the protospacer target in certain Cas13a proteins, while other orthologs do not require a specific PFS. In a preferred embodiment, the CRISPR effector protein may recognize a 3' PFS. In certain embodiments, the CRISPR effector protein may recognize a 3' PFS which is 5'H, wherein H is A, C or U. See, e.g. Abudayyeh, 2016. In certain embodiments, the effector protein may be *Leptotrichia shahii* Cas13p, more preferably *Leptotrichia shahii* DSM 19757 Cas13, and the 3' PFS is a 5' H.

In the context of formation of a CRISPR complex, "target molecule" or "target sequence" or "target nucleic acid" refers to a molecule harboring a sequence, or a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell. A target sequence may comprise DNA polynucleotides.

As such, a CRISPR system may comprise RNA-targeting effector proteins. A CRISPR system may comprise DNA-targeting effector proteins. In some embodiments, a CRISPR system may comprise a combination of RNA- and DNA-targeting effector proteins, or effector proteins that target both RNA and DNA.

Other Example Type VI Cas Proteins

In some embodiments, one or more elements of a nucleic acid-targeting system is derived from a particular organism comprising an endogenous CRISPR RNA-targeting system. In certain example embodiments, the effector protein CRISPR RNA-targeting system comprises at least one HEPN domain, including but not limited to the HEPN domains described herein, HEPN domains known in the art, and domains recognized to be HEPN domains by comparison to consensus sequence motifs. Several such domains are provided herein. In one non-limiting example, a consensus sequence can be derived from the sequences of Cas13a or Cas13b orthologs provided herein. In certain example embodiments, the effector protein comprises a single HEPN domain. In certain other example embodiments, the effector protein comprises two HEPN domains.

In one example embodiment, the effector protein comprises one or more HEPN domains comprising a RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed in U.S. Provisional Patent Application 62/432,240 entitled "Novel CRISPR Enzymes and Systems," U.S. Provisional Patent Application 62/471,710 entitled "Novel Type VI CRISPR Orthologs and Systems" filed on Mar. 15, 2017, and U.S. Provisional Patent Application entitled "Novel Type VI CRISPR Orthologs and Systems," filed on Apr. 12, 2017.

In an embodiment of the invention, a HEPN domain comprises at least one RxxxxH motif comprising the sequence of R(N/H/K)X1X2X3H (SEQ ID NO: 61991-61993). In an embodiment of the invention, a HEPN domain comprises a RxxxxH motif comprising the sequence of R(N/H)X1X2X3H (SEQ ID NO: 61991 and SEQ ID NO: 61992). In an embodiment of the invention, a HEPN domain comprises the sequence of R(N/K)X1X2X3H (SEQ ID NO: 61991 and SEQ ID NO: 61993). In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

In particular embodiments, the Type VI RNA-targeting Cas enzyme is Cas13a. In other example embodiments, the Type VI RNA-targeting Cas enzyme is Cas13b. In certain embodiments, the Cas13b protein is from an organism of a genus selected from the group consisting of: *Bergeyella, Prevotella, Porphyromonas, Bacterioides, Alistipes, Riemerella, Myroides, Capnocytophaga, Porphyromonas, Flavobacterium, Porphyromonas, Chryseobacterium, Paludibacter, Psychroflexus, Riemerella,* Phaeodactylibacter, Sinomicrobium, *Reichenbachiella.*

In particular embodiments, the homologue or orthologue of a Type VI protein such as Cas13a as referred to herein has a sequence homology or identity of at least 30%, or at least 40%, or at least 50%, or at least 60%, or at least 70%, or at least 80%, more preferably at least 85%, even more preferably at least 90%, such as for instance at least 95% with a Type VI protein such as Cas13a (e.g., based on the wild-type sequence of any of *Leptotrichia shahii* Cas13a, Lachnospiraceae bacterium MA2020 Cas13a, Lachnospiraceae bacterium NK4A179 Cas13a, *Clostridium aminophilum* (DSM 10710) Cas13a, *Carnobacterium gallinarum* (DSM 4847) Cas13, *Paludibacter propionicigenes* (WB4) Cas13, *Listeria weihenstephanensis* (FSL R9-0317) Cas13, Listeriaceae bacterium (FSL M6-0635) Cas13, *Listeria newyorkensis* (FSL M6-0635) Cas13, *Leptotrichia wadei* (F0279) Cas13, *Rhodobacter capsulatus* (SB 1003) Cas13, *Rhodobacter capsulatus* (R121) Cas13, *Rhodobacter capsulatus* (DE442) Cas13, *Leptotrichia wadei* (Lw2) Cas13, or *Listeria seeligeri* (Cas13). In further embodiments, the homologue or orthologue of a Type VI protein such as Cas13 as referred to herein has a sequence identity of at least 30%, or at least 40%, or at least 50%, or at least 60%, or at least 70%, or at least 80%, more preferably at least 85%, even more preferably at least 90%, such as for instance at least 95% with the wild type Cas13 (e.g., based on the wild-type sequence of any of *Leptotrichia shahii* Cas13, Lachnospiraceae bacterium MA2020 Cas13, Lachnospiraceae bacterium NK4A179 Cas13, *Clostridium aminophilum* (DSM 10710) Cas13, *Carnobacterium gallinarum* (DSM 4847) Cas13, *Paludibacter propionicigenes* (WB4) Cas13, *Listeria weihenstephanensis* (FSL R9-0317) Cas13, Listeriaceae bacterium (FSL M6-0635) Cas13, *Listeria newyorkensis* (FSL M6-0635) Cas13, *Leptotrichia wadei* (F0279) Cas13, *Rhodobacter capsulatus* (SB 1003) Cas13, *Rhodobacter capsulatus* (R121) Cas13, *Rhodobacter capsulatus* (DE442) Cas13, *Leptotrichia wadei* (Lw2) Cas13, or *Listeria seeligeri* Cas13).

In certain other example embodiments, the CRISPR system the effector protein is a Cas13 nuclease. The activity of Cas13 may depend on the presence of two HEPN domains. These have been shown to be RNase domains, i.e. nuclease (in particular an endonuclease) cutting RNA. Cas13a HEPN may also target DNA, or potentially DNA and/or RNA. On the basis that the HEPN domains of Cas13a are at least capable of binding to and, in their wild-type form, cutting RNA, then it is preferred that the Cas13a effector protein has RNase function. Regarding Cas13a CRISPR systems, reference is made to U.S. Provisional 62/351,662 filed on Jun. 17, 2016 and U.S. Provisional 62/376,377 filed on Aug. 17, 2016. Reference is also made to U.S. Provisional 62/351,803 filed on Jun. 17, 2016. Reference is also made to U.S. Provisional entitled "Novel Crispr Enzymes and Systems" filed Dec. 8, 2016 bearing Broad Institute No. 10035.PA4. Reference is further made to East-Seletsky et al. "Two distinct RNase activities of CRISPR-C2c2 enable guide-RNA processing and RNA detection" Nature doi:10/1038/nature19802 and Abudayyeh et al. "C2c2 is a single-component programmable RNA-guided RNA targeting CRISPR effector" bioRxiv doi:10.1101/054742.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector protein complex (see, Samai et al., 2015, Cell, vol. 151, 1164-1174). A CRISPR-Cas system, composition or method targeting RNA via the present effector proteins is thus provided.

In an embodiment, the Cas protein may be a Cas13a ortholog of an organism of a genus which includes but is not limited to *Leptotrichia, Listeria,* Corynebacter, *Sutterella,* Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma and Campylobacter. Species of organism of such a genus can be as otherwise herein discussed.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to *Leptotrichia, Listeria,* Corynebacter, *Sutterella,* Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma and Campylobacter. A chimeric enzyme can comprise a first fragment and a second fragment, and the fragments can be of CRISPR enzyme orthologs of organisms of genera herein mentioned or of species herein mentioned; advantageously the fragments are from CRISPR enzyme orthologs of different species.

In embodiments, the Cas13a protein as referred to herein also encompasses a functional variant of Cas13a or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be manmade. Advantageous embodiments can involve engineered or non-naturally occurring Type VI RNA-targeting effector protein.

In an embodiment, nucleic acid molecule(s) encoding the Cas13 or an ortholog or homolog thereof, may be codon-optimized for expression in a eukaryotic cell. A eukaryote can be as herein discussed. Nucleic acid molecule(s) can be engineered or non-naturally occurring.

In an embodiment, the Cas13a or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the Cas13a or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the Cas1a3 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In certain example embodiments, the Cas13a effector protein may be from an organism selected from the group consisting of; *Leptotrichia, Listeria,* Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma,* and *Campylobacter.*

In certain embodiments, the effector protein may be a *Listeria* sp. Cas13p, preferably *Listeria seeligeria* Cas13p, more preferably *Listeria seeligeria* serovar 1/2b str. SLCC3954 Cas13p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. Cas13p, preferably *Leptotrichia shahii* Cas13p, more preferably *Leptotrichia shahii* DSM 19757 Cas13p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

In certain example embodiments, the effector protein may be a *Leptotrichia* sp., *Leptotrichia wadei* F0279, or a *Listeria* sp., preferably *Listeria newyorkensis* FSL M6-0635.

In certain example embodiments, the Cas13 effector proteins of the invention include, without limitation, the following 21 ortholog species (including multiple CRISPR loci: *Leptotrichia shahii; Leptotrichia wadei* (Lw2); *Listeria seeligeri;* Lachnospiraceae bacterium MA2020; Lachnospiraceae bacterium NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* F SL R9-0317; Listeriaceae bacterium FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica;* [*Eubacterium*] *rectale;* Eubacteriaceae bacterium CHKCI004; *Blautia* sp. Marseille-P2398; and *Leptotrichia* sp. oral taxon 879 str. F0557. Twelve (12) further non-limiting examples are: Lachnospiraceae bacterium NK4A144; *Chloroflexus aggregans; Demequina aurantiaca; Thalassospira* sp. TSLS-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae;* Porphyromonadaceae bacterium KH3CP3RA; *Listeria riparia;* and *Insolitispirillum peregrinum.*

In certain embodiments, the Cas13 protein according to the invention is or is derived from one of the orthologues as described, or is a chimeric protein of two or more of the orthologues as described below, or is a mutant or variant of one of the orthologues as described (or a chimeric mutant or variant), including dead Cas13, split Cas13, destabilized Cas13, etc. as defined herein elsewhere, with or without fusion with a heterologous/functional domain.

In certain example embodiments, the Cas13a effector protein is from an organism of a genus selected from the group consisting of: *Leptotrichia, Listeria,* Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter,* and *Lachnospira.*

In an embodiment of the invention, there is provided an effector protein which comprises an amino acid sequence having at least 80% sequence homology to the wild-type sequence of any of *Leptotrichia shahii* Cas13, Lachnospiraceae bacterium MA2020 Cas13, Lachnospiraceae bacterium NK4A179 Cas13, *Clostridium aminophilum* (DSM 10710) Cas13, *Carnobacterium gallinarum* (DSM 4847) Cas13, *Paludibacter propionicigenes* (WB4) Cas13, *Listeria weihenstephanensis* (FSL R9-0317) Cas13, Listeriaceae bacterium (FSL M6-0635) Cas13, *Listeria newyorkensis* (FSL M6-0635) Cas13, *Leptotrichia wadei* (F0279) Cas13, *Rhodobacter capsulatus* (SB 1003) Cas13, *Rhodobacter capsulatus* (R121) Cas13, *Rhodobacter capsulatus* (DE442) Cas13, *Leptotrichia wadei* (Lw2) Cas13, or *Listeria seeligeri* Cas13. According to the invention, a consensus sequence can be generated from multiple Cas13 orthologs, which can assist in locating conserved amino acid residues, and motifs, including but not limited to catalytic residues and HEPN motifs in Cas13 orthologs that mediate Cas13 function. One such consensus sequence, generated from selected orthologs.

In an embodiment of the invention, the effector protein comprises an amino acid sequence having at least 80% sequence homology to a Type VI effector protein consensus sequence including but not limited to a consensus sequence described herein.

In another non-limiting example, a sequence alignment tool to assist generation of a consensus sequence and identification of conserved residues is the MUSCLE alignment tool (www.ebi.ac.uk/Tools/msa/muscle/). For example, using MUSCLE, the following amino acid locations conserved among Cas13a orthologs can be identified in *Leptotrichia wadei* Cas13a:K2; K5; V6; E301; L331; I335; N341; G351; K352; E375; L392; L396; D403; F446; I466; I470; R474 (HEPN); H475; H479 (HEPN), E508; P556; L561; I595; Y596; F600; Y669; I673; F681; L685; Y761; L676; L779; Y782; L836; D847; Y863; L869; I872; K879; I933; L954; I958; R961; Y965; E970; R971; D972; R1046 (HEPN), H1051 (HEPN), Y1075; D1076; K1078; K1080; I1083; I1090.

In certain example embodiments, the RNA-targeting effector protein is a Type VI-B effector protein, such as Cas13b and Group 29 or Group 30 proteins. In certain example embodiments, the RNA-targeting effector protein comprises one or more HEPN domains. In certain example embodiments, the RNA-targeting effector protein comprises a C-terminal HEPN domain, a N-terminal HEPN domain, or both. Regarding example Type VI-B effector proteins that may be used in the context of this invention, reference is made to U.S. application Ser. No. 15/331,792 entitled "Novel CRISPR Enzymes and Systems" and filed Oct. 21, 2016, International Patent Application No. PCT/US2016/058302 entitled "Novel CRISPR Enzymes and Systems", and filed Oct. 21, 2016, and Smargon et al. "Cas13b is a Type VI-B CRISPR-associated RNA-Guided RNase differentially regulated by accessory proteins Csx27 and Csx28" Molecular Cell, 65, 1-13 (2017); dx.doi.org/10.1016/j.molce1.2016.12.023. In certain example embodiments, the Cas13b effector protein is, or comprises an amino acid sequence having at least 80% sequence homology to any of the sequences of Table 1 of International Patent Application No. PCT/US2016/058302. Further reference is made to example Type VI-B effector proteins of U.S. Provisional Application Nos. 62/471,710, 62/566,829 and International Patent Publication No. WO2018/1703333, entitled "Novel Cas13b Orthologues CRISPR Enzymes and System". In particular embodiments, the Cas13b enzyme is derived from

*Bergeyella zoohelcum*. In certain other example embodiments, the effector protein is, or comprises an amino acid sequence having at least 80% sequence homology to any of the sequences listed in Tables 1A or 1B of International Patent Publication No. WO2018/1703333, specifically incorporated herein by reference. In certain embodiments, the Cas 13b effector protein is, or comprises an amino acid sequence having at least 80% sequence homology to any of the polypeptides in U.S. Provisional Applications 62/484, 791, 62/561,662, 62/568,129 or International Patent Publication WO2018/191388, all entitled "Novel Type VI CRISPR Orthologs and Systems," incorporated herein by reference. In certain embodiments, the Cas13b effector protein is, or comprises an amino acid sequence having at least 80% sequence homology to a polypeptide as set forth in FIG. 1 of International Patent Publication WO2018/191388, specifically incorporated herein by reference. In an aspect, the Cas13b protein is selected from the group consisting of *Porphyromonas gulae* Cas13b (accession number WP 039434803), *Prevotella* sp. P5-125 Cas 13b (accession number WP 044065294), *Porphyromonas gingivalis* Cas 13b (accession number WP 053444417), *Porphyromonas* sp. COT-052 OH4946 Cas 13b (accession number WP 039428968), *Bacteroides pyogenes* Cas 13b (accession number WP 034542281), *Riemerella anatipestifer* Cas13b (accession number WP 004919755).

In certain example embodiments, the RNA-targeting effector protein is a Cas13c effector protein as disclosed in U.S. Provisional Patent Application No. 62/525,165 filed Jun. 26, 2017, and International Patent Publication No. WO2018/035250 filed Aug. 16, 2017. In certain example embodiments, the Cas13c protein may be from an organism of a genus such as *Fusobacterium* or Anaerosalibacter. Example wildtype orthologue sequences of Cas13c are: EH019081, WP_094899336, WP_040490876, WP_047396607, WP_035935671, WP_035906563, WP_042678931, WP_062627846, WP_005959231, WP_027128616, WP_062624740, WP_096402050.

In certain example embodiments, the Cas13 protein may be selected from any of the following: Cas13a: *Leptotrichia shahii, Leptotrichia wadei* (Lw2), *Listeria seeligeri*, Lachnospiraceae bacterium MA2020, Lachnospiraceae bacterium NK4A179, [*Clostridium*] *aminophilum* DSM 10710, *Carnobacterium gallinarum* DSM 4847, *Carnobacterium gallinarum* DSM 4847, *Paludibacter propionicigenes* WB4, *Listeria weihenstephanensis* FSL R9-0317, Listeriaceae bacterium FSL M6-0635, *Leptotrichia wadei* F0279, *Rhodobacter capsulatus* SB 1003, *Rhodobacter capsulatus* R121, *Rhodobacter capsulatus* DE442, *Leptotrichia buccalis* C-1013-b, Herbinix hemicellulosilytica, [*Eubacterium*] *rectale*, Eubacteriaceae bacterium CHKCI004, *Blautia* sp. Marseille-P2398, *Leptotrichia* sp. oral taxon 879 str. F0557; Cas 13b: *Bergeyella zoohelcum, Prevotella intermedia, Prevotella buccae, Alistipes* sp. ZOR0009, *Prevotella* sp. MA2016, *Riemerella anatipestifer, Prevotella aurantiaca, Prevotella saccharolytica, Prevotella intermedia, Capnocytophaga canimorsus, Porphyromonas gulae, Prevotella* sp. P5-125, *Flavobacterium branchiophilum, Porphyromonas gingivalis, Prevotella intermedia*; Cas13c: *Fusobacterium necrophorum* subsp. *funduliforme* ATCC 51357 contig00003, *Fusobacterium necrophorum* DJ-2 contig0065, whole genome shotgun sequence, *Fusobacterium necrophorum* BFTR-1 contig0068, *Fusobacterium necrophorum* subsp. *funduliforme* 1_1_36S cont1.14, *Fusobacterium perfoetens* ATCC 29250 T364DRAFT_scaffold00009.9_C, *Fusobacterium ulcerans* ATCC 49185 cont2.38, Anaerosalibacter sp. ND1 genome assembly Anaerosalibacter *massiliensis* ND1.

In certain example embodiments the orthologue is a Cas13a, Cas13b, Cas13c, or Cas13d. In certain example embodiments the orthologue is a Cas13 orthologue. In certain example embodiments, the Cas13a orthologues is derived from Herbinix hemicellulosilytica. In certain example embodiments, the Cas13a orthologue is derived from Herbinix hemicellulosilytica DSM 29228. In certain example embodiments, the Cas 13 orthologue is defined by SEQ ID NO: 75 of International Publication No. WO 2017/219027. In certain example embodiments, the Cas 13 orthologue is defined by a sequence from FIG. 1A of U.S. Provisional Application 62/967,408, filed Jan. 29, 2020, entitled "Novel CRISPR Enzymes and Systems" (loci QNRW01000010.1, OWPA01000389.1, 0153798_10014618, 0153978_10005171, and 0153798_10004687). In certain example embodiments, the Cas 13a orthologue is encoded by the nucleic acid sequence 0123519_10037894 or 0J26742_10014101. In certain other example embodiments, the Cas13 orthologue has at least 80% sequence identity to SEQ ID NO: 75 of International Publication No. WO 2017/219027. In certain other example embodiments, the Cas13 orthologue has at least 80% sequence identity to sequence from FIG. 1A of U.S. Provisional Application 62/967,408, filed Jan. 29, 2020, entitled "Novel CRISPR Enzymes and Systems" (loci QNRW01000010.1, OWPA01000389.1, 0153798_10014618, 0153978_10005171, and 0153798_10004687), incorporated herein by reference. In certain other example embodiments, the Cas13 orthologue has at least 80% sequence identity to a polypeptide encoded by the nucleic acid sequence 0123519_10037894 or 0J26742_10014101. In certain example embodiments, the Cas13 orthologue has at least one HEPN domain and at least 80% identity to SEQ ID NO: 75 of International Publication No. WO 2017/219027. In certain example embodiments, the Cas13 orthologue has at least one HEPN domain and at least 80% identity to sequence from loci QNRW01000010.1, OWPA01000389.1, 0153798_10014618, 0153978_10005171, and 0153798_10004687. In certain example embodiments, the Cas13 orthologue has at least one HEPN domain and at least 80% identity to a polypeptide encoded by the nucleic acid sequence of 0123519_10037894 or 0J26742_10014101 in BROD-4880P2_Cas13a_sequences.txt. In another example embodiment, the Cas13 orthologue has at least two HEPN domains and at least 80% identity to SEQ ID NO: 75 of International Publication No. WO 2017/219027. In another example embodiment, the Cas13 orthologue has at least two HEPN domains and at least 80% identity to sequence from FIG. 1A of U.S. Provisional Application 62/967,408, filed Jan. 29, 2020, entitled "Novel CRISPR Enzymes and Systems" loci QNRW01000010.1, OWPA01000389.1, 0153798_10014618, 0153978_10005171, and 0153798_10004687. The Cas13a thermostable proteins of FIG. 1A of U.S. Provisional Application 62/967,408, filed Jan. 29, 2020, entitled "Novel CRISPR Enzymes and Systems" were identified from stable anaerobic thermophilic methanogenic microbiomes fermenting switchgrass, supporting their thermostability. See, Liang et al., Biotechnol Biofuels 2018; 11: 243 doi: 10.1186/s13068-018-1238-1. Similarly, the 0J26742_10014101 clusters with the verified thermophilic sourced Cas13a sequences detailed in FIG. 1A of U.S. Provisional Application 62/967,408, filed Jan. 29, 2020, entitled "Novel CRISPR Enzymes and Systems". The nucleic acid identified at loci 123519_10037894 was identified from a study focusing on 70° C. organism. In certain example embodiments, the Cas13 orthologue has at least two HEPN domains and at least 80% identity to a polypeptide encoded by the nucleic acid sequence 0123519_10037894 or 0J26742_10014101. Accordingly, a person of ordinary skill in the art may use characteristics of the above identified orthologs to select other suitable thermostable orthologues from those disclosed herein.

Other Example Type V Cas Proteins

In certain example embodiments, the assays may comprise a DNA-targeting effector protein. In certain example embodiments, the assays may comprise multiple DNA-targeting effectors or one or more orthologs in combination with one or more RNA-targeting effectors. In certain example embodiments, the DNA targeting are Type V Cas proteins, such as Cas12 proteins. In certain other example embodiments, the Cas12 proteins are Cas12a, Cas12b, Cas12c, Cas12d, Cas12e, Cas12g, or a combination thereof.

Cpf1 Orthologs

The present invention encompasses the use of a Cpf1 effector protein, derived from a Cpf1 locus denoted as subtype V-A. Herein such effector proteins are also referred to as "Cpf1p", e.g., a Cpf1 protein (and such effector protein or Cpf1 protein or protein derived from a Cpf1 locus is also called "CRISPR enzyme"). Presently, the subtype V-A loci encompasses cas1, cas2, a distinct gene denoted cpf1 and a CRISPR array. Cpf1 (CRISPR-associated protein Cpf1, subtype PREFRAN) is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in all Cas9 proteins, and the RuvC-like domain is contiguous in the Cpf1 sequence, in contrast to Cas9 where it contains long inserts including the HNH domain. Accordingly, in particular embodiments, the CRISPR-Cas enzyme comprises only a RuvC-like nuclease domain.

The programmability, specificity, and collateral activity of the RNA-guided Cpf1 also make it an ideal switchable nuclease for non-specific cleavage of nucleic acids. In one embodiment, a Cpf1 system is engineered to provide and take advantage of collateral non-specific cleavage of RNA. In another embodiment, a Cpf1 system is engineered to provide and take advantage of collateral non-specific cleavage of ssDNA. Accordingly, engineered Cpf1 systems provide platforms for nucleic acid detection and transcriptome manipulation. Cpf1 is developed for use as a mammalian transcript knockdown and binding tool. Cpf1 is capable of robust collateral cleavage of RNA and ssDNA when activated by sequence-specific targeted DNA binding.

Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225). See also Shmakov et al. (2015) for application in the field of CRISPR-Cas loci. Homologous proteins may but need not be structurally related, or are only partially structurally related. The Cpf1 gene is found in several diverse bacterial genomes, typically in the same locus with cas1, cas2, and cas4 genes and a CRISPR cassette (for example, FNFX1_1431-FNFX1_1428 of *Francisella cf. novicida* Fx1). In particular embodiments, the effector protein is a Cpf1 effector protein from an organism from a genus comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium*, Corynebacter, *Carnobacterium, Rhodobacter, Listeria, Paludibacter, Clostridium*, Lachnospiraceae, Clostridiaridium, *Leptotrichia, Francisella, Legionella, Alicyclobacillus, Methanomethyophilus, Porphyromonas, Prevotella*, Bacteroidetes, *Helcococcus*, Letospira, *Desulfovibrio, Desulfonatronum*, Opitutaceae, *Tuberibacillus, Bacillus, Brevibacilus, Methylobacterium* or *Acidaminococcus*.

In further particular embodiments, the Cpf1 effector protein is from an organism selected from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii*.

The effector protein may comprise a chimeric effector protein comprising a first fragment from a first effector protein (e.g., a Cpf1) ortholog and a second fragment from a second effector (e.g., a Cpf1) protein ortholog, and wherein the first and second effector protein orthologs are different. At least one of the first and second effector protein (e.g., a Cpf1) orthologs may comprise an effector protein (e.g., a Cpf1) from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium*, Corynebacter, *Carnobacterium, Rhodobacter, Listeria, Paludibacter, Clostridium*, Lachnospiraceae, Clostridiaridium, *Leptotrichia, Francisella, Legionella, Alicyclobacillus, Methanomethyophilus, Porphyromonas, Prevotella*, Bacteroidetes, *Helcococcus*, Letospira, *Desulfovibrio, Desulfonatronum*, Opitutaceae, *Tuberibacillus, Bacillus, Brevibacilus, Methylobacterium* or *Acidaminococcus*; e.g., a chimeric effector protein comprising a first fragment and a second fragment wherein each of the first and second fragments is selected from a Cpf1 of an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium*, Corynebacter, *Carnobacterium, Rhodobacter, Listeria, Paludibacter, Clostridium*, Lachnospiraceae, Clostridiaridium, *Leptotrichia, Francisella, Legionella, Alicyclobacillus, Methanomethyophilus, Porphyromonas, Prevotella*, Bacteroidetes, *Helcococcus*, Letospira, *Desulfovibrio, Desulfonatronum*, Opitutaceae, *Tuberibacillus, Bacillus, Brevibacilus, Methylobacterium* or *Acidaminococcus* wherein the first and second fragments are not from the same bacteria; for instance a chimeric effector protein comprising a first fragment and a second fragment wherein each of the first and second fragments is selected from a Cpf1 of *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus* Methanoplasma *termitum, Eubacterium eligens, Moraxella bovoculi* 237, *Leptospira inadai*, Lachnospiraceae bacterium ND2006, *Porphyromonas crevioricanis* 3, *Prevotella disiens* and *Porphyromonas macacae*, wherein the first and second fragments are not from the same bacteria. In a more preferred embodiment, the Cpf1p is derived from a bacterial species selected from *Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus* Methanoplasma *termitum*, *Eubacterium eligens*, *Moraxella bovoculi* 237, *Leptospira inadai*, Lachnospiraceae bacterium ND2006, *Porphyromonas crevioricanis* 3, *Prevotella disiens* and *Porphyromonas macacae*. In certain embodiments, the Cpf1p is derived from a bacterial species selected from *Acidaminococcus* sp. BV3L6, Lachnospiraceae bacterium MA2020. In certain embodiments, the effector protein is derived from a subspecies of *Francisella tularensis* 1, including but not limited to *Francisella tularensis* subsp. *Novicida*.

In some embodiments, the Cpf1p is derived from an organism from the genus of *Eubacterium*. In some embodiments, the CRISPR effector protein is a Cpf1 protein derived from an organism from the bacterial species of *Eubacterium rectale*. In some embodiments, the amino acid sequence of the Cpf1 effector protein corresponds to NCBI Reference Sequence WP_055225123.1, NCBI Reference Sequence WP_055237260.1, NCBI Reference Sequence WP_055272206.1, or GenBank ID OLA16049.1. In some embodiments, the Cpf1 effector protein has a sequence homology or sequence identity of at least 60%, more particularly at least 70, such as at least 80%, more preferably at least 85%, even more preferably at least 90%, such as for instance at least 95%, with NCBI Reference Sequence WP_055225123.1, NCBI Reference Sequence WP_055237260.1, NCBI Reference Sequence WP_055272206.1, or GenBank ID OLA16049.1. The skilled person will understand that this includes truncated forms of the Cpf1 protein whereby the sequence identity is determined over the length of the truncated form. In some embodiments, the Cpf1 effector recognizes the PAM sequence of TTTN or CTTN.

In particular embodiments, the homologue or orthologue of Cpf1 as referred to herein has a sequence homology or identity of at least 80%, more preferably at least 85%, even more preferably at least 90%, such as for instance at least 95% with Cpf1. In further embodiments, the homologue or orthologue of Cpf1 as referred to herein has a sequence identity of at least 80%, more preferably at least 85%, even more preferably at least 90%, such as for instance at least 95% with the wild type Cpf1. Where the Cpf1 has one or more mutations (mutated), the homologue or orthologue of said Cpf1 as referred to herein has a sequence identity of at least 80%, more preferably at least 85%, even more preferably at least 90%, such as for instance at least 95% with the mutated Cpf1.

In an embodiment, the Cpf1 protein may be an ortholog of an organism of a genus which includes, but is not limited to *Acidaminococcus* sp, Lachnospiraceae bacterium or *Moraxella bovoculi*; in particular embodiments, the type V Cas protein may be an ortholog of an organism of a species which includes, but is not limited to *Acidaminococcus* sp. BV3L6; Lachnospiraceae bacterium ND2006 (LbCpf1) or *Moraxella bovoculi* 237. In particular embodiments, the homologue or orthologue of Cpf1 as referred to herein has a sequence homology or identity of at least 80%, more preferably at least 85%, even more preferably at least 90%, such as for instance at least 95% with one or more of the Cpf1 sequences disclosed herein. In further embodiments, the homologue or orthologue of Cpf as referred to herein has a sequence identity of at least 80%, more preferably at least 85%, even more preferably at least 90%, such as for instance at least 95% with the wild type FnCpf1, AsCpf1 or LbCpf1. The skilled person will understand that this includes truncated forms of the Cpf1 protein whereby the sequence identity is determined over the length of the truncated form. In certain of the following, Cpf1 amino acids are followed by nuclear localization signals (NLS) (italics), a glycine-serine (GS) linker, and 3×HA tag. Further Cpf1 orthologs include NCBI WP_055225123.1, NCBI WP_055237260.1, NCBI WP_055272206.1, and GenBank OLA16049.1.

C2c1 Orthologs

The present invention encompasses the use of a C2c1 effector proteins, derived from a C2c1 locus denoted as subtype V-B. Herein such effector proteins are also referred to as "C2c1p", e.g., a C2c1 protein (and such effector protein or C2c1 protein or protein derived from a C2c1 locus is also called "CRISPR enzyme"). Presently, the subtype V-B loci encompasses cas1-Cas4 fusion, cas2, a distinct gene denoted C2c1 and a CRISPR array. C2c1 (CRISPR-associated protein C2c1) is a large protein (about 1100-1300 amino acids) that contains a RuvC-like nuclease domain homologous to the corresponding domain of Cas9 along with a counterpart to the characteristic arginine-rich cluster of Cas9. However, C2c1 lacks the HNH nuclease domain that is present in all Cas9 proteins, and the RuvC-like domain is contiguous in the C2c1 sequence, in contrast to Cas9 where it contains long inserts including the HNH domain. Accordingly, in particular embodiments, the CRISPR-Cas enzyme comprises only a RuvC-like nuclease domain.

The programmability, specificity, and collateral activity of the RNA-guided C2c1 also make it an ideal switchable nuclease for non-specific cleavage of nucleic acids. In one embodiment, a C2c1 system is engineered to provide and take advantage of collateral non-specific cleavage of RNA. In another embodiment, a C2c1 system is engineered to provide and take advantage of collateral non-specific cleavage of ssDNA. Accordingly, engineered C2c1 systems provide platforms for nucleic acid detection and transcriptome manipulation, and inducing cell death. C2c1 is developed for use as a mammalian transcript knockdown and binding tool. C2c1 is capable of robust collateral cleavage of RNA and ssDNA when activated by sequence-specific targeted DNA binding.

In certain embodiments, C2c1 is provided or expressed in an in vitro system or in a cell, transiently or stably, and targeted or triggered to non-specifically cleave cellular nucleic acids. In one embodiment, C2c1 is engineered to knock down ssDNA, for example viral ssDNA. In another embodiment, C2c1 is engineered to knock down RNA. The system can be devised such that the knockdown is dependent on a target DNA present in the cell or in vitro system, or triggered by the addition of a target nucleic acid to the system or cell.

C2c1 (also known as Cas12b) proteins are RNA guided nucleases. In certain embodiments, the Cas protein may comprise at least 80% sequence identity to a polypeptide as described in International Patent Publication WO 2016/205749 at FIG. 17-21, FIG. 41A-41M, 44A-44E, incorporated herein by reference. Its cleavage relies on a tracr RNA to recruit a guide RNA comprising a guide sequence and a direct repeat, where the guide sequence hybridizes with the target nucleotide sequence to form a DNA/RNA heteroduplex. Based on current studies, C2c1 nuclease activity also requires relies on recognition of PAM sequence. C2c1 PAM sequences are T-rich sequences. In some embodiments, the PAM sequence is 5' TTN 3' or 5' ATTN 3', wherein N is any nucleotide. In a particular embodiment, the PAM sequence is 5' TTC 3'. In a particular embodiment, the PAM is in the sequence of *Plasmodium falciparum*.

In particular embodiments, the effector protein is a C2c1 effector protein from an organism from a genus comprising *Alicyclobacillus, Desulfovibrio, Desulfonatronum*, Opitutaceae, *Tuberibacillus, Bacillus, Brevibacillus, Candidatus, Desulfatirhabdium, Citrobacter, Elusimicrobia, Methylobacterium*, Omnitrophica, Phycisphaerae, Planctomycetes, Spirochaetes, and Verrucomicrobiaceae.

In further particular embodiments, the C2c1 effector protein is from a species selected from *Alicyclobacillus acidoterrestris* (e.g., ATCC 49025), *Alicyclobacillus contaminans* (e.g., DSM 17975), *Alicyclobacillus macrosporangiidus* (e.g. DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1), Elusimicrobia bacterium RIFOXYA12, Omnitrophica WOR_2 bacterium RIFCSPHIGHO2, Opitutaceae bacterium TAV5, Phycisphaerae bacterium ST-NAGAB-D1, Planctomycetes bacterium RBG_13_46_10, Spirochaetes bacterium GWB1_27_13, Verrucomicrobiaceae bacterium UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060).

In one aspect, the CRISPR-Cas protein is a Cas12b from BROD_5090P4_Cas12b_sequences.txt. In certain embodiments, the CRISPR-Cas protein is a Cas12b from a thermostable species, for example *Alicyclobacillus acidiphilus* (AapCas12b). When the Aap protein is utilized, a related guide can be used, for example from the same or another *Alicyclobacillus* species, e.g. *Alicyclobacillus acidoterrestrus* (AacCas12b). In an aspect, the guide comprises at least 95%, 96%, 97% or more sequence identity to the DR and/or the tracr sequence from Aac. In certain embodiments, the AapCas12b protein comprises a sequence with 80%, 85%, 90%, 95% identity to, or consisting of the sequence:

```
                                   (SEQ ID NO: 61,956)
MAVKSMKVKLRLDNMPEIRAGLWKLHTEVNAGVRYYTEWLSLLRQENLYRR

SPNGDGEQECYKTAEECKAELLERLRARQVENGHCGPAGSDDELLQLARQL

YELLVPQAIGAKGDAQQIARKFLSPLADKDAVGGLGIAKAGNKPRWVRMRE

AGEPGWEEEKAKAEARKSTDRTADVLRALADFGLKPLMRVYTDSDMSSVQW

KPLRKGQAVRTWDRDMFQQAIERMMSWESWNQRVGEAYAKLVEQKSRFEQK

NFVGQEHLVQLVNQLQQDMKEASHGLESKEQTAHYLTGRALRGSDKVFEKW

EKLDPDAPFDLYDTEIKNVQRRNTRRFGSHDLFAKLAEPKYQALWREDASF

LTRYAVYNSIVRKLNHAKMFATFTLPDATAHPIWTRFDKLGGNLHQYTFLF

NEFGEGRHAIRFQKLLTVEDGVAKEVDDVTVPISMSAQLDDLLPRDPHELV

ALYFQDYGAEQHLAGEFGGAKIQYRRDQLNHLHARRGARDVYLNLSVRVQS

QSEARGERRPPYAAVFRLVGDNHRAFVHFDKLSDYLAEHPDDGKLGSEGLL

SGLRVMSVDLGLRTSASISVFRVARKDELKPNSEGRVPFCFPIEGNENLVA

VHERSQLLKLPGETESKDLRAIREERQRTLRQLRTQLAYLRLLVRCGSEDV

GRRERSWAKLIEQPMDANQMTPDWREAFEDELQKLKSLYGICGDREWTEAV
```
-continued
```
YESVRRVWRHMGKQVRDWRKDVRSGERPKIRGYQKDVVGGNSIEQIEYLER

QYKFLKSWSFFGKVSGQVIRAEKGSRFAITLREHIDHAKEDRLKKLADRII

MEALGYVYALDDERGKGKWVAKYPPCQLILLEELSEYQFNNDRPPSENNQL

MQWSHRGVFQELLNQAQVHDLLVGTMYAAFSSRFDARTGAPGIRCRRVPAR

CAREQNPEPFPWWLNKFVAEHKLDGCPLRADDLIPTGEGEFFVSPFSAEEG

DFHQIHADLNAAQNLQRRLWSDFDISQIRLRCDWGEVDGEPVLIPRTTGKR

TADSYGNKVFYTKTGVTYYERERGKKRRKVFAQEELSEEEAELLVEADEAR

EKSVVLMRDPSGIINRGDWTRQKEFWSMVNQRIEGYLVKQIRSRVRLQESA

CENTGDI*.
```

The guide may be derived from a different species than the Cas protein. In certain embodiments, the CRISPR-Cas protein is a Cas12b from a thermostable species, for example *Alicyclobacillus acidiphilus* (Aap). When the Aap Cas protein is utilized, a related guide can be used, for example from the same or another *Alicyclobacillus* species, e.g. *Alicyclobacillus acidoterrestris* (Aac). In an aspect, the guide comprises at least 95%, 96%, 97% or more sequence similarity to the DR and/or the tracr sequence from Aac Cas12b. The guide can be designed similarly for other Cas proteins, deriving the guide from a different species than the Cas protein species.

In an aspect, the CRISPR-Cas protein is a Cas12b from Aap, and the guide molecule is derived from Aac, or an *Alicyclobacillus* CRISPR Cas system direct repeat and tracrRNA. In certain embodiments, the guide is designed with a spacer sequence to target a molecule of interest, for example, SARS-CoV-2. While any portion of the SARS-CoV-2 can be targeted, as described elsewhere herein, in an aspect, the spacer is designed to target the Nucleocapsid protein of the SARS-CoV-2. In certain embodiments, the Aac guide has 90%, 91%, 92%, 93%, 94%, 95%, 96%, 97%, 98%, 99% sequence similarity to any one of Type 1 to Type 5 guide sequence below.

In an aspect, the guide comprises:

Type 1:
```
                                   (SEQ ID NO: 61,957)
GTCTAGAGGACAGAATTTTTCAACGGGTGTGCCAATGGCCACTTTCCAGGT

GGCAAAGCCCGTTGAGCTTCTCAAATCTGAGAAGTGGCAC,
```

Type 2:
```
                                   (SEQ ID NO: 61,958)
GTCTAAAGGACAGAATTTTTCAACGGGTGTGCCAATGGCCACTTTCCAGGT

GGCAAAGCCCGTTGAACTTCTCAAATCTGAGAAGTGGCAC
```

Type 3:
```
                                   (SEQ ID NO: 61,959)
GTCTAGAGGACAGAATTTTTCAACGGGTGTGCCAATGGCCACTTTCCAGGT

GGCAAAGCCCGTTGAACTTCTCAAATCTGAGAAGTGGCAC
```

Type 4:
```
                                   (SEQ ID NO: 61,960)
GTCTAAAGGACAGAATTTTTCAACGGGTGTGCCAATGGCCACTTTCCAGGT GGCAAAGCCCGTTGAGCTTCTCAAATCTGAGAAGTGGCAC
```
or Type 5:
(SEQ ID NO: 61,961)
GTCTAGAGGACAGAATTTTTCAACGGGTGTGCCAATGGCCACTTTCCAGGT

GGCAAAGCCCGTTGAACTTCTCAAATCTGCGAAGTGGCAC.

In certain embodiments, preservation of the underlined portions of the following guide sequence are maintained:

(SEQ ID NO: 61962)
GTCTAGAGGACAGAATTTTTC<u>AACGGG</u>TGTGCCAATGGCCACTTTCCAGGT

GGCAAA<u>GCCCGTT</u>GAG<u>CTT</u>CT<u>C</u>AAATC<u>TGAGAAG</u>TGGCAC.

Figure 45:
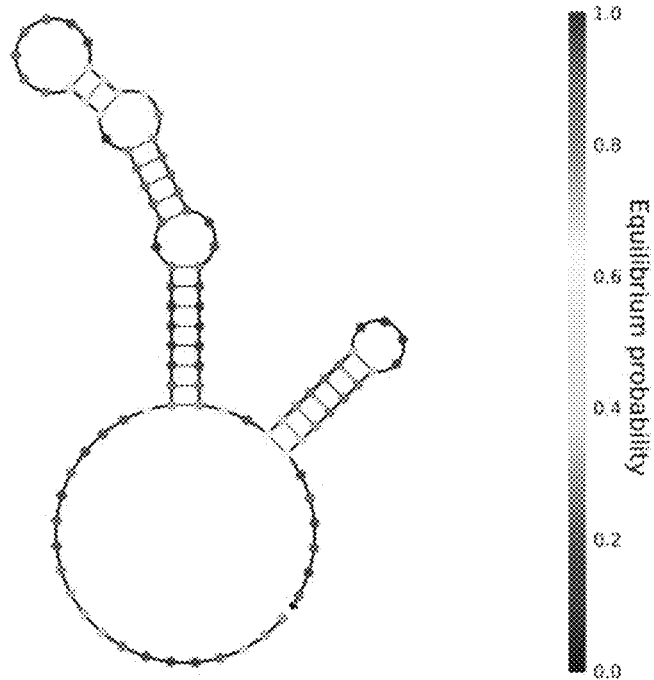
Figure 45:
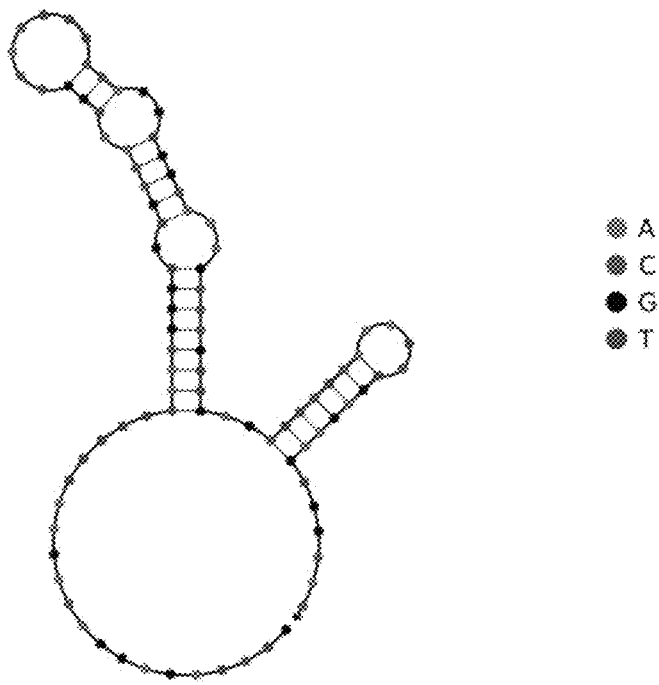

However, importance of particular bases of the guide sequence are not limited to the underlined areas in SEQ ID NO: 61962, and mutations of these bases can be performed when structure and activity of the guide sequence can be maintained. Such mutations can be tested and optimized in accordance with the guide optimization methods detailed elsewhere herein. In an aspect, the guide preserves the secondary structure of SEQ ID NO: 61994 as detailed in FIG. 45. In some embodiments, the sequence of the guide molecule (direct repeat and/or spacer) is selected to reduce the degree secondary structure within the guide molecule. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In an aspect, the CRISPR-Cas protein is a Cas12b from Aap, and the guide molecule is derived from Aac, or an *Alicyclobacillus* CRISPR Cas system direct repeat and tracrRNA. In certain embodiments, the guide is designed with a spacer sequence to target SARS-CoV-2. While any portion of the SARS-CoV-2 can be targeted, as described elsewhere herein, in an aspect, the spacer is designed to target the Nucleocapsid protein of the SARS-CoV-2.

In an aspect, the CRISPR-Cas protein is a BrCas12b. In certain embodiments, the BrCas12b protein comprises a sequence with 80%, 85%, 90%, 95% identity to, or consisting of the sequence:

(SEQ ID NO: 61963)
MPVRSFKVKLVTRSGDAEHMLQLRRGLWKTHEIVNQGIAYYMNKLALMRQE

PYAGKSREVVRLELLHSLRAQQKRNNWTGDAGTDDEILNLSRRLYELLVPS

AIGEKGDAQMLSRKFLSPLVDPNSEGGKGTAKSGRKPRWMKMREEGHPDWE

AEREKDRAKKAADPTASILNDLEAFGLRPLFPLFTDEQKGIQWLPKQKRQF

VRTFDRDMFQQALERMLSWESWNRRVAEEYQKLQAQRDELYAKYLADGGAW

LEALQSFEKQREVELAEESFAAKSEYLITRRQIRGWKQVYEKWSQLPEHAA

QEQFWQVVADVQTSLPGAFGDPKVYQFLSQPEHHHIWRGYPNRLFHYSDYN

GVRKKLQRARHDATFTLPDPVEHPLWIRFDARGGNIHDYEISQNGKQYQVT

FSRLLWPENETWVERENVTVAIGASQQLKRQIRLDGYADKKQKVRYRDYSS

GIELTGVLGGAKIQFDRRHLRKASNRLADGETGPVYLNVVVDIEPFLAMRN

GRLQTPIGQVLQVNTKDWPKVTGYKPAELISWIQNSPLAVGTGVNTIEAGM

RVMSVDLGQRSAAAVSIFEVMRQKPAEQETKLFYPIAVTGLYAVHRRSLLL

RLPGEKISDEIEQQRKIRAHARSLVRYQIRLLADVLRLHTRGTAEQRRAKL

DELLATLQTKQELDQKLWQTELEKLFDYIHEPAERWQQALVAAHRTLEPVI

GQAVRHWRKSLRIDRKGLAGMSMWNIEELEETRKLLIAWSKHSRVPGEPNR

LDKEETFAPQQLQHIQNVKDDRLKQMANLLVMTALGYKYDEAEKQWKEAYP

ACQMILFEDLSRYRFALDRPRRENNRLMKWAHRSIPRLVYLQGELFGIQVG

DVYSAYTSRFHAKTGAPGIRCHALKEEDLQPNSYVVKQLIKDGFIREDQTG

SLKPGQIVPWSGGELFVTLADRSGSRLAVIHADINAAQNLQKRFWQQNTEI

FRVPCKVTTSGLIPAYDKMKKLFGKGYFAKINQTDTSEVYVWEHSAKMKGK

TTPADPAEEGVFDESLTDEMEELEDSQEGYKTLFRDPSGFFWSSDRWLPQK

EFWFWVKRRIEKKLREQLQ.

In an aspect, when the CRISPR-Cas protein is a BrCas12b, the tracrRNA can be selected from one of tracrRNA design 1-tracrRNA design 6 as detailed below:

tracrRdesign 1:
(SEQ ID NO: 61964)
TGCAGGTTAGTGGAAATATAGATAGCCGTTGTGACTGAGTGACGTGTTAGG

TCACCGTAGCACATGACACAACTGCACTGGTCAGCCTGTAGCTAACCACCT

TCATTATATCTAGTTTTTCCAAC tracrRNA design 2:
(SEQ ID NO: 61965)
GTTGTGACTGAGTGACGTGTTAGGTCACCGTAGCACATGACACAACTGCAC

TGGTCAGCCTGTAGCTAACCACCTTCATTATATCTAGTTTTTCCAAC tracrRNA design 3:
(SEQ ID NO: 61966)
TGACACAACTGCACTGGTCAGCCTGTAGCTAACCACCTTCATTATATCTAG

TTTTTCCAAC tracrRNA design 4:
(SEQ ID NO: 61967)
GAAGGTGGTTAGCTACAGGCTGACCAGTGCAGTTGTGTCATGTGCTACGGT

GACCTAACACGTCACTCAGTCACAACGGCTATCTATATTTCCACTAAC tracrRNA design 5:
(SEQ ID NO: 61968)
GTTGGAAAAACTAGATATAATGAAGGTGGTTAGCTACAGGCTGACCAGTGC

AGTTGTGTCATGTGCTACGGTGACCTAACACGTCACTCAGTCACAACGGCT

ATCTATATTTCCACTAAC tracrRNA design 6:
(SEQ ID NO: 61969)
GTGCAGTTGTGTCATGTGCTACGGTGACCTAACACGTCACTCAGTCACAAC

GGCTATCTATATTTCCACTAAC

In an aspect, when BrCas12b is utilized, the crNA design can be selected from one of crRNA design 1 to crRNA design 3, wherein N represents the spacer design:

crRNA design 1:
(SEQ ID NO: 61970)
GTCCGTTTCGTTAGTGGAAATGTAGATGGTTAGCACNNNNNNNNNNNNNNNN
NNNNNNNNNNNN crRNA design 2:
(SEQ ID NO: 61971)
TAGTGGAAATGTAGATGGTTAGCACNNNNNNNNNNNNNNNNNNNNNNNNNN
N crRNA design 3
(SEQ ID NO: 61972)
GTTAGTGGAAATCTAGATGGTTAGCACNNNNNNNNNNNNNNNNNNNNNNNN
NNN In certain example embodiments, the guide sequence is selected from SEQ ID Nos:40500-61643.

The effector protein may comprise a chimeric effector protein comprising a first fragment from a first effector protein (e.g., a C2c1) ortholog and a second fragment from a second effector (e.g., a C2c1) protein ortholog, and wherein the first and second effector protein orthologs are different. At least one of the first and second effector protein (e.g., a C2c1) orthologs may comprise an effector protein (e.g., a C2c1) from an organism comprising *Alicyclobacillus, Desulfovibrio, Desulfonatronum,* Opitutaceae, *Tuberibacillus, Bacillus, Brevibacillus, Candidatus, Desulfatirhabdium,* Elusimicrobia, *Citrobacter, Methylobacterium,* Omnitrophicai, Phycisphaerae, Planctomycetes, Spirochaetes, and Verrucomicrobiaceae; e.g., a chimeric effector protein comprising a first fragment and a second fragment wherein each of the first and second fragments is selected from a C2c1 of an organism comprising *Alicyclobacillus, Desulfovibrio, Desulfonatronum,* Opitutaceae, *Tuberibacillus, Bacillus, Brevibacillus, Candidatus, Desulfatirhabdium,* Elusimicrobia, *Citrobacter, Methylobacterium,* Omnitrophicai, Phycisphaerae, Planctomycetes, Spirochaetes, and Verrucomicrobiaceae wherein the first and second fragments are not from the same bacteria; for instance a chimeric effector protein comprising a first fragment and a second fragment wherein each of the first and second fragments is selected from a C2c1 of *Alicyclobacillus acidoterrestris* (e.g., ATCC 49025), *Alicyclobacillus contaminans* (e.g., DSM 17975), *Alicyclobacillus macrosporangiidus* (e.g., DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1), Elusimicrobia bacterium RIFOXYA12, Omnitrophica WOR_2 bacterium RIFCSPHIGHO2, Opitutaceae bacterium TAV5, Phycisphaerae bacterium ST-NAGAB-D1, Planctomycetes bacterium RBG_13_46_10, Spirochaetes bacterium GWB1_27_13, Verrucomicrobiaceae bacterium UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060), wherein the first and second fragments are not from the same bacteria.

In a more preferred embodiment, the C2c1p is derived from a bacterial species selected from *Alicyclobacillus acidoterrestris* (e.g., ATCC 49025), *Alicyclobacillus contaminans* (e.g., DSM 17975), *Alicyclobacillus macrosporangiidus* (e.g. DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1), Elusimicrobia bacterium RIFOXYA12, Omnitrophica WOR_2 bacterium RIFCSPHIGHO2, Opitutaceae bacterium TAV5, Phycisphaerae bacterium ST-NAGAB-D1, Planctomycetes bacterium RBG_13_46_10, Spirochaetes bacterium GWB1_27_13, Verrucomicrobiaceae bacterium UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060). In certain embodiments, the C2c1p is derived from a bacterial species selected from *Alicyclobacillus acidoterrestris* (e.g., ATCC 49025), *Alicyclobacillus contaminans* (e.g., DSM 17975).

In particular embodiments, the homologue or orthologue of C2c1 as referred to herein has a sequence homology or identity of at least 80%, more preferably at least 85%, even more preferably at least 90%, such as for instance at least 95% with C2c1. In further embodiments, the homologue or orthologue of C2c1 as referred to herein has a sequence identity of at least 80%, more preferably at least 85%, even more preferably at least 90%, such as for instance at least 95% with the wild type C2c1. Where the C2c1 has one or more mutations (mutated), the homologue or orthologue of said C2c1 as referred to herein has a sequence identity of at least 80%, more preferably at least 85%, even more preferably at least 90%, such as for instance at least 95% with the mutated C2c1.

In an embodiment, the C2c1 protein may be an ortholog of an organism of a genus which includes, but is not limited to *Alicyclobacillus, Desulfovibrio, Desulfonatronum,* Opitutaceae, *Tuberibacillus, Bacillus, Brevibacillus, Candidatus, Desulfatirhabdium,* Elusimicrobia, *Citrobacter, Methylobacterium,* Omnitrophicai, Phycisphaerae, Planctomycetes, Spirochaetes, and Verrucomicrobiaceae; in particular embodiments, the type V Cas protein may be an ortholog of an organism of a species which includes, but is not limited to *Alicyclobacillus acidoterrestris* (e.g., ATCC 49025), *Alicyclobacillus contaminans* (e.g., DSM 17975), *Alicyclobacillus macrosporangiidus* (e.g., DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1), Elusimicrobia bacterium RIFOXYA12, Omnitrophica WOR_2 bacterium RIFCSPHIGHO2, Opitutaceae bacterium TAV5, Phycisphaerae bacterium S T-NAGAB-D1, Planctomycetes bacterium RBG_13_46_10, Spirochaetes bacterium GWB1_27_13, Verrucomicrobiaceae bacterium UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060). In particular embodiments, the homologue or orthologue of C2c1 as referred to herein has a sequence homology or identity of at least 80%, more preferably at least 85%, even more preferably at least 90%, such as for instance at least 95% with one or more of the C2c1 sequences disclosed herein. In further embodiments, the homologue or orthologue of C2c1 as referred to herein has a sequence identity of at least 80%, more preferably at least 85%, even more preferably at least 90%, such as for instance at least 95% with the wild type AacC2c1 or BthC2c1.

In particular embodiments, the C2c1 protein of the invention has a sequence homology or identity of at least 60%, more particularly at least 70, such as at least 80%, more preferably at least 85%, even more preferably at least 90%, such as for instance at least 95% with AacC2c1 or BthC2c1. In further embodiments, the C2c1 protein as referred to herein has a sequence identity of at least 60%, such as at least 70%, more particularly at least 80%, more preferably at least 85%, even more preferably at least 90%, such as for instance at least 95% with the wild type AacC2c1. In particular embodiments, the C2c1 protein of the present invention has less than 60% sequence identity with AacC2c1. The skilled person will understand that this includes truncated forms of the C2c1 protein whereby the sequence identity is determined over the length of the truncated form.

In certain methods according to the present invention, the CRISPR-Cas protein is preferably mutated with respect to a corresponding wild-type enzyme such that the mutated CRISPR-Cas protein lacks the ability to cleave one or both DNA strands of a target locus containing a target sequence. In particular embodiments, one or more catalytic domains of the C2c1 protein are mutated to produce a mutated Cas protein which cleaves only one DNA strand of a target sequence.

In particular embodiments, the CRISPR-Cas protein may be mutated with respect to a corresponding wild-type enzyme such that the mutated CRISPR-Cas protein lacks substantially all DNA cleavage activity. In some embodiments, a CRISPR-Cas protein may be considered to substantially lack all DNA and/or RNA cleavage activity when the cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form.

In certain embodiments of the methods provided herein the CRISPR-Cas protein is a mutated CRISPR-Cas protein which cleaves only one DNA strand, i.e. a nickase. More particularly, in the context of the present invention, the nickase ensures cleavage within the non-target sequence, i.e. the sequence which is on the opposite DNA strand of the target sequence and which is 3' of the PAM sequence. By means of further guidance, and without limitation, an arginine-to-alanine substitution (R911A) in the Nuc domain of C2c1 from *Alicyclobacillus acidoterrestris* converts C2c1 from a nuclease that cleaves both strands to a nickase (cleaves a single strand). It will be understood by the skilled person that where the enzyme is not AacC2c1, a mutation may be made at a residue in a corresponding position.

Cas 12c Orthologs

Figure 43:
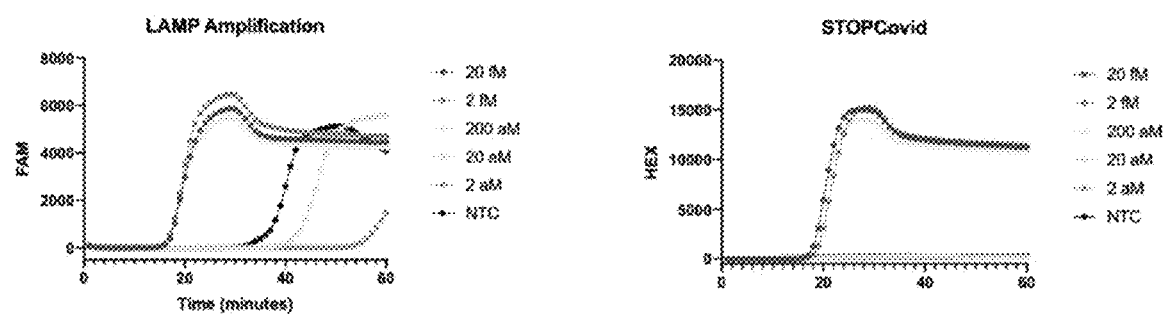
Figure 44:
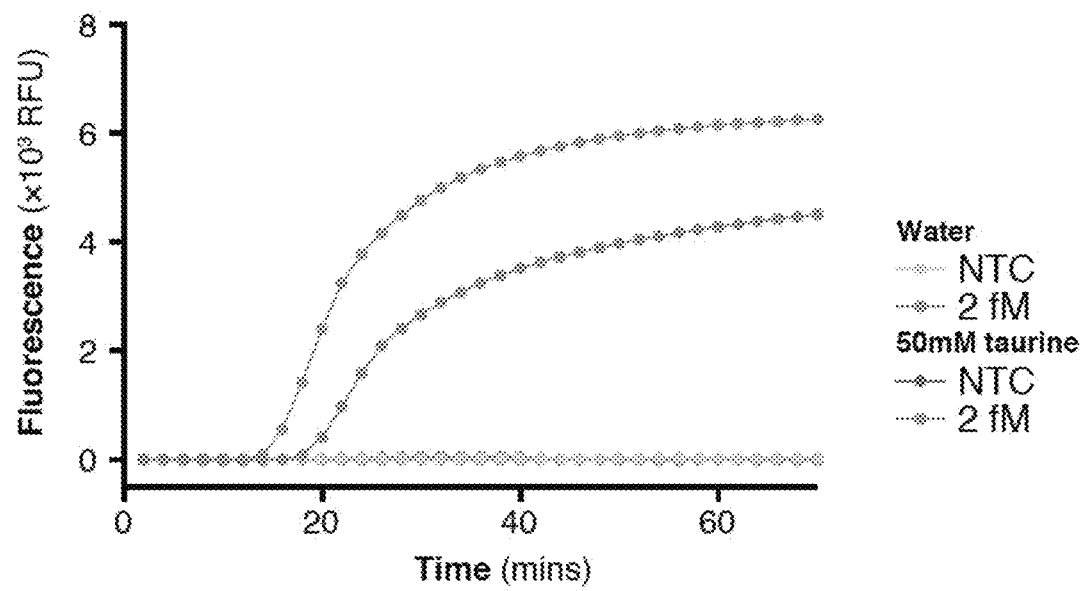
FIG. 44—Provides data showing an ability to detect target in 20 to 30 minutes FIG. 45—Shows secondary structure of guide of *Alicyclobacillus acidoterrestris* (Aac) that is used with *Alicyclobacillus acidiphilus* (Aap) Cas12b in exemplary CRISPR Systems.

In certain embodiments, the effector protein, particularly a Type V loci effector protein, more particularly a Type V-C loci effector protein, even more particularly a C2c3p, may originate, may be isolated or may be derived from a bacterial metagenome selected from the group consisting of the bacterial metagenomes listed in the Table in FIG. 43A-43B of PCT/US2016/038238, specifically incorporated by reference, which presents analysis of the Type-V-C Cas12c loci.

In certain embodiments, the effector protein, particularly a Type V loci effector protein, more particularly a Type V-C loci effector protein, even more particularly a C2c3p, may comprise, consist essentially of or consist of an amino acid sequence selected from the group consisting of amino acid sequences shown in the multiple sequence alignment in FIG. 131 of PCT/US2016/038238, specifically incorporated by reference.

Figure 14:
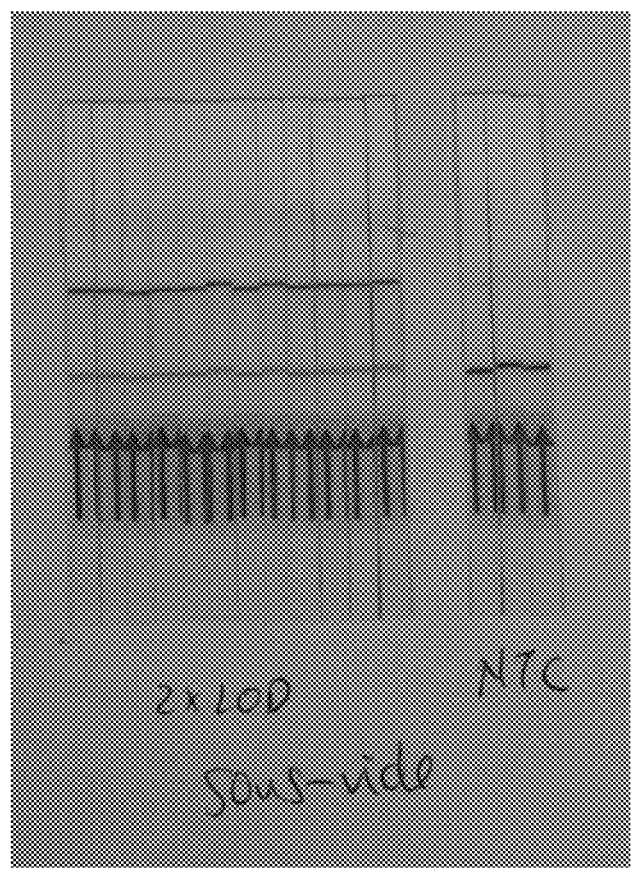
FIG. 14—The SHERLOCK assay can be run with a <$40 using conventional heating devices such as a sous vide heater FIG. 15—Shows SHERLOCK assays strips for 9 different patients using a nasopharyngeal swab sample. The results were compared to qPCR tests.
Figure 15:
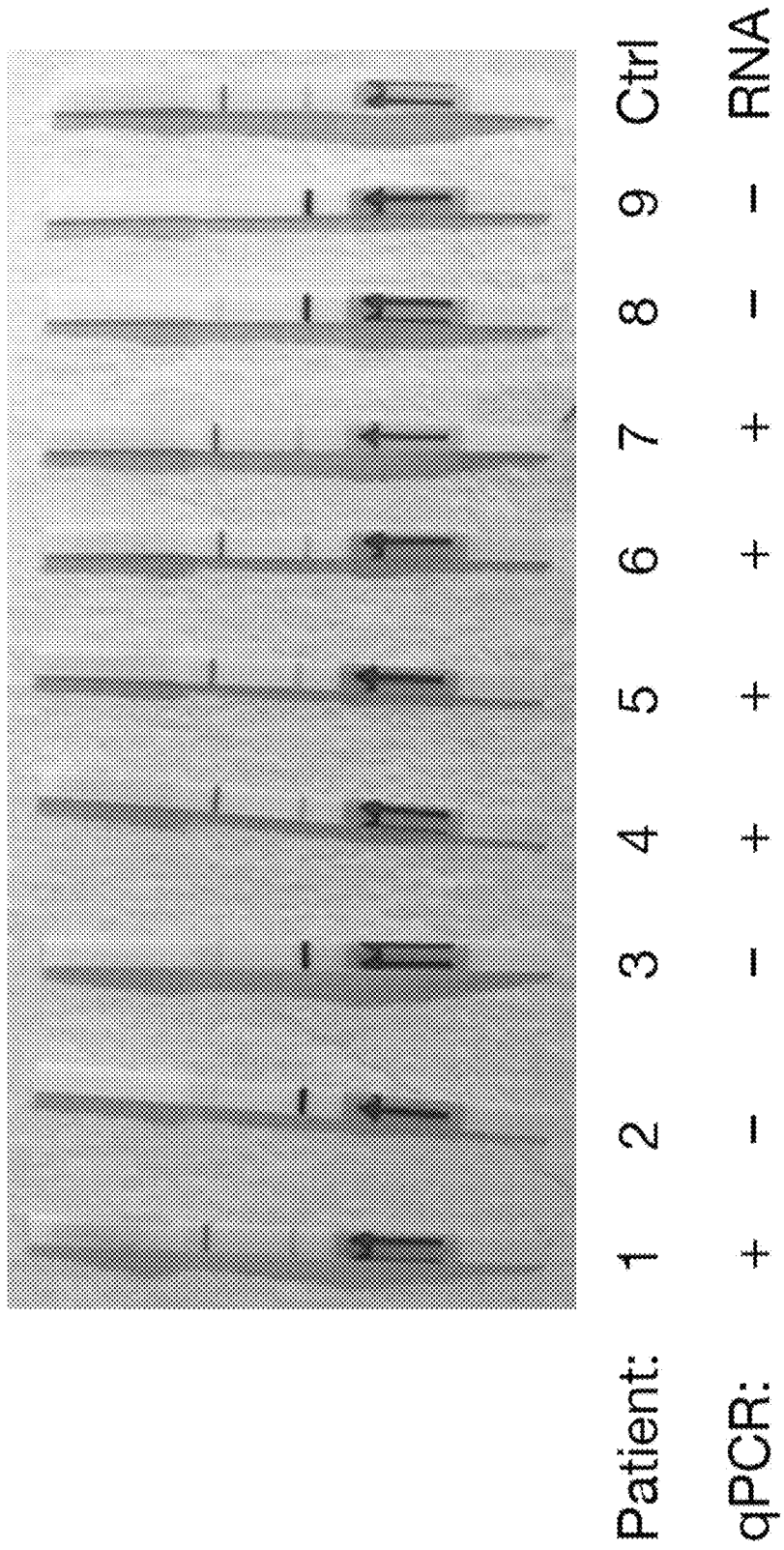

In certain embodiments, a Type V-C locus as intended herein may encode Cas1 and the C2c3p effector protein. See FIG. 14 of PCT/US2016/038238, specifically incorporated by reference, depicting the genomic architecture of the Cas12c CRISPR-Cas loci. In certain embodiments, a Cas1 protein encoded by a Type V-C locus as intended herein may cluster with Type I-B system. See FIG. 10A and 10B and FIG. 10C-V of PCT/US2016/038238, specifically incorporated by reference, illustrating a Cas1 tree including Cas1 encoded by representative Type V-C loci.

In certain embodiments, the effector protein, particularly a Type V loci effector protein, more particularly a Type V-C loci effector protein, even more particularly a C2c3p, such as a native C2c3p, may be about 1100 to about 1500 amino acids long, e.g., about 1100 to about 1200 amino acids long, or about 1200 to about 1300 amino acids long, or about 1300 to about 1400 amino acids long, or about 1400 to about 1500 amino acids long, e.g., about 1100, about 1200, about 1300, about 1400 or about 1500 amino acids long, or at least about 1100, at least about 1200, at least about 1300, at least about 1400 or at least about 1500 amino acids long.

Figure 13:
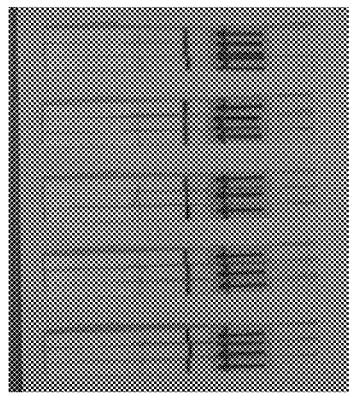
FIG. 13—Shows positive detection of COVID in 12 patients using the SHERLOCK assay.
Figure 13:
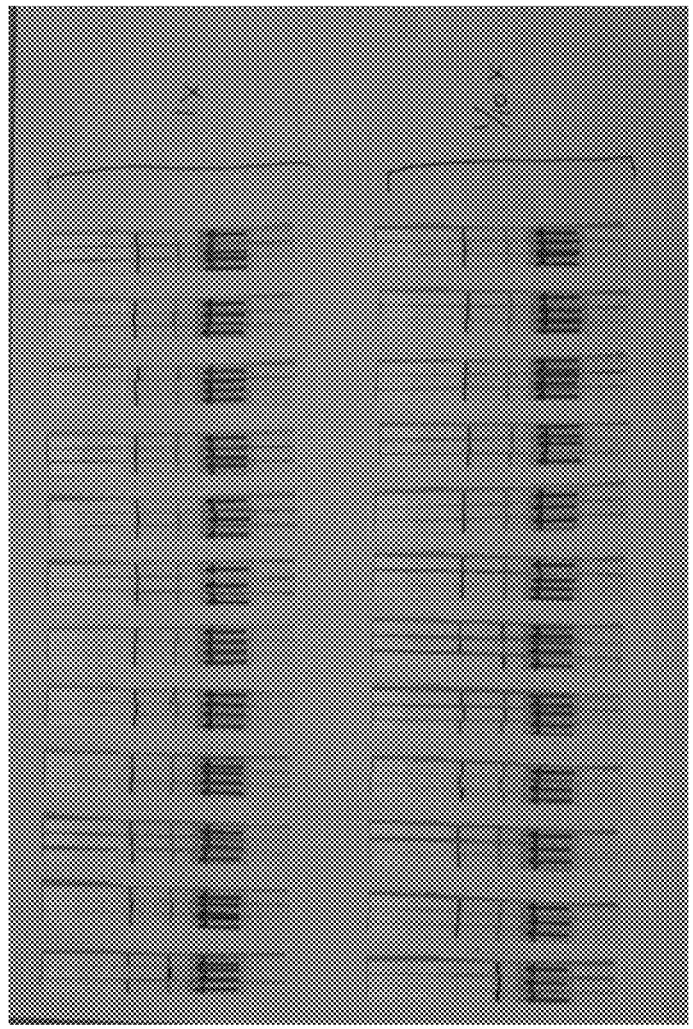

In certain embodiments, the effector protein, particularly a Type V loci effector protein, more particularly a Type V-C loci effector protein, even more particularly a C2c3p, and preferably the C-terminal portion of said effector protein, comprises the three catalytic motifs of the RuvC-like nuclease (i.e., RuvCI, RuvCII and RuvCIII). In certain embodiments, said effector protein, and preferably the C-terminal portion of said effector protein, may further comprise a region corresponding to the bridge helix (also known as arginine-rich cluster) that in Cas9 protein is involved in crRNA-binding. In certain embodiments, said effector protein, and preferably the C-terminal portion of said effector protein, may further comprise a Zn finger region. Preferably, the Zn-binding cysteine residue(s) may be conserved in C2c3p. In certain embodiments, said effector protein, and preferably the C-terminal portion of said effector protein, may comprise the three catalytic motifs of the RuvC-like nuclease (i.e., RuvCI, RuvCII and RuvCIII), the region corresponding to the bridge helix, and the Zn finger region, preferably in the following order, from N to C terminus: RuvCI-bridge helix-RuvCII-Zinc finger-RuvCIII. See FIG. 13A and 13C of PCT/US2016/038238, specifically incorporated by reference, for illustration of representative Type V-C effector proteins domain architecture.

In certain embodiments, Type V-C loci as intended herein may comprise CRISPR repeats between 20 and 30 bp long, more typically between 22 and 27 bp long, yet more typically 25 bp long, e.g., 20, 21, 22, 23, 24, 25, 26, 27, 28, 29, or 30 bp long.

Orthologous proteins may but need not be structurally related, or are only partially structurally related. In particular embodiments, the homologue or orthologue of a Type V protein such as Cas12c as referred to herein has a sequence homology or identity of at least 80%, more preferably at least 85%, even more preferably at least 90%, such as for instance at least 95% with a Cas12c. In further embodiments, the homologue or orthologue of a Type V Cas12c as referred to herein has a sequence identity of at least 80%, more preferably at least 85%, even more preferably at least 90%, such as for instance at least 95% with the wild type Cas12c.

In an embodiment, the Type V RNA-targeting Cas protein may be a Cas12c ortholog of an organism of a genus which includes but is not limited to Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter.*

In an embodiment, the Cas12c or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains. In an embodiment, the Cas12c or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to RuvC I, RuvC II, RuvC III, HNH domains, and HEPN domains.

Guide Sequences

As used herein, the term "guide sequence" and "guide molecule" in the context of a CRISPR-Cas system, comprises any polynucleotide sequence having sufficient complementarity with a target nucleic acid sequence to hybridize with the target nucleic acid sequence and direct sequence-specific binding of a nucleic acid-targeting complex to the target nucleic acid sequence. The guide sequences made using the methods disclosed herein may be a full-length guide sequence, a truncated guide sequence, a full-length sgRNA sequence, a truncated sgRNA sequence, or an E+F sgRNA sequence. In some embodiments, the degree of complementarity of the guide sequence to a given target sequence, when optimally aligned using a suitable alignment algorithm, is about or more than about 50%, 60%, 75%, 80%, 85%, 90%, 95%, 97.5%, 99%, or more. In certain example embodiments, the guide molecule comprises a guide sequence that may be designed to have at least one mismatch with the target sequence, such that a RNA duplex formed between the guide sequence and the target sequence. Accordingly, the degree of complementarity is preferably less than 99%. For instance, where the guide sequence consists of 24 nucleotides, the degree of complementarity is more particularly about 96% or less. In particular embodiments, the guide sequence is designed to have a stretch of two or more adjacent mismatching nucleotides, such that the degree of complementarity over the entire guide sequence is further reduced. For instance, where the guide sequence consists of 24 nucleotides, the degree of complementarity is more particularly about 96% or less, more particularly, about 92% or less, more particularly about 88% or less, more particularly about 84% or less, more particularly about 80% or less, more particularly about 76% or less, more particularly about 72% or less, depending on whether the stretch of two or more mismatching nucleotides encompasses 2, 3, 4, 5, 6 or 7 nucleotides, etc. In some embodiments, aside from the stretch of one or more mismatching nucleotides, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence (or a sequence in the vicinity thereof) may be evaluated in a test tube by providing the target nucleic acid sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art. A guide sequence, and hence a nucleic acid-targeting guide RNA may be selected to target any target nucleic acid sequence.

As used herein, the term "guide sequence," "crRNA," "guide RNA," or "single guide RNA," or "gRNA" refers to a polynucleotide comprising any polynucleotide sequence having sufficient complementarity with a target nucleic acid sequence to hybridize with the target nucleic acid sequence and to direct sequence-specific binding of a RNA-targeting complex comprising the guide sequence and a CRISPR effector protein to the target nucleic acid sequence. In some example embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In certain embodiments, the guide sequence or spacer length of the guide molecules is from 15 to 50 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer. In certain example embodiment, the guide sequence is 15, 16, 17, 18, 19, 20, 21, 22, 23, 24, 25, 26, 27, 28, 29, 30, 31, 32, 33, 34, 35, 36, 37, 38, 39 40, 41, 42, 43, 44, 45, 46, 47 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nt.

In some embodiments, it is of interest to reduce the susceptibility of the guide molecule to RNA cleavage, such as to cleavage by Cas13. Accordingly, in particular embodiments, the guide molecule is adjusted to avoid cleavage by Cas13 or other RNA-cleaving enzymes.

In certain embodiments, the guide molecule comprises non-naturally occurring nucleic acids and/or non-naturally occurring nucleotides and/or nucleotide analogs, and/or chemically modifications. Preferably, these non-naturally occurring nucleic acids and non-naturally occurring nucleotides are located outside the guide sequence. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, or 2'-fluoro analogs. Further examples of modified bases include, but are not limited to, 2-aminopurine, 5-bromo-uridine, pseudouridine, inosine, 7-methylguanosine. Examples of guide RNA chemical modifications include, without limitation, incorporation of 2'-O-methyl (M), 2'-O-methyl 3'phosphorothioate (MS), S-constrained ethyl(cEt), or 2'-O-methyl 3'thioPACE (MSP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9):985-9, doi: 10.1038/nbt.3290, published online 29 Jun. 2015 Ragdarm et al., 0215, PNAS, E7110-E7111; Allerson et al., J. Med. Chem. 2005, 48:901-904; Bramsen et al., Front. Genet., 2012, 3:154; Deng et al., PNAS, 2015, 112:11870-11875; Sharma et al., Med Chem Comm., 2014, 5:1454-1471; Hendel et al., Nat. Biotechnol. (2015) 33(9): 985-989; Li et al., Nature Biomedical Engineering, 2017, 1, 0066 DOI:10.1038/s41551-017-0066). In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233:74-83). In certain embodiments, a guide comprises ribonucleotides in a region that binds to a target RNA and one or more deoxyribonucleotides and/or nucleotide analogs in a region that binds to Cas13. In an embodiment of the invention, deoxyribonucleotides and/or nucleotide analogs are incorporated in engineered guide structures, such as, without limitation, stem-loop regions, and the seed region. For Cas13 guide, in certain embodiments, the modification is not in the 5'-handle of the stem-loop regions. Chemical modification in the 5'-handle of the stem-loop region of a guide may abolish its function (see Li, et al., Nature Biomedical Engineering, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl 3' phosphorothioate (MS), S-constrained ethyl(cEt), or 2'-O-methyl 3' thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., eLife, 2017, 6:e25312, DOI:10.7554).

In some embodiments, a nucleic acid-targeting guide is selected to reduce the degree secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

In some embodiments, a nucleic acid-targeting guide is designed or selected to modulate intermolecular interactions among guide molecules, such as among stem-loop regions of different guide molecules. It will be appreciated that nucleotides within a guide that base-pair to form a stem-loop are also capable of base-pairing to form an intermolecular duplex with a second guide and that such an intermolecular duplex would not have a secondary structure compatible with CRISPR complex formation. Accordingly, is useful to select or design DR sequences in order to modulate stem-loop formation and CRISPR complex formation. In some embodiments, about or less than about 75%, 50%, 40%, 30%, 25%, 20%, 15%, 10%, 5%, 1%, or fewer of nucleic acid-targeting guides are in intermolecular duplexes. It will be appreciated that stem-loop variation will often be within limits imposed by DR-CRISPR effector interactions. One way to modulate stem-loop formation or change the equilibrium between stem-loop and intermolecular duplex is to vary nucleotide pairs in the stem of the stem-loop of a DR. For example, in one embodiment, a G-C pair is replaced by an A-U or U-A pair. In another embodiment, an A-U pair is substituted for a G-C or a C-G pair. In another embodiment, a naturally occurring nucleotide is replaced by a nucleotide analog. Another way to modulate stem-loop formation or change the equilibrium between stem-loop and intermolecular duplex is to modify the loop of the stem-loop of a DR. Without be bound by theory, the loop can be viewed as an intervening sequence flanked by two sequences that are complementary to each other. When that intervening sequence is not self-complementary, its effect will be to destabilize intermolecular duplex formation. The same principle applies when guides are multiplexed: while the targeting sequences may differ, it may be advantageous to modify the stem-loop region in the DRs of the different guides. Moreover, when guides are multiplexed, the relative activities of the different guides can be modulated by balancing the activity of each individual guide. In certain embodiments, the equilibrium between intermolecular stem-loops vs. intermolecular duplexes is determined. The determination may be made by physical or biochemical means and can be in the presence or absence of a CRISPR effector.

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

In general, the CRISPR-Cas, CRISPR-Cas9 or CRISPR system may be as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, in particular a Cas9 gene in the case of CRISPR-Cas9, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. The section of the guide sequence through which complementarity to the target sequence is important for cleavage activity is referred to herein as the seed sequence. A target sequence may comprise any polynucleotide, such as DNA or RNA polynucleotides. In some embodiments, a target sequence is located in the nucleus or cytoplasm of a cell, and may include nucleic acids in or from mitochondrial, organelles, vesicles, liposomes or particles present within the cell. In some embodiments, especially for non-nuclear uses, NLSs are not preferred. In some embodiments, a CRISPR system comprises one or more nuclear exports signals (NESs). In some embodiments, a CRISPR system comprises one or more NLSs and one or more NESs. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Cas to a target genomic locus, are used interchangeably as in foregoing cited documents such as WO 2014/093622 (PCT/US2013/

074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In some embodiments of CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and advantageously tracr RNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

Multiplexing Polynucleotides

Provided herein are engineered polynucleotide sequences that can direct the activity of a CRISPR protein to multiple targets using a single crRNA. The engineered polynucleotide sequences, also referred to as a multiplexing polynucleotides, can include two or more direct repeats interspersed with two or more guide sequences. More specifically, the engineered polynucleotide sequences can include a direct repeat sequence having one or more mutations relative to the corresponding wild type direct repeat sequence. The engineered polynucleotide can be configured, for example, as: 5' DR1-G1-DR2-G2 3'. In some embodiments, the engineered polynucleotide can be configured to include three, four, five, or more additional direct repeat and guide sequences, for example: 5' DR1-G1-DR2-G2-DR3-G3 3', 5" DR1-G1-DR2-G2-DR3-G3-DR4-G4 3', or 5' DR1-G1-DR2-G2-DR3-G3-DR4-G4-DR5-G5 3'.

Regardless of the number of direct repeat sequences, the direct repeat sequences differ from one another. Thus, DR1 can be a wild type sequence and DR2 can include one or more mutations relative to the wild type sequence in accordance with the disclosure provided herein regarding direct repeats for Cas orthologs. The guide sequences can also be the same or different. In some embodiments, the guide sequences can bind to different nucleic acid targets, for example, nucleic acids encoding different polypeptides. The multiplexing polynucleotides can be as described, for example, at [0039]-[0072] in U.S. Application 62/780,748 entitled "CRISPR Cpf1 Direct Repeat Variants" and filed Dec. 17, 2018, incorporated herein in its entirety by reference.

Multiplex design of guide molecules for the detection of coronaviruses and/or other respiratory viruses in a sample to identify the cause of a respiratory infection is envisioned, and design can be according to the methods disclosed herein. Briefly, the design of guide molecules can encompass utilization of training models described herein using a variety of input features, which may include the particular Cas protein used for targeting of the sequences of interest. See U.S. Provisional Application 62/818,702 FIG. 4A, incorporated specifically by reference. Guide molecules can be designed as detailed elsewhere herein. Regarding detection of coronavirus, guide design can be predicated on genome sequences disclosed in Tian et al, "Potent binding of 2019 novel coronavirus spike protein by a SARS coronavirus-specific human monoclonal antibody"; doi: 10.1101/2020.01.28.923011, incorporated by reference, which details human monoclonal antibody, CR3022 binding of the 2019-nCoV RBD (KD of 6.3 nM) or Sequences of the 2019-nCoV are available at GISAID accession no. EPI_ISL_402124 and EPI_ISL_402127-402130, and described in doi:10.1101/2020.01.22.914952, or EP_ISL_402119-402121 and EP_ISL_402123-402124; see also GenBank Accession No. MN908947.3. Guide design can target unique viral genomic regions of SARS-CoV-2 or conserved genomic regions across one or more viruses of the coronavirus family.

Guide Modifications

In certain embodiments, guides of the invention comprise non-naturally occurring nucleic acids and/or non-naturally occurring nucleotides and/or nucleotide analogs, and/or chemical modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, boranophosphate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified bases include, but are not limited to, 2-aminopurine, 5-bromo-uridine, pseudouridine (Ψ), N1-methylpseudouridine (me1Ψ), 5-methoxyuridine (5moU), inosine, 7-methylguanosine. Examples of guide RNA chemical modifications include, without limitation, incorporation of 2'-O-methyl (M), 2'-O-methyl-3'-phosphorothioate (MS), phosphorothioate (PS), S-constrained ethyl(cEt), or 2'-O-methyl-3'-thioPACE (MSP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9):985-9, doi: 10.1038/nbt.3290, published online 29 Jun. 2015; Ragdarm et al., 0215, PNAS, E7110-E7111; Allerson et al., J. Med. Chem. 2005, 48:901-904; Bramsen et al., Front. Genet., 2012, 3:154; Deng et al., PNAS, 2015, 112:11870-11875; Sharma et al., Med Chem Comm., 2014, 5:1454-1471; Hendel et al., Nat. Biotechnol. (2015) 33(9): 985-989; Li et al., Nature Biomedical Engineering, 2017, 1, 0066 DOI:10.1038/s41551-017-0066). In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233:74-83). In certain embodiments, a guide comprises ribonucleotides in a region that binds to a target DNA and one or more deoxyribonucleotides and/or nucleotide analogs in a region that binds to Cas9, Cpf1, or C2c1. In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 5'-handle of the stem-loop regions. Chemical modification in the 5'-handle of the stem-loop region of a guide may abolish its function (see Li, et al., Nature Biomedical Engineering, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), or 2'-O-methyl-3'-thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., eLife, 2017, 6:e25312, DOI:10.7554).

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, use is made of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target RNA may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromo-uridine, pseudouridine (Ψ), N1-methylpseudouridine (me1Ψ), 5-methoxyuridine (5moU), inosine, 7-methyl-guanosine, 2'-O-methyl-3'-phosphorothioate (MS), S-constrained ethyl(cEt), phosphorothioate (PS), or 2'-O-methyl-3'-thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 3'-terminus are chemically modified. Such chemical modifications at the 3'-terminus of the Cpf1 CrRNA improve gene cutting efficiency (see Li, et al., Nature Biomedical Engineering, 2017, 1:0066). In a specific embodiment, 5 nucleotides in the 3'-terminus are replaced with 2'-fluoro analogues. In a specific embodiment, 10 nucleotides in the 3'-terminus are replaced with 2'-fluoro analogues. In a specific embodiment, 5 nucleotides in the 3'-terminus are replaced with 2'-O-methyl (M) analogs.

In some embodiments, the loop of the 5'-handle of the guide is modified. In some embodiments, the loop of the 5'-handle of the guide is modified to have a deletion, an insertion, a split, or chemical modifications. In certain embodiments, the loop comprises 3, 4, or 5 nucleotides. In certain embodiments, the loop comprises the sequence of UCUU, UUUU, UAUU, or UGUU.

A guide sequence, and hence a nucleic acid-targeting guide RNA may be selected to target any target nucleic acid sequence. In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nuclear RNA (snoRNA), double stranded RNA (dsRNA), non coding RNA (ncRNA), long non-coding RNA (lncRNA), and small cytoplasmic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In certain embodiments, the spacer length of the guide RNA is less than 28 nucleotides. In certain embodiments, the spacer length of the guide RNA is at least 18 nucleotides and less than 28 nucleotides. In certain embodiments, the spacer length of the guide RNA is between 19 and 28 nucleotides. In certain embodiments, the spacer length of the guide RNA is between 19 and 25 nucleotides. In certain embodiments, the spacer length of the guide RNA is 20 nucleotides. In certain embodiments, the spacer length of the guide RNA is 23 nucleotides. In certain embodiments, the spacer length of the guide RNA is 25 nucleotides.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

In certain example embodiments, the cleavage efficiency may be exploited to design single guides that can distinguish two or more targets that vary by a single nucleotide, such as a single nucleotide polymorphism (SNP), variation, or (point) mutation. The CRISPR effector may have reduced sensitivity to SNPs (or other single nucleotide variations) and continue to cleave SNP targets with a certain level of efficiency. Thus, for two targets, or a set of targets, a guide RNA may be designed with a nucleotide sequence that is complementary to one of the targets i.e. the on-target SNP. The guide RNA is further designed to have a synthetic mismatch. As used herein a "synthetic mismatch" refers to a non-naturally occurring mismatch that is introduced upstream or downstream of the naturally occurring SNP, such as at most 5 nucleotides upstream or downstream, for instance 4, 3, 2, or 1 nucleotide upstream or downstream, preferably at most 3 nucleotides upstream or downstream, more preferably at most 2 nucleotides upstream or downstream, most preferably 1 nucleotide upstream or downstream (i.e. adjacent the SNP). When the CRISPR effector binds to the on-target SNP, only a single mismatch will be formed with the synthetic mismatch and the CRISPR effector will continue to be activated and a detectable signal produced. When the guide RNA hybridizes to an off-target SNP, two mismatches will be formed, the mismatch from the SNP and the synthetic mismatch, and no detectable signal generated. Thus, the systems disclosed herein may be designed to distinguish SNPs within a population. For, example the systems may be used to distinguish pathogenic strains that differ by a single SNP or detect certain disease specific SNPs, such as but not limited to, disease associated SNPs, such as without limitation cancer associated SNPs.

In certain embodiments, the guide RNA is designed such that the SNP is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the SNP is located on position 1, 2, 3, 4, 5, 6, 7, 8, or 9 of the spacer sequence (starting at the 5' end). In certain embodiments, the guide RNA is designed such that the SNP is located on position 2, 3, 4, 5, 6, or 7 of the spacer sequence (starting at the 5' end). In certain embodiments, the guide RNA is designed such that the SNP is located on position 3, 4, 5, or 6 of the spacer sequence (starting at the 5' end). In certain embodiments, the guide RNA is designed such that the SNP is located on position 3 of the spacer sequence (starting at the 5' end).

In certain embodiments, the guide RNA is designed such that the mismatch (e.g. the synthetic mismatch, i.e. an additional mutation besides a SNP) is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the mismatch is located on position 1, 2, 3, 4, 5, 6, 7, 8, or 9 of the spacer sequence (starting at the 5' end). In certain embodiments, the guide RNA is designed such that the mismatch is located on position 4, 5, 6, or 7 of the spacer sequence (starting at the 5' end. In certain embodiments, the guide RNA is designed such that the mismatch is located at position 3, 4, 5, or 6 of the spacer, preferably position 3. In certain embodiments, the guide RNA is designed such that the mismatch is located on position 5 of the spacer sequence (starting at the 5' end).

In certain embodiments, said mismatch is 1, 2, 3, 4, or 5 nucleotides upstream or downstream, preferably 2 nucleotides, preferably downstream of said SNP or other single nucleotide variation in said guide RNA.

In certain embodiments, the guide RNA is designed such that the mismatch is located 2 nucleotides upstream of the SNP (i.e. one intervening nucleotide).

In certain embodiments, the guide RNA is designed such that the mismatch is located 2 nucleotides downstream of the SNP (i.e. one intervening nucleotide).

In certain embodiments, the guide RNA is designed such that the mismatch is located on position 5 of the spacer sequence (starting at the 5' end) and the SNP is located on position 3 of the spacer sequence (starting at the 5' end).

In certain embodiments, the guide RNA comprises a spacer which is truncated relative to a wild type spacer. In certain embodiments, the guide RNA comprises a spacer which comprises less than 28 nucleotides, preferably between and including 20 to 27 nucleotides.

In certain embodiments, the guide RNA comprises a spacer which consists of 20-25 nucleotides or 20-23 nucleotides, such as preferably 20 or 23 nucleotides.

In certain embodiments, the one or more guide RNAs are designed to detect a single nucleotide polymorphism in a target RNA or DNA, or a splice variant of an RNA transcript.

In certain embodiments, the one or more guide RNAs may be designed to bind to one or more target molecules that are diagnostic for a disease state. In some embodiments, the disease may be cancer. In some embodiments, the disease state may be an autoimmune disease. In some embodiments, the disease state may be an infection. In some embodiments, the infection may be caused by a virus, a bacterium, a fungus, a protozoa, or a parasite. In specific embodiments, the infection is a viral infection. In specific embodiments, the viral infection is caused by a DNA virus.

The embodiments described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

Methods for Designing Highly Active Guides

A method for designing highly active guide molecules, e.g., guide RNAs, for use in the detection systems may comprise the steps of designing putative guide RNAs tiled across a target molecule of interest; creating a training model based on results of incubating guide RNAs with a Cas protein and the target molecule; predicting highly active guide RNAs for the target molecule, wherein the predicting comprises optimizing the nucleotide at each base position in the guide RNA based on the training model; and validating the predicted highly active guide RNAs by incubating the guide RNAs with the Cas protein and the target molecule. The method can be as described in U.S. Provisional Application Nos. 62/818,702 and 62/890,555, incorporated by reference in their entirety. Guide RNAs generate by the design methods can be used with the systems for detecting coronavirus as described elsewhere herein. The guide RNAs generated by these design methods can further be used to generate optimized guides with reaction conditions and/or reagents optimization.

In some embodiments, the invention provides a method for designing guide RNAs for use in the detection systems described herein. The method may comprise designing putative guide RNAs tiled across a target molecule of interest, such as a coronavirus, viruses that cause respiratory illness, including coronavirus, including 2019-nCov (Covid-19). The method may further comprise creating a training model based on results of incubating guide RNAs with a Cas protein and the target molecule. The method may further comprise predicting highly active guide RNAs for the target molecule. Predicting may comprise optimizing the nucleotide at each base position in the guide RNA based on the training model. The method may further comprise validating the predicted highly active guide RNAs by incubating the guide RNAs with the Cas protein and the target molecule.

In certain instances, the optimized guide for the target molecule is generated by pooling a set of guides, the guides produced by tiling guides across the target molecule; incubating the set of guides with a Cas polypeptide and the target molecule and measuring cleavage activity of each guide in the set; creating a training model based on the cleavage activity of the set of guides in the incubating step. Steps of predicting highly active guides for the target molecule and identifying the optimized guides by incubating the predicted highly active guides with the Cas polypeptide and the target molecule and selecting optimized guides may also be utilized in generating optimized guides. In embodiments, the training model comprises one or more input features selected from guide sequence, flanking target sequence, normalized positions of the guide in the target and guide GC content. In certain instances, the guide sequence and/or flanking sequence input comprises one hit encoding mono-nucleotide and/or dinucleotide In an embodiment, the training model comprises applying logistic regression model on the activity of the guides across the one or more input features.

In an aspect, the predicting highly active guides for the target molecule comprises selecting guides with an increase in activity of a guide relative to the median activity, or selecting guides with highest guide activity. In certain instances, the increase in activity is measured by an increase in fluorescence. Guides may be selected based on a particular cutoff, in certain instances based on activity relative to a median or above a particular cutoff-, for instance, are selected with a 1.5, 2, 2.5 or 3-fold activity relative to median, or are in the top quartile or quintile for each target tested.

The optimized guides may be generated for a Cas13 ortholog, in some instances, the optimized guide is generated for an LwaCas13a or a Cca13b ortholog.

In some embodiments, the invention provides a method for designing guide RNAs for use in the detection systems described herein. The method may comprise designing putative guide RNAs tiled across a target molecule of interest. The method may further comprise creating a training model based on results of incubating guide RNAs with a Cas13 protein and the target molecule. The method may further comprise predicting highly active guide RNAs for the target molecule. Predicting may comprise optimizing the nucleotide at each base position in the guide RNA based on the training model. The method may further comprise validating the predicted highly active guide RNAs by incubating the guide RNAs with the Cas13 protein and the target molecule.

Guides may be screened for on-target and off-target effects. When using LAMP amplification, the products of LAMP can help identify those guides with more minimal off-target effects relative to on-target products.

The design of putative guide RNAs for target molecules of interest is described elsewhere herein.

The creation of training models is known in the art. Machine learning can be generalized as the ability of a learning machine to perform accurately on new, unseen examples/tasks after having experienced a learning data set. Machine learning may include the following concepts and methods. Supervised learning concepts may include AODE; Artificial neural network, such as Backpropagation, Auto-encoders, Hopfield networks, Boltzmann machines, Restricted Boltzmann Machines, and Spiking neural networks; Bayesian statistics, such as Bayesian network and Bayesian knowledge base; Case-based reasoning; Gaussian process regression; Gene expression programming; Group method of data handling (GMDH); Inductive logic programming; Instance-based learning; Lazy learning; Learning Automata; Learning Vector Quantization; Logistic Model Tree; Minimum message length (decision trees, decision graphs, etc.), such as Nearest Neighbor Algorithm and Analogical modeling; Probably approximately correct learning (PAC) learning; Ripple down rules, a knowledge acquisition methodology; Symbolic machine learning algorithms; Support vector machines; Random Forests; Ensembles of classifiers, such as Bootstrap aggregating (bagging) and Boosting (meta-algorithm); Ordinal classification; Information fuzzy networks (IFN); Conditional Random Field; ANOVA; Linear classifiers, such as Fisher's linear discriminant, Linear regression, Logistic regression, Multinomial logistic regression, Naive Bayes classifier, Perceptron, Support vector machines; Quadratic classifiers; k-nearest neighbor; Boosting; Decision trees, such as C4.5, Random forests, ID3, CART, SLIQ, SPRINT; Bayesian networks, such as Naive Bayes; and Hidden Markov models. Unsupervised learning concepts may include; Expectation-maximization algorithm; Vector Quantization; Generative topographic map; Information bottleneck method; Artificial neural network, such as Self-organizing map; Association rule learning, such as, Apriori algorithm, Eclat algorithm, and FP-growth algorithm; Hierarchical clustering, such as Single-linkage clustering and Conceptual clustering; Cluster analysis, such as, K-means algorithm, Fuzzy clustering, DBSCAN, and OPTICS algorithm; and Outlier Detection, such as Local Outlier Factor. Semi-supervised learning concepts may include; Generative models; Low-density separation; Graph-based methods; and Co-training. Reinforcement learning concepts may include; Temporal difference learning; Q-learning; Learning Automata; and SARSA. Deep learning concepts may include; Deep belief networks; Deep Boltzmann machines; Deep Convolutional neural networks; Deep Recurrent neural networks; and Hierarchical temporal memory.

The methods as disclosed herein designing putative guide RNAs may comprise design based on one or more variables, including guide sequence, flanking target sequence, guide position and guide GC content as input features. In certain embodiments, the length of the flanking target region can be considered a free parameter and can be further selected during cross-validation. Additionally, mono-nucleotide and/or dinucleotide based identities across a guide length and flanking sequence in the target, varying one or more of flanking sequence length, normalized positions of the guide in the target, and GC content of the guide, or a combination thereof.

In embodiments, the training model for the guide design of highly active guides is Cas protein specific. In embodiments, the Cas protein is a Cas13a, Cas13b, a Cas12a and/or a Cas12b protein. In certain embodiments, the protein is LwaCas13a or CcaCas13b. Selection for the best guides can be dependent on each enzyme. In particular embodiments, where majority of guides have activity above background on a per-target basis, selection of guides may be based on 1.5 fold, 2, 2.5, 3 or more fold activity over the median activity. In other instances, the best performing guides may be at or near background fluorescence. In this instance, the guide selection may be based on a top percentile, e.g. quartile or quintile, of performing guides.

Codon optimization is described elsewhere herein. In specific embodiments, the nucleotide at each base position in the guide RNA may be optimized based on the training model, thus allowing for prediction of highly active guide RNAs for the target molecule.

The predicted highly active guide RNAs may then be validated or verified by incubating the guide RNAs with a Cas effector protein, such as Cas13 protein and the target molecule(s) for coronavirus, for example coronavirus sequence that is immunostimulatory to a host immune system, or a target sequence unique to the 2019-nCov, as described elsewhere herein.

In certain embodiments, optimization comprises validation of best performing models for a particular Cas polypeptide across multiple guides may comprise comparing the predicted score of each guide versus actual collateral activity upon target recognition. In embodiments, kinetic data of the best and worst predicted guides are evaluated. In embodiments, lateral flow performance of the predicted guides is evaluated for a target sequence.

In an aspect, the guide sequence is selected from SEQ ID NO: 40,500-61,643.

Detection Construct

The systems and methods described herein comprise a detection construct. As used herein, a "detection construct" refers to a molecule that can be cleaved or otherwise deactivated by an activated CRISPR system effector protein described herein. The term "detection construct" may also be referred to in the alternative as a "masking construct." Depending on the nuclease activity of the CRISPR effector protein, the masking construct may be a RNA-based masking construct or a DNA-based masking construct. The Nucleic Acid-based masking constructs comprises a nucleic acid element that is cleavable by a CRISPR effector protein. Cleavage of the nucleic acid element releases agents or produces conformational changes that allow a detectable signal to be produced. Example constructs demonstrating how the nucleic acid element may be used to prevent or mask generation of detectable signal are described below and embodiments of the invention comprise variants of the same. Prior to cleavage, or when the masking construct is in an 'active' state, the masking construct blocks the generation or detection of a positive detectable signal. In certain embodiments, detection constructs are designed for cutting motifs of particular Cas proteins. See, International Publication WO 2019/126577, incorporated herein by reference in its entirety, and specifically paragraphs [00314]-[00356], Table 25, and Examples 8-10, for teaching of design of detection constructs for Cas proteins with preferred cutting motifs. For example, when AapCas12b is used, a reporter designed with A and T bases can be utilized because of preferred cleavage specificity. In an aspect, a reporter comprising sequence TTTTTTT is utilized with AapCas12b systems.

It will be understood that in certain example embodiments a minimal background signal may be produced in the presence of an active masking construct. A positive detectable signal may be any signal that can be detected using optical, fluorescent, chemiluminescent, electrochemical or other detection methods known in the art. The term "positive detectable signal" is used to differentiate from other detectable signals that may be detectable in the presence of the masking construct. For example, in certain embodiments a first signal may be detected when the masking agent is present or when a CRISPR system has not been activated (i.e. a negative detectable signal), which then converts to a second signal (e.g. the positive detectable signal) upon detection of the target molecules and cleavage or deactivation of the masking agent, or upon activation of the CRISPR effector protein. The positive detectable signal, then, is a signal detected upon activation of the CRISPR effector protein, and may be, in a colorimetric or fluorescent assay, a decrease in fluorescence or color relative to a control or an increase in fluorescence or color relative to a control, depending on the configuration of the lateral flow substrate, and as described further herein.

In certain example embodiments, the masking construct may comprise a HCR initiator sequence and a cutting motif, or a cleavable structural element, such as a loop or hairpin, that prevents the initiator from initiating the HCR reaction. The cutting motif may be preferentially cut by one of the activated CRISPR effector proteins. Upon cleavage of the cutting motif or structure element by an activated CRISPR effector protein, the initiator is then released to trigger the HCR reaction, detection thereof indicating the presence of one or more targets in the sample. In certain example embodiments, the masking construct comprises a hairpin with a RNA loop. When an activated CRISPR effector protein cuts the RNA loop, the initiator can be released to trigger the HCR reaction.

In certain example embodiments, the masking construct may suppress generation of a gene product. The gene product may be encoded by a reporter construct that is added to the sample. The masking construct may be an interfering RNA involved in a RNA interference pathway, such as a short hairpin RNA (shRNA) or small interfering RNA (siRNA). The masking construct may also comprise microRNA (miRNA). While present, the masking construct suppresses expression of the gene product. The gene product may be a fluorescent protein or other RNA transcript or proteins that would otherwise be detectable by a labeled probe, aptamer, or antibody but for the presence of the masking construct. Upon activation of the effector protein the masking construct is cleaved or otherwise silenced allowing for expression and detection of the gene product as the positive detectable signal. In preferred embodiments, the masking constructs comprise two or more detectable signals, for example, fluorescent signals, that can be read on different channels of a fluorimeter.

In specific embodiments, the masking construct comprises a silencing RNA that suppresses generation of a gene product encoded by a reporting construct, wherein the gene product generates the detectable positive signal when expressed.

In certain example embodiments, the masking construct may sequester one or more reagents needed to generate a detectable positive signal such that release of the one or more reagents from the masking construct results in generation of the detectable positive signal. The one or more reagents may combine to produce a colorimetric signal, a chemiluminescent signal, a fluorescent signal, or any other detectable signal and may comprise any reagents known to be suitable for such purposes. In certain example embodiments, the one or more reagents are sequestered by RNA aptamers that bind the one or more reagents. The one or more reagents are released when the effector protein is activated upon detection of a target molecule and the RNA or DNA aptamers are degraded.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is a RNA- or DNA-based aptamer that can be cleaved by the activated effector protein upon detection of a target molecule.

In certain other example embodiments, the masking construct binds to an immobilized reagent in solution thereby blocking the ability of the reagent to bind to a separate labeled binding partner that is free in solution. Thus, upon application of a washing step to a sample, the labeled binding partner can be washed out of the sample in the absence of a target molecule. However, if the effector protein is activated, the masking construct is cleaved to a degree sufficient to interfere with the ability of the masking construct to bind the reagent thereby allowing the labeled binding partner to bind to the immobilized reagent. Thus, the labeled binding partner remains after the wash step indicating the presence of the target molecule in the sample. In certain aspects, the masking construct that binds the immobilized reagent is a DNA or RNA aptamer. The immobilized reagent may be a protein and the labeled binding partner may be a labeled antibody. Alternatively, the immobilized reagent may be streptavidin and the labeled binding partner may be labeled biotin. The label on the binding partner used in the above embodiments may be any detectable label known in the art. In addition, other known binding partners may be used in accordance with the overall design described herein.

In certain example embodiments, the masking construct may comprise a ribozyme. Ribozymes are RNA molecules having catalytic properties. Ribozymes, both naturally and engineered, comprise or consist of RNA that may be targeted by the effector proteins disclosed herein. The ribozyme may be selected or engineered to catalyze a reaction that either generates a negative detectable signal or prevents generation of a positive control signal. Upon deactivation of the ribozyme by the activated effector protein the reaction generating a negative control signal, or preventing generation of a positive detectable signal, is removed thereby allowing a positive detectable signal to be generated. In one example embodiment, the ribozyme may catalyze a colorimetric reaction causing a solution to appear as a first color. When the ribozyme is deactivated the solution then turns to a second color, the second color being the detectable positive signal. An example of how ribozymes can be used to catalyze a colorimetric reaction are described in Zhao et al. "Signal amplification of glucosamine-6-phosphate based on ribozyme glmS," Biosens Bioelectron. 2014; 16:337-42, and provide an example of how such a system could be modified to work in the context of the embodiments disclosed herein. Alternatively, ribozymes, when present can generate cleavage products of, for example, RNA transcripts. Thus, detection of a positive detectable signal may comprise detection of non-cleaved RNA transcripts that are only generated in the absence of the ribozyme.

In some embodiments, the masking construct may be a ribozyme that generates a negative detectable signal, and wherein a positive detectable signal is generated when the ribozyme is deactivated.

In certain example embodiments, the one or more reagents is a protein, such as an enzyme, capable of facilitating generation of a detectable signal, such as a colorimetric, chemiluminescent, or fluorescent signal, that is inhibited or sequestered such that the protein cannot generate the detectable signal by the binding of one or more DNA or RNA aptamers to the protein. Upon activation of the effector proteins disclosed herein, the DNA or RNA aptamers are cleaved or degraded to an extent that they no longer inhibit the protein's ability to generate the detectable signal. In certain example embodiments, the aptamer is a thrombin inhibitor aptamer. In certain example embodiments the thrombin inhibitor aptamer has a sequence of GGGAACAAAGCUGAAGUACUUACCC (SEQ ID NO: 61973). When this aptamer is cleaved, thrombin will become active and will cleave a peptide colorimetric or fluorescent substrate. In certain example embodiments, the colorimetric substrate is para-nitroanilide (pNA) covalently linked to the peptide substrate for thrombin. Upon cleavage by thrombin, pNA is released and becomes yellow in color and easily visible to the eye. In certain example embodiments, the fluorescent substrate is 7-amino-4-methylcoumarin a blue fluorophore that can be detected using a fluorescence detector. Inhibitory aptamers may also be used for horseradish peroxidase (HRP), beta-galactosidase, or calf alkaline phosphatase (CAP) and within the general principals laid out above.

In certain embodiments, RNAse or DNAse activity is detected colorimetrically via cleavage of enzyme-inhibiting aptamers. One potential mode of converting DNAse or RNAse activity into a colorimetric signal is to couple the cleavage of a DNA or RNA aptamer with the re-activation of an enzyme that is capable of producing a colorimetric output. In the absence of RNA or DNA cleavage, the intact aptamer will bind to the enzyme target and inhibit its activity. The advantage of this readout system is that the enzyme provides an additional amplification step: once liberated from an aptamer via collateral activity (e.g. Cpf1 collateral activity), the colorimetric enzyme will continue to produce colorimetric product, leading to a multiplication of signal.

In certain embodiments, an existing aptamer that inhibits an enzyme with a colorimetric readout is used. Several aptamer/enzyme pairs with colorimetric readouts exist, such as thrombin, protein C, neutrophil elastase, and subtilisin. These proteases have colorimetric substrates based upon pNA and are commercially available. In certain embodiments, a novel aptamer targeting a common colorimetric enzyme is used. Common and robust enzymes, such as beta-galactosidase, horseradish peroxidase, or calf intestinal alkaline phosphatase, could be targeted by engineered aptamers designed by selection strategies such as SELEX. Such strategies allow for quick selection of aptamers with nanomolar binding efficiencies and could be used for the development of additional enzyme/aptamer pairs for colorimetric readout.

In certain embodiments, the masking construct may be a DNA or RNA aptamer and/or may comprise a DNA or RNA-tethered inhibitor.

In certain embodiments, the masking construct may comprise a DNA or RNA oligonucleotide to which a detectable ligand and a masking component are attached.

In certain embodiments, RNAse or DNase activity is detected colorimetrically via cleavage of RNA-tethered inhibitors. Many common colorimetric enzymes have competitive, reversible inhibitors: for example, beta-galactosidase can be inhibited by galactose. Many of these inhibitors are weak, but their effect can be increased by increases in local concentration. By linking local concentration of inhibitors to DNase RNAse activity, colorimetric enzyme and inhibitor pairs can be engineered into DNase and RNAse sensors. The colorimetric DNase or RNAse sensor based upon small-molecule inhibitors involves three components: the colorimetric enzyme, the inhibitor, and a bridging RNA or DNA that is covalently linked to both the inhibitor and enzyme, tethering the inhibitor to the enzyme. In the uncleaved configuration, the enzyme is inhibited by the increased local concentration of the small molecule; when the DNA or RNA is cleaved (e.g. by Cas13 or Cas12 collateral cleavage), the inhibitor will be released and the colorimetric enzyme will be activated.

In certain embodiments, the aptamer or DNA- or RNA-tethered inhibitor may sequester an enzyme, wherein the enzyme generates a detectable signal upon release from the aptamer or DNA or RNA tethered inhibitor by acting upon a substrate. In some embodiments, the aptamer may be an inhibitor aptamer that inhibits an enzyme and prevents the enzyme from catalyzing generation of a detectable signal from a substance. In some embodiments, the DNA- or RNA-tethered inhibitor may inhibit an enzyme and may prevent the enzyme from catalyzing generation of a detectable signal from a substrate.

In certain embodiments, RNAse activity is detected colorimetrically via formation and/or activation of G-quadruplexes. G quadruplexes in DNA can complex with heme (iron (III)-protoporphyrin IX) to form a DNAzyme with peroxidase activity. When supplied with a peroxidase substrate (e.g. ABTS: (2,2'-Azinobis [3-ethylbenzothiazoline-6-sulfonic acid]-diammonium salt)), the G-quadruplex-heme complex in the presence of hydrogen peroxide causes oxidation of the substrate, which then forms a green color in solution. An example G-quadruplex forming DNA sequence is: GGGTAGGGCGGGTTGGGA (SEQ ID NO: 61974). By hybridizing an additional DNA or RNA sequence, referred to herein as a "staple," to this DNA aptamer, formation of the G-quadraplex structure will be limited. Upon collateral activation, the staple will be cleaved allowing the G quadraplex to form and heme to bind. This strategy is particularly appealing because color formation is enzymatic, meaning there is additional amplification beyond collateral activation.

In certain embodiments, the masking construct may comprise an RNA oligonucleotide designed to bind a G-quadruplex forming sequence, wherein a G-quadruplex structure is formed by the G-quadruplex forming sequence upon cleavage of the masking construct, and wherein the G-quadruplex structure generates a detectable positive signal.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is a DNA- or RNA-based aptamer that can be cleaved by the activated effector protein upon detection of a target molecule.

In one example embodiment, the masking construct comprises a detection agent that changes color depending on whether the detection agent is aggregated or dispersed in solution. For example, certain nanoparticles, such as colloidal gold, undergo a visible purple to red color shift as they move from aggregates to dispersed particles. Accordingly, in certain example embodiments, such detection agents may be held in aggregate by one or more bridge molecules. At least a portion of the bridge molecule comprises RNA or DNA. Upon activation of the effector proteins disclosed herein, the RNA or DNA portion of the bridge molecule is cleaved allowing the detection agent to disperse and resulting in the corresponding change in color. In certain example embodiments, the detection agent is a colloidal metal. The colloidal metal material may include water-insoluble metal particles or metallic compounds dispersed in a liquid, a hydrosol, or a metal sol. The colloidal metal may be selected from the metals in groups IA, IB, IIB and IIIB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the $Al^{3+}$, $Ru^{3+}$, $Zn^{2+}$, $Fe^{3+}$, $Ni^{2+}$ and $Ca^{2+}$ ions.

When the RNA or DNA bridge is cut by the activated CRISPR effector, the aforementioned color shift is observed. In certain example embodiments the particles are colloidal metals. In certain other example embodiments, the colloidal metal is a colloidal gold. In certain example embodiments, the colloidal nanoparticles are 15 nm gold nanoparticles (AuNPs). Due to the unique surface properties of colloidal gold nanoparticles, maximal absorbance is observed at 520 nm when fully dispersed in solution and appear red in color to the naked eye. Upon aggregation of AuNPs, they exhibit a red-shift in maximal absorbance and appear darker in color, eventually precipitating from solution as a dark purple aggregate. In certain example embodiments the nanoparticles are modified to include DNA linkers extending from the surface of the nanoparticle. Individual particles are linked together by single-stranded RNA (ssRNA) or single-stranded DNA bridges that hybridize on each end to at least a portion of the DNA linkers. Thus, the nanoparticles will form a web of linked particles and aggregate, appearing as a dark precipitate. Upon activation of the CRISPR effectors disclosed herein, the ssRNA or ssDNA bridge will be cleaved, releasing the AU NPS from the linked mesh and producing a visible red color. Example DNA linkers and bridge sequences are listed below. Thiol linkers on the end of the DNA linkers may be used for surface conjugation to the AuNPS. Other forms of conjugation may be used. In certain example embodiments, two populations of AuNPs may be generated, one for each DNA linker. This will help facilitate proper binding of the ssRNA bridge with proper orientation. In certain example embodiments, a first DNA linker is conjugated by the 3' end while a second DNA linker is conjugated by the 5' end.

In certain other example embodiments, the masking construct may comprise an RNA or DNA oligonucleotide to which are attached a detectable label and a masking agent of that detectable label. An example of such a detectable label/masking agent pair is a fluorophore and a quencher of the fluorophore. Quenching of the fluorophore can occur as a result of the formation of a non-fluorescent complex between the fluorophore and another fluorophore or non-fluorescent molecule. This mechanism is known as ground-state complex formation, static quenching, or contact quenching. Accordingly, the RNA or DNA oligonucleotide may be designed so that the fluorophore and quencher are in sufficient proximity for contact quenching to occur. Fluorophores and their cognate quenchers are known in the art and can be selected for this purpose by one having ordinary skill in the art. The particular fluorophore/quencher pair is not critical in the context of this invention, only that selection of the fluorophore/quencher pairs ensures masking of the fluorophore. Upon activation of the effector proteins disclosed herein, the RNA or DNA oligonucleotide is cleaved thereby severing the proximity between the fluorophore and quencher needed to maintain the contact quenching effect. Accordingly, detection of the fluorophore may be used to determine the presence of a target molecule in a sample.

In certain other example embodiments, the masking construct may comprise one or more RNA oligonucleotides to which are attached one or more metal nanoparticles, such as gold nanoparticles. In some embodiments, the masking construct comprises a plurality of metal nanoparticles crosslinked by a plurality of RNA or DNA oligonucleotides forming a closed loop. In one embodiment, the masking construct comprises three gold nanoparticles crosslinked by three RNA or DNA oligonucleotides forming a closed loop. In some embodiments, the cleavage of the RNA or DNA oligonucleotides by the CRISPR effector protein leads to a detectable signal produced by the metal nanoparticles.

In certain other example embodiments, the masking construct may comprise one or more RNA or DNA oligonucleotides to which are attached one or more quantum dots. In some embodiments, the cleavage of the RNA or DNA oligonucleotides by the CRISPR effector protein leads to a detectable signal produced by the quantum dots.

In one example embodiment, the masking construct may comprise a quantum dot. The quantum dot may have multiple linker molecules attached to the surface. At least a portion of the linker molecule comprises RNA or DNA. The linker molecule is attached to the quantum dot at one end and to one or more quenchers along the length or at terminal ends of the linker such that the quenchers are maintained in sufficient proximity for quenching of the quantum dot to occur. The linker may be branched. As above, the quantum dot/quencher pair is not critical, only that selection of the quantum dot/quencher pair ensures masking of the fluorophore. Quantum dots and their cognate quenchers are known in the art and can be selected for this purpose by one having ordinary skill in the art. Upon activation of the effector proteins disclosed herein, the RNA or DNA portion of the linker molecule is cleaved thereby eliminating the proximity between the quantum dot and one or more quenchers needed to maintain the quenching effect. In certain example embodiments the quantum dot is streptavidin conjugated. RNA or DNA are attached via biotin linkers and recruit quenching molecules with the sequences /5Biosg/ UCUCGUACGUUC/3IAbRQSp/ (SEQ ID NO:61975) or /5Biosg/UCUCGUACGUUCUCUCGUACGUUC/ 3IAbRQSp/ (SEQ ID NO: 61976) where /5Biosg/ is a biotin tag and/31AbRQSp/ is an Iowa black quencher (Iowa Black FQ). Upon cleavage, by the activated effectors disclosed herein the quantum dot will fluoresce visibly.

In specific embodiments, the detectable ligand may be a fluorophore and the masking component may be a quencher molecule.

In a similar fashion, fluorescence energy transfer (FRET) may be used to generate a detectable positive signal. FRET is a non-radiative process by which a photon from an energetically excited fluorophore (i.e. "donor fluorophore") raises the energy state of an electron in another molecule (i.e. "the acceptor") to higher vibrational levels of the excited singlet state. The donor fluorophore returns to the ground state without emitting a fluoresce characteristic of that fluorophore. The acceptor can be another fluorophore or non-fluorescent molecule. If the acceptor is a fluorophore, the transferred energy is emitted as fluorescence characteristic of that fluorophore. If the acceptor is a non-fluorescent molecule the absorbed energy is loss as heat. Thus, in the context of the embodiments disclosed herein, the fluorophore/quencher pair is replaced with a donor fluorophore/ acceptor pair attached to the oligonucleotide molecule. When intact, the masking construct generates a first signal (negative detectable signal) as detected by the fluorescence or heat emitted from the acceptor. Upon activation of the effector proteins disclosed herein the RNA oligonucleotide is cleaved and FRET is disrupted such that fluorescence of the donor fluorophore is now detected (positive detectable signal).

In certain example embodiments, the masking construct comprises the use of intercalating dyes which change their absorbance in response to cleavage of long RNAs or DNAs to short nucleotides. Several such dyes exist. For example, pyronine-Y will complex with RNA and form a complex that has an absorbance at 572 nm. Cleavage of the RNA results in loss of absorbance and a color change. Methylene blue may be used in a similar fashion, with changes in absorbance at 688 nm upon RNA cleavage. Accordingly, in certain example embodiments the masking construct comprises a RNA and intercalating dye complex that changes absorbance upon the cleavage of RNA by the effector proteins disclosed herein.

In certain example embodiments, the masking construct may comprise an initiator for an HCR reaction. See e.g. Dirks and Pierce. PNAS 101, 15275-15728 (2004). HCR reactions utilize the potential energy in two hairpin species. When a single-stranded initiator having a portion of complementary to a corresponding region on one of the hairpins is released into the previously stable mixture, it opens a hairpin of one species. This process, in turn, exposes a single-stranded region that opens a hairpin of the other species. This process, in turn, exposes a single stranded region identical to the original initiator. The resulting chain reaction may lead to the formation of a nicked double helix that grows until the hairpin supply is exhausted. Detection of the resulting products may be done on a gel or colorimetrically. Example colorimetric detection methods include, for example, those disclosed in Lu et al. "Ultra-sensitive colorimetric assay system based on the hybridization chain reaction-triggered enzyme cascade amplification ACS Appl Mater Interfaces, 2017, 9(1):167-175, Wang et al. "An enzyme-free colorimetric assay using hybridization chain reaction amplification and split aptamers" Analyst 2015, 150, 7657-7662, and Song et al. "Non-covalent fluorescent labeling of hairpin DNA probe coupled with hybridization chain reaction for sensitive DNA detection." Applied Spectroscopy, 70(4): 686-694 (2016).

In certain example embodiments, the masking construct suppresses generation of a detectable positive signal until cleaved, or modified by an activated CRISPR effector protein. In some embodiments, the masking construct may suppress generation of a detectable positive signal by masking the detectable positive signal, or generating a detectable negative signal instead.

Devices for Detection Assays

In certain embodiments, the detection assay can be provided on a cartridge or chip. In an aspect, the cartridge can comprise one or more ampoules and one or more wells that are communicatively coupled, allowing for the transfer, exchange or movement of reagents and sample with or without the use of beads through the chambers of the cartridge and facilitating detection assays utilizing systems/devices for facilitating the detection assay on the cartridge.

Cartridge

The cartridge, also referred to herein as a chip, according to the present invention comprises a series of components of ampoules and chambers that are communicatively coupled with one or more other components on the cartridge. The coupling is typically a fluidic communication, for example, via channels. The cartridge may comprise a membrane that seals one or more of the chambers and/or ampoules. In an aspect, the membrane allows for storage of reagents, buffers and other solid or fluid components which cover and seal the cartridge. The membrane can be configured to be punctured, pierced or otherwise released from sealing or covering one or more components of the cartridge by a means for releasing reagents.

As noted above, certain embodiments enable the use of nucleic acid binding beads to concentrate target nucleic acid but that do not require elution of the isolated nucleic acid. Thus, in certain example embodiments, the cartridge may further comprise an activatable magnet, such as an electromagnet. A means for activating the magnet may be located on the device, or the means for supplying the magnet or activating the magnet on the cartridge may be provided by a second device, such as those disclosed in further detail below.

Figure 30A:
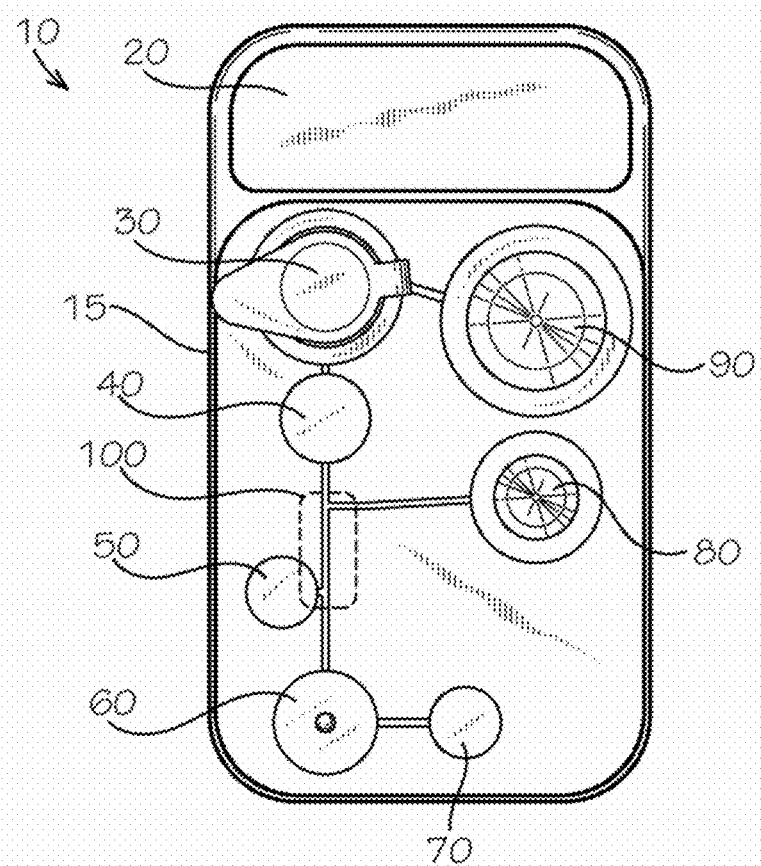
FIG. 30A-30B—shows the top view (FIG. 30A) and side view (FIG. 30B) of an exemplary cartridge (10) according to the invention.
Figure 30B:
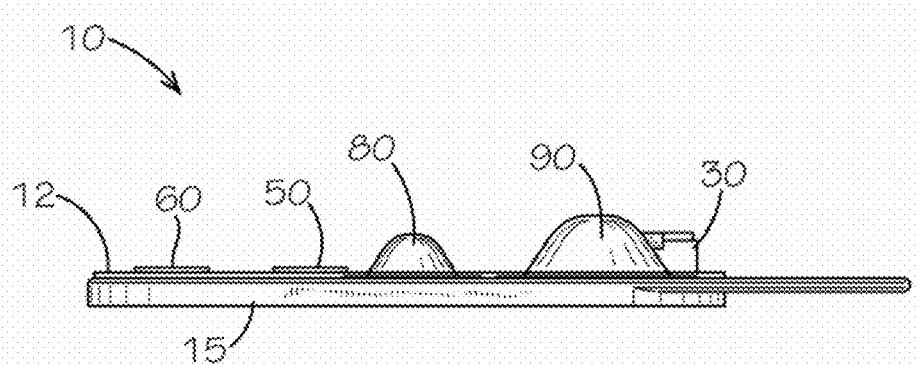
Figure 31A:
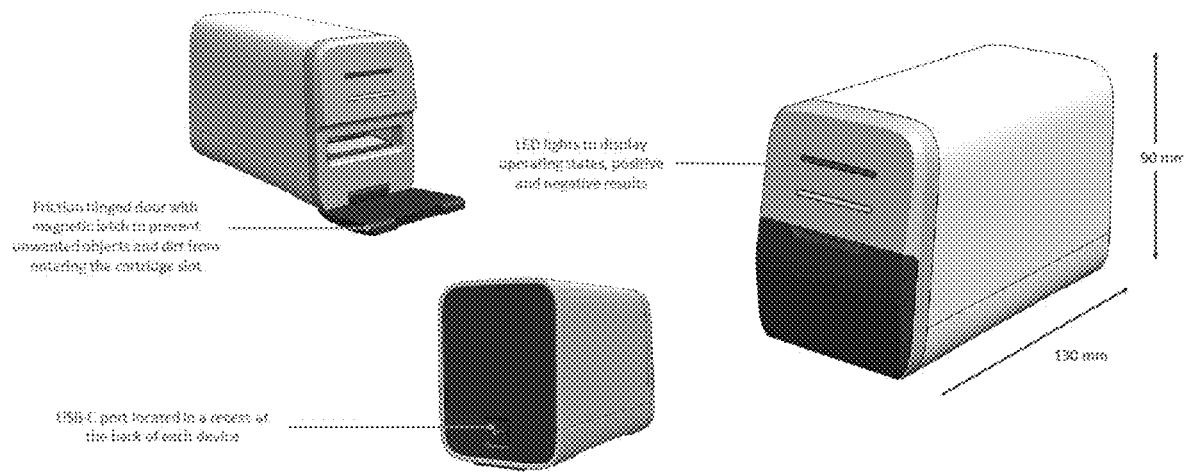
FIG. 31A-31C—FIG. 31A provides an exemplary front loading device, upper left shows a friction hinged door with magnetic latch to prevent unwanted objects and dirt from entering the cartridge slot, upper right, device showing use of LED lights to display operating states, positive and negative results; lower image depicts rear of device with USB-C port located in a recess.
Figure 31B:
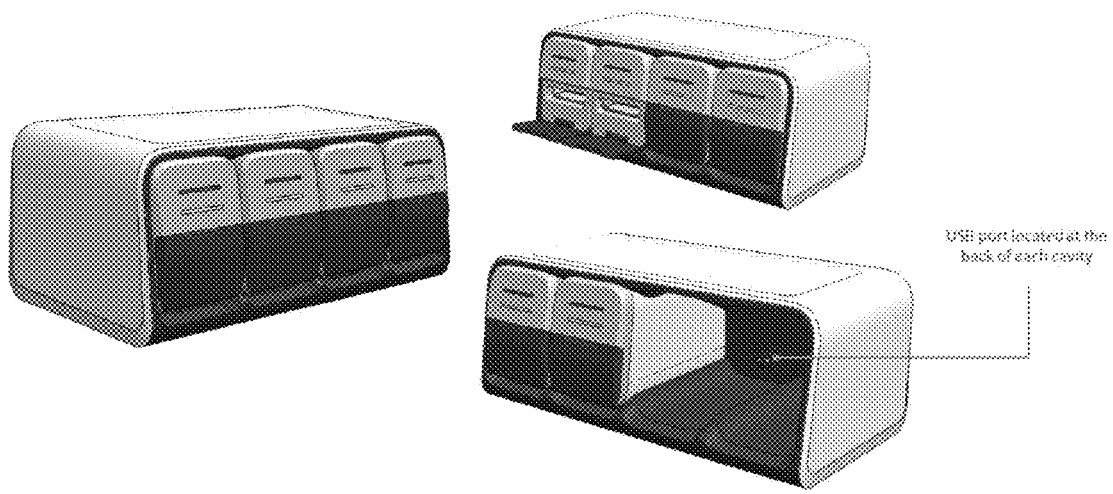
Figure 31C:
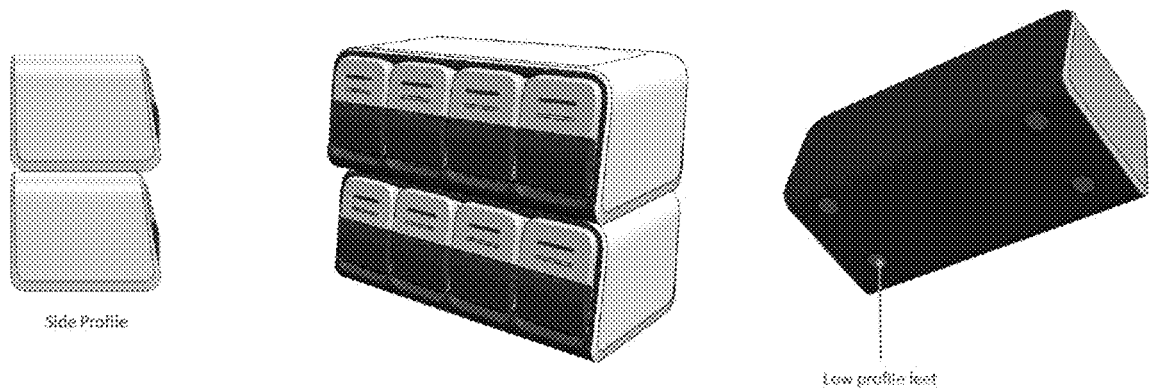
Figure 32:
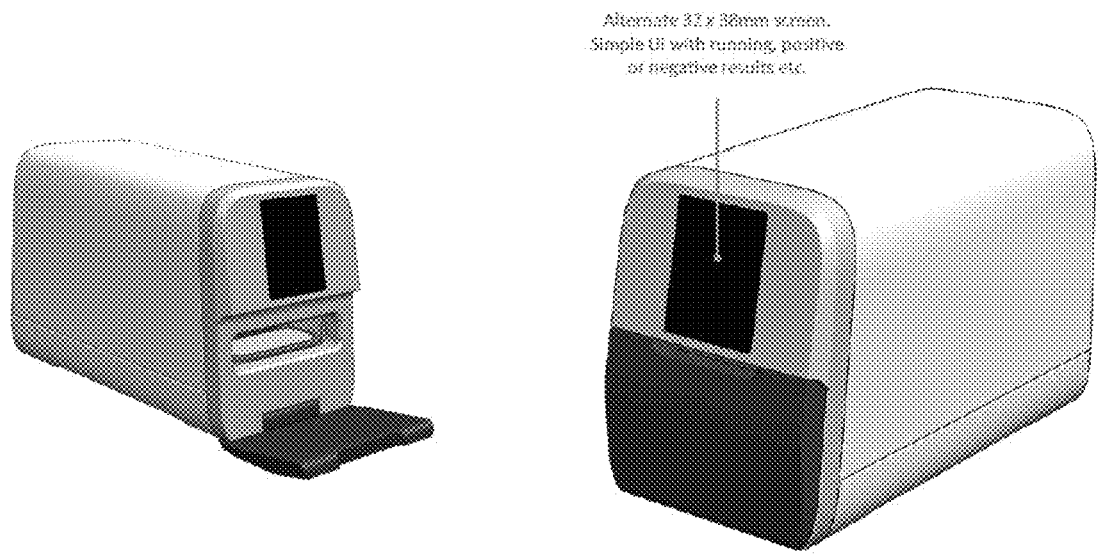
FIG. 32—shows alternate front-loading device with screen, left with front hinge open; right, with front hinge closed with alternate screen and simple user interface with running, positive, negative results r other display information FIG. 33—depicts front loading internal details, tope view (left) shows geared otor, optics and USB-C port; profile view (right) shows cartridge detection sensor, cam wheel, main PCBA, heater and plunger.
Figure 33:
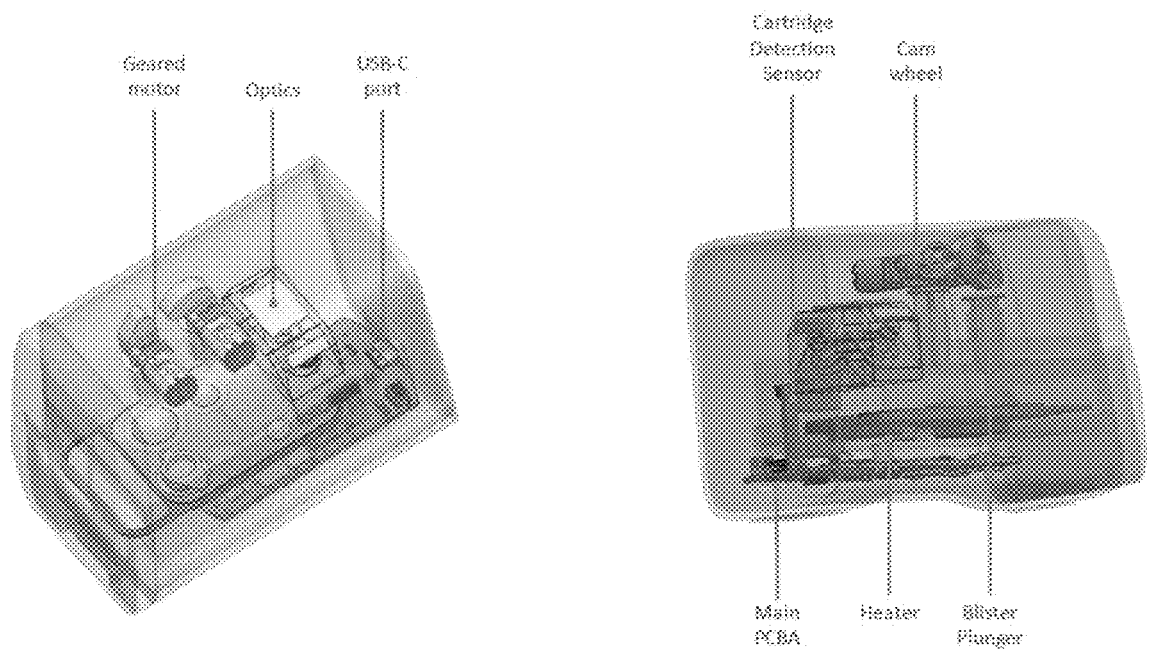
Figure 34A:
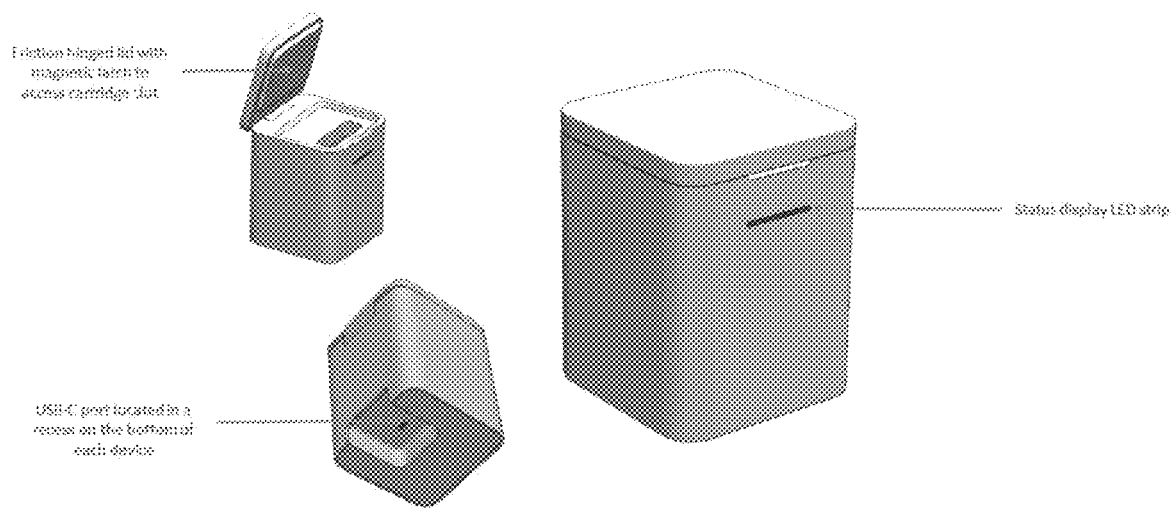
FIG. 34A-34C—FIG. 34A shows top loading device detains, friction hinged lid with magnetic latch to access cartridge slot (upper left), USB-C port in recess on the bottom of each device (lower left), front view of a top loading details (right) shows status display LED strip.
Figure 34B:
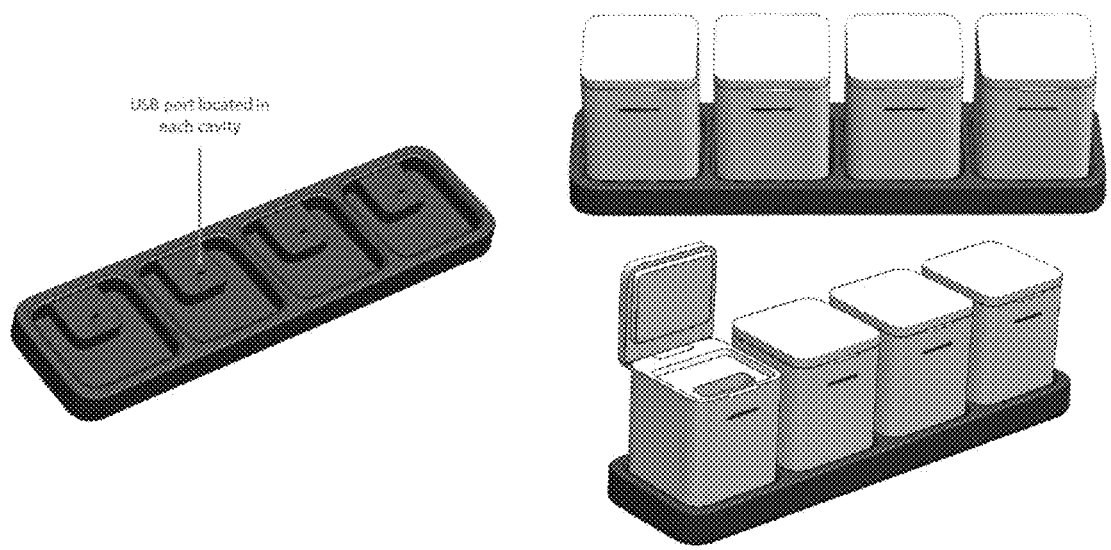
Figure 34C:
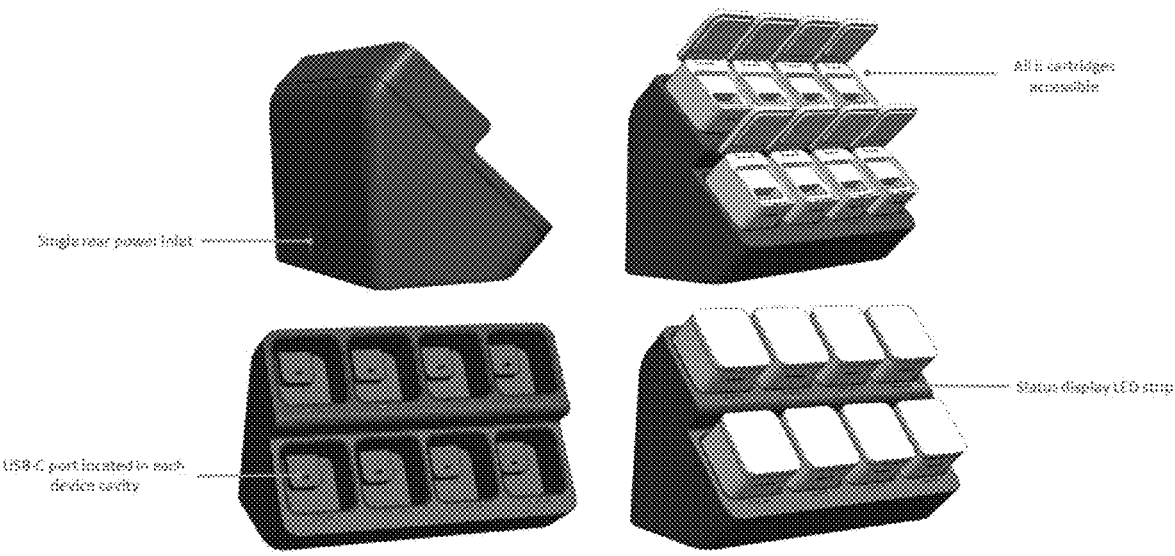
Figure 36:
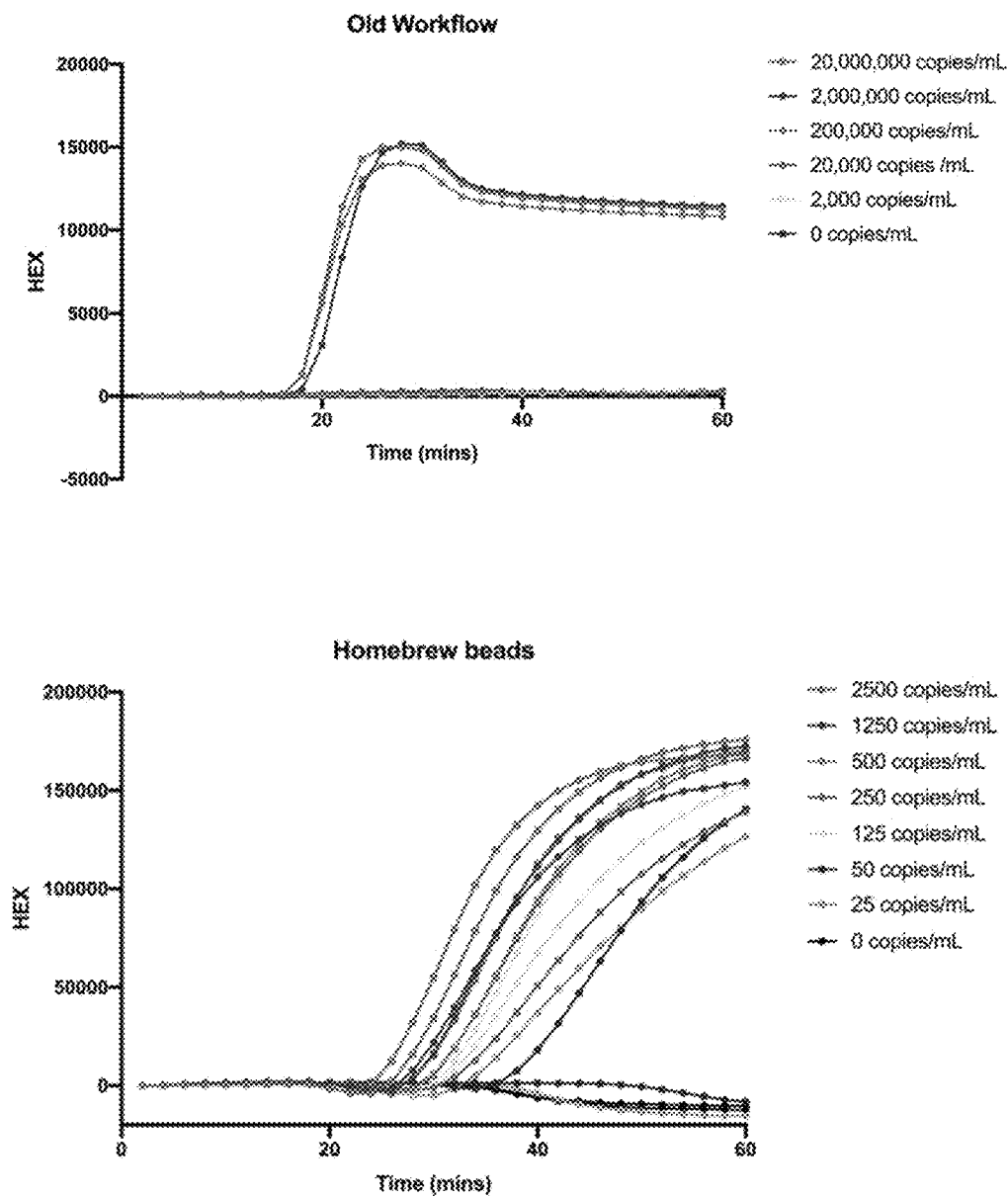
FIG. 36—Concentration with magnetic beads. Upper panel shows old workflow, lower panel with homebrew beads FIG. 37A-37C—Simplifying bead purification for POC application shows no mixing is required after addition of STOPCovid Master Mix FIG. 37A Free Beads, FIG. 37B beads on magnet (Elution only), FIG. 37C beads on magnet (binding and elution)
Figure 37A:
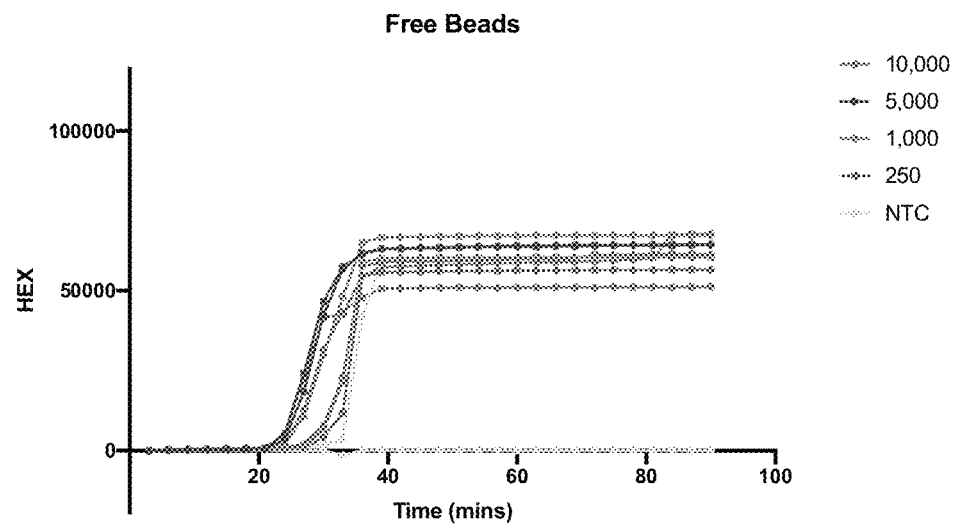
Figure 37B:
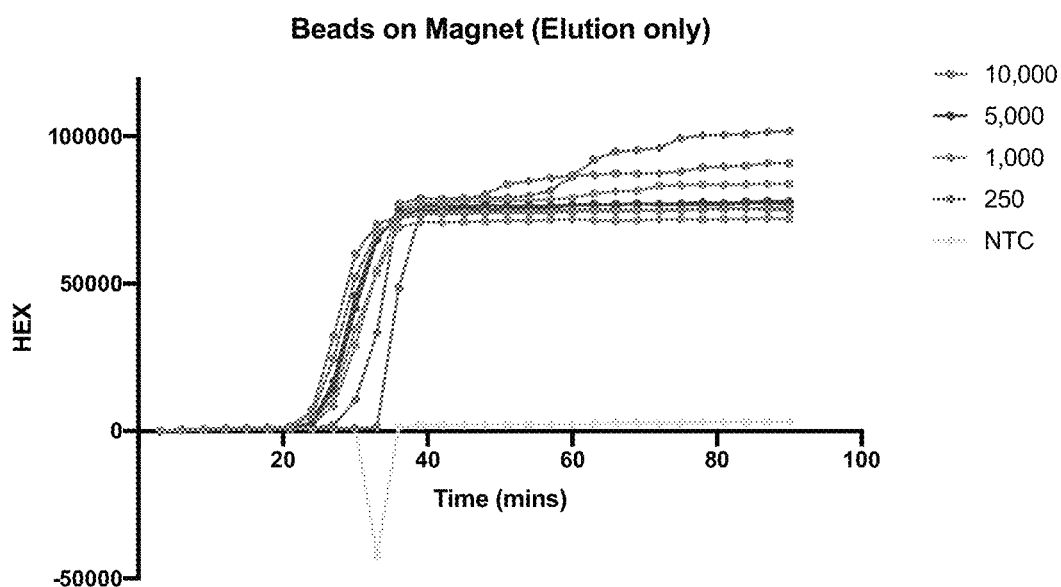
Figure 37C:
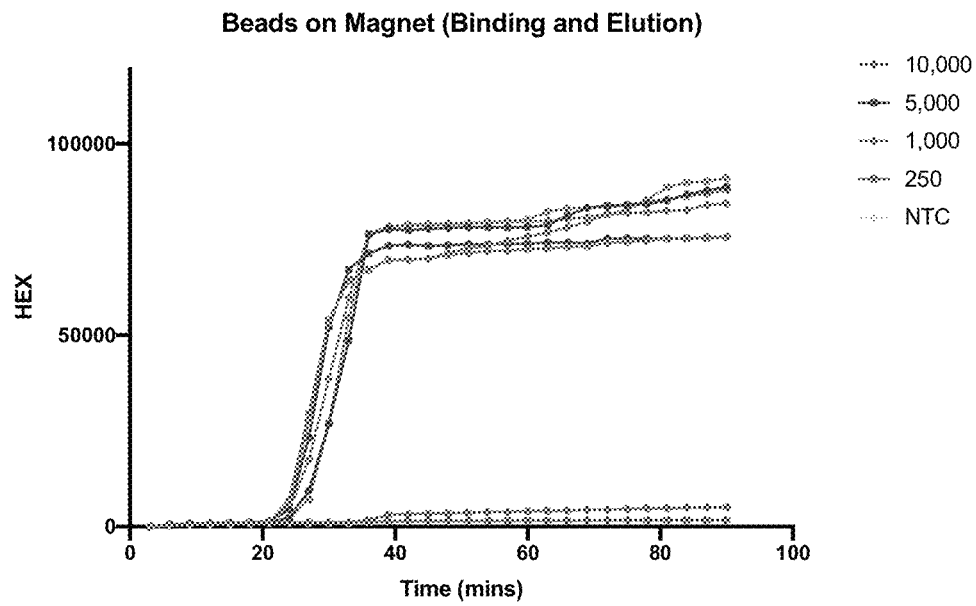
Figure 38A:
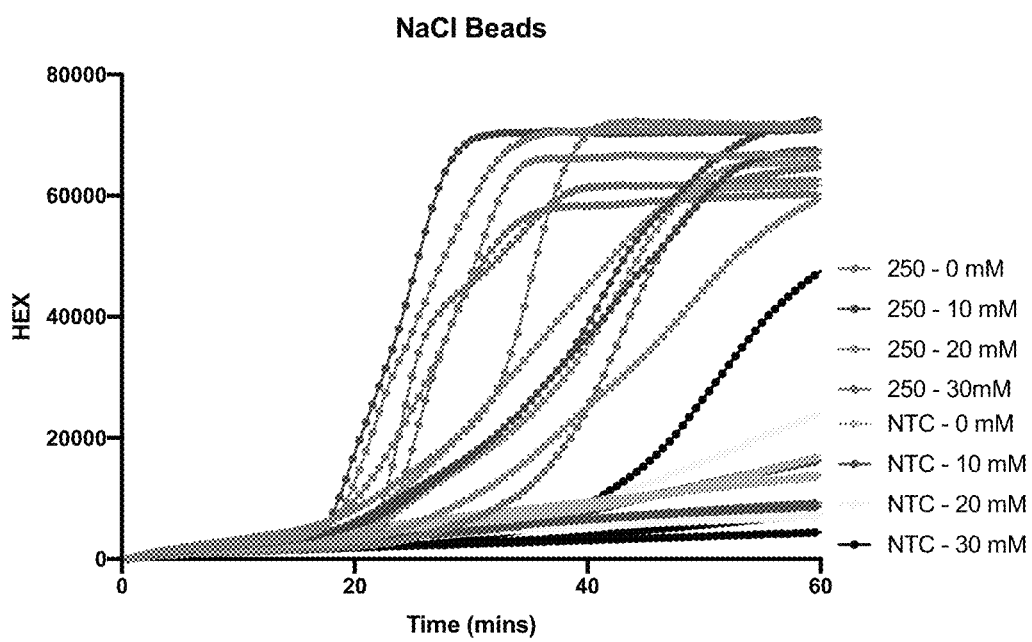
FIG. 38A-38B—Simplifying Bead purification for POC application shows removing the wash step requires significant reduction in salt concentration in the reaction buffer.
Figure 38B:
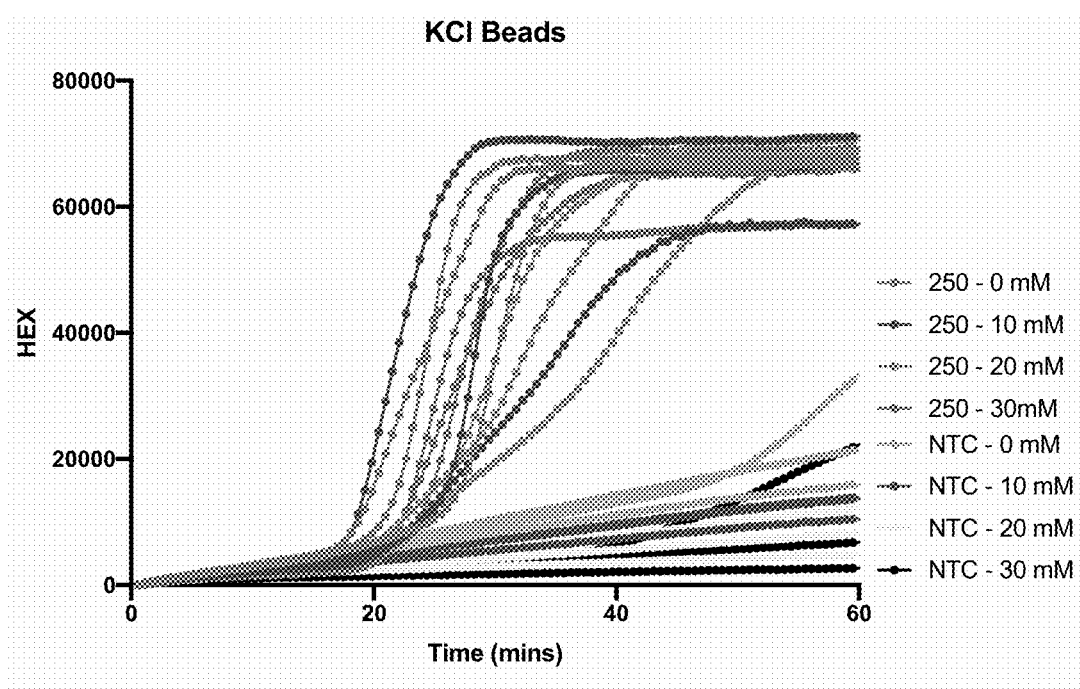
Figure 39:
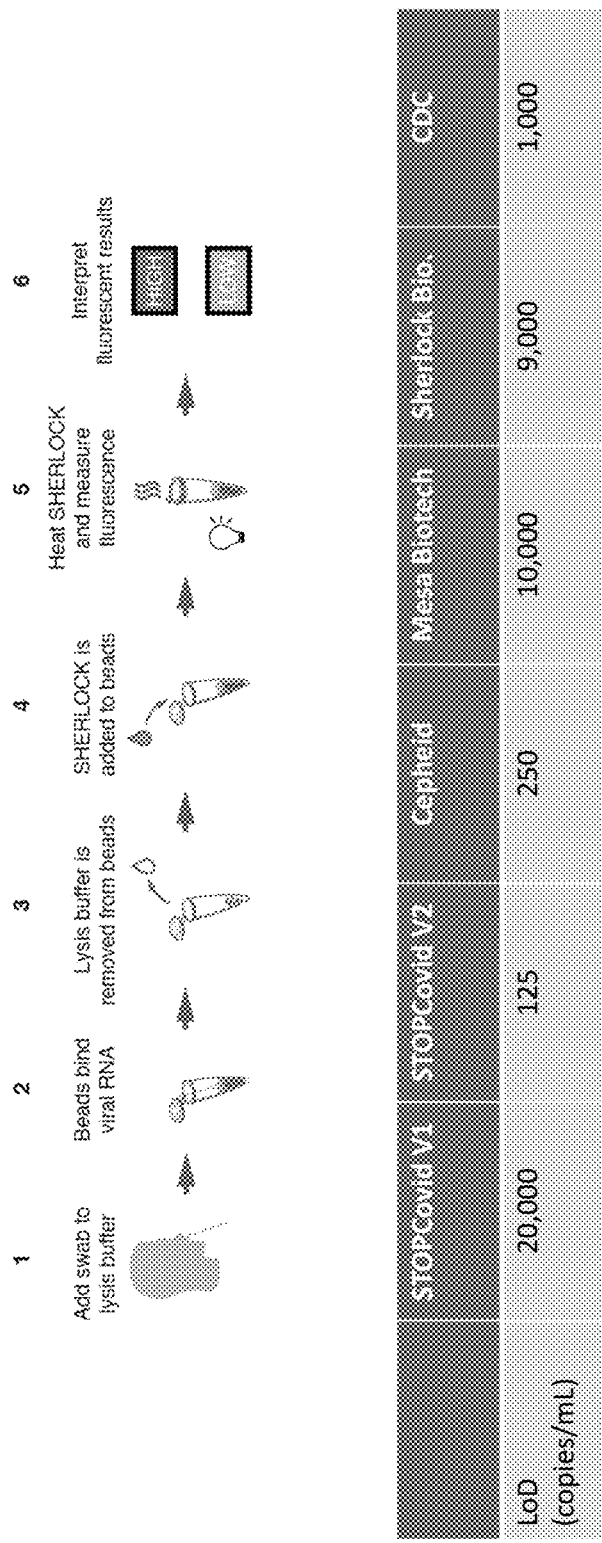
FIG. 39—An example workflow demonstrating increased sensitivity while minimizing complexity.

An exemplary cartridge is depicted in FIG. 30A-30B. This embodiment is by way of example only, and it should be understood that other configurations of individual components on the cartridge are also envisioned without departing from the overall scope and function of the invention. The cartridge (10) can comprise two or more ampoules (80,90). A first chamber for receiving a sample (30) is also provided and can be communicatively connected to an ampoule (90) and a second chamber (40). The second chamber (40) may be a lysis chamber. The lysis chamber can in turn be communicatively connected to a channel (100). The channel (100) may be a metering channel that is communicatively coupled to an ampoule (90) and a third chamber (60). The third chamber (60) may be an amplification chamber. Hydrophobic vents can be disposed on the cartridge (50, 70). FIG. 30B shows the cartridge body (15) with a membrane cover or laminate film (12).

The overall size of the device may be between 10, 15, 20, 25, 30, 35, 40, 45, 55, 60, 65, 70, 75, 80, 85, 90, 95, or 100 mm in width, and 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, or 200 mm. The sizing of ampoules, chambers, and channels can be selected to be in line with the reaction volumes discussed herein and to fit within the general size parameters of the overall cartridge.

Ampoules

The ampoules, also referred to as blisters, allow for storage and release of reagents throughout the cartridge. Ampoules can include liquid or solid reagents, for example, lysis reagents in one ampoule and reaction reagents in another ampoule. The reagents can be as described elsewhere herein, and can be adapted for the use in the cartridge. The ampoule may be sealed by a film that allows for the bursting, puncture or other release of the contents of the ampoules. See, e.g. Becker, H. & Gärtner, C. Microfluidics-enabled diagnostic systems: markets, challenges, and examples. In Microchip Diagnostics: Methods and Protocols (eds Taly, V. et al.) (Springer, New York, 2017); Czurratis et al., doi: 10.1088/0960-1317/25/4/045002. Considerations for ampoules can include as discussed in, for example, Smith, S., et al., Blister pouches for effective reagent storage on microfluidic chips for blood cell counting. Microfluid Nanofluid 20, 163 (2016). DOI:10.1007/s10404-016-1830-2. In an aspect, the seal is a frangible seal formed of a composite-layer film that is assembled to the cartridge main body. While referred to herein as an ampoule, the ampoule may comprise a cavity on a chip which comprises a sealed film that is opened by the release means.

Chambers

The chambers on the chip may located and sized for fluidic communication via channels or other communication means with ampoules and/or other chambers on the chip, see, e.g. FIG. 30A. A chamber for receiving a sample can be provided. The sample can be injected, placed in a receptacle into the chamber for receiving a sample, or otherwise transferred to the chamber. A lysis chamber may comprise, for example, capture beads, that may be used for concentration and/or extraction of the desired target material from the sample. Alternatively, the beads may be comprised in an ampoule comprising extraction-free polynucleotide isolation reagents that are in fluidic communication with the lysis chamber. An amplification chamber may also be provided with, for example, one or more lyophilized components of the system in the amplification chamber and/or communicatively connected to an ampoule comprising one or more components of the amplification reaction.

When the cartridge comprises a magnet, it may be configured near one or more of the chambers. In an aspect, the magnet is near the lysis well, and may be configured such that the device has a means for activating the magnet. Embodiments comprising a magnet in the cartridge may be utilized with methodologies using magnetic beads for extraction of particular target molecules.

System for Detection Assays

A system configured for use with the cartridge and to perform an assay, also referred to as a sample analysis apparatus, detection system or detection device, is configured system to receive the cartridge and conduct an assay comprising isothermal amplification of nucleic acids and detection of target nucleic acids on the cartridge. The system may comprise: a body; a door housing which may be provided in an opened state or a closed state, and configured to be coupled to the body of the sample analysis apparatus by a hinge or other closure means; a cartridge accommodating unit included in the detection system and configured to accommodate the cartridge. The system may further comprise one or more means for releasing reagents for extractions, amplification and/or detection; one or more heating means for extractions, amplification and/or detection, a means for mixing reagents for extraction, amplification, and/or detections, and/or a means for reading the results of the assay. The device may further comprise a user interface for programming the device and/or readout of the results of the assay.

Means for Release of Reagents

The system may comprise means for releasing reagents for extraction, amplification and/or detection. Release of reagents can be performed by a crushing, puncturing, applying heat or pressure until burst, cutting, or other means for the opening of the ampoule and release of contents. e.g. Becker, H. & Gärtner, C. Microfluidics-enabled diagnostic systems: markets, challenges, and examples. In Microchip Diagnostics: Methods and Protocols (eds Taly, V. et al.) (Springer, New York, 2017); Czurratis et al., doi: 10.1088/0960-1317/25/4/045002. Mechanical actuators

Heating Means

The heating means or heating element can be provided, for example, by electrical or chemical elements. One or more heating means can be utilized, or circuits providing regulation of temperature to one or more locations within the detection device can be utilized. In one preferred embodiment the device is configured to comprise a heating means for heating the lysis (extraction) chamber and at the amplification chamber of the cartridge. In an aspect, the heating element is disposed under the extraction well. The system can be designed with one or more heating means for extraction, amplification and/or detection.

Mixing Means

A means for mixing reagents for extraction, amplification and/or detection can be provided. A means for mixing reagents may comprise a means for mixing one or more fluids, or a fluid with a solid or lyophilized reaction mixture can also be provided. Means for mixing that disturb the laminar flow can be provided. In an aspect, the mixing means is a passive mixer, in another aspect, the mixing means is an active mixer. See, e.g. Nam-Trung Nguyen and Zhigang Wu 2005 J. Micromech. Microeng. 15 R1, doi: 10.1088/0960-1317/15/2/R01 for discussion of mixing approaches. In an aspect, the active mixer can be based on external sources such as pressure, temperature, hydrodynamics (with electrical or magnetic forces), dielectrophoresis, electrokinetics, or acoustics. Examples of passive mixing means can be provided by use of geometric approaches, such as a curved path or channel, see, e.g. U.S. Pat. No. 7,160,025, or an expansion/contraction of a channel cross section or diameter. When the cartridge is utilized with beads, channels and wells are configured and sized for the flow of beads.

Means for Reading the Results of the Assay

A means for reading the results of the assay can be provided in the system. The means for reading the results of the assay will depend in part on the type of detectable signal generated by the assay. In particular embodiments, the assay generates a detectable fluorescent or color readaout. In these instances, the means for reading the results of the assay will be an optic means, for example a single channel or multi-channel optical means such as a fluorimeter, colorimeter or other spectroscopic sensor.

A combination of means for reading the results of the assay can be utilized, and may include readings such as turbidity, temperature, magnetic, radio, or electrical properties and or optical properties, including scattering, polarization effects, etc.

The system may further comprise a user interface for programming the device and/or readout of the results of the assay. The user interface may comprise an LED screen. The system can be further configured for a USB port that can allow for docking of four or more devices.

In an aspect, the system comprises a means for activating a magnet that is disposed within or on the cartridge.

Lateral Flow Devices

In certain embodiments, the detection assay can be provided on a lateral flow device, as described in International Publication WO 2019/071051, incorporated herein by reference. The lateral flow device can be adapted to detect one or more coronaviruses and/or other viruses in combination of the coronavirus. The lateral flow device may comprise a flexible substrate, such as a paper substrate or a flexible polymer-based substrate, which can include freeze-dried reagents for detection assays with a visual readout of the assay results. See, WO 2019/071051 at [0145]-[0151] and Example 2, specifically incorporated herein by reference. In an aspect, lyophilized reagents can include preferred excipients that aid in rate of reaction, specificity, or other variables. The excipients may comprise trehalose, histidine, and/or glycine. In certain embodiments, the coronavirus assay can be utilized with isothermal amplification reagents, allowing amplification without complex instrumentation that may be unavailable in the field, as described in WO 2019/071051. Accordingly, the assay can be adapted for field diagnostics, including use of visual readout on a lateral flow device, rapid, sensitive detection and can be deployed for early and direct detection. Colorimetric detection can be utilized and may be particularly suited for field deployable applications, as described in International Application PCT/US2019/015726, published as WO2019/148206. In particular, colorimetric detection can be as described in WO2019/148206 at FIGS. 102, 105, 107-111 and [00306]-[00324], incorporated herein by reference.

In one embodiment, the invention provides a lateral flow device comprising a substrate comprising a first end and a second end. The first end may comprise a sample loading portion, a first region comprising a detectable ligand, two or more CRISPR effector systems, two or more detection constructs, and one or more first capture regions, each comprising a first binding agent. The substrate may also comprise two or more second capture regions between the first region of the first end and the second end, each second capture region comprising a different binding agent. Each of the two or more CRISPR effector systems may comprise a CRISPR effector protein and one or more guide sequences, each guide sequence configured to bind one or more target molecules.

The embodiments disclosed herein are directed to lateral flow detection devices that comprise SHERLOCK systems.

The device may comprise a lateral flow substrate for detecting a SHERLOCK reaction. Substrates suitable for use in lateral flow assays are known in the art. These may include, but are not necessarily limited to membranes or pads made of cellulose and/or glass fiber, polyesters, nitrocellulose, or absorbent pads (J Saudi Chem Soc 19(6):689-705; 2015), and other embodiments further described herein. The SHERLOCK system, i.e. one or more CRISPR systems and corresponding reporter constructs are added to the lateral flow substrate at a defined reagent portion of the lateral flow substrate, typically on one end of the lateral flow substrate. Reporting constructs used within the context of the present invention can comprise a first molecule and a second molecule linked by an RNA or DNA linker. The lateral flow substrate further comprises a sample portion. The sample portion may be equivalent to, continuous with, or adjacent to the reagent portion. In an aspect, the lateral flow substrate can be contained within a further device (see, e.g. FIG. 21). In an aspect, the lateral flow substrate can be utilized for visual readout of a detectable signal in one-pot reactions, e.g. wherein steps of extracting, amplifying and detecting are performed in an individual discrete volume.

Lateral Flow Substrate

In certain example embodiments, a lateral flow device comprises a lateral flow substrate on which detection can be performed. Substrates suitable for use in lateral flow assays are known in the art. These may include, but are not necessarily limited to, membranes or pads made of cellulose and/or glass fiber, polyesters, nitrocellulose, or absorbent pads (*J Saudi Chem Soc* 19(6):689-705; 2015).

Lateral support substrates comprise a first and second end, and one or more capture regions that each comprise binding agents. The first end may comprise a sample loading portion, a first region comprising a detectable ligand, two or more CRISPR effector systems, two or more detection constructs, and one or more first capture regions, each comprising a first binding agent. The substrate may also comprise two or more second capture regions between the first region of the first end and the second end, each second capture region comprising a different binding agent. Each of the two or more CRISPR effector systems may comprise a CRISPR effector protein and one or more guide sequences, each guide sequence configured to bind one or more target molecules. The lateral flow substrates may be configured to detect a SHERLOCK reaction.

Lateral support substrates may be located within a housing (see for example, "Rapid Lateral Flow Test Strips" Merck Millipore 2013). The housing may comprise at least one opening for loading samples and a second single opening or separate openings that allow for reading of detectable signal generated at the first and second capture regions.

The embodiments disclosed herein can be prepared in freeze-dried format for convenient distribution and point-of-care (POC) applications. Such embodiments are useful in multiple scenarios in human health including, for example, viral detection, bacterial strain typing, sensitive genotyping, and detection of disease-associated cell free DNA. Accordingly, the lateral substrate comprising one or more of the elements of the system, including detectable ligands, CRISPR effector systems, detection constructs and binding agents may be freeze-dried to the lateral flow substrate and packaged as a ready to use device. Alternatively, all or a portion of the elements of the system may be added to the reagent portion of the lateral flow substrate at the time of using the device.

First End and Second End of the Substrate

The substrate of the lateral flow device comprises a first and second end. The SHERLOCK system, i.e. one or more CRISPR systems and corresponding reporter constructs are added to the lateral flow substrate at a defined reagent portion of the lateral flow substrate, typically on a first end of the lateral flow substrate. Reporting constructs used within the context of the present invention comprise a first molecule and a second molecule linked by an RNA or DNA linker. The lateral flow substrate further comprises a sample portion. The sample portion may be equivalent to, continuous with, or adjacent to the reagent portion.

In certain example embodiments, the first end comprises a first region. The first region comprises a detectable ligand, two or more CRISPR effector systems, two or more detection constructs, and one or more first capture regions, each comprising a first binding agent.

Capture Regions

The lateral flow substrate can comprise one or more capture regions. In embodiments the first end of the lateral flow substrate comprises one or more first capture regions, with two or more second capture regions between the first region of the first end of the substrate and the second end of the substrate. The capture regions may be provided as a capture line, typically a horizontal line running across the device, but other configurations are possible. The first capture region is proximate to and on the same end of the lateral flow substrate as the sample loading portion.

Binding Agents

Specific binding-integrating molecules comprise any members of binding pairs that can be used in the present invention. Such binding pairs are known to those skilled in the art and include, but are not limited to, antibody-antigen pairs, enzyme-substrate pairs, receptor-ligand pairs, and streptavidin-biotin. In addition to such known binding pairs, novel binding pairs may be specifically designed. A characteristic of binding pairs is the binding between the two members of the binding pair.

A first binding agent that specifically binds the first molecule of the reporter construct is fixed or otherwise immobilized to the first capture region. The second capture region is located towards the opposite end of the lateral flow substrate from the first capture region. A second binding agent is fixed or otherwise immobilized at the second capture region. The second binding agent specifically binds the second molecule of the reporter construct, or the second binding agent may bind a detectable ligand. For example, the detectable ligand may be a particle, such as a colloidal particle, that when it aggregates can be detected visually, and generates a detectable positive signal. The particle may be modified with an antibody that specifically binds the second molecule on the reporter construct. If the reporter construct is not cleaved it will facilitate accumulation of the detectable ligand at the first binding region. If the reporter construct is cleaved the detectable ligand is released to flow to the second binding region. In such an embodiment, the second binding region comprises a second binding agent capable of specifically or non-specifically binding the detectable ligand on the antibody of the detectable ligand. Binding agents can be, for example, antibodies, that recognize a particular affinity tag. Such binding agents can further contain, for example, detectable labels, such as isotope labels and/or nucleic acid barcodes. A barcode is a short sequence of nucleotides (for example, DNA, RNA, or combinations thereof) that is used as an identifier. A nucleic acid barcode may have a length of 4-100 nucleotides and be either single or double-stranded. Methods for identifying cells with barcodes are known in the art. Accordingly, guide RNAs of the CRISPR effector systems described herein may be used to detect the barcode.

Detectable Ligands

The first region is loaded with a detectable ligand, such as those disclosed herein, for example a gold nanoparticle. The detectable ligand may be a particle, such as a colloidal particle, that when it aggregates can be detected visually. The particle may be modified with an antibody that specifically binds the second molecule on the reporter construct. If the reporter construct is not cleaved it will facilitate accumulation of the detectable ligand at the first binding region. If the reporter construct is cleaved the detectable ligand is released to flow to the second binding region. In such an embodiment, the second binding agent is an agent capable of specifically or non-specifically binding the detectable ligand on the antibody on the detectable ligand. Examples of suitable binding agents for such an embodiment include, but are not limited to, protein A and protein G. In some examples, the detectable ligand is a gold nanoparticle, which may be modified with a first antibody, such as an anti-FITC antibody.

Lateral Flow Detection Constructs

The first region also comprises a detection construct. In one example embodiment, a RNA detection construct and a CRISPR effector system (a CRISPR effector protein and one or more guide sequences configured to bind to one or more target sequences) as disclosed herein. In one example embodiment, and for purposes of further illustration, the RNA construct may comprise a FAM molecule on a first end of the detection construction and a biotin on a second end of the detection construct. Upstream of the flow of solution from the first end of the lateral flow substrate is a first test band. The test band may comprise a biotin ligand. Accordingly, when the RNA detection construct is present it its initial state, i.e. in the absence of target, the FAM molecule on the first end will bind the anti-FITC antibody on the gold nanoparticle, and the biotin on the second end of the RNA construct will bind the biotin ligand allowing for the detectable ligand to accumulate at the first test, generating a detectable signal. Generation of a detectable signal at the first band indicates the absence of the target ligand. In the presence of target, the CRISPR effector complex forms and the CRISPR effector protein is activated resulting in cleavage of the RND detection construct. In the absence of intact RNA detection construct the colloidal gold will flow past the second strip. The lateral flow device may comprise a second band, upstream of the first band. The second band may comprise a molecule capable of binding the antibody-labeled colloidal gold molecule, for example an anti-rabbit antibody capable of binding a rabbit anti-FITC antibody on the colloidal gold. Therefore, in the presence of one or more targets, the detectable ligand will accumulate at the second band, indicating the presence of the one or more targets in the sample.

In some embodiments, the first end of the lateral flow device comprises two detection constructs and each of the two detection constructs comprises an RNA or DNA oligonucleotide, comprising a first molecule on a first end and a second molecule on a second end. The first molecule and the second molecule may be linked by an RNA or DNA linker.

In some embodiments, the first molecule on the first end of the first detection construct may be FAM and the second molecule on the second end of the first detection construct may be biotin, or vice versa. In some embodiments, the first molecule on the first end of the second detection construct may be FAM and the second molecule on the second end of the second detection construct may be Digoxigenin (DIG), or vice versa.

In some embodiments, the first end may comprise three detection constructs, wherein each of the three detection constructs comprises an RNA or DNA oligonucleotide, comprising a first molecule on a first end and a second molecule on a second end. In specific embodiments, the first and second molecules on the detection constructs comprise Tye 665 and Alexa 488; Tye 665 and FAM, and Tye 665 and Digoxigenin (DIG), respectively.

In some embodiments, the first end of the lateral flow device comprises two or more CRISPR effector systems, also referred to as a CRISPR-Cas or CRISPR system. In some embodiments, such a CRISPR effector system may include a CRISPR effector protein and one or more guide sequences configured to bind to one or more target sequences.

Samples

When utilizing the detection systems with a lateral flow substrate, samples to be screened are loaded at the sample loading portion of the lateral flow substrate. The samples must be liquid samples or samples dissolved in an appropriate solvent, usually aqueous. The liquid sample reconstitutes the SHERLOCK reagents such that a SHERLOCK reaction can occur. The liquid sample begins to flow from the sample portion of the substrate towards the first and second capture regions.

A sample for use with the invention may be a biological or environmental sample, such as a surface sample, a fluid sample, or a food sample (fresh fruits or vegetables, meats). Food samples may include a beverage sample, a paper surface, a fabric surface, a metal surface, a wood surface, a plastic surface, a soil sample, a freshwater sample, a wastewater sample, a saline water sample, exposure to atmospheric air or other gas sample, or a combination thereof. For example, household/commercial/industrial surfaces made of any materials including, but not limited to, metal, wood, plastic, rubber, or the like, may be swabbed and tested for contaminants. Soil samples may be tested for the presence of pathogenic bacteria or parasites, or other microbes, both for environmental purposes and/or for human, animal, or plant disease testing. Water samples such as freshwater samples, wastewater samples, or saline water samples can be evaluated for cleanliness and safety, and/or potability, to detect the presence of, for example, *Cryptosporidium parvum, Giardia lamblia*, or other microbial contamination. In further embodiments, a biological sample may be obtained from a source including, but not limited to, a tissue sample, saliva, blood, plasma, sera, stool, urine, sputum, mucous, lymph, synovial fluid, spinal fluid, cerebrospinal fluid, ascites, pleural effusion, seroma, pus, bile, aqueous or vitreous humor, transudate, exudate, or swab of skin or a mucosal membrane surface. In some particular embodiments, an environmental sample or biological samples may be crude samples and/or the one or more target molecules may not be purified or amplified from the sample prior to application of the method. Identification of microbes may be useful and/or needed for any number of applications, and thus any type of sample from any source deemed appropriate by one of skill in the art may be used in accordance with the invention.

Figure 40:
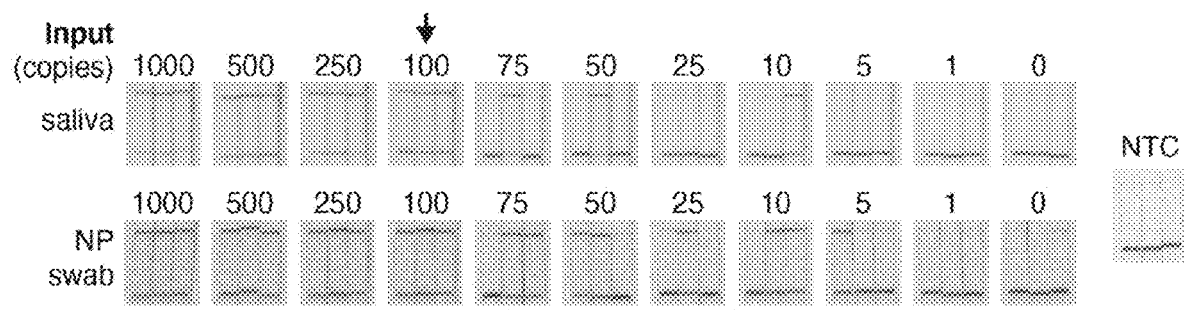
FIG. 40—Shows data from an example embodiment demonstrating limit of detection (LOD) of 100 genomes per reaction from saliva or nasopharyngeal swabs FIG. 41—Shows results of 12 replicates (right) using sous-vide waterbath (left) for STOPCOvid reaction FIG. 42A-42B—Shows data from an example embodiment demonstrating an ability to achieve 97% sensitivity and 100% specificity on patient nasopharyngeal swab samples FIG. 43—Shows CRISPR detection may improve upon LAMP by increased specificity.
Figure 41:
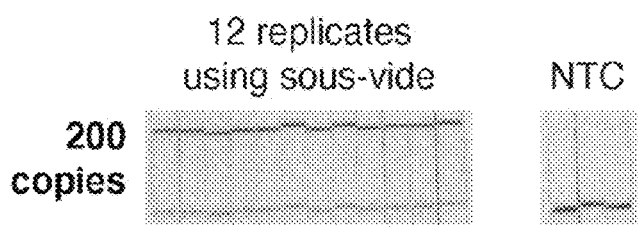

In particular embodiments, the methods and systems can be utilized for direct detection from patient samples. In an aspect, the methods and systems can further allow for direct detection from patient samples with a visual readout to further facilitate field-deployability. In an aspect, a field depoloyable version can include, for example the lateral flow devices and systems as described herein, and/or colorimetric detection. The methods and systems can be utilized to distinguish multipe viral species and strains and identify clinically relevant mutations, important with viral outbreaks such as the coronavirus outbreak in Wuhan (2019-nCoV). In an aspect, the sample is from a nasophyringeal swab or a saliva sample. See., e.g. FIG. 40, see also, Wyllie et al., "Saliva is more sensitive for SARS-CoV-2 detection in COVID-19 patients than nasopharyngeal swabs," DOI: 10.1101/2020.04.16.20067835.

Methods for Detecting and/or Quantifying Target Nucleic Acids

In some embodiments, the invention provides methods for detecting target nucleic acids in a sample. Such methods may comprise contacting a sample with the first end of a lateral flow device as described herein. The first end of the lateral flow device may comprise a sample loading portion, wherein the sample flows from the sample loading portion of the substrate towards the first and second capture regions and generates a detectable signal.

A positive detectable signal may be any signal that can be detected using optical, fluorescent, chemiluminescent, electrochemical or other detection methods known in the art, as described elsewhere herein.

In some embodiments, the lateral flow device may be capable of detecting two different target nucleic acid sequences. In some embodiments, this detection of two different target nucleic acid sequences may occur simultaneously.

In some embodiments, the absence of target nucleic acid sequences in a sample elicits a detectable fluorescent signal at each capture region. In such instances, the absence of any target nucleic acid sequences in a sample may cause a detectable signal to appear at the first and second capture regions.

In some embodiments, the lateral flow device as described herein is capable of detecting three different target nucleic acid sequences. In specific embodiments, when the target nucleic acid sequences are absent from the sample, a fluorescent signal may be generated at each of the three capture regions. In such exemplary embodiments, a fluorescent signal may be absent at the capture region for the corresponding target nucleic acid sequence when the sample contains one or more target nucleic acid sequences.

Samples to be screened are loaded at the sample loading portion of the lateral flow substrate. The samples must be liquid samples or samples dissolved in an appropriate solvent, usually aqueous. The liquid sample reconstitutes the system reagents such that a SHERLOCK reaction can occur. Intact reporter construct is bound at the first capture region by binding between the first binding agent and the first molecule. Likewise, the detection agent will begin to collect at the first binding region by binding to the second molecule on the intact reporter construct. If target molecule(s) are present in the sample, the CRISPR effector protein collateral effect is activated. As activated CRISPR effector protein comes into contact with the bound reporter construct, the reporter constructs are cleaved, releasing the second molecule to flow further down the lateral flow substrate towards the second binding region. The released second molecule is then captured at the second capture region by binding to the second binding agent, where additional detection agent may also accumulate by binding to the second molecule. Accordingly, if the target molecule(s) is not present in the sample, a detectable signal will appear at the first capture region, and if the target molecule(s) is present in the sample, a detectable signal will appear at the location of the second capture region.

In some embodiments, the invention provides a method for quantifying target nucleic acids in samples comprising distributing a sample or set of samples into one or more individual discrete volumes comprising two or more CRISPR systems as described herein. The method may comprise using HDA to amplify one or more target molecules in the sample or set of samples, as described herein. The method may further comprise incubating the sample or set of samples under conditions sufficient to allow binding of the guide RNAs to one or more target molecules. The method may further comprise activating the CRISPR effector protein via binding of the guide RNAs to the one or more target molecules. Activating the CRISPR effector protein may result in modification of the detection construct such that a detectable positive signal is generated. The method may further comprise detecting the one or more detectable positive signals, wherein detection indicates the presence of one or more target molecules in the sample. The method may further comprise comparing the intensity of the one or more signals to a control to quantify the nucleic acid in the sample. The steps of amplifying, incubating, activating, and detecting may all be performed in the same individual discrete volume.

An "individual discrete volume" is a discrete volume or discrete space, such as a container, receptacle, or other defined volume or space that can be defined by properties that prevent and/or inhibit migration of nucleic acids and reagents necessary to carry out the methods disclosed herein, for example a volume or space defined by physical properties such as walls, for example the walls of a well, tube, or a surface of a droplet, which may be impermeable or semipermeable, or as defined by other means such as chemical, diffusion rate limited, electro-magnetic, or light illumination, or any combination thereof. By "diffusion rate limited" (for example diffusion defined volumes) is meant spaces that are only accessible to certain molecules or reactions because diffusion constraints effectively defining a space or volume as would be the case for two parallel laminar streams where diffusion will limit the migration of a target molecule from one stream to the other. By "chemical" defined volume or space is meant spaces where only certain target molecules can exist because of their chemical or molecular properties, such as size, where for example gel beads may exclude certain species from entering the beads but not others, such as by surface charge, matrix size or other physical property of the bead that can allow selection of species that may enter the interior of the bead. By "electro-magnetically" defined volume or space is meant spaces where the electro-magnetic properties of the target molecules or their supports such as charge or magnetic properties can be used to define certain regions in a space such as capturing magnetic particles within a magnetic field or directly on magnets. By "optically" defined volume is meant any region of space that may be defined by illuminating it with visible, ultraviolet, infrared, or other wavelengths of light such that only target molecules within the defined space or volume may be labeled. One advantage to the used of non-walled, or semipermeable is that some reagents, such as buffers, chemical activators, or other agents maybe passed in Applicants' through the discrete volume, while other material, such as target molecules, maybe maintained in the discrete volume or space. Typically, a discrete volume will include a fluid medium, (for example, an aqueous solution, an oil, a buffer, and/or a media capable of supporting cell growth) suitable for labeling of the target molecule with the indexable nucleic acid identifier under conditions that permit labeling. Exemplary discrete volumes or spaces useful in the disclosed methods include droplets (for example, microfluidic droplets and/or emulsion droplets), hydrogel beads or other polymer structures (for example poly-ethylene glycol di-acrylate beads or agarose beads), tissue slides (for example, fixed formalin paraffin embedded tissue slides with particular regions, volumes, or spaces defined by chemical, optical, or physical means), microscope slides with regions defined by depositing reagents in ordered arrays or random patterns, tubes (such as, centrifuge tubes, microcentrifuge tubes, test tubes, cuvettes, conical tubes, and the like), bottles (such as glass bottles, plastic bottles, ceramic bottles, Erlenmeyer flasks, scintillation vials and the like), wells (such as wells in a plate), plates, pipettes, or pipette tips among others. In certain example embodiments, the individual discrete volumes are the wells of a microplate. In certain example embodiments, the microplate is a 96 well, a 384 well, or a 1536 well microplate.

Incubating the sample at either the amplification step or the extraction steps as described herein can be performed using heat sources known in the art. Advantageously, the heat source can be readily commercially available heating sources that do not require complicated instrumentation. Exemplary heating systems can include heating blocks, incubators, and/or water baths with temperatures maintained by commercially available sous-vide cookers. In this way, sample diagnostics can be performed without the requirement of expensive and proprietary equipment found primarily in diagnostic laboratory and hospital settings.

In certain example embodiments, paper-based microfluidics may be used for transfer of samples or reagents. For example, paper strips having wax barrier printed at a defined distance from the end of a paper dipstick may be used to define a volume of reagent or sample to be transferred. For example, a wax barrier may be printed across a paper dipstick to define a microliter volume such that when the dipstick is transferred into a volume of a reagent or sample only a microliter of said reagent or sample is absorbed onto the dipstick. The dipstick may be place in a second regant mix, where the reagent or sample will diffuse into the reaction mixture. Such components allow for preparation and use of the assay without specialized equipment such as pipettors.

Amplifying Target Molecules

The step of amplifying one or more target molecules can comprise amplification systems known in the art. In some embodiments, amplification is isothermal. In certain example embodiments, target RNAs and/or DNAs may be amplified prior to activating the CRISPR effector protein. Any suitable RNA or DNA amplification technique may be used. In certain embodiments, the amplifying step may take less than about 1 hour, 50 minutes, 40 minutes, 30 minutes, 25 minutes, 20 minutes or 15 minutes, which may depend on the sample, starting concentrations and nature of amplification used.

In certain embodiments, the amplifying of the target molecules and the detection of the target molecules can be performed in a single reaction, for example, a 'one-pot' method. Guidance for use of a single-pot approach can be as described in Gootenberg, et al., Science 2018 Apr. 27: 360(6387) 439-444 (using Cas13, Cas12a and Csm6 generally, detecting multiple targets in a single reaction, and specifically performing DNA extraction in a sample and using as input for direct detection at Figure S33); and Ding et al., "All-in-One Dual CRISPR-Cas12a (AIOD-CRISPR) Assay: A Case for Rapid, Ultrasensitive and Visual Detection of Novel Coronavirus SARS-CoV-2 and HIV Virus," doi:10.1101/2020.03.19.998724, biorxiv preprint (utilizing a pair of crRNAs with dual CRISPR-Cas12a detection for a one-pot approach to target-specific nucleic acid detection); and International Patent Application PCT/US2020/022795, filed Mar. 13, 2020, incorporated herein by reference in its entirety.

In certain example embodiments, the RNA or DNA amplification is an isothermal amplification. In certain example embodiments, the isothermal amplification may be nucleic-acid sequenced-based amplification (NASBA), recombinase polymerase amplification (RPA), loop-mediated isothermal amplification (LAMP), strand displacement amplification (SDA), helicase-dependent amplification (HDA), or nicking enzyme amplification reaction (NEAR). In certain example embodiments, non-isothermal amplification methods may be used which include, but are not limited to, PCR, multiple displacement amplification (MDA), rolling circle amplification (RCA), ligase chain reaction (LCR), or ramification amplification method (RAM).

The amplifying of target molecules can be optimized by methods as detailed herein. In an aspect, the design optimizes the primers used in the amplification, In particular aspects, the isothermal amplification is used alone. In another aspect, the iotheraml amplification is used with CRISPR-Cas systems. In either approach, design considerations can follow a rational design for optimization of the reactions. Optimization of the methods as disclosed herein can include first screening primers to identify one or more sets of primers that work well for a particular target, Cas protein and/or reaction. Once the primers have been screened, titration of magnesium concentration can be performed to identify an optimal magnesium concentration for higher signal to noise readout. Once an optimum magnesium concentration is identified, additional additives are screened at around 20-25% of the reaction, and once additives are identified, these additives, such as those additives identified in FIG. 17, can be evaluated and varied in concentration to identify optimal reaction kinetics for specific reaction parameters. In an example, varying additives with specific primers, target, Cas protein (when CRISPR system is used), temperature, and other additive concentrations within the reaction can be identified. Optimization can be made with the goal of reducing the number of steps and buffer exchanges that have to occur in the reaction, simplifying the reaction and reducing the risks of contamination at transfer steps. In an aspect, addition of inhibitors, such as proteinase K can be considered so that buffer exchanges can be reduced. Similarly, optimizing the salt levels as well as the type of salt utilized can further facilitate and optimize the one-pot detections disclosed herein. In an aspect, potassium chloride can be utilized rather than sodium chloride when such amplification approaches are used with bead concentration in a lysis step.

Loop-Mediated Isothermal Amplification

In certain example embodiments, a loop-mediated isothermal amplification (LAMP) reaction may be used to target nucleic acids, which encompasses both LAMP and RT-LAMP reactions. LAMP can be performed with a four-primer system for isothermal nucleic acid amplification in conjunction with a polymerase. Notomi et al., Nucleic Acids Res. 2000, 28, 12, Nagamine et al., Molecular and Cellular Probes (2002) 16, 223-229, doi: 10.1006/mcpr.2002.0415. When performing LAMP with a 4-primer system, two loop-forming inner primers, denoted as FIP and BIP, are provided with two outer primers, F3 and B3. The inner primers each contain two distinct sequences, one for priming in the first stage of the amplification and the other sequence for self-priming in subsequent amplification states. The two outer primers initiate strand displacement of nucleic acid strands initiated from the FIP and BIP primers, thereby generating formation of loops and strand displacement nucleic acid synthesis utilizing the provided polymerase. LAMP can be conducted with two to six primers, ranging from only the two loop-forming primers, up to at least the addition of 2 additional primers, LF and LB along with the two outer primers and two inner primers. LAMP technologies advantageously have high specificity and can work at a variety of pH and temperature. In a preferred aspect, the LAMP is an isothermal reaction at between about 45° C. to 75° C., 55 to 70° C. or 60° C. to 65° C. Colorimetric LAMP (Y. Zhang et al., doi:10.1101/2020.92.26.20028373), RT-LAMP (Lamb et al., doi: 10.1101/2020.02.19.20025155; and Yang et al., doi:10.1101/2020.03.02.20030130) have been developed for detection of COVID-19, and are incorporated herein by reference in their entirety.

In certain embodiments, the LAMP reagents may include Bst 2.0+RTx or Bst 3.0 from New England Biolabs. In certain embodiments, the LAMP reagents may comprise colorimetric or fluorescent detection. Detection of LAMP products can be accomplished using colorimetric tools, such as hydroxy napthol blue (see, e.g. Goto, M., et al., Colorimetric detection of loop-mediated isothermal amplification reaction by using hydroxy naphthol blue. Biotechniques, 2009. 46(3): p. 167-72) leuco triphenylmethane dyes (see, e.g. Miyamoto, S., et al., Method for colorimetric detection of double-stranded nucleic acid using leuco triphenylmethane dyes. Anal Biochem, 2015. 473: p. 28-33) and pH-sensitive dyes (see, e.g. Tanner, N. A., Y. Zhang, and T. C. Evans, Jr., Visual detection of isothermal nucleic acid amplification using pH-sensitive dyes. Biotechniques, 2015. 58(2): p. 59-68); as well as fluorescent detection (see, e.g. Yu et al., *Clinical Chemistry*, hvaa102, doi:10.1093/clinchem/ hvaa102 12 May 2020), including use of quenching probes (see, e.g. Shirato et al., *J Virol Methods.* 2018 August; 258:41-48. doi: 10.1016/j.jviromet.2018.05.006).

In an aspect, the primer sets for LAMP are designed to amplify one or more target sequences, generating amplicons that comprise the one or more target sequences. Optionally, the primers can comprise barcodes that can be designed as described elsewhere herein. Incubating to a temperature sufficient for LAMP amplification, e.g. 50° C.-72° C., more preferably 55° C. to 65° C., using a polymerase and, optionally a reverse transcriptase (in the event RT-LAMP is utilized). Preferably the enzymes utilized in the LAMP reaction are heat-stabilized. LAMP primer sites have been designed, see, e.g. Park et al., "Development of Reverse Transcription Loop-Mediated Isothermal Amplification Assays Targeting SARS-CoV-2" J. of Mol. Diag. (2020). Optionally, a control template is further provided with the sample, which may differ from the target sequence but share primer binding sites. In an exemplary embodiment, visual read out of the detection results can be accomplished using commercially-available lateral flow substrate, e.g. a commercially available paper substrate.

In certain embodiments, the LAMP primer can be selected from SEQ ID Nos: 1-40499. In certain embodiments, the primers are designed to target one or more of the targets in Table 3, for example, *Chlamydia trachomatis* D/UW-3/CX chromosome, Hepatitis A virus, Hepatitis B virus (strain ayw) genome, Hepatitis C virus (isolate H77) genotype 1, complete cds, Hepatitis C virus genotype 1, Hepatitis C virus genotype 2, Hepatitis C virus genotype 3, genome, Hepatitis C virus genotype 4, genome, Hepatitis C virus genotype 5, genome, Hepatitis C virus genotype 6, Hepatitis C virus genotype 7, Hepatitis delta virus, Hepatitis E virus, Hepatitis E virus rat/R63/DEU/2009, Hepatitis GB virus A, Hepatitis GB virus B, Human adenovirus 54, Human adenovirus A, Human betaherpesvirus 6A, variant A DNA, complete virion genome, isolate U1102, Human coronavirus 229E, Human coronavirus HKU1, Human Coronavirus NL63, Human coronavirus OC43 strain ATCC VR-759, Human gammaherpesvirus 4, Human genital-associated circular DNA virus-1 isolate 349, Human herpesvirus 1 strain 17, Human herpesvirus 2 strain HG52, Human herpesvirus 3, Human herpesvirus 4, Human herpesvirus 5 strain Merlin, Human herpesvirus 6B, Human herpesvirus 7, Human herpesvirus 8 strain GK18, Human immunodeficiency virus 1, Human immunodeficiency virus 2, Human papillomavirus 54, Human papillomavirus 116, Human papillomavirus—1, Human papillomavirus—2, Human papillomavirus—18, Human papillomavirus—61, Human papillomavirus isolate SE379, Human papillomavirus KCS, Human papillomavirus type 4, Human papillomavirus type 6b, Human papillomavirus type 7 genomic DNA, Human papillomavirus type 9, Human papillomavirus type 10 genomic DNA, Human papillomavirus type 16, Human papillomavirus type 26, Human papillomavirus type 30 genomic DNA, Human papillomavirus type 32, Human papillomavirus type 34, Human papillomavirus type 41, Human papillomavirus type 48, Human papillomavirus type 49, Human papillomavirus type 50, Human papillomavirus type 53, Human papillomavirus type 60, Human papillomavirus type 63, Human papillomavirus type 71 DNA, Human papillomavirus type 85 isolate 114B, Human papillomavirus type 88, Human papillomavirus type 90, Human papillomavirus type 92, Human papillomavirus type 96, Human papillomavirus type 101, Human papillomavirus type 103, Human papillomavirus type 108, Human papillomavirus type 109, Human papillomavirus type 112, Human papillomavirus type 121, Human papillomavirus type 126, Human papillomavirus type 128, Human papillomavirus type 129, Human papillomavirus type 131, Human papillomavirus type 132, Human papillomavirus type 134, Human papillomavirus type 135, Human papillomavirus type 136, Human papillomavirus type 137, Human papillomavirus type 140, Human papillomavirus type 144, Human papillomavirus type 154 isolate PV77, Human papillomavirus type 156 isolate GC01, Human papillomavirus type 161 isolate KC1, Human papillomavirus type 163 isolate KC3, Human papillomavirus type 166 isolate KC9, Human papillomavirus type 167 isolate KC10, Human papillomavirus type 172, Human papillomavirus type 175 isolate SE87, Human papillomavirus type 178, Human papillomavirus type 179 isolate SIBX16, Human papillomavirus type 184 isolate SIBX17, Human papillomavirus type 187 isolate ACS447, Human papillomavirus type 201 isolate HPV201, Human papillomavirus type 204 isolate A342, Human papillomoavirus type 5, Human parainfluenza virus 1, Human parainfluenza virus 3, Human rhinovirus 1 strain ATCC VR-1559, Human rhinovirus 3, Human rhinovirus 14, Human rhinovirus 89, Human rhinovirus C, Human rhinovirus NAT001 polyprotein gene, complete cds, Human T-lymphotropic virus 1, Influenza A virus (A/California/07/2009 (H1N1)) segment 1 polymerase PB2 (PB2) gene, complete cds, Influenza A virus (A/California/07/2009 (H1N1)) segment 2 polymerase PB1 (PB1) gene, complete cds; and nonfunctional PB1-F2 protein (PB1-F2) gene, Influenza A virus (A/California/07/ 2009 (H1N1)) segment 3 polymerase PA (PA) gene, complete cds, Influenza A virus (A/California/07/2009 (H1N1)) segment 4 hemagglutinin (HA) gene, complete cds, Influenza A virus (A/California/07/2009 (H1N1)) segment 5 nucleocapsid protein (NP) gene, complete cds, Influenza A virus (A/California/07/2009 (H1N1)) segment 6 neuraminidase (NA) gene, complete cds, Influenza A virus (A/California/07/2009 (H1N1)) segment 7 matrix protein 2 (M2) and matrix protein 1 (M1) genes, complete cds, Influenza A virus (A/California/07/2009 (H1N1)) segment 8 nuclear export protein (NEP) and nonstructural protein 1 (NS1) genes, complete cds, Influenza A virus (A/Goose/Guangdong/1/96 (H5N1)) neuraminidase (NA) gene, complete cds, Influenza A virus (A/Goose/Guangdong/1/96 (H5N1)) nucleocapsid protein (NP) gene, complete cds, Influenza A virus (A/Goose/Guangdong/1/96 (H5N1)) polymerase (PB2) gene, complete cds, Influenza A virus (A/goose/ Guangdong/1/1996 (H5N1)) hemagglutinin (HA) gene, complete cds, Influenza A virus (A/goose/Guangdong/1/ 1996 (H5N1)) polymerase (PA) and PA-X protein (PA-X) genes, complete cds, Influenza A virus (A/goose/Guangdong/1/1996 (H5N1)) polymerase (PB1) and PB1-F2 protein (PB1-F2) genes, complete cds, Influenza A virus (A/goose/Guangdong/1/1996 (H5N1)) segment 7, Influenza A virus (A/goose/Guangdong/1/1996 (H5N1)) segment 8, Influenza A virus (A/Hong Kong/1073/99 (H9N2)) segment 5, Influenza A virus (A/Hong Kong/1073/99 (H9N2)) segment 7, Influenza A virus (A/Hong Kong/1073/99 (H9N2)) segment 8, Influenza A virus (A/Korea/426/1968 (H2N2)) segment 1, Influenza A virus (A/Korea/426/1968 (H2N2)) segment 2, Influenza A virus (A/Korea/426/1968 (H2N2)) segment 3, Influenza A virus (A/Korea/426/1968 (H2N2)) segment 4, Influenza A virus (A/Korea/426/1968 (H2N2)) segment 5, Influenza A virus (A/Korea/426/1968 (H2N2)) segment 6, Influenza A virus (A/Korea/426/1968 (H2N2)) segment 7, Influenza A virus (A/Korea/426/1968 (H2N2)) segment 8, Influenza A virus (A/New York/392/2004 (H3N2)) segment 1, Influenza A virus (A/New York/392/ 2004 (H3N2)) segment 2, Influenza A virus (A/New York/

392/2004 (H3N2)) segment 3, Influenza A virus (A/New York/392/2004 (H3N2)) segment 4, Influenza A virus (A/New York/392/2004 (H3N2)) segment 5, Influenza A virus (A/New York/392/2004 (H3N2)) segment 6, Influenza A virus (A/New York/392/2004 (H3N2)) segment 7, Influenza A virus (A/New York/392/2004 (H3N2)) segment 8, Influenza A virus (A/Puerto Rico/8/1934 (H1N1)) segment 1, Influenza A virus (A/Puerto Rico/8/1934 (H1N1)) segment 2, Influenza A virus (A/Puerto Rico/8/1934 (H1N1)) segment 3, Influenza A virus (A/Puerto Rico/8/1934 (H1N1)) segment 4, Influenza A virus (A/Puerto Rico/8/1934 (H1N1)) segment 5, Influenza A virus (A/Puerto Rico/8/1934 (H1N1)) segment 6, Influenza A virus (A/Puerto Rico/8/1934 (H1N1)) segment 7, Influenza A virus (A/Puerto Rico/8/1934 (H1N1)) segment 8, Influenza A virus (A/Shanghai/02/2013 (H7N9)) segment 1 polymerase PB2 (PB2) gene, complete cds, Influenza A virus (A/Shanghai/02/2013 (H7N9)) segment 2 polymerase PB1 (PB1) and PB1-F2 protein (PB1-F2) genes, complete cds, Influenza A virus (A/Shanghai/02/2013 (H7N9)) segment 3 polymerase PA (PA) and PA-X protein (PA-X) genes, complete cds, Influenza A virus (A/Shanghai/02/2013 (H7N9)) segment 4 hemagglutinin (HA) gene, complete cds, Influenza A virus (A/Shanghai/02/2013 (H7N9)) segment 5 nucleocapsid protein (NP) gene, complete cds, Influenza A virus (A/Shanghai/02/2013 (H7N9)) segment 6 neuraminidase (NA) gene, complete cds, Influenza A virus (A/Shanghai/02/2013 (H7N9)) segment 7 matrix protein 2 (M2) and matrix protein 1 (M1) genes, complete cds, Influenza A virus (A/Shanghai/02/2013 (H7N9)) segment 8 nuclear export protein (NEP) and nonstructural protein 1 (NS1) genes, complete cds, Influenza A virus ha gene for Hemagglutinin, genomic RNA, strain A/Hong Kong/1073/99 (H9N2), Influenza A virus na gene for neuraminidase, genomic RNA, strain A/Hong Kong/1073/99 (H9N2), Influenza A virus pa gene for polymerase PA, genomic RNA, strain A/Hong Kong/1073/99 (H9N2), Influenza A virus 01 gene for polymerase Pb1, genomic RNA, strain A/Hong Kong/1073/99 (H9N2), Influenza A virus pb2 gene for polymerase Pb2, genomic RNA, strain A/Hong Kong/1073/99 (H9N2), Influenza B virus (B/Lee/1940) segment 2, Influenza B virus (B/Lee/1940) segment 3, Influenza B virus (B/Lee/1940) segment 4, Influenza B virus (B/Lee/1940) segment 5, Influenza B virus (B/Lee/1940) segment 6, Influenza B virus (B/Lee/1940) segment 7, Influenza B virus (B/Lee/1940) segment 8, Influenza B virus RNA 1, Influenza C virus (C/Ann Arbor/1/50) HEF gene for hemagglutinin-esterase-fusion, complete cds, Influenza C virus (C/Ann Arbor/1/50) M1, CM2 genes for matrix protein, CM2 protein, complete cds, Influenza C virus (C/Ann Arbor/1/50) P3 gene for polymerase 3, complete cds, Influenza C virus (C/Ann Arbor/1/50) PB1 gene for polymerase 1, complete cds, Influenza C virus (C/Ann Arbor/1/50) PB2 gene for polymerase 2, complete cds, Influenza C virus (C/Ann Arbor/1/50) segment 5, Influenza C virus (C/Ann Arbor/1/50) segment 7, *Neisseria gonorrhoeae* strain WHO F chromosome 1, Respiratory syncytial virus, SARS coronavirus, or *Streptococcus pyogenes* strain NCTC8198 chromosome 1.

TABLE 3

Exemplary target sequences

| Name | % GC | Accession | Common Name | Created | Created Date | Description |
|---|---|---|---|---|---|---|
| NC_000117 | 41.30% | NC_000117.1 | | Wed Aug 03 00:00:00 EDT 2016 | Wed Aug 03 00:00:00 EDT 2016 | Chlamydia trachomatis D/UW-3/CX chromosome, complete genome |
| NC_001489 | 37.90% | NC_001489.1 | | Mon Aug 13 00:00:00 EDT 2018 | Mon Aug 13 00:00:00 EDT 2018 | Hepatitis A virus, complete genome |
| NC_003977 | 48.50% | NC_003977.2 | | Mon Aug 13 00:00:00 EDT 2018 | Mon Aug 13 00:00:00 EDT 2018 | Hepatitis B virus (strain ayw) genome |
| NC_038882 | 58.40% | NC_038882.1 | isolate H77 | Tue Apr 21 00:00:00 EDT 2020 | Tue Apr 21 00:00:00 EDT 2020 | Hepatitis C virus (isolate H77) genotype 1, complete cds |
| NC_004102 | 58.20% | NC_004102.1 | | Thu Jul 11 00:00:00 EDT 2019 | Thu Jul 11 00:00:00 EDT 2019 | Hepatitis C virus genotype 1, complete genome |
| NC_009823 | 56.90% | NC_009823.1 | | Wed May 22 00:00:00 EDT 2019 | Wed May 22 00:00:00 EDT 2019 | Hepatitis C virus genotype 2, complete genome |
| NC_009824 | 55.60% | NC_009824.1 | | Wed May 22 00:00:00 EDT 2019 | Wed May 22 00:00:00 EDT 2019 | Hepatitis C virus genotype 3, genome |
| NC_009825 | 56.20% | NC_009825.1 | | Wed May 22 00:00:00 EDT 2019 | Wed May 22 00:00:00 EDT 2019 | Hepatitis C virus genotype 4, genome |
| NC_009826 | 57.10% | NC_009826.1 | | Wed May 22 00:00:00 EDT 2019 | Wed May 22 00:00:00 EDT 2019 | Hepatitis C virus genotype 5, genome |
| NC_009827 | 55.40% | NC_009827.1 | | Wed May 22 00:00:00 EDT 2019 | Wed May 22 00:00:00 EDT 2019 | Hepatitis C virus genotype 6, complete genome |
| NC_030791 | 56.80% | NC_030791.1 | | Tue May 28 00:00:00 EDT 2019 | Tue May 28 00:00:00 EDT 2019 | Hepatitis C virus genotype 7, complete genome |
| NC_001653 | 58.80% | NC_001653.2 | | Mon Aug 13 00:00:00 EDT 2018 | Mon Aug 13 00:00:00 EDT 2018 | Hepatitis delta virus, complete genome |
| NC_001434 | 57.90% | NC_001434.1 | | Mon Aug 13 00:00:00 EDT 2018 | Mon Aug 13 00:00:00 EDT 2018 | Hepatitis E virus, complete genome |
| NC_038504 | 57.60% | NC_038504.1 | | Tue Jun 04 00:00:00 EDT 2019 | Tue Jun 04 00:00:00 EDT 2019 | Hepatitis E virus rat/R63/DEU/2009, complete genome |
| NC_001837 | 57.90% | NC_001837.1 | | Mon Aug 13 00:00:00 EDT 2018 | Mon Aug 13 00:00:00 EDT 2018 | Human GB virus A, complete genome |
| NC_001655 | 50.60% | NC_001655.1 | | Thu May 23 00:00:00 EDT 2019 | Thu May 23 00:00:00 EDT 2019 | Human GB virus B, complete genome |
| NC_012959 | 54.90% | NC_012959.1 | | Mon Aug 13 00:00:00 EDT 2018 | Mon Aug 13 00:00:00 EDT 2018 | Human adenovirus 54, complete genome |
| NC_001460 | 46.50% | NC_001460.1 | | Mon Aug 13 00:00:00 EDT 2018 | Mon Aug 13 00:00:00 EDT 2018 | Human adenovirus A, complete genome |
| NC_001664 | 42.40% | NC_001664.4 | | Fri Jan 18 00:00:00 EST2019 | Fri Jan 18 00:00:00 EST2019 | Human betaherpesvirus 6A, variant A DNA, complete virion genome, isolate U1102 |
| NC_002645 | 38.30% | NC_002645.1 | | Mon Aug 13 00:00:00 EDT 2018 | Mon Aug 13 00:00:00 EDT 2018 | Human coronavirus 229E, complete genome |
| NC_006577 | 32.10% | NC_006577.2 | HCoV-HKU1 | Mon Aug 13 00:00:00 EDT 2018 | Mon Aug 13 00:00:00 EDT 2018 | Human coronavirus HKU1, complete genome |
| NC_005831 | 34.50% | NC_005831.2 | HCoV-NL63 | Mon Aug 13 00:00:00 EDT 2018 | Mon Aug 13 00:00:00 EDT 2018 | Human Coronavirus NL63, complete genome |
| NC_006213 | 36.80% | NC_006213.1 | HCoV-OC43 | Thu Feb 21 00:00:00EST 2019 | Thu Feb 21 00:00:00EST 2019 | Human coronavirus OC43 strain ATCC VR-759, complete genome |
| NC_007605 | 59.50% | NC_007605.1 | Epstein-Barr virus | Mon Aug 13 00:00:00 EDT 2018 | Mon Aug 13 00:00:00 EDT 2018 | Human gammaherpesvirus 4, complete genome |
| NC_026817 | 54.90% | NC_026817.1 | | Mon Aug 13 00:00:00 EDT 2018 | Mon Aug 13 00:00:00 EDT 2018 | Human genital-associated circular DNA virus-1 isolate 349, complete genome |
| NC_001806 | 68.30% | NC_001806.2 | Herpes simplex virus 1 | Mon Aug 13 00:00:00 EDT 2018 | Mon Aug 13 00:00:00 EDT 2018 | Human herpesvirus 1 strain 17, complete genome |
| NC_001798 | 70.40% | NC_001798.2 | Herpes simplex virus 2 | Mon May 16 00:00:00 EDT 2016 | Mon May 16 00:00:00 EDT 2016 | Human herpesvirus 2 strain HG52, complete genome |
| NC_001348 | 46.00% | NC_001348.1 | HHV-3 | Mon Aug 13 00:00:00 EDT 2018 | Mon Aug 13 00:00:00 EDT 2018 | Human herpesvirus 3, complete genome |
| NC_009334 | 59.50% | NC_009334.1 | Epstein-Barr virus type 2 | Mon Aug 13 00:00:00 EDT 2018 | Mon Aug 13 00:00:00 EDT 2018 | Human herpesvirus 4, complete genome |
| NC_006273 | 57.50% | NC_006273.2 | HHV-5; HCMV | Mon Aug 13 00:00:00 EDT 2018 | Mon Aug 13 00:00:00 EDT 2018 | Human herpesvirus 5 strain Merlin, complete genome |
| NC_000898 | 42.80% | NC_000898.1 | HHV-6B | Mon Aug 13 00:00:00 EDT 2018 | Mon Aug 13 00:00:00 EDT 2018 | Human herpesvirus 6B, complete genome |
| NC_001716 | 36.20% | NC_001716.2 | HHV-7 | Mon Aug 13 00:00:00 EDT 2018 | Mon Aug 13 00:00:00 EDT 2018 | Human herpesvirus 7, complete genome |
| NC_009333 | 53.80% | NC_009333.1 | Kaposi's sarcoma-associated herpesvirus | Tue Jun 04 00:00:00 EDT 2019 | Tue Jun 04 00:00:00 EDT 2019 | Human herpesvirus 8 strain GK18, complete genome |
| NC_001802 | 42.10% | NC_001802.1 | HIV-1 | Mon Aug 13 00:00:00 EDT 2018 | Mon Aug 13 00:00:00 EDT 2018 | Human immunodeficiency virus 1, complete genome |

TABLE 3-continued

Exemplary target sequences

| Name | % GC | Accession | Common Name | Created | Created Date | Description |
|---|---|---|---|---|---|---|
| NC_001722 | 45.70% | NC_001722.1 | HIV-2 | Mon Aug 13 00:00:00 EDT 2018 | Mon Aug 13 00:00:00 EDT 2018 | Human immunodeficiency virus 2, complete genome |
| NC_001676 | 41.90% | NC_001676.1 | | Mon Aug 13 00:00:00 EDT 2018 | Mon Aug 13 00:00:00 EDT 2018 | Human papillomavirus 54, complete genome |
| NC_013035 | 38.50% | NC_013035.1 | | Mon Aug 13 00:00:00 EDT 2018 | Mon Aug 13 00:00:00 EDT 2018 | Human papillomavirus 116, complete genome |
| NC_001356 | 40.30% | NC_001356.1 | | Mon Aug 13 00:00:00 EDT 2018 | Mon Aug 13 00:00:00 EDT 2018 | Human papillomavirus - 1, complete genome |
| NC_001352 | 48.40% | NC_001352.1 | | Mon Aug 13 00:00:00 EDT 2018 | Mon Aug 13 00:00:00 EDT 2018 | Human papillomavirus - 2, complete genome |
| NC_001357 | 40.40% | NC_001357.1 | | Mon Aug 13 00:00:00 EDT 2018 | Mon Aug 13 00:00:00 EDT 2018 | Human papillomavirus - 18, complete genome |
| NC_001694 | 46.30% | NC_001694.1 | | Mon Aug 13 00:00:00 EDT 2018 | Mon Aug 13 00:00:00 EDT 2018 | Human papillomavirus - 61, complete genome |
| NC_027779 | 37.50% | NC_027779.1 | | Mon Aug 13 00:00:00 EDT 2018 | Mon Aug 13 00:00:00 EDT 2018 | Human papillomavirus isolate SE379, complete genome |
| NC_026946 | 36.80% | NC_026946.1 | | Mon Aug 13 00:00:00 EDT 2018 | Mon Aug 13 00:00:00 EDT 2018 | Human papillomavirus KC5, complete genome |
| NC_001457 | 38.50% | NC_001457.1 | | Mon Aug 13 00:00:00 EDT 2018 | Mon Aug 13 00:00:00 EDT 2018 | Human papillomavirus type 4, complete genome |
| NC_001355 | 40.90% | NC_001355.1 | | Mon Aug 13 00:00:00 EDT 2018 | Mon Aug 13 00:00:00 EDT 2018 | Human papillomavirus type 6b, complete genome |
| NC_001595 | 39.50% | NC_001595.1 | | Mon Aug 13 00:00:00 EDT 2018 | Mon Aug 13 00:00:00 EDT 2018 | Human papillomavirus type 7 genomic DNA |
| NC_001596 | 41.00% | NC_001596.1 | | Mon Aug 13 00:00:00 EDT 2018 | Mon Aug 13 00:00:00 EDT 2018 | Human papillomavirus type 9, complete genome |
| NC_001576 | 45.90% | NC_001576.1 | | Mon Aug 13 00:00:00 EDT 2018 | Mon Aug 13 00:00:00 EDT 2018 | Human papillomavirus type 10 genomic DNA |
| NC_001526 | 36.50% | NC_001526.4 | | Mon Aug 13 00:00:00 EDT 2018 | Mon Aug 13 00:00:00 EDT 2018 | Human papillomavirus type 16, complete genome |
| NC_001583 | 38.60% | NC_001583.1 | | Mon Aug 13 00:00:00 EDT 2018 | Mon Aug 13 00:00:00 EDT 2018 | Human papillomavirus type 26, complete genome |
| NC_038889 | 40.40% | NC_038889.1 | | Fri Aug 24 00:00:00 EDT 2018 | Fri Aug 24 00:00:00 EDT 2018 | Human papillomavirus type 30 genomic DNA |
| NC_001586 | 41.00% | NC_001586.1 | | Mon Aug 13 00:00:00 EDT 2018 | Mon Aug 13 00:00:00 EDT 2018 | Human papillomavirus type 32, complete genome |
| NC_001587 | 38.20% | NC_001587.1 | | Mon Aug 13 00:00:00 EDT 2018 | Mon Aug 13 00:00:00 EDT 2018 | Human papillomavirus type 34, complete genome |
| NC_001354 | 46.90% | NC_001354.1 | | Mon Aug 13 00:00:00 EDT 2018 | Mon Aug 13 00:00:00 EDT 2018 | Human papillomavirus type 41, complete genome |
| NC_001690 | 36.80% | NC_001690.1 | | Mon Aug 13 00:00:00 EDT 2018 | Mon Aug 13 00:00:00 EDT 2018 | Human papillomavirus type 48, complete genome |
| NC_001591 | 41.10% | NC_001591.1 | | Mon Aug 13 00:00:00 EDT 2018 | Mon Aug 13 00:00:00 EDT 2018 | Human papillomavirus type 49, complete genome |
| NC_001691 | 36.80% | NC_001691.1 | | Mon Aug 13 00:00:00 EDT 2018 | Mon Aug 13 00:00:00 EDT 2018 | Human papillomavirus type 50, complete genome |
| NC_001593 | 40.10% | NC_001593.1 | | Mon Aug 13 00:00:00 EDT 2018 | Mon Aug 13 00:00:00 EDT 2018 | Human papillomavirus type 53, complete genome |
| NC_001693 | 37.00% | NC_001693.1 | | Mon Aug 13 00:00:00 EDT 2018 | Mon Aug 13 00:00:00 EDT 2018 | Human papillomavirus type 60, complete genome |
| NC_001458 | 40.40% | NC_001458.1 | | Mon Aug 13 00:00:00 EDT 2018 | Mon Aug 13 00:00:00 EDT 2018 | Human papillomavirus type 63, complete genome |
| NC_039089 | 44.40% | NC_039089.1 | | Fri Aug 24 00:00:00 EDT 2018 | Fri Aug 24 00:00:00 EDT 2018 | Human papillomavirus type 71 DNA, complete genome |
| NC_034616 | 37.70% | NC_034616.1 | | Sat Aug 25 00:00:00 EDT 2018 | Sat Aug 25 00:00:00 EDT 2018 | Human papillomavirus type 85 isolate 114B, complete genome |
| NC_010329 | 40.10% | NC_010329.1 | | Mon Aug 13 00:00:00 EDT 2018 | Mon Aug 13 00:00:00 EDT 2018 | Human papillomavirus type 88, complete genome |
| NC_004104 | 46.70% | NC_004104.1 | candHPV90 | Mon Aug 13 00:00:00 EDT 2018 | Mon Aug 13 00:00:00 EDT 2018 | Human papillomavirus type 90, complete genome |
| NC_004500 | 40.00% | NC_004500.1 | | Mon Aug 13 00:00:00 EDT 2018 | Mon Aug 13 00:00:00 EDT 2018 | Human papillomavirus type 92, complete genome |
| NC_005134 | 40.30% | NC_005134.2 | | Mon Aug 13 00:00:00 EDT 2018 | Mon Aug 13 00:00:00 EDT 2018 | Human papillomavirus type 96, complete genome |
| NC_008189 | 43.10% | NC_008189.1 | HPV101 | Mon Aug 13 00:00:00 EDT 2018 | Mon Aug 13 00:00:00 EDT 2018 | Human papillomavirus type 101, complete genome |
| NC_008188 | 41.60% | NC_008188.1 | HPV103 | Mon Aug 13 00:00:00 EDT 2018 | Mon Aug 13 00:00:00 EDT 2018 | Human papillomavirus type 103, complete genome |
| NC_012213 | 42.60% | NC_012213.1 | | Tue Jun 04 00:00:00 EDT 2019 | Tue Jun 04 00:00:00 EDT 2019 | Human papillomavirus type 108, complete genome |
| NC_012485 | 38.30% | NC_012485.1 | | Mon Aug 13 00:00:00 EDT 2018 | Mon Aug 13 00:00:00 EDT 2018 | Human papillomavirus type 109, complete genome |
| NC_012486 | 37.50% | NC_012486.1 | | Mon Aug 13 00:00:00 EDT 2018 | Mon Aug 13 00:00:00 EDT 2018 | Human papillomavirus type 112, complete genome |
| NC_014185 | 37.70% | NC_014185.1 | | Mon Aug 13 00:00:00 EDT 2018 | Mon Aug 13 00:00:00 EDT 2018 | Human papillomavirus type 121, complete genome |
| NC_016157 | 38.00% | NC_016157.1 | | Mon Aug 13 00:00:00 EDT 2018 | Mon Aug 13 00:00:00 EDT 2018 | Human papillomavirus type 126, complete genome |
| NC_014952 | 36.00% | NC_014952.1 | | Tue Jun 04 00:00:00 EDT 2019 | Tue Jun 04 00:00:00 EDT 2019 | Human papillomavirus type 128, complete genome |
| NC_014953 | 37.30% | NC_014953.1 | | Tue Jun 04 00:00:00 EDT 2019 | Tue Jun 04 00:00:00 EDT 2019 | Human papillomavirus type 129, complete genome |
| NC_014954 | 37.00% | NC_014954.1 | | Tue Jun 04 00:00:00 EDT 2019 | Tue Jun 04 00:00:00 EDT 2019 | Human papillomavirus type 131, complete genome |
| NC_014955 | 37.90% | NC_014955.1 | | Mon Aug 13 00:00:00 EDT 2018 | Mon Aug 13 00:00:00 EDT 2018 | Human papillomavirus type 132, complete genome |
| NC_014956 | 38.10% | NC_014956.1 | | Tue Jun 04 00:00:00 EDT 2019 | Tue Jun 04 00:00:00 EDT 2019 | Human papillomavirus type 134, complete genome |
| NC_017993 | 36.80% | NC_017993.1 | | Mon Aug 13 00:00:00 EDT 2018 | Mon Aug 13 00:00:00 EDT 2018 | Human papillomavirus type 135, complete genome |

TABLE 3-continued

Exemplary target sequences

| Name | % GC | Accession | Common Name | Created | Created Date | Description |
|---|---|---|---|---|---|---|
| NC_017994 | 38.50% | NC_017994.1 | | Mon Aug 13 00:00:00 EDT 2018 | Mon Aug 13 00:00:00 EDT 2018 | Human papillomavirus type 136, complete genome |
| NC_017995 | 37.60% | NC_017995.1 | | Mon Aug 13 00:00:00 EDT 2018 | Mon Aug 13 00:00:00 EDT 2018 | Human papillomavirus type 137, complete genome |
| NC_017996 | 39.70% | NC_017996.1 | | Mon Aug 13 00:00:00 EDT 2018 | Mon Aug 13 00:00:00 EDT 2018 | Human papillomavirus type 140, complete genome |
| NC_017997 | 38.20% | NC_017997.1 | | Mon Aug 13 00:00:00 EDT 2018 | Mon Aug 13 00:00:00 EDT 2018 | Human papillomavirus type 144, complete genome |
| NC_021483 | 37.90% | NC_021483.1 | HPV154 | Mon Aug 13 00:00:00 EDT 2018 | Mon Aug 13 00:00:00 EDT 2018 | Human papillomavirus type 154 isolate PV77, complete genome |
| NC_033781 | 36.20% | NC_033781.1 | | Mon Aug 13 00:00:00 EDT 2018 | Mon Aug 13 00:00:00 EDT 2018 | Human papillomavirus type 156 isolate GC01, complete genome |
| NC_038522 | 37.70% | NC_038522.1 | | Fri Aug 24 00:00:00 EDT 2018 | Fri Aug 24 00:00:00 EDT 2018 | Human papillomavirus type 161 isolate KC1, complete genome |
| NC_028125 | 37.70% | NC_028125.1 | | Mon Aug 13 00:00:00 EDT 2018 | Mon Aug 13 00:00:00 EDT 2018 | Human papillomavirus type 163 isolate KC3, complete genome |
| NC_019023 | 38.30% | NC_019023.1 | | Mon Aug 13 00:00:00 EDT 2018 | Mon Aug 13 00:00:00 EDT 2018 | Human papillomavirus type 166 isolate KC9, complete genome |
| NC_022892 | 35.80% | NC_022892.1 | | Mon Aug 13 00:00:00 EDT 2018 | Mon Aug 13 00:00:00 EDT 2018 | Human papillomavirus type 167 isolate KC10, complete genome |
| NC_038523 | 37.80% | NC_038523.1 | HPV 172 | Fri Aug 24 00:00:00 EDT 2018 | Fri Aug 24 00:00:00 EDT 2018 | Human papillomavirus type 172, complete genome |
| NC_038524 | 38.90% | NC_038524.1 | | Fri Aug 24 00:00:00 EDT 2018 | Fri Aug 24 00:00:00 EDT 2018 | Human papillomavirus type 175 isolate SE87, complete genome |
| NC_023891 | 38.20% | NC_023891.1 | | Mon Aug 13 00:00:00 EDT 2018 | Mon Aug 13 00:00:00 EDT 2018 | Human papillomavirus type 178, complete genome |
| NC_022095 | 36.80% | NC_022095.1 | | Mon Aug 13 00:00:00 EDT 2018 | Mon Aug 13 00:00:00 EDT 2018 | Human papillomavirus type 179 complete genome, isolate SIBX16 |
| NC_038914 | 36.90% | NC_038914.1 | | Fri Aug 24 00:00:00 EDT 2018 | Fri Aug 24 00:00:00 EDT 2018 | Human papillomavirus type 184 complete genome, isolate SIBX17 |
| NC_039086 | 38.90% | NC_039086.1 | | Mon Aug 13 00:00:00 EDT 2018 | Fri Aug 24 00:00:00 EDT 2018 | Human papillomavirus type 187 isolate ACS447, complete genome |
| NC_027528 | 37.70% | NC_027528.1 | | Mon Aug 13 00:00:00 EDT 2018 | Mon Aug 13 00:00:00 EDT 2018 | Human papillomavirus type 201 isolate HPV201, complete genome |
| NC_038525 | 37.80% | NC_038525.1 | | Fri Aug 24 00:00:00 EDT 2018 | Fri Aug 24 00:00:00 EDT 2018 | Human papillomavirus type 204 isolate A342, complete genome |
| NC_001531 | 42.40% | NC_001531.1 | | Mon Aug 13 00:00:00 EDT 2018 | Mon Aug 13 00:00:00 EDT 2018 | Human papillomavirus type 5, complete genome |
| NC_003461 | 37.20% | NC_003461.1 | | Mon Aug 13 00:00:00 EDT 2018 | Mon Aug 13 00:00:00 EDT 2018 | Human parainfluenza virus 1, complete genome |
| NC_001796 | 34.50% | NC_001796.2 | | Mon Aug 13 00:00:00 EDT 2018 | Mon Aug 13 00:00:00 EDT 2018 | Human parainfluenza virus 3, complete genome |
| NC_038311 | 37.40% | NC_038311.1 | | Fri Aug 24 00:00:00 EDT 2018 | Fri Aug 24 00:00:00 EDT 2018 | Human rhinovirus 1 strain ATCC VR-1559, complete genome |
| NC_038312 | 39.90% | NC_038312.1 | HRV-A1 | Tue Jun 04 00:00:00 EDT 2019 | Tue Jun 04 00:00:00 EDT 2019 | Human rhinovirus 3, complete genome |
| NC_001490 | 40.60% | NC_001490.1 | | Mon Aug 13 00:00:00 EDT 2018 | Mon Aug 13 00:00:00 EDT 2018 | Human rhinovirus 14, complete genome |
| NC_001617 | 39.00% | NC_001617.1 | | Mon Aug 13 00:00:00 EDT 2018 | Mon Aug 13 00:00:00 EDT 2018 | Human rhinovirus 89, complete genome |
| NC_009996 | 42.80% | NC_009996.1 | | Mon Aug 13 00:00:00 EDT 2018 | Mon Aug 13 00:00:00 EDT 2018 | Human rhinovirus C, complete genome |
| NC_038878 | 43.40% | NC_038878.1 | | Fri Aug 24 00:00:00 EDT 2018 | Fri Aug 24 00:00:00 EDT 2018 | Human rhinovirus NAT001 polyprotein gene, complete cds |
| NC_001436 | 53.50% | NC_001436.1 | | Mon Aug 13 00:00:00 EDT 2018 | Mon Aug 13 00:00:00 EDT 2018 | Human T-lymphotropic virus 1, complete genome |
| NC_026438 | 44.80% | NC_026438.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 1 polymerase PB2 (PB2) gene, complete cds |
| NC_026435 | 42.00% | NC_026435.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 2 polymerase PB1 (PB1) gene, complete cds; and nonfunctional PB1-F2 protein (PB1-F2) gene, complete sequence |

TABLE 3-continued

Exemplary target sequences

| Name | % GC | Accession | Common Name | Created | Created Date | Description |
|---|---|---|---|---|---|---|
| NC_026437 | 44.20% | NC_026437.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 3 polymerase PA (PA) gene, complete cds |
| NC_026433 | 40.80% | NC_026433.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 4 hemagglutinin (HA) gene, complete cds |
| NC_026436 | 46.30% | NC_026436.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 5 nucleocapsid protein (NP) gene, complete cds |
| NC_026434 | 42.10% | NC_026434.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 6 neuraminidase (NA) gene, complete cds |
| NC_026431 | 47.10% | NC_026431.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 7 matrix protein 2 (M2) and matrix protein 1 (M1) genes, complete cds |
| NC_026432 | 43.60% | NC_026432.1 | A/California/07/2009(H1N1) | Mon Aug 13 00:00:00 EDT 2018 | Mon Aug 13 00:00:00 EDT 2018 | Influenza A virus (A/California/07/2009(H1N1)) segment 8 nuclear export protein (NEP) and nonstructural protein 1 (NS1) genes, complete cds |
| NC_007361 | 43.40% | NC_007361.1 | A/goose/Guangdong/1/1996(H5N1) | Mon Aug 13 00:00:00 EDT 2018 | Mon Aug 13 00:00:00 EDT 2018 | Influenza A virus (A/Goose/Guangdong/1/96(H5N1)) neuraminidase (NA) gene, complete cds |
| NC_007360 | 46.80% | NC_007360.1 | A/goose/Guangdong/1/1996(H5N1) | Mon Aug 13 00:00:00 EDT 2018 | M TABLE 3-continued

| Exemplary target sequences | | | | | | |
|---|---|---|---|---|---|---|
| Name | % GC | Accession | Common Name | Created | Created Date | Description |
| NC_007374 | 41.60% | NC_007374.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 4, complete sequence |
| NC_007381 | 46.40% | NC_007381.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 5, complete sequence |
| NC_007382 | 43.40% | NC_007382.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 6, complete sequence |
| NC_007377 | 47.50% | NC_007377.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 7, complete sequence |
| NC_007380 | 43.40% | NC_007380.1 | A/Korea/426/1968(H2N2 | Mon Aug 13 00:00:00 EDT 2018 | Mon Aug 13 00:00:00 EDT 2018 | Influenza A virus (A/Korea/426/1968(H2N2)) segment 8, complete sequence |
| NC_007373 | 42.50% | NC_007373.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 1, complete sequence |
| NC_007372 | 42.20% | NC_007372.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 2, complete sequence |
| NC_007371 | 41.70% | NC_007371.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 3, complete sequence |
| NC_007366 | 42.00% | NC_007366.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 4, complete sequence |
| NC_007369 | 45.80% | NC_007369.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 5, complete sequence |
| NC_007368 | 42.70% | NC_007368.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 6, complete sequence |
| NC_007367 | 46.70% | NC_007367.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 7, complete sequence |
| NC_007370 | 41.70% | NC_007370.1 | A/New York/392/2004(H3N2 | Mon Aug 13 00:00:00 EDT 2018 | Mon Aug 13 00:00:00 EDT 2018 | Influenza A virus (A/New York/392/2004(H3N2)) segment 8, complete sequence |
| NC_002023 | 43.70% | NC_002023.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 1, complete sequence |
| NC_002021 | 42.10% | NC_002021.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 2, complete sequence |
| NC_002022 | 42.00% | NC_002022.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 3, complete sequence |
| NC_002017 | 41.60% | NC_002017.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 4, complete sequence |
| NC_002019 | 46.40% | NC_002019.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 5, complete sequence |
| NC_002018 | 42.70% | NC_002018.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 6, complete sequence |
| NC_002016 | 47.20% | NC_002016.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 7, complete sequence |
| NC_002020 | 44.30% | NC_002020.1 | A/Puerto Rico/8/1934(H1N1 | Mon Aug 13 00:00:00 EDT 2018 | Mon Aug 13 00:00:00 EDT 2018 | Influenza A virus (A/Puerto Rico/8/1934(H1N1)) segment 8, complete sequence |
| NC_026422 | 44.90% | NC_026422.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 1 polymerase PB2 (PB2) gene, complete cds |
| NC_026423 | 44.20% | NC_026423.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 2 polymerase PB1 (PB1) and PB1-F2 protein (PB1-F2) genes, complete cds |

TABLE 3-continued

Exemplary target sequences

| Name | % GC | Accession | Common Name | Created | Created Date | Description |
|---|---|---|---|---|---|---|
| NC_026424 | 44.30% | NC_026424.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 3 polymerase PA (PA) and PA-X protein (PA-X) genes, complete cds |
| NC_026425 | 41.80% | NC_026425.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 4 hemagglutinin (HA) gene, complete cds |
| NC_026426 | 46.60% | NC_026426.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 5 nucleocapsid protein (NP) gene, complete cds |
| NC_026429 | 43.60% | NC_026429.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 6 neuraminidase (NA) gene, complete cds |
| NC_026427 | 47.50% | NC_026427.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 7 matrix protein 2 (M2) and matrix protein 1 (M1) genes, complete cds |
| NC_026428 | 41.90% | NC_026428.1 | A/Shanghai/02/2013(H7N9 | Mon Aug 13 00:00:00 EDT 2018 | Mon Aug 13 00:00:00 EDT 2018 | Influenza A virus (A/Shanghai/02/2013(H7N9)) segment 8 nuclear export protein (NEP) and nonstructural protein 1 (NS1) genes, complete cds |
| NC_004908 | 42.50% | NC_004908.1 | A/Hong Kong/1073/99(H9N2 | Mon Aug 13 00:00:00 EDT 2018 | Mon Aug 13 00:00:00 EDT 2018 | Influenza A virus ha gene for Hemagglutinin, genomic RNA, strain A/Hong Kong/1073/99(H9N2) |
| NC_004909 | 42.60% | NC_004909.1 | A/Hong Kong/1073/99(H9N2 | Mon Aug 13 00:00:00 EDT 2018 | Mon Aug 13 00:00:00 EDT 2018 | Influenza A virus na gene for neuraminidase, genomic RNA, strain A/Hong Kong/1073/99(H9N2) |
| NC_004912 | 44.00% | NC_004912.1 | A/Hong Kong/1073/99(H9N2 | Mon Aug 13 00:00:00 EDT 2018 | Mon Aug 13 00:00:00 EDT 2018 | Influenza A virus pa gene for polymerase PA, genomic RNA, strain A/Hong Kong/1073/99(H9N2) |
| NC_004911 | 43.50% | NC_004911.1 | A/Hong Kong/1073/99(H9N2 | Mon Aug 13 00:00:00 EDT 2018 | Mon Aug 13 00:00:00 EDT 2018 | Influenza A virus pb1 gene for polymerase Pb1, genomic RNA, strain A/Hong Kong/1073/99(H9N2) |
| NC_004910 | 43.20% | NC_004910.1 | A/Hong Kong/1073/99(H9N2 | Mon Aug 13 00:00:00 EDT 2018 | Mon Aug 13 00:00:00 EDT 2018 | Influenza A virus pb2 gene for polymerase Pb2, genomic RNA, strain A/Hong Kong/1073/99(H9N2) |
| NC_002205 | 38.50% | NC_002205.1 | B/Lee/1940 | Mon Aug 13 00:00:00 EDT 2018 | Mon Aug 13 00:00:00 EDT 2018 | Influenza B virus (B/Lee/1940) segment 2, complete sequence |
| NC_002206 | 39.20% | NC_002206.1 | B/Lee/1940 | Mon Aug 13 00:00:00 EDT 2018 | Mon Aug 13 00:00:00 EDT 2018 | Influenza B virus (B/Lee/1940) segment 3, complete sequence |
| NC_002207 | 41.80% | NC_002207.1 | B/Lee/1940 | Mon Aug 13 00:00:00 EDT 2018 | Mon Aug 13 00:00:00 EDT 2018 | Influenza B virus (B/Lee/1940) segment 4, complete sequence |
| NC_002208 | 42.00% | NC_002208.1 | B/Lee/1940 | Mon Aug 13 00:00:00 EDT 2018 | Mon Aug 13 00:00:00 EDT 2018 | Influenza B virus (B/Lee/1940) segment 5, complete sequence |
| NC_002209 | 41.60% | NC_002209.1 | B/Lee/1940 | Mon Aug 13 00:00:00 EDT 2018 | Mon Aug 13 00:00:00 EDT 2018 | Influenza B virus (B/Lee/1940) segment 6, complete sequence |
| NC_002210 | 38.80% | NC_002210.1 | B/Lee/1940 | Mon Aug 13 00:00:00 EDT 2018 | Mon Aug 13 00:00:00 EDT 2018 | Influenza B virus (B/Lee/1940) segment 7, complete sequence |
| NC_002211 | 41.30% | NC_002211.1 | B/Lee/1940 | Mon Aug 13 00:00:00 EDT 2018 | Mon Aug 13 00:00:00 EDT 2018 | Influenza B virus (B/Lee/1940) segment 8, complete sequence |
| NC_002204 | 39.10% | NC_002204.1 | B/Lee/1940 | Mon Aug 13 00:00:00 EDT 2018 | Mon Aug 13 00:00:00 EDT 2018 | Influenza Bvirus RNA 1, complete sequence |
| NC_006310 | 39.80% | NC_006310.2 | C/Ann Arbor/1/50 | Mon Aug 13 00:00:00 EDT 2018 | Mon Aug 13 00:00:00 EDT 2018 | Influenza C virus (C/Ann Arbor/1/50) HEF gene for hemagglutinin-esterase-fusion, complete cds |
| NC_006312 | 38.60% | NC_006312.2 | C/Ann Arbor/1/50 | Mon Aug 13 00:00:00 EDT 2018 | Mon Aug 13 00:00:00 EDT 2018 | Influenza C virus (C/Ann Arbor/1/50) M1, CM2 genes for matrix protein, CM2 protein, complete cds |
| NC_006309 | 35.60% | NC_006309.2 | C/Ann Arbor/1/50 | Mon Aug 13 00:00:00 EDT 2018 | Mon Aug 13 00:00:00 EDT 2018 | Influenza C virus (C/Ann Arbor/1/50) P3 gene for polymerase 3, complete cds |
| NC_006308 | 35.60% | NC_006308.2 | C/Ann Arbor/1/50 | Mon Aug 13 00:00:00 EDT 2018 | Mon Aug 13 00:00:00 EDT 2018 | Influenza C virus (C/Ann Arbor/1/50) PB1 gene for polymerase 1, complete cds |

TABLE 3-continued

Exemplary target sequences

| Name | % GC | Accession | Common Name | Created | Created Date | Description |
|---|---|---|---|---|---|---|
| NC_006307 | 36.80% | NC_006307.2 | C/Ann Arbor/1/50 | Mon Aug 13 00:00:00 EDT 2018 | Mon Aug 13 00:00:00 EDT 2018 | Influenza C virus (C/Ann Arbor/1/50) PB2 gene for polymerase 2, complete cds |
| NC_006311 | 38.40% | NC_006311.1 | C/Ann Arbor/1/50 | Mon Aug 13 00:00:00 EDT 2018 | Mon Aug 13 00:00:00 EDT 2018 | Influenza C virus (C/Ann Arbor/1/50) segment 5, complete sequence |
| NC_006306 | 37.50% | NC_006306.2 | C/Ann Arbor/1/50 | Mon Aug 13 00:00:00 EDT 2018 | Mon Aug 13 00:00:00 EDT 2018 | Influenza C virus (C/Ann Arbor/1/50) segment 7, complete sequence |
| NZ_LT591897 | 52.10% | NZ_LT591897.1 | | Sat Apr 04 00:00:00 EDT 2020 | Sat Apr 04 00:00:00 EDT 2020 | Neisseria gonorrhoeae strain WHO F chromosome 1 |
| NC_001803 | 33.20% | NC_001803.1 | | Mon Aug 13 00:00:00 EDT 2018 | Mon Aug 13 00:00:00 EDT 2018 | Respiratory syncytial virus, complete genome |
| NC_004718 | 40.80% | NC_004718.3 | | Mon Aug 13 00:00:00 EDT 2018 | Mon Aug 13 00:00:00 EDT 2018 | SARS coronavirus, complete genome |
| NZ_LN831034 | 38.50% | NZ_LN831034.1 | | Thu Apr 02 00:00:00 EDT 2020 | Thu Apr 02 00:00:00 EDT 2020 | Streptococcus pyogenes strain NCTC8198 chromosome 1 |

NASBA

In certain example embodiments, the RNA or DNA amplification is NASBA, which is initiated with reverse transcription of target RNA by a sequence-specific reverse primer to create a RNA/DNA duplex. RNase H is then used to degrade the RNA template, allowing a forward primer containing a promoter, such as the T7 promoter, to bind and initiate elongation of the complementary strand, generating a double-stranded DNA product. The RNA polymerase promoter-mediated transcription of the DNA template then creates copies of the target RNA sequence. Importantly, each of the new target RNAs can be detected by the guide RNAs thus further enhancing the sensitivity of the assay. Binding of the target RNAs by the guide RNAs then leads to activation of the CRISPR effector protein and the methods proceed as outlined above. The NASBA reaction has the additional advantage of being able to proceed under moderate isothermal conditions, for example at approximately 41° C., making it suitable for systems and devices deployed for early and direct detection in the field and far from clinical laboratories.

RPA

In certain other example embodiments, a recombinase polymerase amplification (RPA) reaction may be used to amplify the target nucleic acids. RPA reactions employ recombinases which are capable of pairing sequence-specific primers with homologous sequence in duplex DNA. If target DNA is present, DNA amplification is initiated and no other sample manipulation such as thermal cycling or chemical melting is required. The entire RPA amplification system is stable as a dried formulation and can be transported safely without refrigeration. RPA reactions may also be carried out at isothermal temperatures with an optimum reaction temperature of 37-42° C. The sequence specific primers are designed to amplify a sequence comprising the target nucleic acid sequence to be detected. In certain example embodiments, a RNA polymerase promoter, such as a T7 promoter, is added to one of the primers. This results in an amplified double-stranded DNA product comprising the target sequence and a RNA polymerase promoter. After, or during, the RPA reaction, a RNA polymerase is added that will produce RNA from the double-stranded DNA templates. The amplified target RNA can then in turn be detected by the CRISPR effector system. In this way target DNA can be detected using the embodiments disclosed herein. RPA reactions can also be used to amplify target RNA. The target RNA is first converted to cDNA using a reverse transcriptase, followed by second strand DNA synthesis, at which point the RPA reaction proceeds as outlined above.

Transposase Based Amplification

Embodiments disclosed herein provide systems and methods for isothermal amplification of target nucleic acid sequences by contacting oligonucleotides containing the target nucleic acid sequence with a transposon complex. The oligonucleotides may be single stranded or double stranded RNA, DNA, or RNA/DNA hybrid oligonucleotides. The transposon complex comprises a transposase and a transposon sequence comprising one or more RNA polymerase promoters. The transposase facilitates insertion of the one or more RNA polymerase promoters into the oligonucleotide. A RNA polymerase promoter can then transcribe the target nucleic acid sequence from the inserted one or more RNA polymerase promoters. One advantage of this system is that there is no need to heat or melt double-stranded DNA templates, since RNA polymerase polymerases require a double-stranded template. Such isothermal amplification is fast and simple, obviating the need for complicated and expensive instrumentation for denaturation and cooling. In certain example embodiment the RNA polymerase promoter is a native of modified T7 RNA promoter.

The term "transposon", as used herein, refers to a nucleic acid segment, which is recognized by a transposase or an integrase enzyme and which is an essential component of a functional nucleic acid-protein complex (i.e. a transposome) capable of transposition. The term "transposase" as used herein refers to an enzyme, which is a component of a functional nucleic acid-protein complex capable of transposition and which is mediating transposition. The term "transposase" also refers to integrases from retrotransposons or of retroviral origin. Transposon complexes form between a transposase enzyme and a fragment of double stranded DNA that contains a specific binding sequence for the enzyme, termed "transposon end". The sequence of the transposon binding site can be modified with other bases, at certain positions, without affecting the ability for transposon complex to form a stable structure that can efficiently transpose into target DNA.

In embodiments provided herein, the transposon complex may comprise a transposase and a transposon sequence comprising one or more RNA polymerase promoters. The term "promoter" refers to a region of DNA involved in binding the RNA polymerase to initiate transcription. In specific embodiments, the RNA polymerase promoter may be a T7 RNA polymerase promoter. The T7 RNA promoter may be inserted into the double-stranded polynucleotide using the transposase. In some embodiments, insertion of the T7 RNA polymerase promoter into the oligonucleotide may be random.

The frequency of transposition is very low for most transposons, which use complex mechanisms to limit activity. Tn5 transposase, for example, utilizes a DNA binding sequence that is suboptimal and the C-terminus of the transposase interferes with DNA binding. Mechanisms involved in Tn5 transposition have been carefully characterized by Reznikoff and colleagues. Tn5 transposes by a cut-and-paste mechanism. The transposon has two pairs of 19 bp elements that are utilized by the transposase: outside elements (OE) and inside elements (IE). One transposase monomer binds to each of the two elements that are utilized. After a monomer is bound to each end of the transposon, the two monomers dimerize, forming a synapse. Vectors with donor backbones of at least 200 bp, but less than 1000 bp, are most functional for transposition in bacteria. Transposon cleavage occurs by trans catalysis and only when monomers bound to each DNA end are in a synaptic complex. Tn5 transposes with a relaxed target site selection and can therefore insert into target DNA with little to no target sequence specificity.

The natural downregulation of Tn5 transposition can be overcome by selection of a hyperactive transposase and by optimizing the transposase-binding elements [York et al. 1998]. A mosaic element (ME), made by modification of three bases of the wild type OE, led to a 50-fold increase in transposition events in bacteria as well as cell-free systems. The combined effect of the optimized ME and hyperactive mutant transposase is estimated to result in a 100-fold increase in transposition activity. Goryshin et al showed that preformed Tn5 transposition complexes could be functionally introduced into bacterial or yeast by electroporation [Goryshin et al. 2000]. Linearization of the DNA, to have inverted repeats precisely positioned at both ends of the transposon, allowed Goryshin and coworkers to bypass the cutting step of transposition thus enhancing transposition efficiency.

In some embodiments, the transposase may be used to tagment the oligonucleotide sequence comprising the target sequence. The term "tagmentation" refers to a step in the Assay for Transposase Accessible Chromatin using sequencing (ATAC-seq) as described. (See, Buenrostro, J. D., Giresi, P. G., Zaba, L. C., Chang, H. Y., Greenleaf, W. J., Transposition of native chromatin for fast and sensitive epigenomic profiling of open chromatin, DNA-binding proteins and nucleosome position. Nature methods 2013; 10 (12): 1213-1218). Specifically, a hyperactive Tn5 transposase loaded in vitro with adapters for high-throughput DNA sequencing, can simultaneously fragment and tag a genome with sequencing adapters. In one embodiment the adapters are compatible with the methods described herein.

In some embodiments, the transposase may be a Tn5 transposase. In some embodiments, the transposase may be a variant of a Tn5 transposase, or an engineered transposase. Transposases may be engineered using any method known in the art. The engineered transposase may be optimized to function at a temperature ranging from 30° C. to 45° C., 35° C. to 40° C. or any temperature in between. The engineered transposase may be optimized to release from the oligonucleotide at a faster rate compared to a wild type transposase.

In some embodiments, the transposase may be a Tn5 transposase, a Mu transposase, or a Tn7 transposase. Transposition efficiency in vitro may vary depending on the transposon system used. Generally, Tn5 and Mu transposases effect higher levels of transposition efficiency. In some embodiments, insertion may be random. In some embodiments, insertion may occur in GC rich regions of the target sequence.

In some embodiments, the transposon sequence may comprise two 19 base pair Mosaic End (ME) Tn5 transposase recognition sequences. Tn5 transposases will generally transpose any DNA sequence contained between such short 19 base pair ME Tn5 transposase recognition sequences.

In some embodiments, use of a transposase allows for separation of a double-stranded polynucleotide in the absence of heat or melting. Embodiments can be as described in PCT/US2019/039195, entitled CRISPR/Cas and Transposase Based Amplification Compositions, Systems and Methods, incorporated herein by reference.

Nickase Dependent Amplification

In an embodiment of the invention may comprise nickase-based amplification. The nicking enzyme may be a CRISPR protein. Accordingly, the introduction of nicks into dsDNA can be programmable and sequence-specific. In an embodiment of the invention, two guides can be designed to target opposite strands of a dsDNA target. According to the invention, the nickase can be Cpf1, C2c1, Cas9 or any ortholog or CRISPR protein that cleaves or is engineered to cleave a single strand of a DNA duplex. The nicked strands may then be extended by a polymerase. In an embodiment, the locations of the nicks are selected such that extension of the strands by a polymerase is towards the central portion of the target duplex DNA between the nick sites. In certain embodiments, primers are included in the reaction capable of hybridizing to the extended strands followed by further polymerase extension of the primers to regenerate two dsDNA pieces: a first dsDNA that includes the first strand Cpf1 guide site or both the first and second strand Cpf1 guide sites, and a second dsDNA that includes the second strand Cpf1 guide site or both the first and second strand Cprf guide sites. These pieces continue to be nicked and extended in a cyclic reaction that exponentially amplifies the region of the target between nicking sites.

The amplification can be isothermal and selected for temperature. In one embodiment, the amplification proceeds rapidly at 37 degrees. In other embodiments, the temperature of the isothermal amplification may be chosen by selecting a polymerase (e.g. Bsu, Bst, Phi29, klenow fragment etc.). operable at a different temperature.

Thus, whereas nicking isothermal amplification techniques use nicking enzymes with fixed sequence preference (e.g. in nicking enzyme amplification reaction or NEAR), which requires denaturing of the original dsDNA target to allow annealing and extension of primers that add the nicking substrate to the ends of the target, use of a CRISPR nickase wherein the nicking sites can be programed via guide RNAs means that no denaturing step is necessary, enabling the entire reaction to be truly isothermal. This also simplifies the reaction because these primers that add the nicking substrate are different than the primers that are used later in the reaction, meaning that NEAR requires two primer sets (i.e. 4 primers) while Cpf1 nicking amplification only requires one primer set (i.e. two primers). This makes nicking Cpf1 amplification much simpler and easier to operate without complicated instrumentation to perform the denaturation and then cooling to the isothermal temperature.

In an aspect, the isothermal amplification reagents may be utilized with a thermostable CRISPR-Cas protein. The combination of thermostable protein and isothermal amplification reagents may be utilized to further improve reaction times for detection and diagnostics.

Accordingly, in certain example embodiments the systems disclosed herein may include amplification reagents. Different components or reagents useful for amplification of nucleic acids are described herein. For example, an amplification reagent as described herein may include a buffer, such as a Tris buffer. A Tris buffer may be used at any concentration appropriate for the desired application or use, for example including, but not limited to, a concentration of 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 25 mM, 50 mM, 75 mM, 1 M, or the like. One of skill in the art will be able to determine an appropriate concentration of a buffer such as Tris for use with the present invention.

A salt, such as magnesium chloride ($MgCl_2$), potassium chloride (KCl), or sodium chloride (NaCl), may be included in an amplification reaction, such as PCR, in order to improve the amplification of nucleic acid fragments. Although the salt concentration will depend on the particular reaction and application, in some embodiments, nucleic acid fragments of a particular size may produce optimum results at particular salt concentrations. Larger products may require altered salt concentrations, typically lower salt, in order to produce desired results, while amplification of smaller products may produce better results at higher salt concentrations. One of skill in the art will understand that the presence and/or concentration of a salt, along with alteration of salt concentrations, may alter the stringency of a biological or chemical reaction, and therefore any salt may be used that provides the appropriate conditions for a reaction of the present invention and as described herein.

Other components of a biological or chemical reaction may include a cell lysis component in order to break open or lyse a cell for analysis of the materials therein. A cell lysis component may include, but is not limited to, a detergent, a salt as described above, such as NaCl, KCl, ammonium sulfate [$(NH_4)_2SO_4$], or others. Detergents that may be appropriate for the invention may include Triton X-100, sodium dodecyl sulfate (SDS), CHAPS (3-[(3-cholamidopropyl)dimethylammonio]-1-propanesulfonate), ethyl trimethyl ammonium bromide, nonyl phenoxypolyethoxylethanol (NP-40). Concentrations of detergents may depend on the particular application, and may be specific to the reaction in some cases. Amplification reactions may include dNTPs and nucleic acid primers used at any concentration appropriate for the invention, such as including, but not limited to, a concentration of 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, 950 nM, 1 mM, 2 mM, 3 mM, 4 mM, 5 mM, 6 mM, 7 mM, 8 mM, 9 mM, 10 mM, 20 mM, 30 mM, 40 mM, 50 mM, 60 mM, 70 mM, 80 mM, 90 mM, 100 mM, 150 mM, 200 mM, 250 mM, 300 mM, 350 mM, 400 mM, 450 mM, 500 mM, or the like. Likewise, a polymerase useful in accordance with the invention may be any specific or general polymerase known in the art and useful or the invention, including Taq polymerase, Q5 polymerase, or the like.

In some embodiments, amplification reagents as described herein may be appropriate for use in hot-start amplification. Hot start amplification may be beneficial in some embodiments to reduce or eliminate dimerization of adaptor molecules or oligos, or to otherwise prevent unwanted amplification products or artifacts and obtain optimum amplification of the desired product. Many components described herein for use in amplification may also be used in hot-start amplification. In some embodiments, reagents or components appropriate for use with hot-start amplification may be used in place of one or more of the composition components as appropriate. For example, a polymerase or other reagent may be used that exhibits a desired activity at a particular temperature or other reaction condition. In some embodiments, reagents may be used that are designed or optimized for use in hot-start amplification, for example, a polymerase may be activated after transposition or after reaching a particular temperature. Such polymerases may be antibody-based or aptamer-based. Polymerases as described herein are known in the art. Examples of such reagents may include, but are not limited to, hot-start polymerases, hot-start dNTPs, and photo-caged dNTPs. Such reagents are known and available in the art. One of skill in the art will be able to determine the optimum temperatures as appropriate for individual reagents.

Amplification of nucleic acids may be performed using specific thermal cycle machinery or equipment, and may be performed in single reactions or in bulk, such that any desired number of reactions may be performed simultaneously. In some embodiments, amplification may be performed using microfluidic or robotic devices, or may be performed using manual alteration in temperatures to achieve the desired amplification. In some embodiments, optimization may be performed to obtain the optimum reactions conditions for the particular application or materials. One of skill in the art will understand and be able to optimize reaction conditions to obtain sufficient amplification.

In certain embodiments, detection of DNA with the methods or systems of the invention requires transcription of the (amplified) DNA into RNA prior to detection.

It will be evident that detection methods of the invention can involve nucleic acid amplification and detection procedures in various combinations. The nucleic acid to be detected can be any naturally occurring or synthetic nucleic acid, including but not limited to DNA and RNA, which may be amplified by any suitable method to provide an intermediate product that can be detected. Detection of the intermediate product can be by any suitable method including but not limited to binding and activation of a CRISPR protein which produces a detectable signal moiety by direct or collateral activity.

Helicase-Dependent Amplification

In helicase-dependent amplification, a helicase enzyme is used to unwind a double stranded nucleic acid to generate templates for primer hybridization and subsequent primer-extension. This process utilizes two oligonucleotide primers, each hybridizing to the 3'-end of either the sense strand containing the target sequence or the anti-sense strand containing the reverse-complementary target sequence. The HDA reaction is a general method for helicase-dependent nucleic acid amplification.

In combining this method with a CRISPR-SHERLOCK system, the target nucleic acid may be amplified by opening R-loops of the target nucleic acid using first and second CRISPR/Cas complexes. The first and second strand of the target nucleic acid may thus be unwound using a helicase, allowing primers and polymerase to bind and extend the DNA under isothermal conditions.

The term "helicase" refers here to any enzyme capable of unwinding a double stranded nucleic acid enzymatically. For example, helicases are enzymes that are found in all organisms and in all processes that involve nucleic acid such as replication, recombination, repair, transcription, translation and RNA splicing. (Kornberg and Baker, DNA Replication, W. H. Freeman and Company ($2^{nd}$ ed. (1992)), especially chapter 11). Any helicase that translocates along DNA or RNA in a 5' to 3' direction or in the opposite 3' to 5' direction may be used in present embodiments of the invention. This includes helicases obtained from prokaryotes, viruses, archaea, and eukaryotes or recombinant forms of naturally occurring enzymes as well as analogues or derivatives having the specified activity. Examples of naturally occurring DNA helicases, described by Kornberg and Baker in chapter 11 of their book, DNA Replication, W. H. Freeman and Company ($2^{nd}$ ed. (1992)), include *E. coli* helicase I, II, III, & IV, Rep, DnaB, PriA, PcrA, T4 Gp41helicase, T4 Dda helicase, T7 Gp4 helicases, SV40 Large T antigen, yeast RAD. Additional helicases that may be useful in HDA include RecQ helicase (Harmon and Kowalczykowski, *J. Biol. Chem.* 276:232-243 (2001)), thermostable UvrD helicases from *T. tengcongensis* (disclosed in this invention, Example XII) and *T. thermophilus* (Collins and McCarthy, *Extremophiles.* 7:35-41. (2003)), thermostable DnaB helicase from *T. aquaticus* (Kaplan and Steitz, *J. Biol. Chem.* 274:6889-6897 (1999)), and MCM helicase from archaeal and eukaryotic organisms ((Grainge et al., *Nucleic Acids Res.* 31:4888-4898 (2003)).

A traditional definition of a helicase is an enzyme that catalyzes the reaction of separating/unzipping/unwinding the helical structure of nucleic acid duplexes (DNA, RNA or hybrids) into single-stranded components, using nucleoside triphosphate (NTP) hydrolysis as the energy source (such as ATP). However, it should be noted that not all helicases fit this definition anymore. A more general definition is that they are motor proteins that move along the single-stranded or double stranded nucleic acids (usually in a certain direction, 3' to 5' or 5 to 3, or both), i.e. translocases, that can or cannot unwind the duplexed nucleic acid encountered. In addition, some helicases simply bind and "melt" the duplexed nucleic acid structure without an apparent translocase activity.

Helicases exist in all living organisms and function in all aspects of nucleic acid metabolism. Helicases are classified based on the amino acid sequences, directionality, oligomerization state and nucleic-acid type and structure preferences.

The most common classification method was developed based on the presence of certain amino acid sequences, called motifs. According to this classification helicases are divided into 6 super families: SF1, SF2, SF3, SF4, SF5 and SF6. SF1 and SF2 helicases do not form a ring structure around the nucleic acid, whereas SF3 to SF6 do. Superfamily classification is not dependent on the classical taxonomy.

DNA helicases are responsible for catalyzing the unwinding of double-stranded DNA (dsDNA) molecules to their respective single-stranded nucleic acid (ssDNA) forms. Although structural and biochemical studies have shown how various helicases can translocate on ssDNA directionally, consuming one ATP per nucleotide, the mechanism of nucleic acid unwinding and how the unwinding activity is regulated remains unclear and controversial (T. M. Lohman, E. J. Tomko, C. G. Wu, "Non-hexameric DNA helicases and translocases: mechanisms and regulation," Nat Rev Mol Cell Biol 9:391-401 (2008)). Since helicases can potentially unwind all nucleic acids encountered, understanding how their unwinding activities are regulated can lead to harnessing helicase functions for biotechnology applications.

The term "HDA" refers to Helicase Dependent Amplification, which is an in vitro method for amplifying nucleic acids by using a helicase preparation for unwinding a double stranded nucleic acid to generate templates for primer hybridization and subsequent primer-extension. This process utilizes two oligonucleotide primers, each hybridizing to the 3'-end of either the sense strand containing the target sequence or the anti-sense strand containing the reverse-complementary target sequence. The HDA reaction is a general method for helicase-dependent nucleic acid amplification.

The invention comprises use of any suitable helicase known in the art. These include, but are not necessarily limited to, UvrD helicase, CRISPR-Cas3 helicase, E. coli helicase I, E. coli helicase II, E. coli helicase III, E. coli helicase IV, Rep helicase, DnaB helicase, PriA helicase, PcrA helicase, T4 Gp41 helicase, T4 Dda helicase, SV40 Large T antigen, yeast RAD helicase, RecD helicase, RecQ helicase, thermostable T. tengcongensis UvrD helicase, thermostable T. thermophilus UvrD helicase, thermostable T. aquaticus DnaB helicase, Dda helicase, papilloma virus E1 helicase, archaeal MCM helicase, eukaryotic MCM helicase, and T7 Gp4 helicase.

In particularly preferred embodiments, the helicase comprises a super mutation. In particular embodiments, Although the E. coli mutation has been described, the mutations were generated by sequence alignment (e.g. D409A/D410A for TteUvrd) and result in thermophilic enzymes working at lower temperatures like 37° C., which is advantageous for amplification methods and systems described herein. In some embodiments, the super mutations is an aspartate to alanine mutation, with position based on sequence alignment. In some embodiments, the super mutant helicase is selected from WP_003870487.1 *Thermoanaerobacter ethanolicus* 403/404, WP_049660019.1 *Bacillus* sp. FJAT-27231 407/408, WP_034654680.1 *Bacillus megaterium* 415/416, WP_095390358.1 *Bacillus simplex* 407/408, and WP_055343022.1 *Paeniclostridium sordellii* 402/403.

Incubating

Methods of detection and/or extraction using the systems disclosed herein can comprise incubating the sample or set of samples under conditions sufficient to allow binding of the guide RNAs to one or more target molecules. Extraction can comprise incubating the sample under conditions sufficient to allow release of viral RNA present in the sample, which may comprise incubating at 22° C. to 60° C. for 30 to 70 minutes or at 90° C.-100° C. for about 10 minutes.

In certain example embodiments, the incubation time of the amplifying and detecting in the present invention may be shortened. The assay may be performed in a period of time required for an enzymatic reaction to occur. One skilled in the art can perform biochemical reactions in 5 minutes (e.g., 5 minute ligation). Incubating may occur at one or more temperatures over timeframes between about 10 minutes and 90 minutes, preferably less than 90 minutes, 75 minutes, 60 minutes, 45 minutes, 30 minutes, 25 minutes, 20 minutes, 15 minutes, or 10 minutes depending on sample, reagents and components of the system. In some embodiments, incubating for the amplification is performed at one or more temperatures between about 20° C. and 80° C., in some embodiments, about 37° C. In some embodiments, incubating for the amplification is performed at one or more temperatures between about 55° C. and 65° C., between about 59° C. and 61° C., in some embodiments, about 60° C.

Activating

In certain example embodiment, activating of the Cas protein occurs via binding of the CRISPR-Cas complex via the guide molecule to the one or more target molecules, wherein activating the CRISPR effector protein results in modification of the detection construct such that a detectable positive signal is generated.

Detecting a Signal

Detecting may comprise visual observance of a positive signal relative to a control. Detecting may comprise a loss of signal or presence of signal at one or more capture regions, for example colorimetric detection, or fluorescent detection. In certain example embodiments, further modifications may be introduced that further amplify the detectable positive signal. For example, activated CRISPR effector protein collateral activation may be used to generate a secondary target or additional guide sequence, or both. In one example embodiment, the reaction solution would contain a secondary target that is spiked in at high concentration. The secondary target may be distinct from the primary target (i.e. the target for which the assay is designed to detect) and in certain instances may be common across all reaction volumes. A secondary guide sequence for the secondary target may be protected, e.g. by a secondary structural feature such as a hairpin with an RNA loop, and unable to bind the second target or the CRISPR effector protein. Cleavage of the protecting group by an activated CRISPR effector protein (i.e. after activation by formation of complex with the primary target(s) in solution) and formation of a complex with free CRISPR effector protein in solution and activation from the spiked in secondary target. In certain other example embodiments, a similar concept is used with free guide sequence to a secondary target and protected secondary target. Cleavage of a protecting group off the secondary target would allow additional CRISPR effector protein, guide sequence, secondary target sequence to form. In yet another example embodiment, activation of CRISPR effector protein by the primary target(s) may be used to cleave a protected or circularized primer, which would then be released to perform an isothermal amplification reaction, such as those disclosed herein, on a template for either secondary guide sequence, secondary target, or both. Subsequent transcription of this amplified template would produce more secondary guide sequence and/or secondary target sequence, followed by additional CRISPR effector protein collateral activation.

Quantifying

In particular methods, comparing the intensity of the one or more signals to a control is performed to quantify the nucleic acid in the sample. The term "control" refers to any reference standard suitable to provide a comparison to the expression products in the test sample. In one embodiment, the control comprises obtaining a "control sample" from which expression product levels are detected and compared to the expression product levels from the test sample. Such a control sample may comprise any suitable sample, including but not limited to a sample from a control patient (can be stored sample or previous sample measurement) with a known outcome; normal tissue, fluid, or cells isolated from a subject, such as a normal patient or the patient having a condition of interest.

The intensity of a signal is "significantly" higher or lower than the normal intensity if the signal is greater or less, respectively, than the normal or control level by an amount greater than the standard error of the assay employed to assess amount, and preferably at least 20%, 30%, 40%, 50%, 60%, 70%, 80%, 90%, 100%, 150%, 200%, 300%, 350%, 400%, 500%, 600%, 700%, 800%, 900%, 1000% or than that amount. Alternatively, the signal can be considered "significantly" higher or lower than the normal and/or control signal if the amount is at least about two, and preferably at least about 5%, 10%, 15%, 20%, 25%, 30%, 35%, 40%, 45%, 50%, 55%, 60%, 65%, 70%, 75%, 80%, 85%, 90%, 95%, 100%, 105%, 110%, 115%, 120%, 125%, 130%, 135%, 140%, 145%, 150%, 155%, 160%, 165%, 170%, 175%, 180%, 185%, 190%, 195%, two times, three times, four times, five times, or more, or any range in between, such as 5%-100%, higher or lower, respectively, than the normal and/or control signal. Such significant modulation values can be applied to any metric described herein, such as altered level of expression, altered activity, changes in biomarker inhibition, changes in test agent binding, and the like.

In some embodiments, the detectable positive signal may be a loss of fluorescent signal or colorimetric relative to a control, as described herein. In some embodiments, the detectable positive signal may be detected on a lateral flow device, as described herein.

Applications of Detection Methods

Systems and methods can be designed for the detection and diagnosis of microbes, including bacterial, fungi and viral microbes. In an aspect, the systems may comprise multiplex detection of multiple variants of viral infections, including coronavirus, different viruses which may be related coronaviruses or respiratory viruses, or a combination thereof. In embodiments, assays can be performed for a variety of viruses and viral infections, including acute respiratory infections using the disclosure detailed herein. The systems can comprise two or more CRISPR Cas systems to multiplex, as described elsewhere herein, to detect a plurality of respiratory infections or viral infections, including coronavirus. The coronavirus is a positive-sense single stranded RNA family of viruses, infecting a variety of animals and humans. SARS-CoV is one type of coronavirus infection, as well as MERS-CoV Detection of one or more coronaviruses are envisioned, including the 2019-nCoV detected in Wuhan City. Sequences of the 2019-nCoV are available at GISAID accession no. EPI_ISL_402124 and EPI_ISL_402127-402130, and described in DOI: 10.1101/2020.01.22.914952. Further deposits of the SARS-CoV-2 deposited in the GISAID platform include EP_ISL_402119-402121 and EP_ISL_402123-402124; see also GenBank Accession No. MN908947.3.

Target molecule detection can comprise two or more detection systems utilizing RNA targeting Cas effector proteins; DNA targeting Cas effector proteins, or a combination thereof. The RNA-targeting effector proteins may be a Cas13 protein, such as Cas13a, Cas13b, or Cas13c, including one of the thermostable Cas13a proteins described herein. The DNA-targeting effector protein may be a Type V protein, e.g. Cas12 protein such as Cpf1 and C2c1. The Cas protein may preferably be thermostable, such as BrCas12b or Aap Cas12b. Multiplexing systems can be designed such that different Cas proteins with different sequence specificities or other motif cutting preferences can be used, including, in certain embodiments, at least one Cas. thermostable protein described herein. See International Publication WO 2019/126577. Type VI and Type V Cas proteins are known to possess different cutting motif preferences. See Gootenberg et al. "Multiplexed and portable nucleic acid detection platform with Cas13b, Cas12a, and Csm6." Science. Apr. 27, 2018, 360:439-444; International Publication WO 2019/051318. Thus, embodiments disclosed herein may further comprise multiplex embodiments comprising two or more Type VI Cas proteins with different cutting preferences, or one or more Type VI Cas proteins and one or more Type V Cas proteins.

Multiplex approaches and selection of Cas effector proteins can be as described in International Publication WO 2019/126577 at [0415]-[0416] and Examples 1-10, incorporated herein by reference. In certain example embodiments, the coronavirus assay comprises a Type VI Cas protein disclosed herein and guide molecule comprising a guide sequence configured to directed binding of the CRISPR-Cas complex to a target molecule and a labeled detection molecule ("RNA-based masking construct"). A multiplex embodiment can be designed to track one or more variants of coronavirus or one or more variants of coronavirus, including SARS-CoV-2, in combination with other viruses, for example, Human respiratory syncytial virus, Middle East respiratory syndrome (MERS) coronavirus, Severe acute respiratory syndrome-related (SARS) coronavirus, and influenza. In embodiments, assays can be done in multiplex to detect multiple variants of coronavirus, different viruses which may be related coronaviruses or respiratory viruses, or a combination thereof. In an aspect, each assay can take place in an individual discrete volume. An "individual discrete volume" is a discrete volume or discrete space, such as a container, receptacle, or other defined volume or space that can be defined by properties that prevent and/or inhibit migration of nucleic acids and reagents necessary to carry out the methods disclosed herein, for example a volume or space defined by physical properties such as walls, for example the walls of a well, tube, or a surface of a droplet, which may be impermeable or semipermeable, or as defined by other means such as chemical, diffusion rate limited, electro-magnetic, or light illumination, or any combination thereof. By "diffusion rate limited" (for example diffusion defined volumes) is meant spaces that are only accessible to certain molecules or reactions because diffusion constraints effectively defining a space or volume as would be the case for two parallel laminar streams where diffusion will limit the migration of a target molecule from one stream to the other. By "chemical" defined volume or space is meant spaces where only certain target molecules can exist because of their chemical or molecular properties, such as size, where for example gel beads may exclude certain species from entering the beads but not others, such as by surface charge, matrix size or other physical property of the bead that can allow selection of species that may enter the interior of the bead. By "electromagnetically" defined volume or space is meant spaces where the electro-magnetic properties of the target molecules or their supports such as charge or magnetic properties can be used to define certain regions in a space such as capturing magnetic particles within a magnetic field or directly on magnets. By "optically" defined volume is meant any region of space that may be defined by illuminating it with visible, ultraviolet, infrared, or other wavelengths of light such that only target molecules within the defined space or volume may be labeled. One advantage to the used of non-walled, or semipermeable is that some reagents, such as buffers, chemical activators, or other agents maybe passed in Applicants' through the discrete volume, while other material, such as target molecules, maybe maintained in the discrete volume or space. Typically, a discrete volume will include a fluid medium, (for example, an aqueous solution, an oil, a buffer, and/or a media capable of supporting cell growth) suitable for labeling of the target molecule with the indexable nucleic acid identifier under conditions that permit labeling. Exemplary discrete volumes or spaces useful in the disclosed methods include droplets (for example, microfluidic droplets and/or emulsion droplets), hydrogel beads or other polymer structures (for example poly-ethylene glycol di-acrylate beads or agarose beads), tissue slides (for example, fixed formalin paraffin embedded tissue slides with particular regions, volumes, or spaces defined by chemical, optical, or physical means), microscope slides with regions defined by depositing reagents in ordered arrays or random patterns, tubes (such as, centrifuge tubes, microcentrifuge tubes, test tubes, cuvettes, conical tubes, and the like), bottles (such as glass bottles, plastic bottles, ceramic bottles, Erlenmeyer flasks, scintillation vials and the like), wells (such as wells in a plate), plates, pipettes, or pipette tips among others. In certain example embodiments, the individual discrete volumes are the wells of a microplate. In certain example embodiments, the microplate is a 96 well, a 384 well, or a 1536 well microplate.

In certain example embodiments, the systems, devices, and methods, disclosed herein are directed to detecting the presence of one or more microbial agents in a sample, such as a biological sample obtained from a subject. In certain example embodiments, the microbe may be a bacterium, a fungus, a yeast, a protozoan, a parasite, or a virus. Accordingly, the methods disclosed herein can be adapted for use in other methods (or in combination) with other methods that require quick identification of microbe species, monitoring the presence of microbial proteins (antigens), antibodies, antibody genes, detection of certain phenotypes (e.g. bacterial resistance), monitoring of disease progression and/or outbreak, and antibiotic screening. Because of the rapid and sensitive diagnostic capabilities of the embodiments disclosed here, detection of microbe species type, down to a single nucleotide difference, and the ability to be deployed as a POC device, the embodiments disclosed herein may be used as guide therapeutic regimens, such as a selection of the appropriate antibiotic or antiviral. The embodiments disclosed herein may also be used to screen environmental samples (air, water, surfaces, food etc.) for the presence of microbial contamination.

Disclosed is a method to identify microbial species, such as bacterial, viral, fungal, yeast, or parasitic species, or the like. Particular embodiments disclosed herein describe methods and systems that will identify and distinguish microbial species within a single sample, or across multiple samples, allowing for recognition of many different microbes. The present methods allow the detection of pathogens and distinguishing between two or more species of one or more organisms, e.g., bacteria, viruses, yeast, protozoa, and fungi or a combination thereof, in a biological or environmental sample, by detecting the presence of a target nucleic acid sequence in the sample. A positive signal obtained from the sample indicates the presence of the microbe. Multiple microbes can be identified simultaneously using the methods and systems of the invention, by employing the use of more than one effector protein, wherein each effector protein targets a specific microbial target sequence. In this way, a multi-level analysis can be performed for a particular subject in which any number of microbes can be detected at once, for example, a subject with unknown respiratory infection, having symptoms of coronavirus, or an individual at risk or having been exposed to coronavirus. In some embodiments, simultaneous detection of multiple microbes may be performed using a set of probes that can identify one or more microbial species.

Microbe Detection

In some embodiments, a method for detecting microbes in samples is provided comprising distributing a sample or set of samples into one or more individual discrete volumes, the individual discrete volumes comprising a CRISPR system as described herein; incubating the sample or set of samples under conditions sufficient to allow binding of the one or more guide RNAs to one or more microbe-specific targets; activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample. The one or more target molecules may be mRNA, gDNA (coding or non-coding), trRNA, or rRNA comprising a target nucleotide tide sequence that may be used to distinguish two or more microbial species/strains from one another. The guide RNAs may be designed to detect target sequences. The embodiments disclosed herein may also utilize certain steps to improve hybridization between guide RNA and target RNA sequences. Methods for enhancing ribonucleic acid hybridization are disclosed in WO 2015/085194, entitled "Enhanced Methods of Ribonucleic Acid Hybridization" which is incorporated herein by reference. The microbe-specific target may be RNA or DNA or a protein. If DNA method may further comprise the use of DNA primers that introduce a RNA polymerase promoter as described herein. If the target is a protein than the method will utilized aptamers and steps specific to protein detection described herein.

Detection of Single Nucleotide Variants

In some embodiments, one or more identified target sequences may be detected using guide RNAs that are specific for and bind to the target sequence as described herein. The systems and methods of the present invention can distinguish even between single nucleotide polymorphisms present among different microbial species and therefore, use of multiple guide RNAs in accordance with the invention may further expand on or improve the number of target sequences that may be used to distinguish between species. For example, in some embodiments, the one or more guide RNAs may distinguish between microbes at the species, genus, family, order, class, phylum, kingdom, or phenotype, or a combination thereof.

Detection Based on rRNA Sequences

In certain example embodiments, the devices, systems, and methods disclosed herein may be used to distinguish multiple microbial species in a sample. In certain example embodiments, identification may be based on ribosomal RNA sequences, including the 16S, 23S, and 5S subunits. Methods for identifying relevant rRNA sequences are disclosed in U.S. Patent Application Publication No. 2017/0029872. In certain example embodiments, a set of guide RNA may designed to distinguish each species by a variable region that is unique to each species or strain. Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that uniquely variable across species or a subset of species such as the RecA gene family, RNA polymerase β subunit, may be used as well. Other suitable phylogenetic markers, and methods for identifying the same, are discussed for example in Wu et al. arXiv:1307.8690 [q-bio.GN].

In certain example embodiments, a method or diagnostic is designed to screen microbes across multiple phylogenetic and/or phenotypic levels at the same time. For example, the method or diagnostic may comprise the use of multiple CRISPR systems with different guide RNAs. A first set of guide RNAs may distinguish, for example, between mycobacteria, gram positive, and gram negative bacteria. These general classes can be even further subdivided. For example, guide RNAs could be designed and used in the method or diagnostic that distinguish enteric and non-enteric within gram negative bacteria. A second set of guide RNA can be designed to distinguish microbes at the genus or species level. Thus a matrix may be produced identifying all mycobacteria, gram positive, gram negative (further divided into enteric and non-enteric) with each genus of species of bacteria identified in a given sample that fall within one of those classes. The foregoing is for example purposes only. Other means for classifying other microbe types are also contemplated and would follow the general structure described above.

Screening for Drug Resistance

In certain example embodiments, the devices, systems and methods disclosed herein may be used to screen for microbial genes of interest, for example antibiotic and/or antiviral resistance genes. Guide RNAs may be designed to distinguish between known genes of interest. Samples, including clinical samples, may then be screened using the embodiments disclosed herein for detection of such genes. The ability to screen for drug resistance at POC would have tremendous benefit in selecting an appropriate treatment regime. In certain example embodiments, the antibiotic resistance genes are carbapenemases including KPC, NDM1, CTX-M15, OXA-48. Other antibiotic resistance genes are known and may be found for example in the Comprehensive Antibiotic Resistance Database (Jia et al. "CARD 2017: expansion and model-centric curation of the Comprehensive Antibiotic Resistance Database." Nucleic Acids Research, 45, D566-573).

Ribavirin is an effective antiviral that hits a number of RNA viruses. Several clinically important viruses have evolved ribavirin resistance including Foot and Mouth Disease Virus doi:10.1128/JVI.03594-13; polio virus (Pfeifer and Kirkegaard. PNAS, 100(12):7289-7294, 2003); and hepatitis C virus (Pfeiffer and Kirkegaard, J. Virol. 79(4): 2346-2355, 2005). A number of other persistent RNA viruses, such as hepatitis and HIV, have evolved resistance to existing antiviral drugs: hepatitis B virus (lamivudine, tenofovir, entecavir) doi:10/1002/hep22900; hepatitis C virus (telaprevir, BILN2061, ITMN-191, SCh6, boceprevir, AG-021541, ACH-806) doi:10.1002/hep.22549; and HIV (many drug resistance mutations) hivb.standford.edu. The embodiments disclosed herein may be used to detect such variants among others.

Aside from drug resistance, there are a number of clinically relevant mutations that could be detected with the embodiments disclosed herein, such as persistent versus acute infection in LCMV (doi:10.1073/pnas.1019304108), and increased infectivity of Ebola (Diehl et al. Cell. 2016, 167(4):1088-1098.

As described herein elsewhere, closely related microbial species (e.g. having only a single nucleotide difference in a given target sequence) may be distinguished by introduction of a synthetic mismatch in the gRNA.

Monitoring Microbe Outbreaks

In some embodiments, a CRISPR system or methods of use thereof as described herein may be used to determine the evolution of a pathogen outbreak. The method may comprise detecting one or more target sequences from a plurality of samples from one or more subjects, wherein the target sequence is a sequence from a microbe causing the outbreaks. Such a method may further comprise determining a pattern of pathogen transmission, or a mechanism involved in a disease outbreak caused by a pathogen.

The pattern of pathogen transmission may comprise continued new transmissions from the natural reservoir of the pathogen or subject-to-subject transmissions (e.g. human-to-human transmission) following a single transmission from the natural reservoir or a mixture of both. In one embodiment, the pathogen transmission may be bacterial or viral transmission, in such case, the target sequence is preferably a microbial genome or fragments thereof. In one embodiment, the pattern of the pathogen transmission is the early pattern of the pathogen transmission, i.e. at the beginning of the pathogen outbreak. Determining the pattern of the pathogen transmission at the beginning of the outbreak increases likelihood of stopping the outbreak at the earliest possible time thereby reducing the possibility of local and international dissemination.

Determining the pattern of the pathogen transmission may comprise detecting a pathogen sequence according to the methods described herein. Determining the pattern of the pathogen transmission may further comprise detecting shared intra-host variations of the pathogen sequence between the subjects and determining whether the shared intra-host variations show temporal patterns. Patterns in observed intrahost and interhost variation provide important insight about transmission and epidemiology (Gire, et al., 2014).

Detection of shared intra-host variations between the subjects that show temporal patterns is an indication of transmission links between subject (in particular between humans) because it can be explained by subject infection from multiple sources (superinfection), sample contamination recurring mutations (with or without balancing selection to reinforce mutations), or co-transmission of slightly divergent viruses that arose by mutation earlier in the transmission chain (Park, et al., Cell 161(7):1516-1526, 2015). Detection of shared intra-host variations between subjects may comprise detection of intra-host variants located at common single nucleotide polymorphism (SNP) positions. Positive detection of intra-host variants located at common (SNP) positions is indicative of superinfection and contamination as primary explanations for the intra-host variants. Superinfection and contamination can be parted on the basis of SNP frequency appearing as inter-host variants (Park, et al., 2015). Otherwise superinfection and contamination can be ruled out. In this latter case, detection of shared intra-host variations between subjects may further comprise assessing the frequencies of synonymous and nonsynonymous variants and comparing the frequency of synonymous and nonsynonymous variants to one another. A nonsynonymous mutation is a mutation that alters the amino acid of the protein, likely resulting in a biological change in the microbe that is subject to natural selection. Synonymous substitution does not alter an amino acid sequence. Equal frequency of synonymous and nonsynonymous variants is indicative of the intra-host variants evolving neutrally. If frequencies of synonymous and nonsynonymous variants are divergent, the intra-host variants are likely to be maintained by balancing selection. If frequencies of synonymous and nonsynonymous variants are low, this is indicative of recurrent mutation. If frequencies of synonymous and nonsynonymous variants are high, this is indicative of co-transmission (Park, et al., 2015).

Like Ebola virus, Lassa virus (LASV) can cause hemorrhagic fever with high case fatality rates. Andersen et al. generated a genomic catalog of almost 200 LASV sequences from clinical and rodent reservoir samples (Andersen, et al., Cell Volume 162, Issue 4, p 738-750, 13 Aug. 2015). Andersen et al. show that whereas the 2013-2015 EVD epidemic is fueled by human-to-human transmissions, LASV infections mainly result from reservoir-to-human infections. Andersen et al. elucidated the spread of LASV across West Africa and show that this migration was accompanied by changes in LASV genome abundance, fatality rates, codon adaptation, and translational efficiency. The method may further comprise phylogenetically comparing a first pathogen sequence to a second pathogen sequence, and determining whether there is a phylogenetic link between the first and second pathogen sequences. The second pathogen sequence may be an earlier reference sequence. If there is a phylogenetic link, the method may further comprise rooting the phylogeny of the first pathogen sequence to the second pathogen sequence. Thus, it is possible to construct the lineage of the first pathogen sequence. (Park, et al., 2015).

The method may further comprise determining whether the mutations are deleterious or adaptive. Deleterious mutations are indicative of transmission-impaired viruses and dead-end infections, thus normally only present in an individual subject. Mutations unique to one individual subject are those that occur on the external branches of the phylogenetic tree, whereas internal branch mutations are those present in multiple samples (i.e. in multiple subjects). Higher rate of nonsynonymous substitution is a characteristic of external branches of the phylogenetic tree (Park, et al., 2015).

In internal branches of the phylogenetic tree, selection has had more opportunity to filter out deleterious mutants. Internal branches, by definition, have produced multiple descendent lineages and are thus less likely to include mutations with fitness costs. Thus, lower rate of nonsynonymous substitution is indicative of internal branches (Park, et al., 2015).

Synonymous mutations, which likely have less impact on fitness, occurred at more comparable frequencies on internal and external branches (Park, et al., 2015).

By analyzing the sequenced target sequence, such as viral genomes, it is possible to discover the mechanisms responsible for the severity of the epidemic episode such as during the 2014 Ebola outbreak. For example, Gire et al. made a phylogenetic comparison of the genomes of the 2014 outbreak to all 20 genomes from earlier outbreaks suggests that the 2014 West African virus likely spread from central Africa within the past decade. Rooting the phylogeny using divergence from other ebolavirus genomes was problematic (6, 13). However, rooting the tree on the oldest outbreak revealed a strong correlation between sample date and root-to-tip distance, with a substitution rate of $8 \times 10^{-4}$ per site per year (13). This suggests that the lineages of the three most recent outbreaks all diverged from a common ancestor at roughly the same time, around 2004, which supports the hypothesis that each outbreak represents an independent zoonotic event from the same genetically diverse viral population in its natural reservoir. They also found out that the 2014 EBOV outbreak might be caused by a single transmission from the natural reservoir, followed by human-to-human transmission during the outbreak. Their results also suggested that the epidemic episode in Sierra Leon might stem from the introduction of two genetically distinct viruses from Guinea around the same time (Gire, et al., 2014).

It has been also possible to determine how the Lassa virus spread out from its origin point, in particular thanks to human-to-human transmission and even retrace the history of this spread 400 years back (Andersen, et al., *Cell* 162(4): 738-50, 2015).

In relation to the work needed during the 2013-2015 EBOV outbreak and the difficulties encountered by the medical staff at the site of the outbreak, and more generally, the method of the invention makes it possible to carry out sequencing using fewer selected probes such that sequencing can be accelerated, thus shortening the time needed from sample taking to results procurement. Further, kits and systems can be designed to be usable on the field so that diagnostics of a patient can be readily performed without need to send or ship samples to another part of the country or the world.

In any method described above, sequencing the target sequence or fragment thereof may be used any of the sequencing processes described above. Further, sequencing the target sequence or fragment thereof may be a near-real-time sequencing. Sequencing the target sequence or fragment thereof may be carried out according to previously described methods (Experimental Procedures: Matranga et al., 2014; and Gire, et al., 2014). Sequencing the target sequence or fragment thereof may comprise parallel sequencing of a plurality of target sequences. Sequencing the target sequence or fragment thereof may comprise Illumina sequencing.

Analyzing the target sequence or fragment thereof that hybridizes to one or more of the selected probes may be an identifying analysis, wherein hybridization of a selected probe to the target sequence or a fragment thereof indicates the presence of the target sequence within the sample.

Currently, primary diagnostics are based on the symptoms a patient has. However, various diseases may share identical symptoms so that diagnostics rely much on statistics. For example, malaria triggers flu-like symptoms: headache, fever, shivering, joint pain, vomiting, hemolytic anemia, jaundice, hemoglobin in the urine, retinal damage, and convulsions. These symptoms are also common for septicemia, gastroenteritis, and viral diseases. Amongst the latter, Ebola hemorrhagic fever has the following symptoms fever, sore throat, muscular pain, headaches, vomiting, diarrhea, rash, decreased function of the liver and kidneys, internal and external hemorrhage.

When a patient is presented to a medical unit, for example in tropical Africa, basic diagnostics will conclude to malaria because statistically, malaria is the most probable disease within that region of Africa. The patient is consequently treated for malaria although the patient might not actually have contracted the disease and the patient ends up not being correctly treated. This lack of correct treatment can be life-threatening especially when the disease the patient contracted presents a rapid evolution. It might be too late before the medical staff realizes that the treatment given to the patient is ineffective and comes to the correct diagnostics and administers the adequate treatment to the patient.

The method of the invention provides a solution to this situation. Indeed, because the number of guide RNAs can be dramatically reduced, this makes it possible to provide on a single chip selected probes divided into groups, each group being specific to one disease, such that a plurality of diseases, e.g. viral infection, can be diagnosed at the same time. Thanks to the invention, more than 3 diseases can be diagnosed on a single chip, preferably more than 4, 5, 6, 7, 8, 9, 10, 11, 12, 13, 14, 15, 16, 17, 18, 19, 20 diseases at the same time, preferably the diseases that most commonly occur within the population of a given geographical area. Since each group of selected probes is specific to one of the diagnosed diseases, a more accurate diagnosis can be performed, thus diminishing the risk of administering the wrong treatment to the patient.

In other cases, a disease such as a viral infection may occur without any symptoms, or had caused symptoms but they faded out before the patient is presented to the medical staff. In such cases, either the patient does not seek any medical assistance or the diagnostics is complicated due to the absence of symptoms on the day of the presentation.

The present invention may also be used in concert with other methods of diagnosing disease, identifying pathogens and optimizing treatment based upon detection of nucleic acids, such as mRNA in crude, non-purified samples.

The method of the invention also provides a powerful tool to address this situation. Indeed, since a plurality of groups of selected guide RNAs, each group being specific to one of the most common diseases that occur within the population of the given area, are comprised within a single diagnostic, the medical staff only need to contact a biological sample taken from the patient with the chip. Reading the chip reveals the diseases the patient has contracted.

In some cases, the patient is presented to the medical staff for diagnostics of particular symptoms. The method of the invention makes it possible not only to identify which disease causes these symptoms but at the same time determine whether the patient suffers from another disease he was not aware of.

This information might be of utmost importance when searching for the mechanisms of an outbreak. Indeed, groups of patients with identical viruses also show temporal patterns suggesting a subject-to-subject transmission links.

Example Microbes

The embodiment disclosed herein may be used to detect a number of different microbes. The term microbe as used herein includes bacteria, fungus, protozoa, parasites and viruses.

Bacteria

The following provides an example list of the types of microbes that might be detected using the embodiments disclosed herein. In certain example embodiments, the microbe is a bacterium. Examples of bacteria that can be detected in accordance with the disclosed methods include without limitation any one or more of (or any combination of) *Acinetobacter baumanii*, *Actinobacillus* sp., Actinomycetes, *Actinomyces* sp. (such as *Actinomyces israelii* and *Actinomyces naeslundii*), *Aeromonas* sp. (such as *Aeromonas hydrophila*, *Aeromonas veronii* biovar *sobria* (*Aeromonas sobria*), and *Aeromonas caviae*), *Anaplasma phagocytophilum*, *Anaplasma marginate Alcaligenes xylosoxidans*, *Acinetobacter baumanii*, *Actinobacillus actinomycetemcomitans*, *Bacillus* sp. (such as *Bacillus anthracis*, *Bacillus cereus*, *Bacillus subtilis*, *Bacillus thuringiensis*, and *Bacillus stearothermophilus*), *Bacteroides* sp. (such as *Bacteroides Bartonella* sp. (such as *Bartonella bacilliformis* and *Bartonella henselae*, *Bifidobacterium* sp., *Bordetella* sp. (such as *Bordetella pertussis*, *Bordetella parapertussis*, and *Bordetella bronchiseptica*), *Borrelia* sp. (such as *Borrelia recurrentis*, and *Borrelia burgdorferi*), *Brucella* sp. (such as *Brucella abortus*, *Brucella canis*, *Brucella melintensis* and *Brucella suis*), *Burkholderia* sp. (such as *Burkholderia pseudomallei* and *Burkholderia cepacia*), *Campylobacter* sp. (such as *Campylobacter jejuni*, *Campylobacter coli*, *Campylobacter lari* and *Campylobacter fetus*), *Capnocytophaga* sp., *Cardiobacterium hominis*, *Chlamydia trachomatis*, *Chlamydophila pneumoniae*, *Chlamydophila psittaci*, *Citrobacter* sp. *Coxiella burnetii*, *Corynebacterium* sp. (such as, *Corynebacterium diphtherias*, *Corynebacterium jeikeum* and *Corynebacterium*), *Clostridium* sp. (such as *Clostridium perfringens*, *Clostridium difficile*, *Clostridium botulinum* and *Clostridium tetani*), *Eikenella corrodens*, *Enterobacter* sp. (such as *Enterobacter aerogenes*, *Enterobacter agglomerans*, *Enterobacter cloacae* and *Escherichia coli*, including opportunistic *Escherichia coli*, such as enterotoxigenic *E. coli*, enteroinvasive *E. coli*, enteropathogenic *E. coli*, enterohemorrhagic *E. coli*, enteroaggregative *E. coli* and uropathogenic *E. coli*) *Enterococcus* sp. (such as *Enterococcus faecalis* and *Enterococcus faecium*) *Ehrlichia* sp. (such as *Ehrlichia chafeensia* and *Ehrlichia canis*), *Epidermophyton floccosum*, *Erysipelothrix rhusiopathiae*, *Eubacterium* sp., *Francisella tularensis*, *Fusobacterium nucleatum*, *Gardnerella vaginalis*, *Gemella morbillorum*, *Haemophilus* sp. (such as *Haemophilus influenzae*, *Haemophilus ducreyi*, *Haemophilus aegyptius*, *Haemophilus parainfluenzae*, *Haemophilus haemolyticus* and *Haemophilus parahaemolyticus*, *Helicobacter* sp. (such as *Helicobacter pylori*, *Helicobacter cinaedi* and *Helicobacter fennelliae*), *Kingella kingii*, *Klebsiella* sp. (such as *Klebsiella pneumoniae*, *Klebsiella granulomatis* and *Klebsiella oxytoca*), *Lactobacillus* sp., *Listeria monocytogenes*, *Leptospira interrogans*, *Legionella pneumophila*, *Leptospira interrogans*, *Peptostreptococcus* sp., *Mannheimia hemolytica*, *Microsporum canis*, *Moraxella catarrhalis*, *Morganella* sp., *Mobiluncus* sp., *Micrococcus* sp., *Mycobacterium* sp. (such as *Mycobacterium leprae*, *Mycobacterium tuberculosis*, *Mycobacterium paratuberculosis*, *Mycobacterium intracellulare*, *Mycobacterium avium*, *Mycobacterium bovis*, and *Mycobacterium marinum*), *Mycoplasm* sp. (such as *Mycoplasma pneumoniae*, *Mycoplasma hominis*, and *Mycoplasma genitalium*), *Nocardia* sp. (such as *Nocardia asteroides*, *Nocardia cyriacigeorgica* and *Nocardia brasiliensis*), *Neisseria* sp. (such as *Neisseria gonorrhoeae* and *Neisseria meningitidis*), *Pasteurella multocida*, *Pityrosporum orbiculare* (*Malassezia furfur*), *Plesiomonas shigelloides*. *Prevotella* sp., *Porphyromonas* sp., *Prevotella melaninogenica*,

*Proteus* sp. (such as *Proteus vulgaris* and *Proteus mirabilis*), *Providencia* sp. (such as *Providencia alcalifaciens, Providencia rettgeri* and *Providencia stuartii*), *Pseudomonas aeruginosa, Propionibacterium acnes, Rhodococcus equi, Rickettsia* sp. (such as *Rickettsia rickettsii, Rickettsia akari* and *Rickettsia prowazekii, Orientia tsutsugamushi* (formerly: *Rickettsia tsutsugamushi*) and *Rickettsia typhi*), *Rhodococcus* sp., *Serratia marcescens, Stenotrophomonas maltophilia, Salmonella* sp. (such as *Salmonella enterica, Salmonella typhi, Salmonella paratyphi, Salmonella enteritidis, Salmonella cholerasuis* and *Salmonella typhimurium*), *Serratia* sp. (such as *Serratia marcesans* and *Serratia liquifaciens*), *Shigella* sp. (such as *Shigella dysenteriae, Shigella flexneri, Shigella boydii* and *Shigella sonnei*), *Staphylococcus* sp. (such as *Staphylococcus aureus, Staphylococcus epidermidis, Staphylococcus hemolyticus, Staphylococcus saprophyticus*), *Streptococcus* sp. (such as *Streptococcus pneumoniae* (for example chloramphenicol-resistant serotype 4 *Streptococcus pneumoniae*, spectinomycin-resistant serotype 6B *Streptococcus pneumoniae*, streptomycin-resistant serotype 9V *Streptococcus pneumoniae*, erythromycin-resistant serotype 14 *Streptococcus pneumoniae*, optochin-resistant serotype 14 *Streptococcus pneumoniae*, rifampicin-resistant serotype 18C *Streptococcus pneumoniae*, tetracycline-resistant serotype 19F *Streptococcus pneumoniae*, penicillin-resistant serotype 19F *Streptococcus pneumoniae*, and trimethoprim-resistant serotype 23F *Streptococcus pneumoniae*, chloramphenicol-resistant serotype 4 *Streptococcus pneumoniae*, spectinomycin-resistant serotype 6B *Streptococcus pneumoniae*, streptomycin-resistant serotype 9V *Streptococcus pneumoniae*, optochin-resistant serotype 14 *Streptococcus pneumoniae*, rifampicin-resistant serotype 18C *Streptococcus pneumoniae*, penicillin-resistant serotype 19F *Streptococcus pneumoniae*, or trimethoprim-resistant serotype 23F *Streptococcus pneumoniae*), *Streptococcus agalactiae, Streptococcus mutans, Streptococcus pyogenes*, Group A streptococci, *Streptococcus pyogenes*, Group B streptococci, *Streptococcus agalactiae*, Group C streptococci, *Streptococcus anginosus, Streptococcus equismilis*, Group D streptococci, *Streptococcus bovis*, Group F streptococci, and *Streptococcus anginosus* Group G streptococci), *Spirillum minus, Streptobacillus moniliformi, Treponema* sp. (such as *Treponema carateum, Treponema peteune, Treponema pallidum* and *Treponema endemicum, Trichophyton rubrum, T mentagrophytes, Tropheryma whippelii, Ureaplasma urealyticum, Veillonella* sp., *Vibrio* sp. (such as *Vibrio cholerae, Vibrio parahemolyticus, Vibrio vulnificus, Vibrio parahaemolyticus, Vibrio vulnificus, Vibrio alginolyticus, Vibrio mimicus, Vibrio hollisae, Vibrio fluvialis, Vibrio metchnikovii, Vibrio damsela* and *Vibrio furnisii*), *Yersinia* sp. (such as *Yersinia enterocolitica, Yersinia pestis*, and *Yersinia pseudotuberculosis*) and *Xanthomonas maltophilia* among others.

Fungi

In certain example embodiments, the microbe is a fungus or a fungal species. Examples of fungi that can be detected in accordance with the disclosed methods include without limitation any one or more of (or any combination of), *Aspergillus, Blastomyces*, Candidiasis, Coccidiodomycosis, *Cryptococcus neoformans, Cryptococcus gatti*, sp. *Histoplasma* sp. (such as *Histoplasma capsulatum*), *Pneumocystis* sp. (such as *Pneumocystis jirovecii*), *Stachybotrys* (such as *Stachybotrys chartarum*), Mucroymcosis, *Sporothrix*, fungal eye infections ringworm, *Exserohilum, Cladosporium*.

In certain example embodiments, the fungus is a yeast. Examples of yeast that can be detected in accordance with disclosed methods include without limitation one or more of (or any combination of), *Aspergillus* species (such as *Aspergillus fumigatus, Aspergillus flavus* and *Aspergillus clavatus*), *Cryptococcus* sp. (such as *Cryptococcus neoformans, Cryptococcus gattii, Cryptococcus laurentii* and *Cryptococcus albidus*), a *Geotrichum* species, a *Saccharomyces* species, a *Hansenula* species, a *Candida* species (such as *Candida albicans*), a *Kluyveromyces* species, a *Debaryomyces* species, a *Pichia* species, or combination thereof. In certain example embodiments, the fungi is a mold. Example molds include, but are not limited to, a *Penicillium* species, a *Cladosporium* species, a *Byssochlamys* species, or a combination thereof.

Protozoa

In certain example embodiments, the microbe is a protozoa. Examples of protozoa that can be detected in accordance with the disclosed methods and devices include without limitation any one or more of (or any combination of), Euglenozoa, Heterolobosea, Diplomonadida, Amoebozoa, Blastocystic, and Apicomplexa. Example Euglenoza include, but are not limited to, *Trypanosoma cruzi* (Chagas disease), *T. brucei* gambiense, *T. brucei* rhodesiense, *Leishmania braziliensis, L. infantum, L. mexicana, L. major, L. tropica*, and *L. donovani*. Example Heterolobosea include, but are not limited to, *Naegleria fowleri*. Example Diplomonadids include, but are not limited to, *Giardia intestinalis* (*G. lamblia*, G. duodenalis). Example Amoebozoa include, but are not limited to, *Acanthamoeba castellanii, Balamuthia madrillaris, Entamoeba histolytica*. Example Blastocysts include, but are not limited to, Blastocystic *hominis*. Example Apicomplexa include, but are not limited to, *Babesia microti, Cryptosporidium parvum, Cyclospora cayetanensis, Plasmodium falciparum, P. vivax, P. ovale, P. malariae*, and *Toxoplasma gondii*.

Parasites

In certain example embodiments, the microbe is a parasite. Examples of parasites that can be detected in accordance with disclosed methods include without limitation one or more of (or any combination of), an *Onchocerca* species and a *Plasmodium* species.

Viruses

In certain example embodiments, the systems, devices, and methods, disclosed herein are directed to detecting viruses in a sample. The embodiments disclosed herein may be used to detect viral infection (e.g. of a subject or plant), or determination of a viral strain, including viral strains that differ by a single nucleotide polymorphism. The virus may be a DNA virus, a RNA virus, or a retrovirus. Non-limiting example of viruses useful with the present invention include, but are not limited to Ebola, measles, SARS, Chikungunya, hepatitis, Marburg, yellow fever, MERS, Dengue, Lassa, influenza, rhabdovirus or HIV. A hepatitis virus may include hepatitis A, hepatitis B, or hepatitis C. An influenza virus may include, for example, influenza A or influenza B. An HIV may include HIV 1 or HIV 2. In certain example embodiments, the viral sequence may be a human respiratory syncytial virus, Sudan ebola virus, Bundibugyo virus, Tai Forest ebola virus, Reston ebola virus, Achimota, *Aedes* flavivirus, Aguacate virus, Akabane virus, Alethinophid reptarenavirus, Allpahuayo mammarenavirus, Amapari mmarenavirus, Andes virus, Apoi virus, Aravan virus, Aroa virus, Arumwot virus, Atlantic salmon paramyxovirus, Australian bat lyssavirus, Avian bornavirus, Avian metapneumovirus, Avian paramyxoviruses, penguin or Falkland Islandsvirus, BK polyomavirus, Bagaza virus, Banna virus, Bat herpesvirus, Bat sapovirus, Bear Canon mammarenavirus, Beilong virus, Betacoronavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwera virus, Caliciviridae virus. California encephalitis virus, Candiru virus, Canine distemper virus, Canine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, *Culex* flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flaviviridae virus, Flexal mammarenavirus, GB virus C, Gairo virus, Gemycircularvirus, Goose paramyxovirus SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human genital-associated circular DNA virus-1, Human herpesvirus 1-8, Human immunodeficiency virus 1/2, Human mastadenovirus A-G, Human papillomavirus, Human parainfluenza virus 1-4, Human paraechovirus, Human picornavirus, Human smacovirus, Ikoma lyssavirus, Ilheus virus, Influenza A-C, Ippy mammarenavirus, Irkut virus, J-virus, JC polyomavirus, Japanese encephalitis virus, Junin mammarenavirus, KI polyomavirus, Kadipiro virus, Kamiti River virus, Kedougou virus, Khuj and virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2\0.225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Moijang virus, Mokolo virus, Monkeypox virus, *Montana myotis* leukoenchalitis virus, Mopeia *lassa* virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichande mammarenavirus, Picornaviridae virus, Pirital mammarenavirus, Piscihepevirus A, Porcine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Togaviridae virus, Torque teno *canis* virus, Torque teno douroucouli virus, Torque teno *felis* virus, Torque teno midi virus, Torque teno sus virus, Torque teno tamarin virus, Torque teno virus, Torque teno *zalophus* virus, Tuhoko virus, Tula virus, *Tupaia* paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence. Examples of RNA viruses that may be detected include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain example embodiments, the virus may be a plant virus selected from the group comprising Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), Citrus tristeza virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis* mosaic virus (ArMV), or *Rupestris* stem pitting-associated virus (RSPaV). In a preferred embodiment, the target RNA molecule is part of said pathogen or transcribed from a DNA molecule of said pathogen. For example, the target sequence may be comprised in the genome of an RNA virus. It is further preferred that CRISPR effector protein hydrolyzes said target RNA molecule of said pathogen in said plant if said pathogen infects or has infected said plant. It is thus preferred that the CRISPR system is capable of cleaving the target RNA molecule from the plant pathogen both when the CRISPR system (or parts needed for its completion) is applied therapeutically, i.e. after infection has occurred or prophylactically, i.e. before infection has occurred.

In certain example embodiments, the virus may be a retrovirus. Example retroviruses that may be detected using the embodiments disclosed herein include one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In certain example embodiments, the virus is a DNA virus. Example DNA viruses that may be detected using the embodiments disclosed herein include one or more of (or any combination of) viruses from the Family Myoviridae, Podoviridae, Siphoviridae, Alloherpesviridae, Herpesviridae (including human herpes virus, and Varicella Zorter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, among others. In some embodiments, a method of diagnosing a species-specific bacterial infection in a subject suspected of having a bacterial infection is described as obtaining a sample comprising bacterial ribosomal ribonucleic acid from the subject; contacting the sample with one or more of the probes described, and detecting hybridization between the bacterial ribosomal ribonucleic acid sequence present in the sample and the probe, wherein the detection of hybridization indicates that the subject is infected with *Escherichia coli, Klebsiella pneumoniae, Pseudomonas aeruginosa, Staphylococcus aureus, Acinetobacter baumannii, Candida albicans, Enterobacter cloacae, Enterococcus faecalis, Enterococcus faecium, Proteus mirabilis, Staphylococcus agalactiae,* or *Staphylococcus maltophilia* or a combination thereof.

Coronavirus

Systems and methods of the presently disclosed invention are designed to detect coronavirus, in an aspect, the target sequence is the 2019-nCoV, also referred to herein as SARS-CoV-2, which causes COVID-19. The coronavirus is a positive-sense single stranded RNA family of viruses, infecting a variety of animals and humans. SARS-CoV is one type of coronavirus infection, as well as MERS-CoV. Detection of one or more coronaviruses are envisioned, including the SARS-CoV-2 detected in Wuhan City. Sequences of the sARS-CoV-2 are available at GISAID accession no. EPI_ISL_402124 and EPI_ISL_402127-402130, and described in DOI: 10.1101/2020.01.22.914952. Further deposits of the SARS-CoV2 are deposited in the GISAID platform include EP_ISL_402119-402121 and EP_ISL_402123-402124; see also GenBank Accession No. MN908947.3. In an aspect, one may use known SARS and SARS-related coronaviruses or other viruses from one or more hosts to generate a non-redundant alignment. Related viruses can be found, for example in bats.

In certain embodiments, the systems are designed to comprise at least one highly active guide polynucleotide which is designed according to the methods disclosed herein. In a preferred embodiment, the guide polynucleotide binds to at least one target sequence that is a unique coronavirus genomic sequence, thereby identifying the presence of coronavirus to the exclusion of other viruses. The systems and methods can be designed to detect a plurality of respiratory infections or viral infections, including coronavirus.

In an aspect the at least one guide polynucleotide binds to a coronavirus sequence encoding a polypeptide that is immunostimulatory to a host immune system. Immunostimulatory polypeptides have the ability to enhance, stimulate, or increase response of the immune system, typically by inducing the activation or activity of a components of the immune system (e.g. an immune cell). In embodiments, the immunostimulatory polypeptide contributes to immune-mediated disease in the host. In an aspect, the host is a mammal, for example, a human, a bat, or a pangolin, that may be infected by a coronavirus. Cyranoski, D. Did pangolins spread the China coronavirus to people? Nature, 7 Feb. 2020. In certain embodiments, the guide polynucleotide can be designed to detect SARS-CoV-2 or a variant thereof in meat, live animals and humans so that testing can be performed, for example at markets and other public places where sources of contamination can arise.

Gene targets may comprise ORF1ab, N protein, RNA-dependent RNA polymerase (RdRP), E protein, ORF1b-nsp14, Spike glycoprotein (S), or pancorona targets. Molecular assays have been under development and can be used as a starting point to develop guide molecules for the methods and systems described herein. See, "Diagnostic detection of 2019-nCoV by real-time RT-PCR" Charité, Berlin Germany (17 Jan. 2020)' Detection of 2019 novel coronavirus (2019-nCoV) in suspected human cases by RT-PCR—Hong Kong University (23 Jan. 2020); PCR and sequencing protocol for 2019-nCoV—Department of Medical Sciences, Ministry of Public Health, Thailand (updated 28 Jan. 2020); PCR and sequencing protocols for 2019-nCoV-National Institute of Infectious Diseases Japan (24 Jan. 2020); US CDC panel primer and probes—U.S. CDC, USAV—U.S. CDC, USA (28 Jan. 2020); China CDC Primers and probes for detection 2019-nCoV (24 Jan. 2020), incorporated in their entirety by reference. Further, the guide molecule design may exploit differences or similarities with SARS-CoV. Researchers have recently identified similarities and differences between 2019-nCoV and SARS-CoV. "Coronavirus Genome Annotation Reveals Amino Acid Differences with Other SARS Viruses," genomeweb, Feb. 10, 2020. For example, guide molecules based on the 8a protein, which was present in SARS-CoV but absent in SARS-CoV-2, can be utilized to differentiate between the viruses. Similarly, the 8b and 3b proteins have different lengths in SARS-CoV and sARS-CoV-2 and can be utilized to design guide molecules to detect non-overlapping proteins of nucleotides encoding in the two viruses. Wu et al., Genome Composition and Divergence of the Novel Coronavirus (2019-nCoV) Originating in China, Cell Host & Microbe (2020), DOI: 10.1016/j.chom.2020.02.001, incorporated herein by reference, including all supplemental information, in particular Table 51.

The systems and methods of detection can be used to identify single nucleotide variants, detection based on rRNA sequences, screening for drug resistance, monitoring microbe outbreaks, genetic perturbations, and screening of environmental samples, as described in PCT/US2018/054472 filed Oct. 22, 2018 at [0183]-[0327], incorporated herein by reference.

In certain example embodiments, the systems, devices, and methods disclosed herein may be used for biomarker detection. For example, the systems, devices and method disclosed herein may be used for SNP detection and/or genotyping. The systems, devices and methods disclosed herein may be also used for the detection of any disease state or disorder characterized by aberrant gene expression. Aberrant gene expression includes aberration in the gene expressed, location of expression and level of expression. Multiple transcripts or protein markers related to cardiovascular, immune disorders, and cancer among other diseases may be detected. In certain example embodiments, the embodiments disclosed herein may be used for cell free DNA detection of diseases that involve lysis. In certain example embodiments, the embodiments could be utilized for faster and more portable detection for pre-natal testing of cell-free DNA. The embodiments disclosed herein may be used for screening panels of different SNPs associated with, among others, different coronaviruses, evolving SARS-CoV2, and other related respiratory viral infections. As described herein elsewhere, closely related genotypes/alleles or biomarkers (e.g. having only a single nucleotide difference in a given target sequence) may be distinguished by introduction of a synthetic mismatch in the gRNA.

In an aspect, the invention relates to a method for detecting target nucleic acids in samples, comprising:

distributing a sample or set of samples into one or more individual discrete volumes, the individual discrete volumes comprising a CRISPR system according to the invention as described herein;

incubating the sample or set of samples under conditions sufficient to allow binding of the one or more guide RNAs to one or more target molecules;

activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample.

The sensitivity of the assays described herein are well suited for detection of target nucleic acids in a wide variety of biological sample types, including sample types in which the target nucleic acid is dilute or for which sample material is limited. Methods for field deployable and rapid diagnostic assays can be optimized for the type of sample material utilized. See, e.g. Myhrvold et al., 2018. Biomarker screening may be carried out on a number of sample types including, but not limited to, saliva, urine, blood, feces, sputum, and cerebrospinal fluid. The embodiments disclosed herein may also be used to detect up- and/or down-regulation of genes. For example, a sample may be serially diluted such that only over-expressed genes remain above the detection limit threshold of the assay.

In certain embodiments, the present invention provides steps of obtaining a sample of biological fluid (e.g., urine, blood plasma or serum, sputum, cerebral spinal fluid), and extracting the DNA or RNA. The mutant nucleotide sequence to be detected, may be a fraction of a larger molecule or can be present initially as a discrete molecule.

In certain embodiments, DNA is isolated from plasma/serum of a cancer patient. For comparison, DNA samples isolated from neoplastic tissue and a second sample may be isolated from non-neoplastic tissue from the same patient (control), for example, lymphocytes. The non-neoplastic tissue can be of the same type as the neoplastic tissue or from a different organ source. In certain embodiments, blood samples are collected and plasma immediately separated from the blood cells by centrifugation. Serum may be filtered and stored frozen until DNA/RNA extraction.

In an aspect, sample preparation can comprise methods as disclosed herein to circumvent other RNA extraction methods and can be used with standard amplification techniques such as RT-PCR as well as the CRISPR-Cas detection methods disclosed herein. In an aspect, the method may comprise a one-step extraction-free RNA preparation method that can be used with samples tested for coronavirus, which may be, in an aspect, a RT-qPCR testing method, a lateral flow detection method or other CRISPR-Cas detection method disclosed herein. Advantageously, the RNA extraction method can be utilized directly with other testing protocols. In an aspect, the method comprises use of a nasopharyngeal swab, nasal saline lavage, or other nasal sample with extraction-free polynucleotide isolation solution, for example, Quick Extract™ DNA Extraction Solution (QE09050), Lucigen. In an aspect, the sample is diluted 2:1, 1:1 or 1:2 sample: extraction-free polynucleotide isolation solution. The sample:extraction mix is incubated at about 90° C. to about 98° C., preferably about 95° C. The incubation period can be about 2, 3, 4, 5, 6, 7, 8, 9, or 10 minutes, preferably about 4 to 6 minutes, or about 5 minutes. Incubation time and temperature may vary depending on sample size and quality. Current CDC Real-Time RT-PCR Diagnostic Panel are as described at fda.gov/media/134922/download, "CDC 2019-Novel Coronavirus (2019-nCoV) Real-Time RT-PCR Diagnostic Panel." In certain embodiments, the extraction-free polynucleotide isolation solution can remain with the sample subsequent to incubation and be utilized in the next steps for detection methods. In an aspect, the detection method is an RT-qPCR reaction and the extraction solution is kept at a concentration of less than 10%, 9%, 8%, 7%, 6%, 5%, 4%, 3% of the reaction mixture, where the reaction mixture comprises the detection reaction reagents, sample and extraction solution.

In certain embodiments, a bead is utilized with particular embodiments of the invention and may be included with the extraction solution. The bead may be used to capture, concentrate or otherwise enrich for particular material. The bead may be magnetic, and may be provided to capture nucleic acid material. In another aspect, the bead is a silica bead. Beads may be utilized in an extraction step of the methods disclosed herein. Beads can be optionally used with the methods described herein, including with the one-pot methods that allow for concentration of viral nucleic acids from large volume samples, such as saliva or swab samples to allow for a single one-pot reaction method. Concentration of desired target molecules can be increased by about 10-fold, 50-fold, 100-fold, 200-fold, 500-fold, 800-fold, 1000-fold, 1500-fold, 2000-fold, 2500-fold, 3000-fold, or more.

Magnetic beads in a PEG and salt solution are preferred in an aspect, and in embodiments bind to viral RNA and/or DNA which allows for concentration and lysis concurrently. Silica beads can be used in another aspect. Capture moieties such as oligonucleotide functionalized beads are envisioned for use. The beads may be using with the extraction reagents, allowed to incubate with a sample and the lysis/extraction-free polynucleotide isolation solution r, thereby concrrating target molecules on the beads. When used with a cartridge device detailed elsewhere herein, a magnet can be activated and the beads collected, with optional flushing of the extraction-free polynucleotide isolation solution and one or more washes performed. Advantageously, the beads can be used in the one-pot methods and systems without additional washings of the beads, allowing for a more efficient process without increased risks of contamination in multi-step processes. Beads can be utilized with the isothermal amplifications detailed herein, and the beads can flow into an amplification chamber of the cartridge or be maintained in the pot for the amplification step. Upon heating, nucleic acid can be released off the beads.

In certain example embodiments, target nucleic acids are detected directly from a crude or unprocessed sample, such as blood, serum, saliva, cebrospinal fluid, sputum, or urine. In certain example embodiments, the target nucleic acid is cell free DNA.

EXAMPLES

Example 1—Coronavirus Assay Development

Systems and methods can be designed for the detection and diagnosis of viruses and viral infections, including Covid-2019, optionally with acute respiratory infections using the disclosure detailed herein. The systems can comprise two or more CRISPR Cas systems to multiplex, for example, detection of Covid-2019, and other coronaviruses such as SARS-CoV and MERS-CoV. Sequences of the 2019-nCoV are available at GISAID accession no. EPI_ISL_402124 and EPI_ISL_402127-402130, and described in DOI: 10.1101/2020.01.22.914952. Further deposits of the SARS-CoV-2 coronavirus deposited in the GISAID platform include EP_ISL_402119-402121 and EP_ISL_402123-402124; see also GenBank Accession No. MN908947, and guide design can be predicated on genome sequences disclosed therein and in Tian et al, "Potent binding of 2019 novel coronavirus spike protein by a SARS coronavirus-specific human monoclonal antibody"; doi: 10.1101/2020.01.28.923011, incorporated by reference, which details human monoclonal antibody, CR3022 binding of the 2019-nCoV RBD (KD of 6.3 nM). Guide design can target unique viral genomic regions of the 2019-nCoV or conserved genomic regions across one or more viruses of the coronavirus family. Gene targets may comprise ORF1ab, N protein, RNA-dependent RNA polymerase (RdRP), E protein, ORF1b-nsp14, Spike glycoprotein (S), or pancorona targets, including guide molecules based on the 8a protein, which was present in SARS-CoV but absent in 2019-nCoV, utilized to differentiate between the viruses. Similarly, the 8b and 3b proteins have different lengths in SARS-CoV and 2019-nCoV and can be utilized to design guide molecules to detect non-overlapping proteins of nucleotides encoding in the two viruses. Wu et al., Genome Composition and Divergence of the Novel Coronavirus (2019-nCoV) Originating in China, Cell Host & Microbe (2020), DOI: 10.1016/j.chom.2020.02.001, incorporated herein by reference, including all supplemental information, in particular Table 51. Molecular assays have been under development and can be used as a starting point to develop guide molecules for the methods and systems described herein.

Detection of respiratory viruses such as coronavirus may include a thermostable CRISPR-Cas protein as described herein, which may be a Cas13a ortholog. As described elsewhere herein, one or more Cas13a orthologs may be utilized in a multiplex design, including the thermostable Cas13a orthologs described herein, where such thermostability confers further rapidity to the diagnostic and detections platforms and methods disclosed herein.

Coronavirus detection can comprise two or more detection systems utilizing RNA targeting Cas effector proteins; DNA targeting Cas effector proteins, or a combination thereof. The RNA-targeting effector proteins may be a Cas13 protein, such as Cas13a, Cas13b, or Cas13c, including one of the thermostable Cas13a proteins described herein. The DNA-targeting effector protein may be a Type V protein, e.g. Cas12 protein such as Cpf1 and C2c1. Multiplexing systems can be designed such that different Cas proteins with different sequence specificities or other motif cutting preferences can be used, including, in certain embodiments, at least one Cas13a thermostable protein described herein. See International Publication WO 2019/126577. Type VI and Type V Cas proteins are known to possess different cutting motif preferences. See Gootenberg et al. "Multiplexed and portable nucleic acid detection platform with Cas13b, Cas12a, and Csm6." Science. Apr. 27, 2018, 360:439-444; International Publication WO 2019/051318. Thus, embodiments disclosed herein may further comprise multiplex embodiments comprising two or more Type VI Cas proteins with different cutting preferences, or one or more Type VI Cas proteins and one or more Type V case proteins.

In certain example embodiments, the coronavirus assay comprises a Type VI Cas protein disclosed herein and guide molecule comprising a guide sequence configured to direct binding of the CRISPR-Cas complex to a target molecule and a labeled detection molecule ("RNA-based masking construct"). A multiplex embodiment can be designed to track one or more variants of coronavirus or one or more variants of coronavirus, including the 2019-nCoV, in combination with other viruses, for example, Human respiratory syncytial virus, Middle East respiratory syndrome (MERS) coronavirus, Severe acute respiratory syndrome-related (SARS) coronavirus, and influenza.

In certain embodiments, the detection assay can be provided on a lateral flow device, as described herein. The lateral flow device may comprise a flexible substrate, such as a paper substrate or a flexible polymer-based substrate, which can include freeze-dried reagents for detection assays with a visual readout of the assay results. See, WO 2019/071051 at [0145]-[0151] and Example 2, specifically incorporated herein by reference. Accordingly, the assay can be adapted for field diagnostics, including use of visual readout on a lateral flow device, rapid, sensitive detection and can be deployed for early and direct detection.

Example 2—Lateral Flow Cornavirus Detection

Detection of coronavirus targets was performed using RPA amplification for 25 minutes followed by a 30 minute Cas 13 reaction using the following primers and guides:

TABLE 4

| | |
|---|---|
| S gene RPA Forward | GAAATTAATACGACTCACTATAGGGAGGTTTCAAACTT TACTTGCTTTACATAGA (SEQ ID NO: 61977) |
| S gene RPA Reverse | TCCTAGGTTGAAGATAACCCACATAATAAG (SEQ ID NO: 61978) |
| S gene LwCas13a crRNA | GAUUUAGACUACCCCAAAAACGAAGGGGACUAAAACGC AGCACCAGCUGUCCAACCUGAAGAAG (SEQ ID NO: 61979) |
| Orf1ab RPA Forward | GAAATTAATACGACTCACTATAGGGCGAAGTTGTAGGA GACATTATACTTAAACC (SEQ ID NO: 61980) |
| Orf1ab RPA Reverse | TAGTAAGACTAGAATTGTCTACATAAGCAGC (SEQ ID NO: 61981) |
| Orf1ab LwCas13a crRNA | GAUUUAGACUACCCCAAAAACGAAGGGGACUAAAACCC AACCUCUUCUGUAAUUUUUAAACUAU (SEQ ID NO: 61982) |

Figures 2A, 2B:
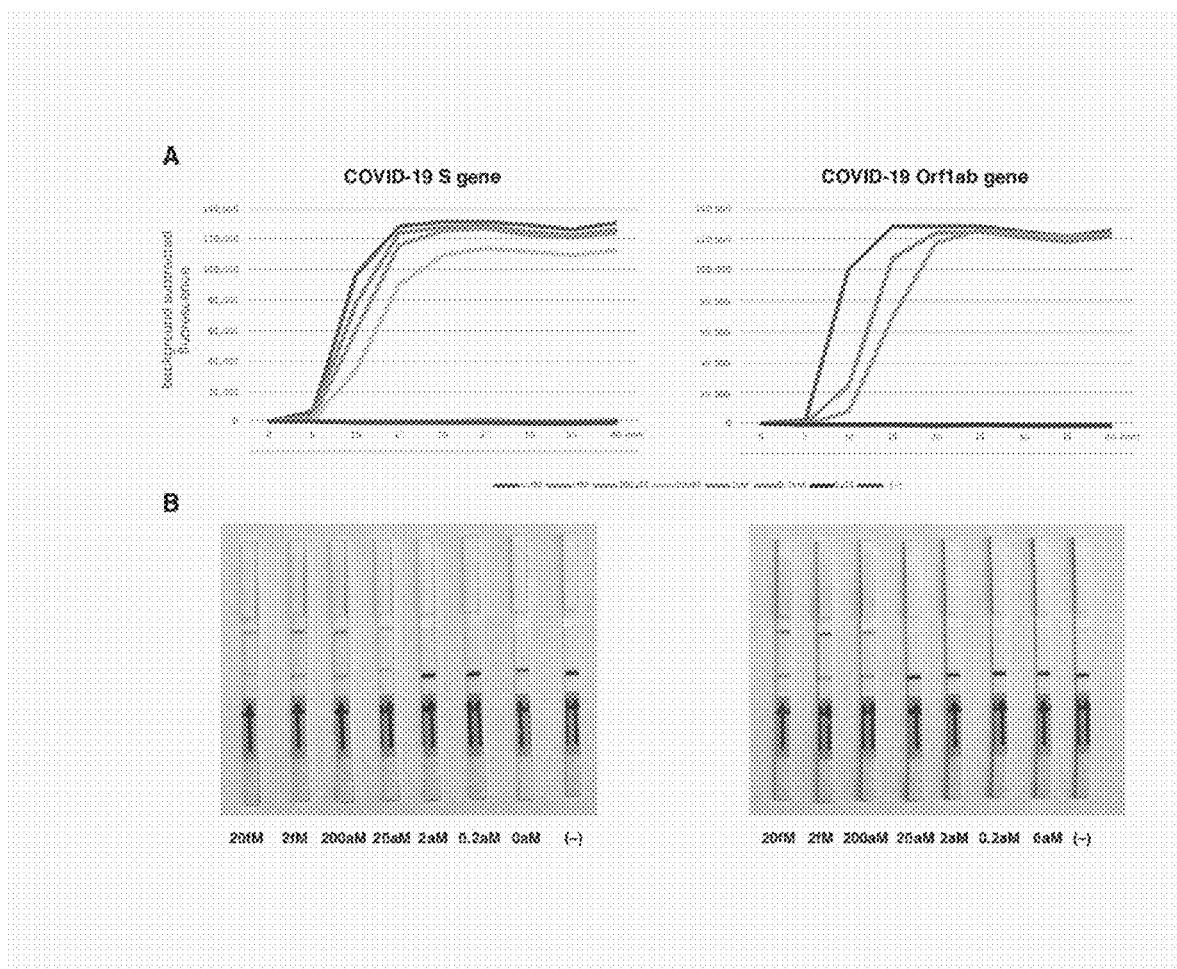
FIG. 2A-2B FIG. 2A—Detection of synthetic COVID-19 sequences using a two-step SHERLOCK reaction (25 min RPA). Readout using fluorescence RNaseAlert reporter.
Figures 3A, 3B:
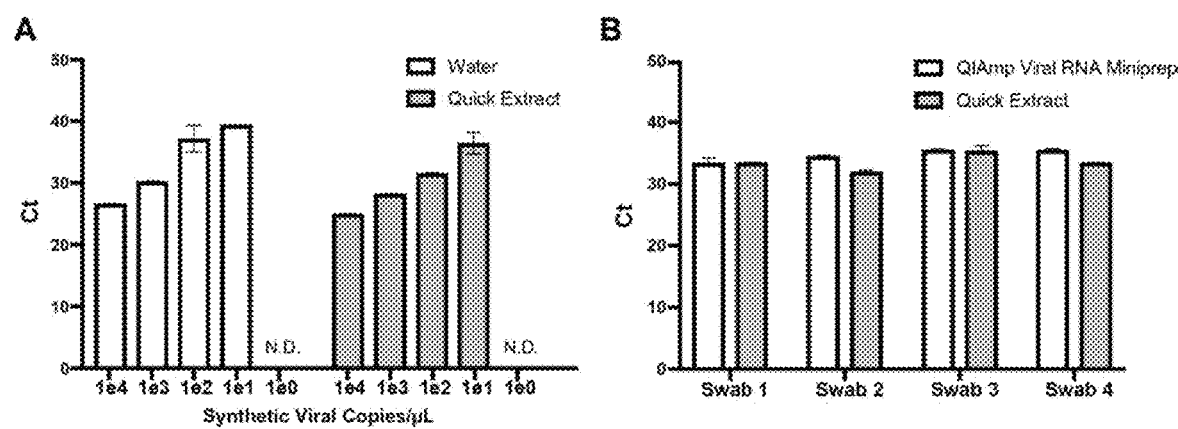
FIG. 3A-3B.

Results are provided in FIG. 1, with S gene detection shown on the left and Orflab on the right, and FIG. 2B. The assay has been further validated by fluorescence in FIG. 2A.

Example 3. RNA Preparation for COVID-19 Detection

One of the major bottlenecks for COVID-19 diagnosis is the limited availability of RNA extraction kits for preparing virus RNA from patient samples and the low-throughput nature of the extraction procedure. Here, Applicants describe a one-step extraction-free RNA preparation method that can be carried out in 5 minutes and the reaction can be used directly with the CDC COVID-19 RT-qPCR testing protocol, thus increasing throughput, and alleviating supply chain issues.

Materials and Reagents

Quick Extract™ DNA Extraction Solution (QE09050), Lucigen Protocol

Step 1. Dilute nasopharyngeal swab stored in Viral Transport Medium or Human Specimen Control (HSC) 1:1 with Quick Extract™ DNA Extraction Solution. For example, in a fresh PCR tube, mix 20 ul of swab sample with 20 ul of Quick Extract.

Step 2. Incubate swab-Quick Extract mix at 95° C. for 5 minutes. Allow reaction to cool on ice before proceeding.

Step 3. Use reaction from step (2) for qRT-PCR. Make sure the amount from step (2) does not exceed 10% of the total qRT-PCR reaction volume. For example, if a RT-qPCR reaction has a total volume of 50 ul, do not use more than 5 ul of the reaction mix from step (2).

Assay Development and Preliminary Validation

Applicants evaluated a number of buffer compositions to identify one that achieved efficient lysis of enveloped virus while preserving the activity of the CDC recommended RT-qPCR reaction (TaqPath™ 1-Step RT-qPCR Master Mix). Of all of the buffers tested, Quick Extract™ DNA Extraction Solution provided satisfactory results.

To confirm that the presence of QE does not interfere with RT-qPCR activity, comparison of RT-qPCR reactions using synthetic SARS-CoV-2 gene fragment (Twist Synthetic SARS-CoV-2 RNA Control 1, SKU:102019) dissolved in either ddH$_2$O or in a 50:50 ddH$_2$O:Quick Extract mixture was performed. Each RT-qPCR reaction was set up with a total volume of 10 ul (1 ul of RNA sample, 0.5 ul of CDC probe N1, 2.5 ul of TaqPath RT-qPCR master mix, and 6 ul of ddH$_2$O). From these reactions, Applicants found that Quick Extract at a final concentration of 5% did not negatively affect the RT-qPCR reaction (FIG. 1A).

Preliminary validation of the Quick Extract RNA preparation procedure was conducted on coronavirus positive nasopharyngeal swabs where it was found that RNA samples prepared using Quick Extract supported similarly sensitive detection of coronavirus as QIAmp Viral RNA Miniprep for all 4 swab samples (FIG. 1B). To simulate low viral load, coronavirus positive swabs were diluted 1:10 in pooled nasopharyngeal swabs from 5 unique, healthy donors (Lee Biosolutions, SKU:991-31-NC-5) prior to purification or Quick Extract treatment. For the QIAmp Viral RNA Miniprep conditions, 100 ul of diluted swab sample was used for extraction and was eluted using 100 ul of ddH$_2$O. 1 ul of the elution was used in a 10 ul RT-qPCR reaction. For the Quick Extract conditions, 1 ul of Quick Extract preparation was used for each 10 ul RT-qPCR reaction.

Example 4. Development of a One Pot RT-LAMP Cas12b SHERLOCK Reaction

Applicants developed a research protocol for a SHERLOCK-based COVID-19 coronavirus detection. The basic protocol is outlined in FIG. 16. A nasopharyngeal swab or saliva sample is collected from a patient. The sample is added to a tube containing SHERLOCK reagents. The tube is heated for 60 minutes at 60° C. A SHERLOCK detection lateral flow strip is then dipped into the reaction in the tube and the strip is then analyzed for results. Table 5 shows final reaction parameters for reagents in the tube.

Figure 16:
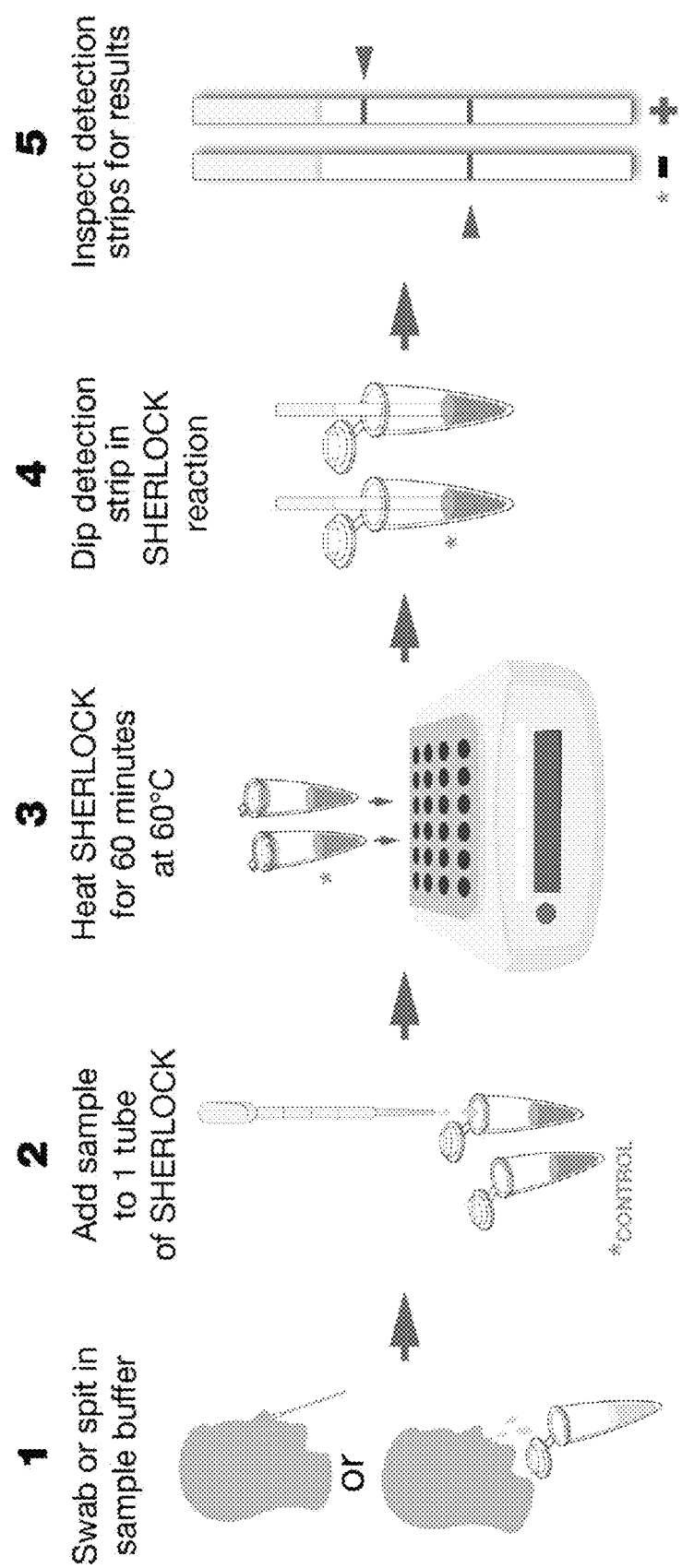
FIG. 16—A schematic for the SHERLOCK diagnostic assay.

The lateral flow strip is inserted directly into this reaction as shown in FIG. 16.

TABLE 5

Final Reaction Parameters

| | Initial Concentration | Final Concentration | Amount (µL) |
|---|---|---|---|
| Isothermal amplification buffer | 10X | 1X | 5 |
| dNTPs | 10 mM | 1.4 mM | 7 |
| MgSO4 | 100 mM | 8 mM | 4 |
| Bst 2.0 | 8000 units/mL | 320 units/mL | 2 |
| WS RTx | 15,000 units/mL | 300 units/mL | 1 |
| Aap Cas12b | 2 mg/mL or 15.4 µM | 500 nM | 1.625 |
| Aac Cas12b crRNA | 360 ng/µL or 10 µM | 500 nM | 2.5 |
| WCV332 | 100 µM | 125 nM | 0.0625 |
| Taurine | 500 mM | 50 nM | 5 |
| LAMP primer pool | 10X | 1X | 5 |
| Sample | | | 5 |
| H2O | | | 11.8125 |
| Total | | | 50 |

Figure 17:
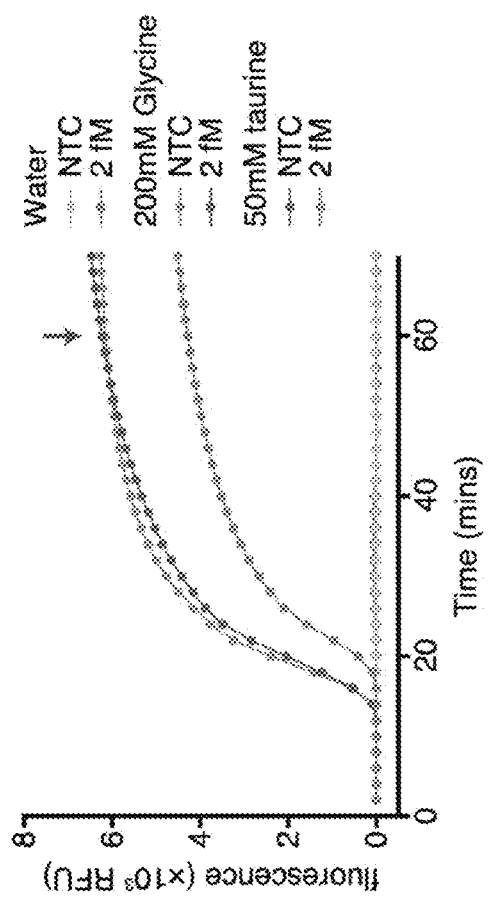
FIG. 17—Shows the different additives that may be used to optimize assay sensitivity and/or kinetics.
Figure 17:
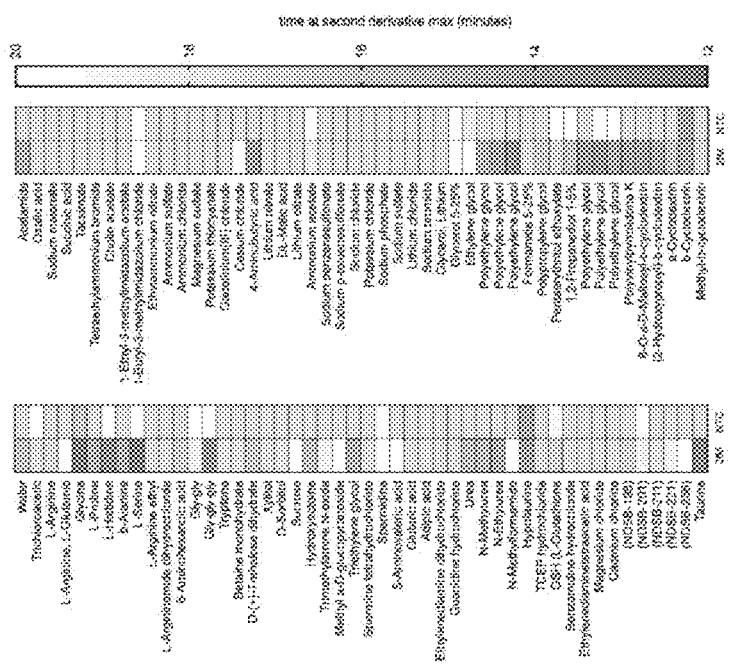
Figure 18:
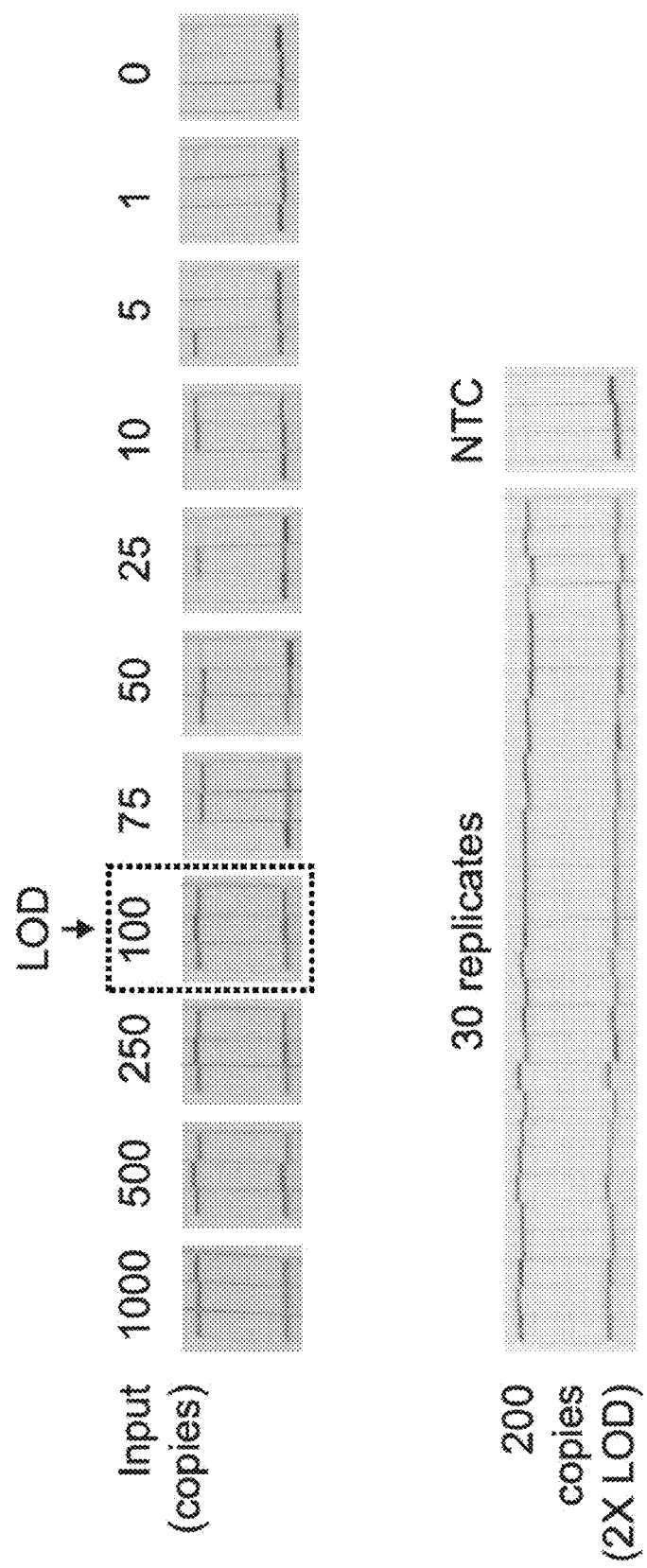
FIG. 18—Shows that the limit of detection is at 100 molecules per reaction.

The different reaction additives that were used to optimize the assay is shown in FIG. 17. FIG. 18 shows results obtained for assessing limit of detection by lateral flow assay at 60° C. for 60 minutes. The limit of detection was 100 molecules per reaction.

Figure 19:
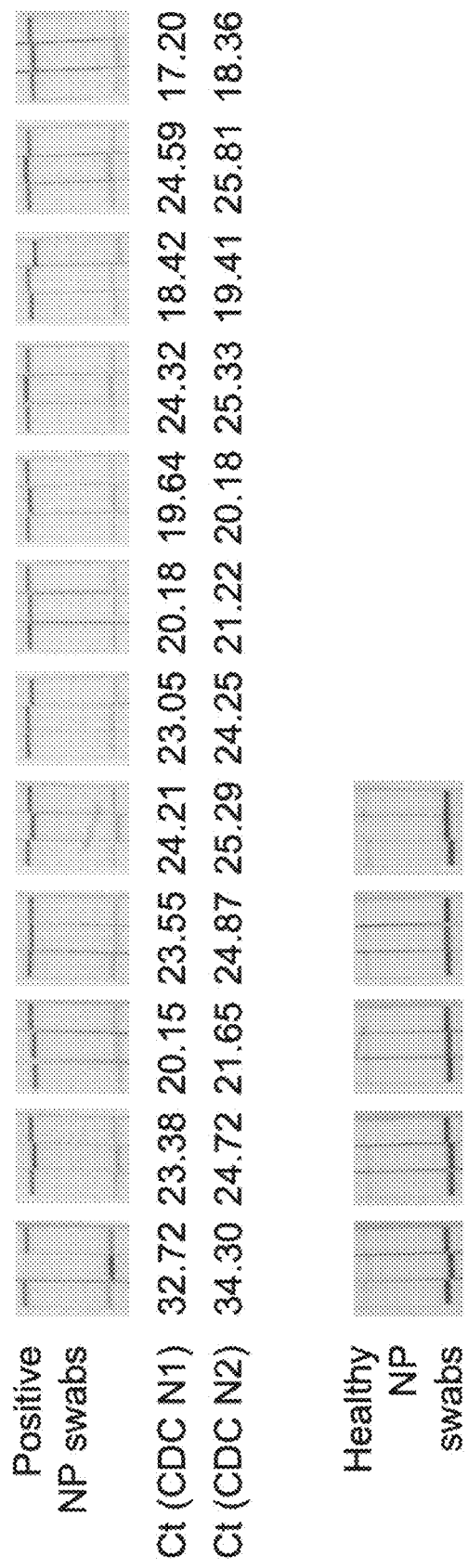
FIG. 19—Shows a comparison of positive SHERLOCK tests to results obtained from qRT-PCR assays.
Figure 20:
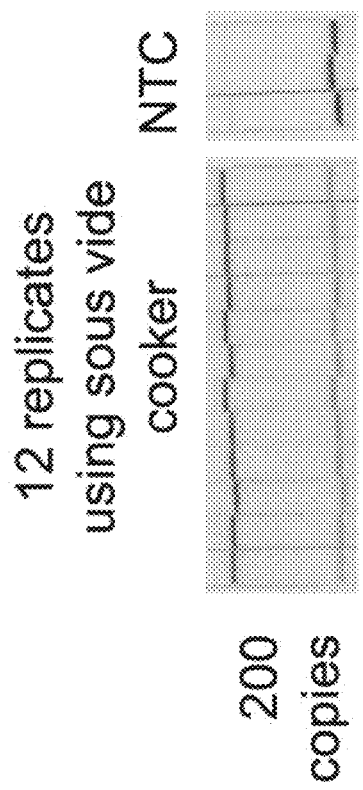
FIG. 20—Illustrates a low cost assay setup using a sous vide cooker.
Figure 20:
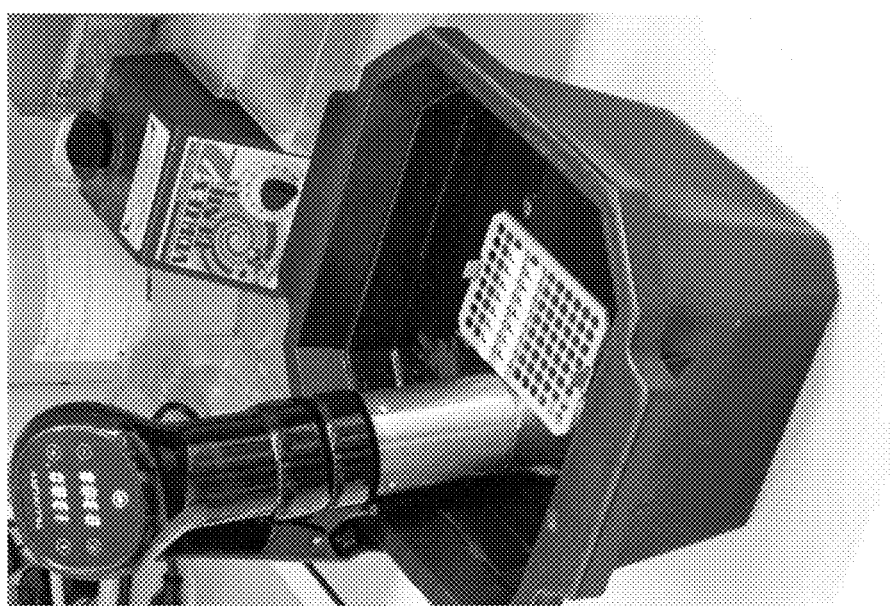

Results obtained by SHERLOCK assay were compared to results obtained by qRT-PCR, as shown in FIG. 19. The assay can also be performed using a sous vide cooker, as illustrated in FIG. 20, 41.

Example 5. Exemplary Use of Device in Diagnostic Methods

Figure 21:
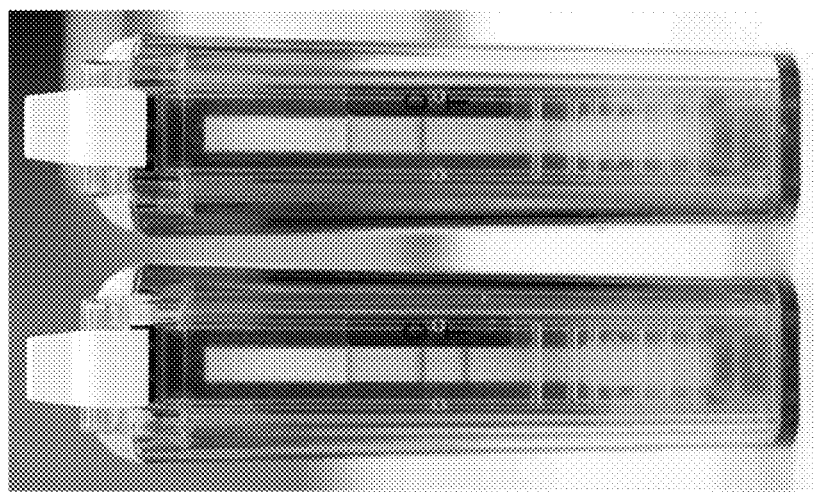
FIG. 21—Shows a point-of-care device that is compatible with SHERLOCK.
Figure 21:
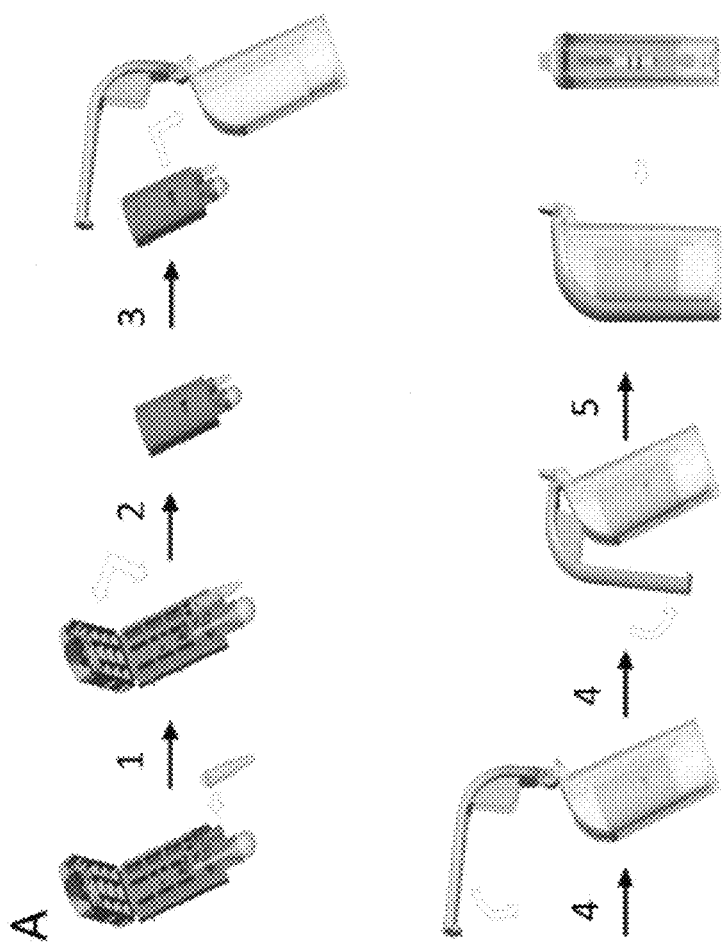
Figure 22:
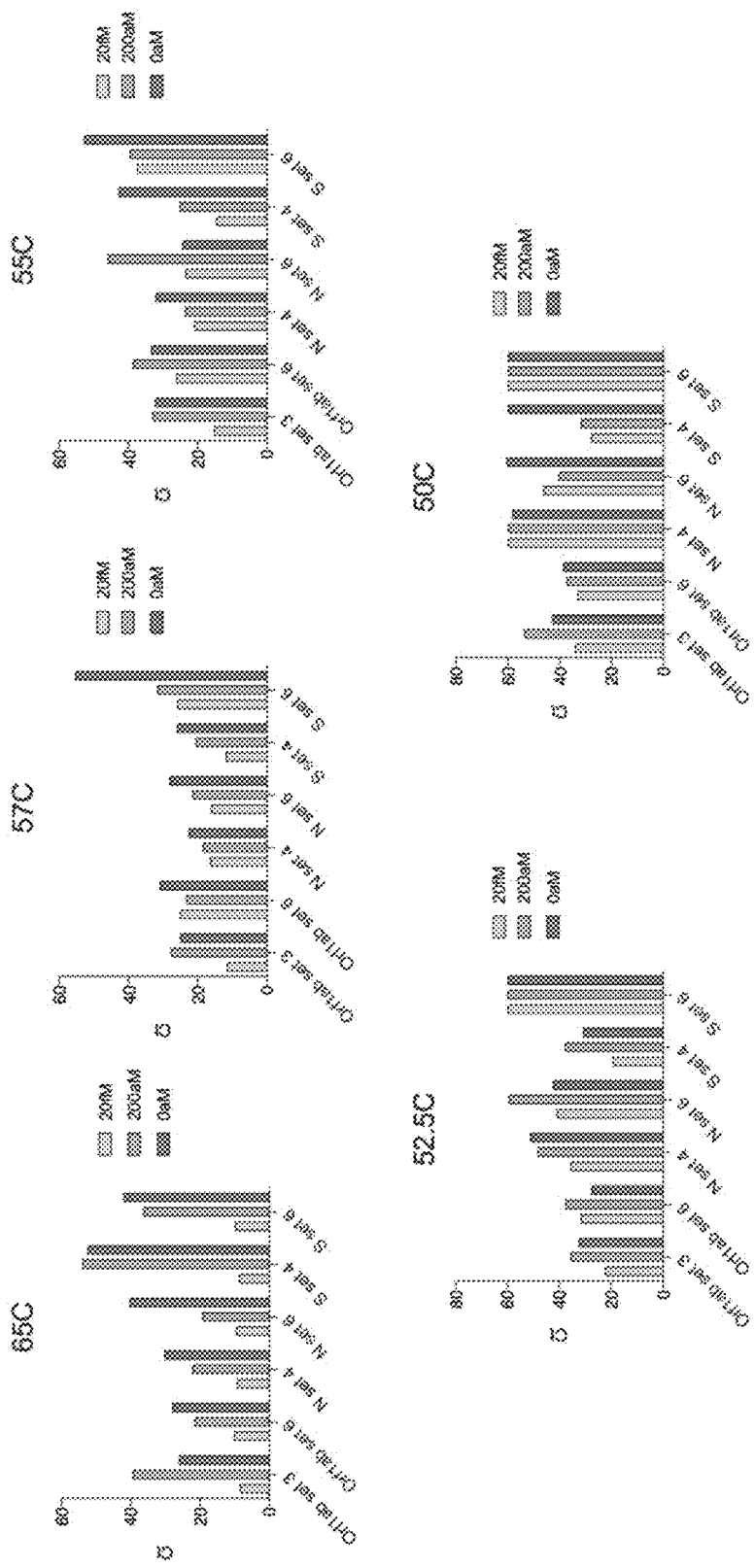
FIG. 22—Demonstrates that LAMP primers are active at lower temperatures.
Figure 23:
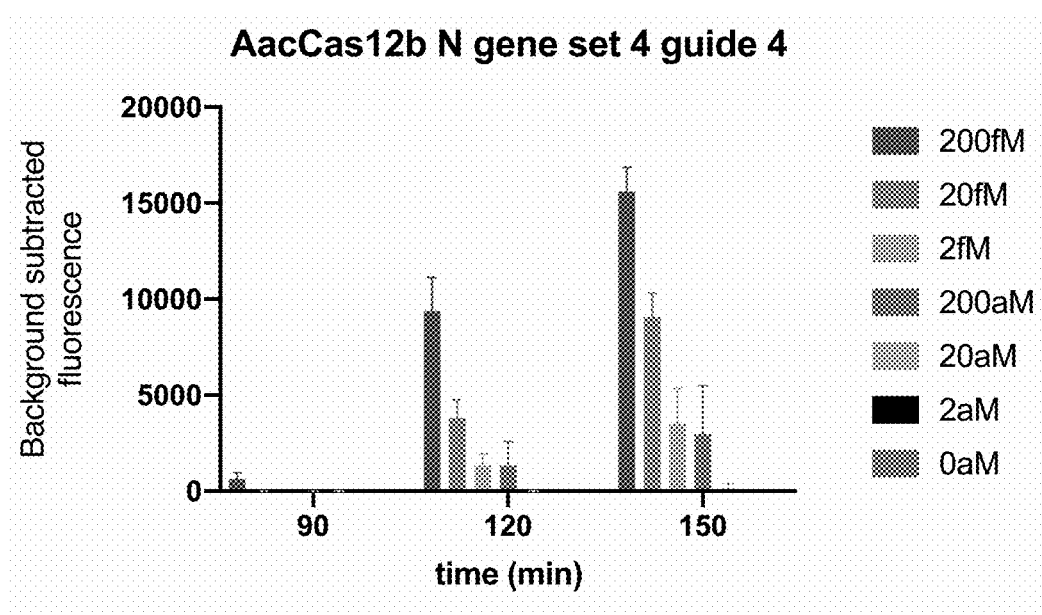
FIG. 23—Demonstrates that combining *Alicyclobacillus acidoterrestris* Cas12b (AacCas12b) with LAMP at 55° C. enables one-pot COVID-19 detection. Input comprised RNA genome of COVID-19 broken into 5 kb fragments.
Figure 24:
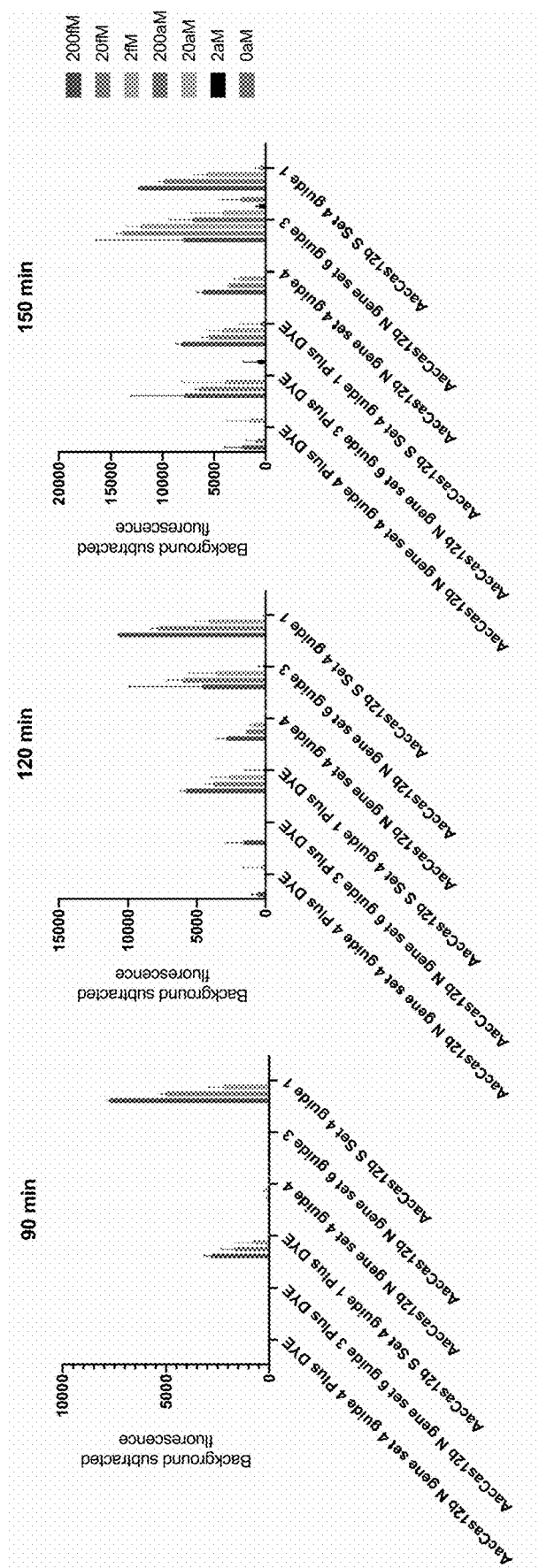
FIG. 24—Demonstrates multiple primer-set and guide combination work targeting different COVID-19 genes. 200 aM detection limit was achieve by 150 minutes. Input comprised RNA genome of COVID-19 broken into 5 kb fragments.

One exemplary device that can be utilized at point of care, in home environments, and/or for distribution as a take home device is shown in FIG. 21. The device can advantageously be disposable and can offer rapid instrument-free visualization of the nucleic acid amplification products of the methods disclosed herein. In an exemplary embodiment, the disposable device is compatible with nucleic acid amplification technologies, including LAMP. The device comprises an ampule which can contain the lateral flow buffer for the lateral flow readout of the amplification result. A sample can be loaded into a container which may comprise the reagents for the SHERLOCK reaction, including amplification reagents and CRISPR-Cas protein and guide molecules, which may optionally be stored in the container as lyophilized reagents. (See FIG. 21 at step 1). The device can further comprise a container for the contents of the SHERLOCK reaction, including LAMP amplification reagents and CRISPR-Cas protein and guide molecules. The device can also be configured to comprise the lateral flow strip, such that after the reaction is conducted, a lateral flow readout is provided in the device utilizing an instrument-free method for the visualization of the reaction products without cross-contamination.

Example 6. Point-of-Care Testing for COVID-19 Using SHERLOCK Diagnostics

Rapid point-of-care (POC) tests capable of being run in any low-resource setting, including at home, are needed to adequately combat the COVID-19 pandemic and re-open society. Applicants previously described a protocol for using the CRISPR-based SHERLOCK (Specific High Sensitivity Enzymatic Reporter UnLOCKing) technique (Gootenberg et al., 2017, 2018) for the detection of SARS-CoV-2. SHERLOCK achieves sensitive detection of SARS-CoV-2 through two consecutive reactions: (1) amplification of the virus RNA using an isothermal amplification reaction, and (2) detection of the resulting amplicon using CRISPR-mediated collateral reporter unlocking. Additional CRISPR-based tests have also been recently developed (Broughton et al., 2020; Ding et al., 2020; Guo et al., 2020; Lucia et al., 2020), but these all rely on two separate reaction steps, which requires liquid handling and opening of tubes. These steps add complexity and can lead to contamination, prohibiting their use outside laboratory environments and precluding use by lay individuals. Other POC tests for COVID-19 have been authorized by the U.S. Food and Drug Administration (FDA), including the Abbott ID NOW and Cepheid Genexpert, but these require complex and expensive instrumentation, limiting use to complex labs and hospitals by trained professionals. Some isothermal pre-amplification methods, such as Loop-mediated Isothermal Amplification (LAMP), have been developed as POC tests (Zhang et al., 2020), but these rely on amplification that can be nonspecific.

Currently, the only tests readily available for at-home or low-resource settings are serology paper-based tests (Whitman et al., 2020). However, these are not adequate for diagnosing live infection as antibodies take 1-2 weeks to become detectable in blood and only signify previous exposure. Therefore, Applicants sought to create a POC COVID-19 nucleic acid test that can be run in any setting. Through a series of optimizations, Applicants developed a streamlined, 1-hour SHERLOCK based test that requires no sample extraction and can be performed at one temperature in a single reaction with minimal fluid handling and visual colorimetric readout (FIG. 16).

The one-pot SHERLOCK SARS-CoV-2 detection protocol works in the following three steps, without requiring separate virus RNA extraction:

| | | |
|---|---|---|
| Step (1) | 5 mins at 95° C. | lysis of virus-containing patient sample using QuickExtract to release virus RNA; |
| Step (2) | 1 hr at 60° C. | detection of virus RNA using one-step SHERLOCK reaction; |
| Step (3) | 2 mins at room temp | visual read out of the detection result by eye using a commercially-available paper dipstick. |

In order to integrate the isothermal amplification step with the CRISPR-mediated detection step, Applicants sought to establish a common reaction condition capable of supporting both steps. Due to the supply chain constraints for the commercially-available recombinase polymerase amplification (RPA) reagents and difficulties in producing a rapid one-pot RPA test for sensitive RNA detection, Applicants chose loop-mediated isothermal amplification (LAMP) reaction for amplifying the virus RNA. The requisite enzymes for LAMP are more readily available from a number of commercial suppliers and the LAMP buffers are simpler and more amenable to systematic optimization with Cas enzymes.

Figure 25:
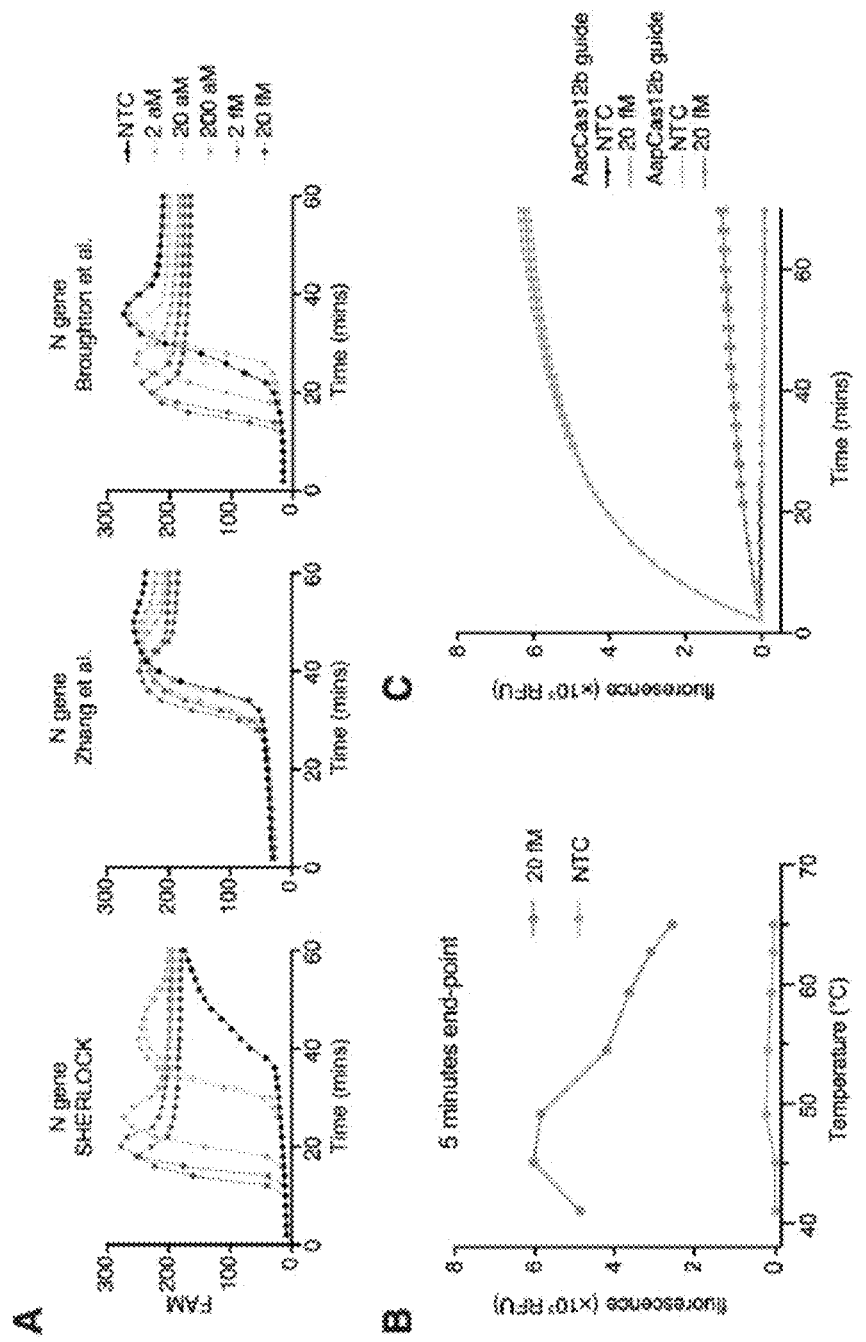
FIG. 25—Development of POC-SHERLOCK using RT-LAMP and thermophilic AapCas12b. (25A) Comparison of the POC-SHERLOCK N gene LAMP primer set to two established LAMP primer sets measured by real-time fluorescence at varying levels of SARS-CoV-2 standard genomes. (25B) Temperature comparison of AapCas12b collateral activity activated by RT-LAMP amplified inputs, including 20 fM SARS-CoV-2 standards and NTC controls. (25C) AapCas12b collateral activity when incubated with AapCas12b or AacCas12b crRNAs and RT-LAMP amplified 20 fM SARS-CoV-2 standards or NTC. (25D) AapCas12b collateral activity measured using different guides for RT-LAMP amplified 20 fM SARS-CoV-2 standards or NTC. (25E) POC-SHERLOCK (One-pot Cas12b and RT-LAMP) results when using AapCas12b or AacCas12b and varying amounts of SARS-CoV-2 inputs or NTC. (25F) POC-SHERLOCK real-time fluorescence performance measured with glycine or taurine additives at 2 fM SARS-CoV-2 input or NTC.
Figure 25:
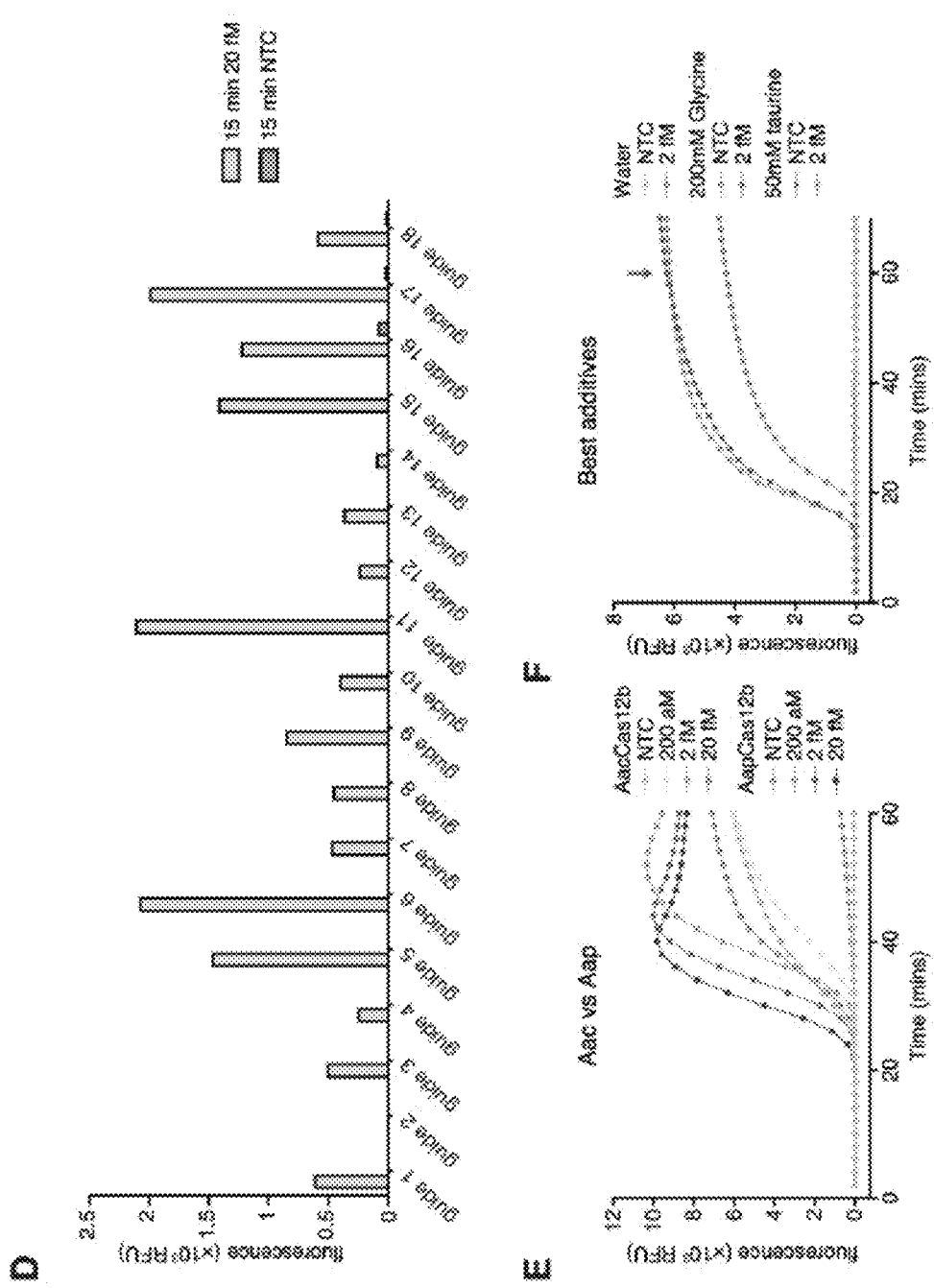

To determine the optimal combination of LAMP primers and guides, Applicants designed 29 sets of LAMP primers targeting different regions of the SARS-CoV-2 genome and identified the best primer set for amplifying gene N (FIG. 25A). As LAMP operates at a higher temperature than RPA (55-65° C. compared to 42° C.), a one-pot reaction demands a Cas enzyme with collateral activity that is thermostable. Of the various Cas proteins Applicants explored, Cas12b from *Alicyclobacillus acidiphilus* (AapCas12b) (Teng et al., 2018) maintained sufficient activity in the same temperature range as LAMP (FIG. 25B). However, because the AapCas12b locus did not contain a CRISPR array, the published single guide RNA (sgRNA) for AapCas12b used a direct repeat (DR) sequence from *Alicyclobacillus macrosporangiidus* Cas12b, which could impede activity. To remedy this, Applicants searched for alternative orthologs with similar protein sequences to AapCas12b and found that *Alicyclobacillus acidoterrestris* Cas12b (AacCas12b) shared a 95% sequence homology (Shmakov et al., 2015). Additionally, the AacCas12b tracrRNA and predicted AapCas12b tracrRNA are 97% identical. Given the high degree of similarity between AapCas12b and AacCas12b protein and tracrRNA, Applicants surmised that the sgRNA for AacCas12b should closely match the cognate AapCas12b DR-tracrRNA hybrid. Indeed, reactions combining AapCas12b enzyme with AacCas12b sgRNA produced more robust and specific nuclease activity compared to the published AapCas12b sgRNA (FIG. 25C).

For the best LAMP amplicon, Applicants tested 18 sgRNAs to identify the optimal combination of primers and guide sequence (FIG. 25D). Using this combination in a one pot reaction, Applicants found that AapCas12b generated faster and higher collateral activity than AacCas12b protein (FIG. 25E). Applicants further optimized one-pot reaction components by screening 94 additives to improve thermal stability, finding that addition of taurine significantly improved reaction kinetics (FIG. 25F).

Figure 6:
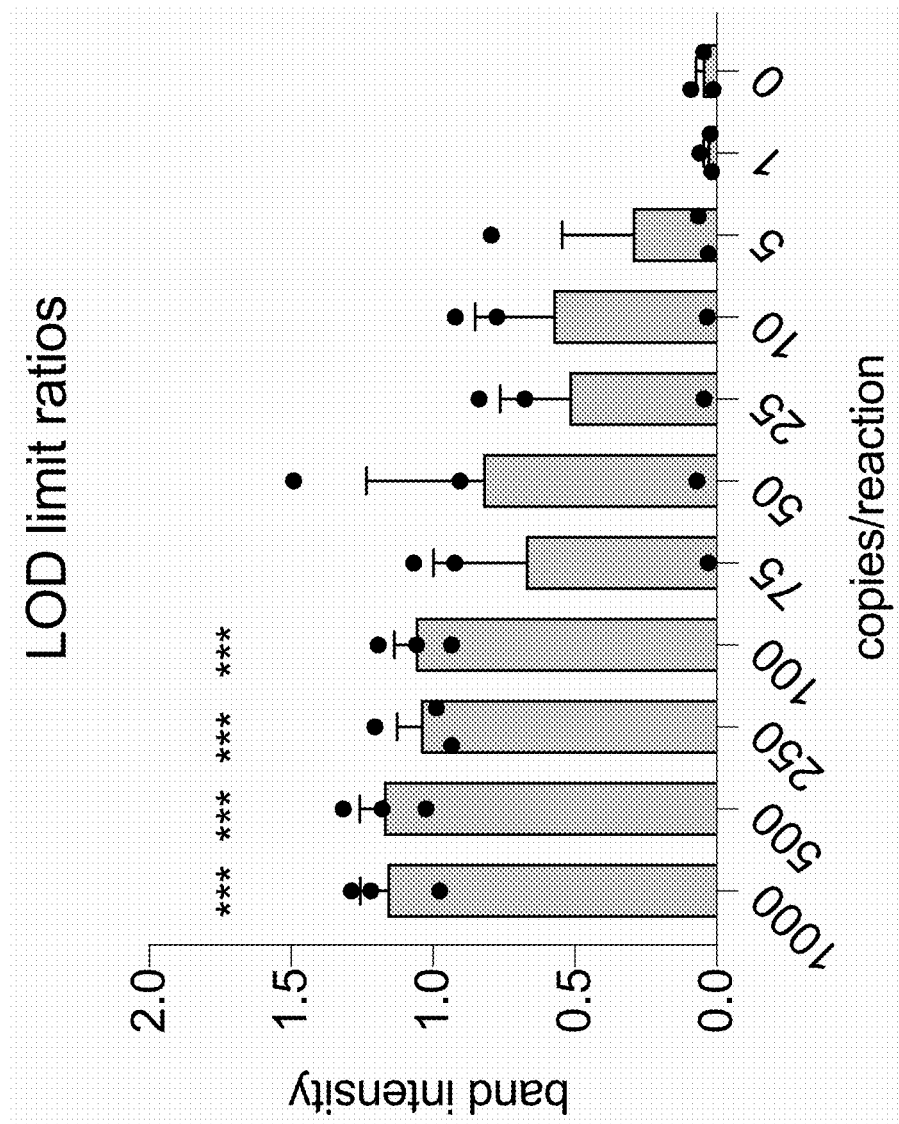
FIG. 6—Graph shows quantification of lateral flow assay from FIG. 5. The bar graph represents quantification of top band intensity/bottom band intensity.
Figure 7:
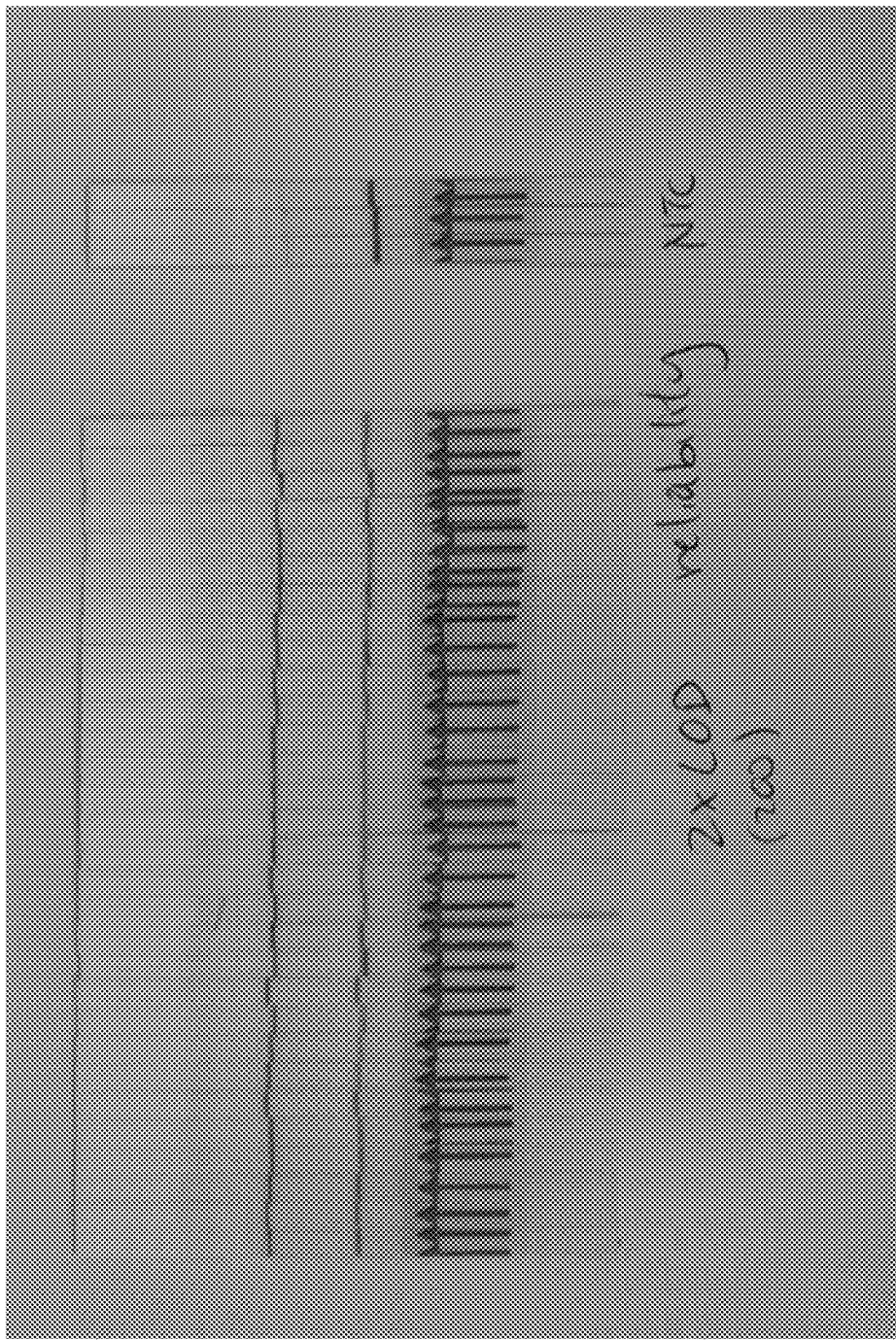
FIG. 7—Shows that SHERLOCK can reliably perform at 2× the limit of detection.
Figure 8:
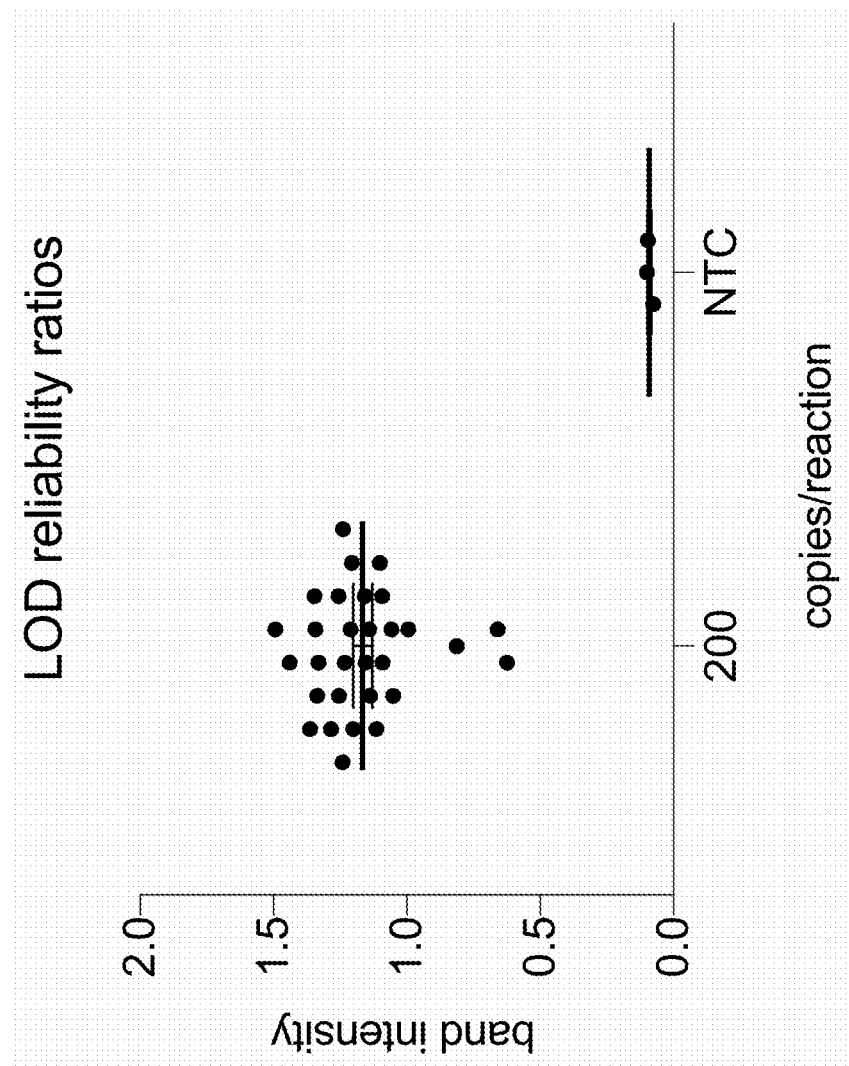
FIG. 8—Graph showing that SHERLOCK can reliably perform at 2× the limit of detection. The graph represents quantification of top band intensity/bottom band intensity of lateral flow assays from FIG. 7.
Figure 9:
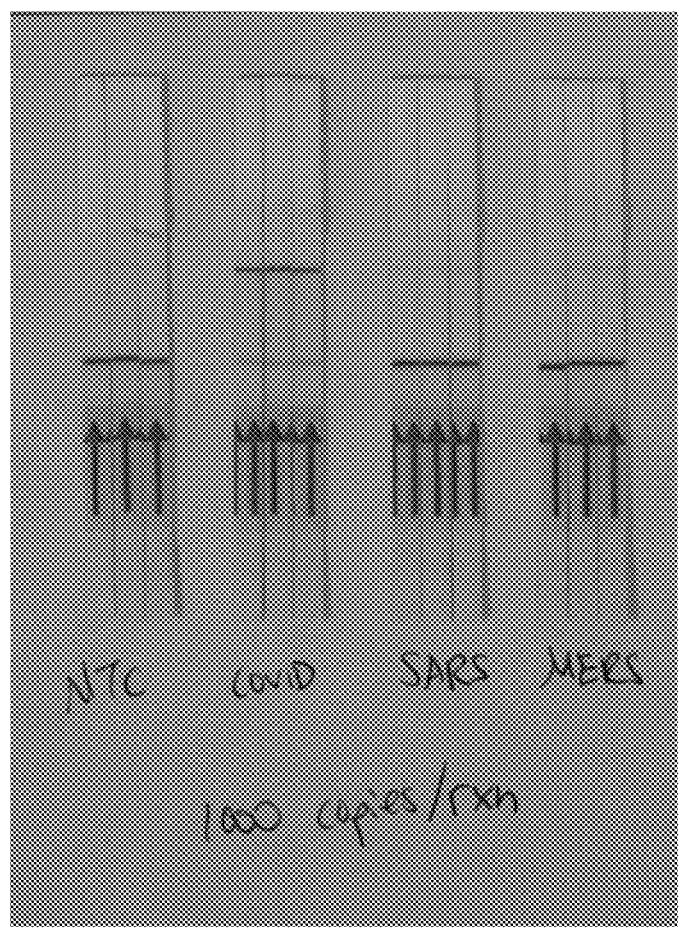
FIG. 9—Shows that the SHERLOCK assay has no cross-reactivity with SARS-CoV or MERS-CoV.
Figure 10:
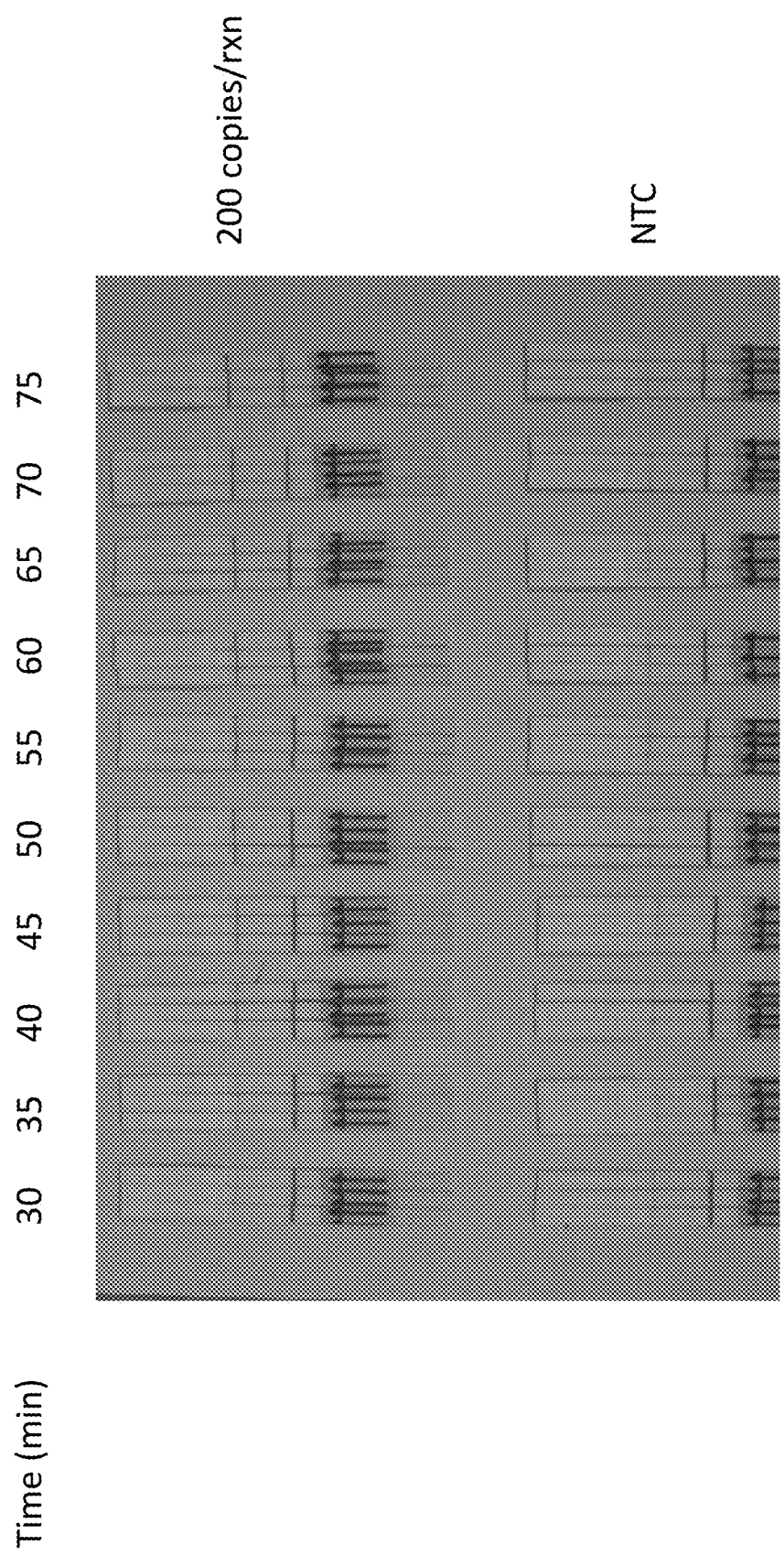
FIG. 10—Shows that a 50 minute incubation is sufficient to reach reaction saturation at 2× limit of detection.
Figure 11:
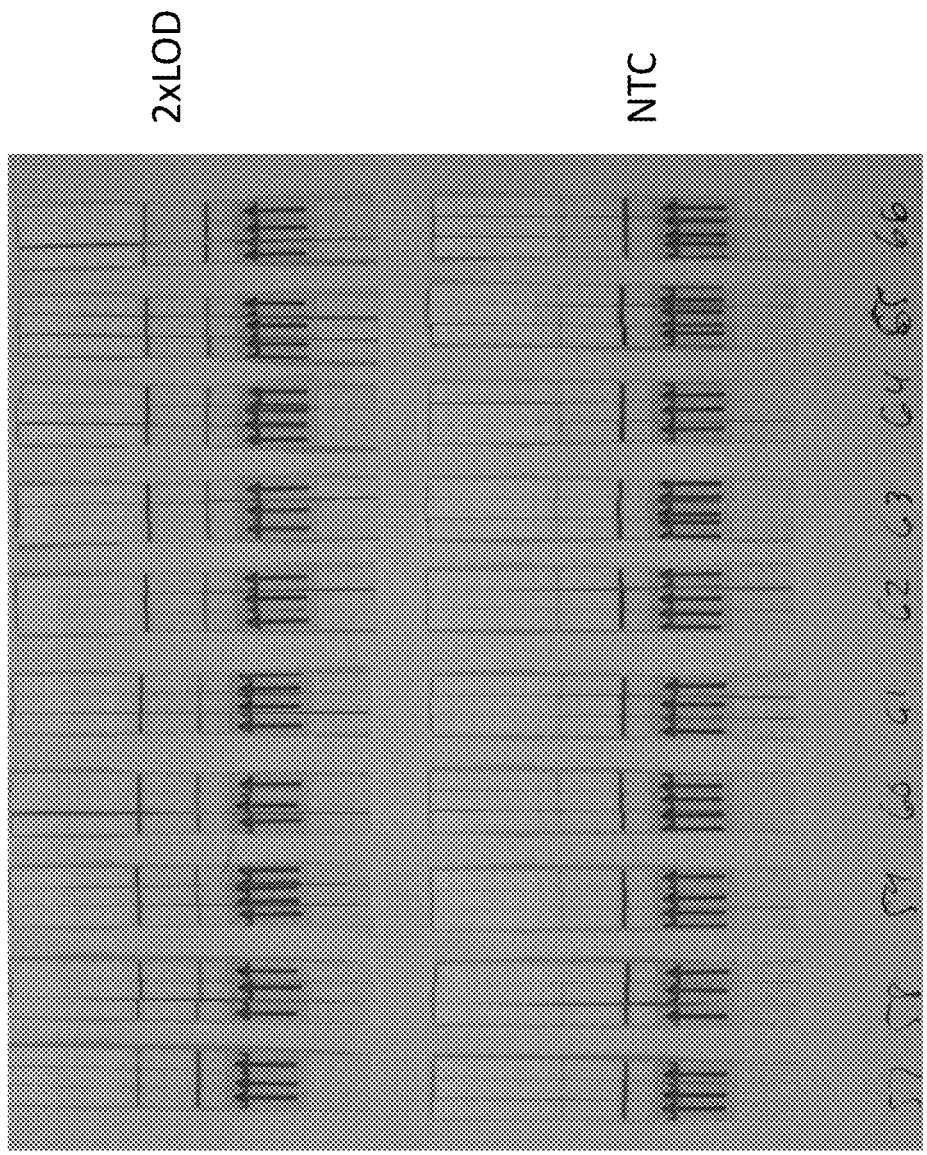
FIG. 11—Shows that SHERLOCK is robust across a 10° C. window.
Figure 12:
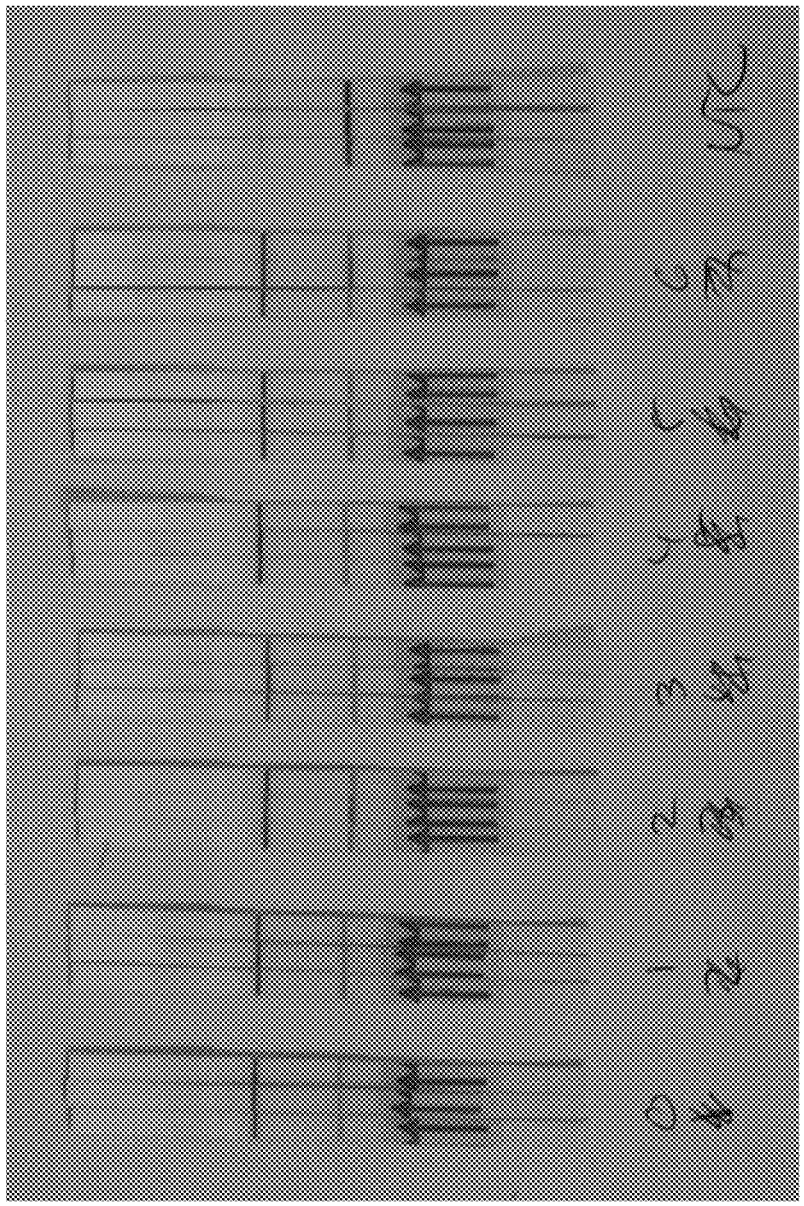
FIG. 12—Shows that SHERLOCK can be master mixed and freeze-thawed for six freeze-thaw cycles or more.
Figure 26:
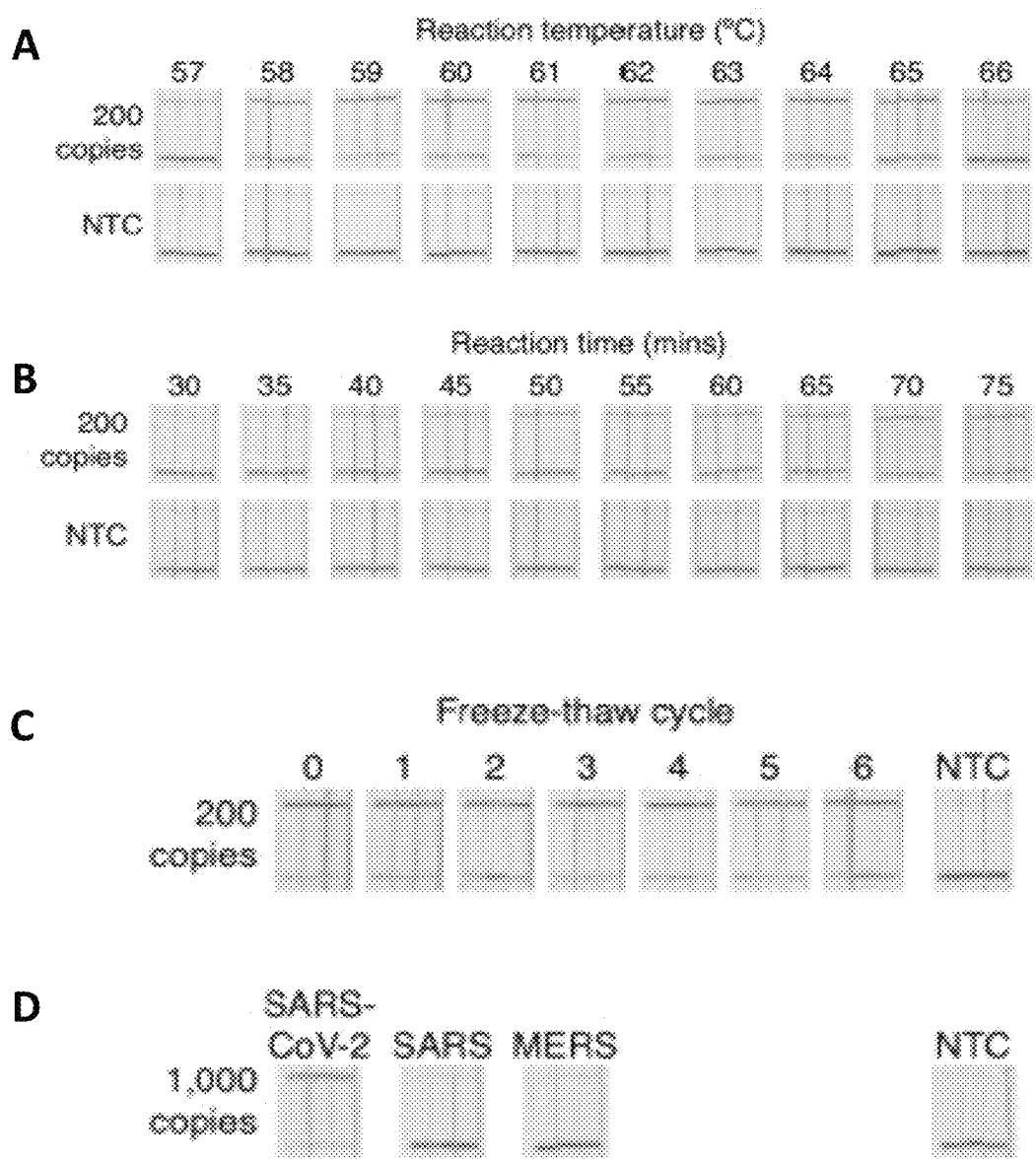
FIG. 26—POC-SHERLOCK performance on lateral flow strips. (25A) Effect of reaction temperature on POC-SHERLOCK lateral flow detection for 200 SARS-CoV-2 copies per reaction and NTC. (25B) Effect of reaction incubation time on POC-SHERLOCK lateral flow detection for 100 SARS-CoV-2 copies per reaction and NTC. (25C) Effect of master mix freeze-thaw cycles on POC-SHERLOCK lateral flow detection for 200 SARS-CoV-2 copies per reaction and NTC. (25D) Measurement of cross-reactivity for COVID-19 POC-SHERLOCK lateral flow test for SARS and MERS N genes compared to NTC. All inputs were at 1,000 copies per reaction.

Applicants profiled the optimized reaction with a lateral flow readout and an RNA extraction-free input using SARS-CoV-2 genome standards spiked into nasopharyngeal (NP) swab to determine limit of detection (LOD), ideal incubation temperature, readout time, and robustness. Applicants found that the LOD of the reaction was 100 copies of SARS-CoV-2 (FIG. 18). This LOD was reliable and reproducible over 30 replicates (FIG. 6). At twice the LOD, the ideal incubation parameters were 60° C. for at least 50 minutes (FIG. 26A, 26B). The reaction components could be formulated as a mastermix and maintained functionality after 6 freeze-thaw cycles (FIG. 26C). The assay exhibited no cross-reactivity with the SARS or MERS coronavirus genomes (FIG. 26D). The reaction could be performed using either a standard heat block or via a water bath maintained by a commercially-available low-cost (under $40 USD) sous-vide cooker (FIG. 20).

Finally, Applicants evaluated the one-pot SHERLOCK detection on 12 positive and 5 negative patient NP swabs. Applicants' assay correctly identified 35/36 positive patient replicates and 15/15 negative patient replicates, resulting in a sensitivity of 97% and specificity of 100% (FIGS. 19 and 27, 42A). To further simplify the assay workflow, Applicants tested whether lysis using QuickExtract at room temperature (22° C.) or the one-pot incubation temperature (60° C.) for 10 mins would be sufficient for detection. As QuickExtract contains Proteinase K that inhibits SHERLOCK without heat inactivation at 95° C., Applicants added Proteinase K Inhibitor to the SHERLOCK reaction. In both cases, Applicants could identify 33/36 positive patient replicates (FIGS.

Figure 29:
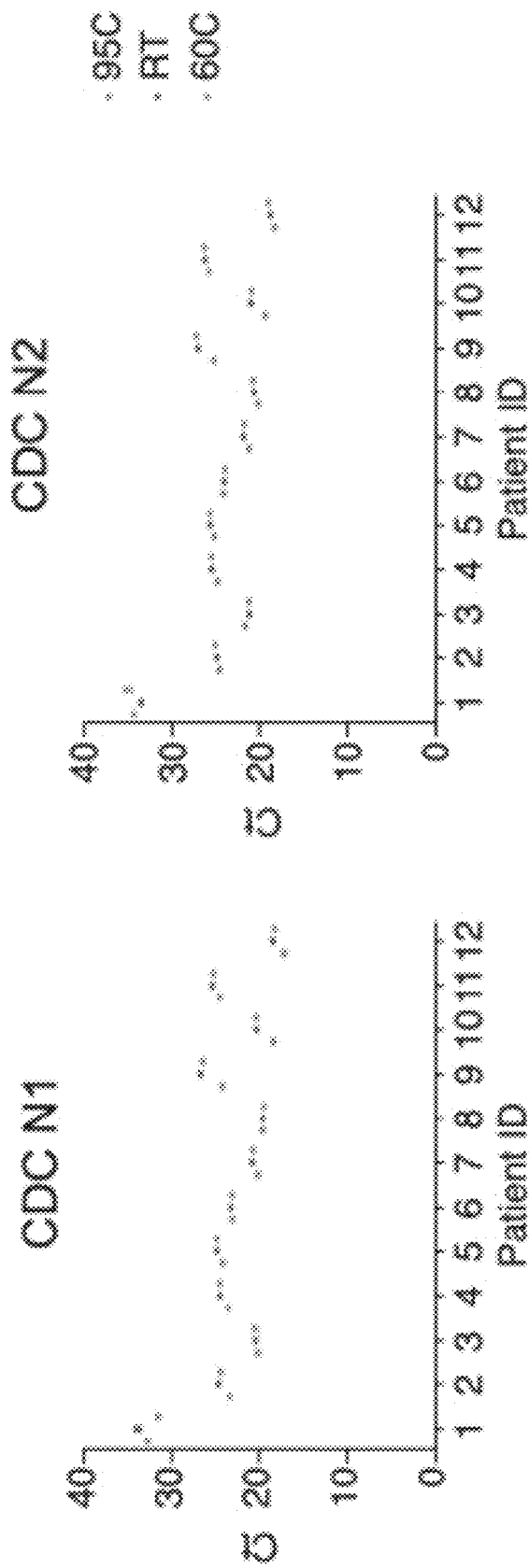
FIG. 29—Comparison of different lysis temperatures for SARS-CoV-2 positive patient nasopharyngeal swab extraction as measured by Ct values from RT-PCR using the CDC N1 and N2 assays. For patients 9 and 10, due to the low volume of samples provided, samples tested with 22° C. and 60° C. lysis conditions were diluted 1:2 prior to POC-SHERLOCK and RT-qPCR.

28A, 28B). Comparison of RT-qPCR Ct values between the lysis methods suggested that both lysis methods are viable alternatives for streamlining the assay workflow, though with a slight decrease (0.2/0.4 Ct at 60° C. and 0.4/0.7 Ct for 22° C. for CDC N1/N2) in sensitivity (FIG. 29).

Materials and Methods

Design of LAMP and SHERLOCK Reactions.

Applicants designed LAMP amplification primers and SHERLOCK AapCas12b guide RNAs to target the N gene of SARS-CoV-2. The N gene is known to be present at higher copy numbers than other segments of the SARS-CoV-2 genome, which helps to increase the detection sensitivity. Below are the LAMP primer sequences and SHERLOCK AapCas12b guide RNAs:

TABLE 6

LAMP Primers and Cas Guide

| | |
|---|---|
| F3: | 5'-GCTGCTGAGGCTTCTAAG-3' (SEQ ID NO: 61983) |
| B3: | 5'-GCGTCAATATGCTTATTCAGC-3' (SEQ ID NO: 61984) |
| FIP: | 5'-GCGGCCAATGTTTGTAATCAGTAGACGTGGTCCAGAA CAA-3' (SEQ ID NO: 61985) |
| BIP: | 5'-TCAGCGTTCTTCGGAATGTCGCTGTGTAGGTCAACCA CG -3' (SEQ ID NO: 61986) |
| Loop Forward: | 5'-CCTTGTCTGATTAGTTCCTGGT-3' (SEQ ID NO: 61987) |
| Loop Reverse: | 5'-TGGCATGGAAGTCACACC-3' (SEQ ID NO: 61988) |
| AapCas12b Guide RNA targeting SARS-CoV-2 N gene: | 5'-GUCUAGAGGACAGAAUUUUCAACGGGUGUGCCAAUG GCCACUUUCCAGGUGG CAAAGCCCGUUGAGCUUCUCAAAUCUGAGAAGUGGCA CCGAAGAACGCUGAAGC GCUG-3' (The spacer matching N gene is underlined.) (SEQ ID NO: 61989) |

AapCas12b Protein Sequence:

(SEQ ID NO: 61990)
MAVKSMKVKLRLDNMPEIRAGLWKLHTEVNAGVRYYTEWLSLLRQENLYRR

SPNGDGEQECYKTAEECKAELLERLRARQVENGHCGPAGSDDELLQLARQL

YELLVPQAIGAKGDAQQIARKFLSPLADKDAVGGLGIAKAGNKPRWVRMRE

AGEPGWEEEKAKAEARKSTDRTADVLRALADFGLKPLMRVYTDSDMSSVQW

KPLRKGQAVRTWDRDMFQQAIERMMSWESWNQRVGEAYAKLVEQKSRFEQK

NFVGQEHLVQLVNQLQQDMKEASHGLESKEQTAHYLTGRALRGSDKVFEKW

EKLDPDAPFDLYDTEIKNVQRRNTRRFGSHDLFAKLAEPKYQALWREDASF

LTRYAVYNSIVRKLNHAKMFATFTLPDATAHPIWTRFDKLGGNLHQYTFLF

NEFGEGRHAIRFQKLLTVEDGVAKEVDDVTVPISMSAQLDDLLPRDPHELV

ALYFQDYGAEQHLAGEFGGAKIQYRRDQLNHLHARRGARDVYLNLSVRVQS

QSEARGERRPPYAAVFRLVGDNHRAFVHFDKLSDYLAEHPDDGKLGSEGLL

SGLRVMSVDLGLRTSASISVFRVARKDELKPNSEGRVPFCFPIEGNENLVA

VHERSQLLKLPGETESKDLRAIREERQRTLRQLRTQLAYLRLLVRCGSEDV

GRRERSWAKLIEQPMDANQMTPDWREAFEDELQKLKSLYGICGDREWTEAV

YESVRRVWRHMGKQVRDWRKDVRSGERPKIRGYQKDVVGGNSIEQIEYLER

QYKFLKSWSFFGKVSGQVIRAEKGSRFAITLREHIDHAKEDRLKKLADRII

MEALGYVYALDDERGKGKWVAKYPPCQLILLEELSEYQFNNDRPPSENNQL

MQWSHRGVFQELLNQAQVHDLLVGTMYAAFSSRFDARTGAPGIRCRRVPAR

CAREQNPEPFPWWLNKFVAEHKLDGCPLRADDLIPTGEGEFFVSPFSAEEG

DFHQIHADLNAAQNLQRRLWSDFDISQIRLRCDWGEVDGEPVLIPRTTGKR

TADSYGNKVFYTKTGVTYYERERGKKRRKVFAQEELSEEEAELLVEADEAR

EKSVVLMRDPSGIINRGDWTRQKEFWSMVNQRIEGYLVKQIRSRVRLQESA

CENTGDI*

Specimen and nucleic acid extraction. Two types of patient samples have been tested for compatibility with one-pot SHERLOCK. All samples should be collected and processed according to the appropriate biosafety procedure.

a. RNA Extracted from Patient Samples:

The patient sample should be collected according to the appropriate biosafety procedures. Please reference the 2020 CDC COVID-19 test protocol for details on specimen collection and subsequent nucleic acid extraction. The input for this protocol, beginning with Step (1), can be the same extracted nucleic acid as used in qRT-PCR assays.

b. Nasopharyngeal (NP) Swabs:

NP swabs dissolved in viral transport media (VTM) or TE can be directly used.

Reagents.

For Step (1)—lysis of viral sample:

QuickExtract DNA Extraction Solution (QE09050), Lucigen. Once thawed, aliquot and store at −20° C. to avoid >3 freeze-thaw cycles.

For Step (2)—one-pot SHERLOCK detection reaction:

Bst 2.0 WarmStart® DNA Polymerase (M0538L), New England BioLabs

WarmStart® RTx Reverse Transcriptase (M0380L), New England BioLabs

10× Isothermal Amplification Buffer (B0374S), New England BioLabs, supplied with M0538L and M0380L 100 mM MgSO4 (B1003S), New England BioLabs, supplied with M0538L and M0380L 10 mM Deoxynucleotide (dNTP) Solution Mix (N0447L), New England BioLabs Taurine (86329-100G), Millipore Sigma AapCas12b protein purified according to Kellner et al., Nature Protocols 2019, stored as 10 μL aliquots at 2 mg/mL.

Guide RNA for detecting N gene can be ordered from Synthego

Reporter DNA for lateral flow read out (Lateral Flow Reporter: /56-FAM/TTTTTTT/3Bio/), can be ordered from IDT (Optional) Proteinase K Inhibitor (539470-10MG), Millipore Sigma. Resuspend 10 mg of Proteinase K Inhibitor with 150 μL of DMSO to make the stock solution. Dilute stock solution 1:100 with ddH2O to make working aliquots. Store both stock and working solutions at −20° C.

10×LAMP Primer Mix:

TABLE 7

LAMP Primer Mix.

| LAMP Primer (100 μM) | Amount (μL) |
|---|---|
| F3 | 2 |
| B3 | 2 |
| FIP | 16 |
| BIP | 16 |
| Loop F | 4 |
| Loop B | 4 |
| ddH$_2$O | 56 |
| Total | 100 |

A Sherlock mastermix can be prepared as follows:

TABLE 8

| | Initial concentration | Final concentration | Amount (uL) |
|---|---|---|---|
| Isothermal amplification buffer | 10 X | 1 X | 5 |
| dNTPs | 10 mM | 1.4 mM | 7 |
| MgSO$_4$ | 100 mM | 8 mM | 4 |
| WS Bst 2.0 | 8000 units/mL | 320 units/mL | 2 |
| WS RTx | 15,000 units/mL | 300 units/mL | 1 |
| Aap Cas12b | 2 mg/mL or 15.4 uM | 500 nM | 1.625 |
| Aac Cas12b | 360 ng/uL or 10 uM | 500 nM | 2.5 |
| crRNA | 10 uM | | |
| Lateral Flow Reporter | 100 uM | 125 nM | 0.0625 |
| Taurine | 500 mM | 50 mM | 5 |
| LAMP primer mix | 10 X | 1 X | 5 |
| ddH$_2$O | | | 11.8125 |
| Total | | | 45 |

If lysing samples at 22° C. or 60° C. instead of 95° C., replace 2 uL of ddH2O with 2 uL of Proteinase K Inhibitor working solution.

For Step (3) reading out using lateral flow dipstick:

HybriDetect Dipstick (MGHD 1), Milenia Biotec GmbH

Positive Control Sequences

SARS-CoV-2 RNA control (102019), Twist Bioscience

Equipment.

95° C. heat block or water bath

60° C. heat block or water bath

Alternative: a sous vide immersion cooker capable of supporting the temperature range of 55° C. to 95° C. can also be used (example).

One-Step SHERLOCK Protocol for SARS-CoV-2 Detection

***IMPORTANT NOTE: To prevent sample contamination from confounding detection result, two different work areas should be used for performing Steps (1)/(2) and (3). Steps (1)/(2) should be performed in a pre-amplification area and is especially sensitive to contamination. Amplified samples should not be opened in the work area for Steps (1)/(2). A separate area for post-amplification reactions should be used for performing Step (3) of the protocol. After incubation, reactions from Step (2) should be thoroughly spun down after incubation before opening in the post-amplification area to carry out Step (3).

Step (1)—Lysis of Patients Sample. *Performed in the Pre-Amplification Area*

NP swab sample should be lysed using the QuickExtract lysis buffer.

Mix 10 μL of NP swab sample with 10 μL of Quick Extract in an eppendorf tube.

Incubate the sample-QuickExtract mixture at 95° C. for 5 minutes (or at room temperature or 60° C. for 10 mins) and proceed to Step (2).

Step (2)—One Pot SHERLOCK Detection. *Performed in the Pre-Amplification Area*

For each sample, set up one reaction as follows. In addition, a positive control can be set up using the SARS-CoV-2 control RNA. A negative control with Isothermal Amplification Buffer, MgSO4, dNTPs, Lateral Flow Reporter, and sample should also be set up to control for DNAse contamination that may produce false positive results.

TABLE 9

| Reagent | Amount (μL) |
|---|---|
| Sherlock mastermix | 45 |
| Lysed sample | 5 |
| Total | 50 |

Mix thoroughly and incubate each reaction at 60° C. for 1 hour. Spin down the reaction in a centrifuge at maximum speed. Transfer the reaction tubes to the post-amplification area before proceeding to Step (3).

Step (3)—Visual Readout of Detection Result Via Lateral Flow Strip. *Performed in the Post-Amplification Area*

Before opening each tube, spin down each reaction tube in a centrifuge at maximum speed to prevent aerosol contamination. Place a HybriDetect Dipstick into each reaction tube and wait for the reaction to flow through the dipstick.

Positive control samples should show the top line and a faint bottom line. Negative control samples should show the bottom line.

For each test sample, check to see the top line appears, indicating positive SARS-CoV-2 detection.

Additional Information

A detailed general protocol for setting up SHERLOCK-based detection can be found in the following reference: SHERLOCK: nucleic acid detection with CRISPR nucleases. Kellner M J, Koob J G, Gootenberg J S, Abudayyeh O O, and Zhang F. Nature Protocols. 2019 October; 14(10): 2986-3012. doi: 10.1038/s41596-019-0210-2.

Conclusions

Applicants' one-pot SHERLOCK detection method is capable of rapid, point-of-care diagnosis of COVID-19. With 97% sensitivity and 100% specificity on patient samples, Applicants were able to detect presence of SARS-CoV-2 down to 100 molecules of viral genome per reaction in a simplified format that any user could perform in a non-laboratory setting. Because of the rapid speed and lack of instrumentation, we envision that this protocol could be used in low resource clinics, workplaces, and even at home. While Applicants tested on nasopharyngeal swabs, saliva samples have similar viral loads and would be a simpler alternative sample source. Future versions of the protocol could benefit from an all-in-one integrated device that could heat the reaction and transfer the reaction to a paper strip to reduce amplicon spread and streamline the workflow.

TABLE 10

Methods Comparison.

| | SHERLOCKv2, RT-LAMP/ AapCas12b | SHERLOCKv1, RPA-Cas13 | SARS-Cov2 DETECTR | CDC SARS-Cov2 qRT-PCR |
|---|---|---|---|---|
| Reference | This study | (Zhang et al. 2020) | (Broughton et al., 2020) | (CDC) |
| Target | N gene | N gene and S gene | E gene and N gene | N gene |
| LoD (per 50 ul reaction) | 100 copies | 50-500 copies | 50 copies | 5-15 copies |
| Assay reaction time | 60 min | 55 min | 40 min | 120 min |
| Assay sample-to-result time | 70 min | 90 min (including RNA extraction) | 75 min (including RNA extraction) | 4 h (including RNA extraction) |
| Assay results | Visual | Visual | Visual | Fluorescent |
| Laboratory instrumentation required | None | Centrifuges, water baths | Centrifuges, water baths | Centrifuges, qPCR machine |
| Sample extraction required | None | Yes | Yes | Yes |
| Liquid transfer steps | 1 | 3 | 3 | 1 |

REFERENCES

Broughton, J. P., Deng, X., Yu, G., Fasching, C. L., Servellita, V., Singh, J., Miao, X., Streithorst, J. A., Granados, A., Sotomayor-Gonzalez, A., et al. (2020). CRISPR-Cas12-based detection of SARS-CoV-2. Nat. Biotechnol.

Ding, X., Yin, K., Li, Z., and Liu, C. (2020). All-in-One Dual CRISPR-Cas12a (AIOD-CRISPR) Assay: A Case for Rapid, Ultrasensitive and Visual Detection of Novel Coronavirus SARS-CoV-2 and HIV virus.

Gootenberg, J. S., Abudayyeh, O. O., Lee, J. W., Essletzbichler, P., Dy, A. J., Joung, J., Verdine, V., Donghia, N., Daringer, N. M., Freije, C. A., et al. (2017). Nucleic acid detection with CRISPR-Cas13a/C2c2. Science 356, 438-442.

Gootenberg, J. S., Abudayyeh, O. O., Kellner, M. J., Joung, J., Collins, J. J., and Zhang, F. (2018). Multiplexed and portable nucleic acid detection platform with Cas13, Cas12a, and Csm6. Science 360, 439-444.

Guo, L., Sun, X., Wang, X., Liang, C., Jiang, H., Gao, Q., Dai, M., Qu, B., Fang, S., Mao, Y., et al. (2020). SARS-CoV-2 detection with CRISPR diagnostics.

Lucia, C., Federico, P.-B., and Alejandra, G. C. (2020). An ultrasensitive, rapid, and portable coronavirus SARS-CoV-2 sequence detection method based on CRISPR-Cas12.

Shmakov, S., Abudayyeh, O. O., Makarova, K. S., Wolf, Y. I., Gootenberg, J. S., Semenova, E., Minakhin, L., Joung, J., Konermann, S., Severinov, K., et al. (2015). Discovery and Functional Characterization of Diverse Class 2 CRISPR-Cas Systems. Mol. Cell 60, 385-397.

Teng, F., Cui, T., Feng, G., Guo, L., Xu, K., Gao, Q., Li, T., Li, J., Zhou, Q., and Li, W. (2018). Repurposing CRISPR-Cas12b for mammalian genome engineering. Cell Discov 4, 63.

Whitman, J. D., Hiatt, J., Mowery, C. T., Shy, B. R., Yu, R., Yamamoto, T. N., Rathore, U., Goldgof, G. M., Whitty, C., Woo, J. M., et al. (2020). Test performance evaluation of SARS-CoV-2 serological assays. medRxiv 2020.04.25.20074856.

Zhang, Y., Odiwuor, N., Xiong, J., Sun, L., Nyaruaba, R. O., Wei, H., and Tanner, N. A. (2020). Rapid Molecular Detection of SARS-CoV-2 (COVID-19) Virus RNA Using Colorimetric LAMP. medRxiv 2020.02.26.20028373.

Example 7—Optimization and Enhancement of Detection Methods

Rather than a multi-step process for the extraction and washing when using beads as is explained in previous prior art methods, the present disclosure improves upon the methods:

A bead and lysis buffer mix is added to the sample, for about 5 to 10 minutes. At this time, the virus is lysed and bound to the beads.

Sample with beads is placed upon magxit, after separation, supernatant is aspirated and reaction buffer mix is added and sample can be subjected in pPCR. Thus, lysis and bead preparation steps are merged rather than multi-steps, and elimination of washes and elution steps are eliminated, with elution merged with the addition of reaction buffer mix.

The bead mix can include potassium chloride, with the typical amount of potassium chloride being reduced or eliminated from the reaction buffer mix. Additionally, the lysis buffer according to methods as provided herein can comprise proteinase K. Without the typical wash steps utilized after lysis, proteinase K carries over from the lysis step in the current methods, and proteinase K inhibitor is added to the reaction buffer mix.

Beads can be optionally used with the methods described herein, including with the one-pot methods that allow for concentration of viral nucleic acids from large volume samples, such as saliva or swab samples to allow for a single one-pot reaction method.

An exemplary method of making the beads are as follows:
Reagents
  500 mL 5M NaCl
  1M Tris-HCl, pH 8.0
  500 mM EDTA, pH 8.0
  Dry Poly-Ethylene Glycol 8000, PEG-8000 (Fisher, P/N BP233-1)
  Carboxy-Modified Sera-Mag Speed Beads (Fisher, P/N 09-981-124)

Protocol

Vortex the Sera-Mag speedbeads bottle for 1 minutes.

Add 0.1% (w/v) of your intended production amount, which is 10 mL of the Sera-Mag Speedbeads solution to a 50 mL conical tube.

Using a 50 mL magnetic separator, pellet the magnetic beads.

Aspirate the supernatant and discard.

The beads contain residual azide. Wash them twice with 10 mL of DI water, resuspending the pellet each time by vortexing for 30 seconds.

Pellet the beads for the last time.

Prepare the bead buffer by mixing orderly the following in a 500 mL reagent bottle.

| Component | Volume |
| --- | --- |
| 5M NaCl | 100 mL |
| 1M Tris-HCl | 5 mL |
| 500 mM EDTA | 1 mL |
| PEG-8000 | 90 g |

Invert mix 10 times and fill with DI water until it reaches the 500 mL mark.

Filter using a vacuum filtration unit according to the manufacturer's instructions and store filtered buffer in container of filtration unit until needed.

Remove the final wash fluid on the beads and add 10 mL of the sterile bead buffer to the beads.

Vortex for 30 seconds to resuspend the beads.

Add the bead slurry to the 500 mL bottle containing the remainder of the sterile buffer.

Twirl the bottle to homogenize the beads with the buffer.

The beads can now be aliquoted and stored at −20° C.

Optimization of Reagents

For ease of reference, optimization is described using LAMP amplification, but the design paradigm is applicable to any other isothermal amplification approach detailed herein. Further optimization of the methods as disclosed herein can include first screening primers to identify one or more sets of primers that work well for a particular target, Cas protein and/or reaction. Once the primers have been screened, titration of Magnesium concentration can be performed to identify an optimal magnesium concentration for higher signal to noise. Once an optimum magnesium concentration is identified, additional additives are screened at around 20-25% of the reaction, and once additives are identified, these additives, such as those components identified in FIG. 17, can be evaluated and varied in concentration to identify optimal reaction kinetics for specific reaction parameters, for example, specific primers, target, Cas protein, temperature, and other additive concentrations within the reaction. As described herein, a change from NaCl to KCl allows for the bead and extraction-free polynucleotide isolation buffer mix to reduce carryover and optimize reactions, allowing for merger of bead preparation, and washing/elution steps. Additionally, optimization of salt types and concentrations may further aid one-pot reactions.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (61990 sequences)

SEQ ID NO: 1 - DNA, 42 bp, Artificial Sequence
  Synthetic
acctgttccacaagtactacaacatacctgaagaggaggagc

SEQ ID NO: 2 - DNA, 47 bp, Artificial Sequence
  Synthetic
tgctgcagctgtttcatgatttactaactcatcatttaagtttggag

SEQ ID NO: 3 - DNA, 48 bp, Artificial Sequence
  Synthetic
gcagagtagcatcatctagaaaacctgtatctttcatgaataggcaaa

SEQ ID NO: 4 - DNA, 44 bp, Artificial Sequence
  Synthetic
tggcgagcataataatatagcacattgctaaaacagtggaagca

SEQ ID NO: 5 - DNA, 39 bp, Artificial Sequence
  Synthetic
ggtggggaaacggagtcgcgcactccactatttcctccc

SEQ ID NO: 6 - DNA, 39 bp, Artificial Sequence
  Synthetic
ataccccagcaccgaccaccaccagagaagctcccagaa

SEQ ID NO: 7 - DNA, 43 bp, Artificial Sequence
  Synthetic
tgagcctgattttgaaatgctacaatggggaagaggaagatgt

SEQ ID NO: 8 - DNA, 47 bp, Artificial Sequence
  Synthetic
ggacctcccaaagtctctaattctacctaatgtaaatgtgtttgtgg

SEQ ID NO: 9 - DNA, 38 bp, Artificial Sequence
  Synthetic
aatgcctcatctggagcagccgcctttacggatgacat

SEQ ID NO: 10 - DNA, 44 bp, Artificial Sequence
  Synthetic
gggttaacaatagtgtgtggcacaggctggagaaatagaaatgc

SEQ ID NO: 11 - DNA, 43 bp, Artificial Sequence
  Synthetic
ggatttcctgttaatccaatgcctatgtggaggttggaaggta

SEQ ID NO: 12 - DNA, 43 bp, Artificial Sequence
  Synthetic
ggccatttaccttatttactggtgaagcgggtattgatggtga

SEQ ID NO: 13 - DNA, 41 bp, Artificial Sequence
  Synthetic
ccagaatgcatattgtccccagaaatgtcctccagatgctg

SEQ ID NO: 14 - DNA, 46 bp, Artificial Sequence
  Synthetic
gtctgtaactaagtcctaaggatgccatggggtcaatatttttgcc

SEQ ID NO: 15 - DNA, 41 bp, Artificial Sequence
  Synthetic
aatgcctgcaataagcacgctgtattgttcaacaacagctg

SEQ ID NO: 16 - DNA, 49 bp, Artificial Sequence
  Synthetic
ggacaacaaagagaaagtccttcgaagacatttgctattagacttttgg

SEQ ID NO: 17 - DNA, 42 bp, Artificial Sequence
  Synthetic
actttcgttttagggcagctattgggaaattccctggcattg

SEQ ID NO: 18 - DNA, 50 bp, Artificial Sequence
  Synthetic
gcgccaagctttctaaagaaagattatgcattaccatttgataatgaagg

SEQ ID NO: 19 - DNA, 39 bp, Artificial Sequence
  Synthetic
gcgtgtcttggaggtcgaggaaccccagaagactccgtg

SEQ ID NO: 20 - DNA, 43 bp, Artificial Sequence
  Synthetic
ccaagtctagacagacctgttgtttgatttgtcccgtctccag

SEQ ID NO: 21 - DNA, 43 bp, Artificial Sequence
  Synthetic
ctccaggatttactctactaggagtggtctcgggattggtact

SEQ ID NO: 22 - DNA, 41 bp, Artificial Sequence
  Synthetic
acggttggatgtccactagcaggttgtaacaacacctgatc

SEQ ID NO: 23 - DNA, 43 bp, Artificial Sequence
  Synthetic
ctctggtgtgtaatgtctccaaagtgcacattttacaggtgac

SEQ ID NO: 24 - DNA, 40 bp, Artificial Sequence
  Synthetic
agcaaaatccagatcgggcgtgaccctgatgtaacaatga

SEQ ID NO: 25 - DNA, 46 bp, Artificial Sequence
  Synthetic
tcgcctatgacttggatgaagtatgtactcctctagaaccttatgc

SEQ ID NO: 26 - DNA, 44 bp, Artificial Sequence
  Synthetic
ccgaataggaaagtatgggtgaccttccatatacttccacgctg

SEQ ID NO: 27 - DNA, 42 bp, Artificial Sequence
  Synthetic
ggtctaaagatacgtcctggcgtaggagacacagaaaatccc

SEQ ID NO: 28 - DNA, 45 bp, Artificial Sequence
  Synthetic
ggtgttccaaagtacacatgtgataataggagctcaagacaatca

SEQ ID NO: 29 - DNA, 40 bp, Artificial Sequence
  Synthetic
ggtcctggaggctgtacgacacctcccctgcgaggaacca

SEQ ID NO: 30 - DNA, 40 bp, Artificial Sequence
  Synthetic
gactccgccaacgatctgccaccaaaagaaacaccgtccg

SEQ ID NO: 31 - DNA, 42 bp, Artificial Sequence
  Synthetic
gcgcctaggacagggatgtacccctcggtaaggtgatcgaca

SEQ ID NO: 32 - DNA, 42 bp, Artificial Sequence
  Synthetic
cactggttcccaacacctgctaaacagacaacgccatcctac

SEQ ID NO: 33 - DNA, 34 bp, Artificial Sequence
  Synthetic
ccattgacaaggccggcgcacgtcaccggccaca

SEQ ID NO: 34 - DNA, 42 bp, Artificial Sequence
  Synthetic
cctctcgggacagccactagaaatgactctttgcagacaggg

SEQ ID NO: 35 - DNA, 42 bp, Artificial Sequence
  Synthetic
gacgtatcttgcacggaggaccgctcatggatgaacacaacg

SEQ ID NO: 36 - DNA, 37 bp, Artificial Sequence
  Synthetic
ggggacatgtccaccctgtcttgcaattggacgcggg

SEQ ID NO: 37 - DNA, 40 bp, Artificial Sequence
  Synthetic
gccgcgttgaggtggatcaatgatgatgcttatggcccag

SEQ ID NO: 38 - DNA, 42 bp, Artificial Sequence
  Synthetic
cacgtttggagtgctgcttcacagcccttattctctggtggg

SEQ ID NO: 39 - DNA, 35 bp, Artificial Sequence
  Synthetic
aaatcccgtaggccgccggcgctggaccggcactt

SEQ ID NO: 40 - DNA, 38 bp, Artificial Sequence
  Synthetic
aacacctgcacctcgccggctacccttgtcgtgagcct

SEQ ID NO: 41 - DNA, 39 bp, Artificial Sequence
  Synthetic
acaagacaggccctcccgagtacagcgtccctactgtcc

SEQ ID NO: 42 - DNA, 42 bp, Artificial Sequence
  Synthetic
cggtgcgcacacttggatcaatgcttaatccatcagtcgcgg

SEQ ID NO: 43 - DNA, 39 bp, Artificial Sequence
  Synthetic
cccccttgatgtgttgcagggcttggcaacgatggggaa

SEQ ID NO: 44 - DNA, 41 bp, Artificial Sequence
  Synthetic
gcgagacagaatcttgcgggacgacttctccttggacccca

SEQ ID NO: 45 - DNA, 40 bp, Artificial Sequence
  Synthetic
aaacctctctgtcgggggcctactggcagtgttgttgtgg

SEQ ID NO: 46 - DNA, 41 bp, Artificial Sequence
  Synthetic
gggggctagtaactgaggcggactgccaggtaatccaactg

SEQ ID NO: 47 - DNA, 42 bp, Artificial Sequence
  Synthetic
cggcacaaacaactcccacaacctggcaaacctcttacctgc

SEQ ID NO: 48 - DNA, 41 bp, Artificial Sequence
  Synthetic
tccctggaaggctgggaagtactgcatggtcctatccgact

SEQ ID NO: 49 - DNA, 40 bp, Artificial Sequence
  Synthetic
acacgggcacttgaggtccttcgtcacaatgaccagcatt

SEQ ID NO: 50 - DNA, 37 bp, Artificial Sequence
  Synthetic
acaggaggggtctgcgcagcgagtacgcacctcccca

SEQ ID NO: 51 - DNA, 40 bp, Artificial Sequence
  Synthetic
tgggcgcaagagatctgacttcctgcccactcagccagat

SEQ ID NO: 52 - DNA, 42 bp, Artificial Sequence
  Synthetic
gctctcagtgcggatgtcttgtggcttctcatatgacacccg

SEQ ID NO: 53 - DNA, 35 bp, Artificial Sequence
  Synthetic
gtcatcgccgcagaccaggaaagcggctgcagcag

SEQ ID NO: 54 - DNA, 42 bp, Artificial Sequence
  Synthetic
cgcctgcaagtggagtgagttttgcggtctctacctcttcaa

SEQ ID NO: 55 - DNA, 48 bp, Artificial Sequence
  Synthetic
gctgattttcctcctgttattgctgatttctaaaaaatgttgctcctg

SEQ ID NO: 56 - DNA, 47 bp, Artificial Sequence
  Synthetic
agtctccagctgctttcatttgcttctagtttgaaaaaatcagaagg

SEQ ID NO: 57 - DNA, 42 bp, Artificial Sequence
  Synthetic
gtgtctattgtgtagcctgttcccaacattcccatacaccgg

SEQ ID NO: 58 - DNA, 44 bp, Artificial Sequence
  Synthetic
catggcattctgtgaccctgctttggatagaatggatgaagaac

SEQ ID NO: 59 - DNA, 44 bp, Artificial Sequence
  Synthetic
cgtttccacctacgggtaaacaaacttggctaaaaatatctgtg

SEQ ID NO: 60 - DNA, 43 bp, Artificial Sequence
  Synthetic
cccatcccattgttgatcatattgtgagtcgctggagtgaatg

SEQ ID NO: 61 - DNA, 47 bp, Artificial Sequence
  Synthetic
ttctggaatatgcaggtttctcaaaagagatggtctattagtagcag

SEQ ID NO: 62 - DNA, 47 bp, Artificial Sequence
  Synthetic
aaggttgcaacacttagcgtagaaaggaacagatctatactaaacac

SEQ ID NO: 63 - DNA, 40 bp, Artificial Sequence
  Synthetic
gcatatctggtcccccctcaccaaaagcataacaatggcc

SEQ ID NO: 64 - DNA, 45 bp, Artificial Sequence
  Synthetic
actgtatctcgggttttctttctccccagaatgtgataggcttct

SEQ ID NO: 65 - DNA, 41 bp, Artificial Sequence
  Synthetic
cgcttgtattgttgtacgatcctgtctggctgacacgtaaa

SEQ ID NO: 66 - DNA, 45 bp, Artificial Sequence
  Synthetic
atccctgaactacctcttttcgatgggacaccataaattttgaga

SEQ ID NO: 67 - DNA, 45 bp, Artificial Sequence
  Synthetic
tgccatcctccttctataaaaccagttccccagattgaatcaaga

SEQ ID NO: 68 - DNA, 43 bp, Artificial Sequence
  Synthetic
tttgtggtgtggtgtcattgtggcaaataaatcaattcagccg

SEQ ID NO: 69 - DNA, 47 bp, Artificial Sequence
  Synthetic
aacttgactttgctaagagccatttaaggagagacataagatgaaag

SEQ ID NO: 70 - DNA, 46 bp, Artificial Sequence
  Synthetic
tgggtagtaagcctttataacgtttggatagatctggtcttacagc

SEQ ID NO: 71 - DNA, 42 bp, Artificial Sequence
  Synthetic
cccattatgcctaggccagcagcatcattattgtctttgact

SEQ ID NO: 72 - DNA, 45 bp, Artificial Sequence
  Synthetic
aaccatggcatctcttataccatcacacattagtagtagcgagtg

SEQ ID NO: 73 - DNA, 48 bp, Artificial Sequence
  Synthetic
gtttgtttgttggtcttctgttggttgatttctgatcagttaccaatc

SEQ ID NO: 74 - DNA, 50 bp, Artificial Sequence
  Synthetic
tgggtgtggatatttgtttcactagccagcagatttacttataaaagaac

SEQ ID NO: 75 - DNA, 48 bp, Artificial Sequence
  Synthetic
cctgagtaagggatgatttttgcatacacacttgaaaatataacaacc

SEQ ID NO: 76 - DNA, 46 bp, Artificial Sequence
  Synthetic
ctgatgaacaatgacttgggatgattgtggttcaactaatcaaaca

SEQ ID NO: 77 - DNA, 40 bp, Artificial Sequence
  Synthetic
tgattgagagtgtcccaggtctccaaaaacaaggaccaac

SEQ ID NO: 78 - DNA, 43 bp, Artificial Sequence
  Synthetic
gcaaggtacaaagttgaacacttcaagcccaccacaaaacaac

SEQ ID NO: 79 - DNA, 43 bp, Artificial Sequence
  Synthetic
ttcccttttgacttgtgtgttctatcagaactacactgctcac

SEQ ID NO: 80 - DNA, 49 bp, Artificial Sequence
  Synthetic
gcatttgttttgaggattggcaaccaaatcaaccagaatcaaaatcaac

SEQ ID NO: 81 - DNA, 45 bp, Artificial Sequence
  Synthetic
actccatttgataagctgactacagctagaaggggaagtgaacaa

SEQ ID NO: 82 - DNA, 42 bp, Artificial Sequence
  Synthetic
actgatcctgcattgtcacagtaaagggtccaacatctgttt

SEQ ID NO: 83 - DNA, 42 bp, Artificial Sequence
  Synthetic
accactcagttgatccttgcttaactgctcctatactgcaag

SEQ ID NO: 84 - DNA, 39 bp, Artificial Sequence
  Synthetic
cactccaactacaccgagggaaataagtggagctgcaga

SEQ ID NO: 85 - DNA, 46 bp, Artificial Sequence
  Synthetic
ctgagttctctttctttgcctgtatcaaagttatcttaacaaccct

SEQ ID NO: 86 - DNA, 46 bp, Artificial Sequence
  Synthetic
tctgtagtggtatagtgttgtgcacaatagactggcagttactgag

SEQ ID NO: 87 - DNA, 46 bp, Artificial Sequence
  Synthetic
ggcgatgcaaatagttaacacttaacttagcataggaattcttggg

SEQ ID NO: 88 - DNA, 42 bp, Artificial Sequence
  Synthetic
ggaggctgcacgacactcatacatcactcccctgtgaggaac

SEQ ID NO: 89 - DNA, 39 bp, Artificial Sequence
  Synthetic
acgatctgaccgccacccgaccaaacgtaacaccaaccg

SEQ ID NO: 90 - DNA, 39 bp, Artificial Sequence
  Synthetic
tggcagcgcctccaagaggcatcgatacccttacgtgcg

SEQ ID NO: 91 - DNA, 35 bp, Artificial Sequence
  Synthetic
tcgaggcgttaccctcgcggccgatgccatcctgc

SEQ ID NO: 92 - DNA, 40 bp, Artificial Sequence
  Synthetic
ttgtgggatccggagcagcttgatgatgaactggtcccct

SEQ ID NO: 93 - DNA, 41 bp, Artificial Sequence
  Synthetic
tgggcaaaatcggtaaggcgtttcaactcttcaggctgtcc

SEQ ID NO: 94 - DNA, 42 bp, Artificial Sequence
  Synthetic
tccgcacactttggtgaatccatccttaacaacaccaggcca

SEQ ID NO: 95 - DNA, 38 bp, Artificial Sequence
  Synthetic
cggacctgtccctgtcttccaggcacaggctggaagcg

SEQ ID NO: 96 - DNA, 37 bp, Artificial Sequence
  Synthetic
acaagaccgtgcgtcccggcggctttggagaacctcg

SEQ ID NO: 97 - DNA, 40 bp, Artificial Sequence
  Synthetic
ggtccgaagatggccaggagttgtgtagtacacccgaccc

SEQ ID NO: 98 - DNA, 39 bp, Artificial Sequence
  Synthetic
cgggagaagacgactggttccaagactgggcgcacaacg

SEQ ID NO: 99 - DNA, 42 bp, Artificial Sequence
  Synthetic
cccgtggtagacagtccagcataactgctacccaaaccttcc

SEQ ID NO: 100 - DNA, 38 bp, Artificial Sequence
  Synthetic
aaagtccaccgctttagccactcacgccgtgggcctat

SEQ ID NO: 101 - DNA, 42 bp, Artificial Sequence
  Synthetic
aggaacttgccgtaggtggagtcctaatatcaggaccggggt

SEQ ID NO: 102 - DNA, 40 bp, Artificial Sequence
  Synthetic
cgagctcgtcgcacttcttctggtgatcaaggggggaaga

SEQ ID NO: 103 - DNA, 40 bp, Artificial Sequence
  Synthetic
ggacgagtcgaacatgccggagcaggactggcagggggaa

SEQ ID NO: 104 - DNA, 38 bp, Artificial Sequence
  Synthetic
gggtgttggcccatggaggccatcgtgggaccagatgt

SEQ ID NO: 105 - DNA, 41 bp, Artificial Sequence
  Synthetic
tgcttgaactgctcagcgagcgatggaagagtgctctcagc

SEQ ID NO: 106 - DNA, 39 bp, Artificial Sequence
  Synthetic
aaggcagtagcggcaccggtcaacatattgggggggtgg

SEQ ID NO: 107 - DNA, 37 bp, Artificial Sequence
  Synthetic
tgcatcgctctccggcacgctaatagccttcgcctcc

SEQ ID NO: 108 - DNA, 40 bp, Artificial Sequence
  Synthetic
gtcctaggaccgacgatcctcattatgcacactcgctgcc

SEQ ID NO: 109 - DNA, 40 bp, Artificial Sequence
  Synthetic
cgggtactcgtggagtcctactgcgcctacacaggtttgc

SEQ ID NO: 110 - DNA, 38 bp, Artificial Sequence
  Synthetic
agcggatcgaaggagtccagaacaggagatgggcggca

SEQ ID NO: 111 - DNA, 40 bp, Artificial Sequence
  Synthetic
gccggaagttgaggagctgccctatctactgccttggccg

SEQ ID NO: 112 - DNA, 40 bp, Artificial Sequence
  Synthetic
ctttggcaagcactgcgtgaagcaactcgttgctacgcca

SEQ ID NO: 113 - DNA, 41 bp, Artificial Sequence
  Synthetic
acacgatgagacgagctggctgaacgaggttttctgcgttc

SEQ ID NO: 114 - DNA, 42 bp, Artificial Sequence
  Synthetic
gcccccaacataaagcctctcaaccaatgttgtgacctggac

SEQ ID NO: 115 - DNA, 41 bp, Artificial Sequence
  Synthetic
ggggttgtagggtcacgggtaaacatcatgctcctccaacg

SEQ ID NO: 116 - DNA, 42 bp, Artificial Sequence
  Synthetic
tgcggccaccctattgatttcattcaaagactccatggcctc

SEQ ID NO: 117 - DNA, 43 bp, Artificial Sequence
  Synthetic
cccatattctttcattgccttttccactttgtgcgacaatgct

SEQ ID NO: 118 - DNA, 43 bp, Artificial Sequence
  Synthetic
ggagaaatttaggcttctcaactccgaacaatggcctggacag

SEQ ID NO: 119 - DNA, 43 bp, Artificial Sequence
  Synthetic
tgtctttggaattttctcctcgtttattacctcctggcttgga

SEQ ID NO: 120 - DNA, 44 bp, Artificial Sequence
  Synthetic
cttgcaatgtgctcaattggagttgacagattcaagttggattg

SEQ ID NO: 121 - DNA, 50 bp, Artificial Sequence
  Synthetic
tcggatcagtaagagagaattccatttataaaaggaagatcccatttgag

SEQ ID NO: 122 - DNA, 44 bp, Artificial Sequence
  Synthetic
gtctttttctttgacagaagactcggcccttttcaatcccttca

SEQ ID NO: 123 - DNA, 41 bp, Artificial Sequence
  Synthetic
gagggccttccactttctgctattgaggaattgtcaaggga

SEQ ID NO: 124 - DNA, 45 bp, Artificial Sequence
  Synthetic
ccaagcgaatctctgtagagttttactcatcggaggacttgaatg

SEQ ID NO: 125 - DNA, 43 bp, Artificial Sequence
  Synthetic
ggggttcagtagcagacattgcgaaaccggtacatataaaagc

SEQ ID NO: 126 - DNA, 41 bp, Artificial Sequence
  Synthetic
caggtcaaacggttctggttttaatgcatggaaatgtggct

SEQ ID NO: 127 - DNA, 43 bp, Artificial Sequence
  Synthetic
gcttccacaaaaaaccatccattaccatggcggataaccaagg

SEQ ID NO: 128 - DNA, 42 bp, Artificial Sequence
  Synthetic
ccgggggcttaggtccttttctggcagtccgtatgtaagtcc

SEQ ID NO: 129 - DNA, 42 bp, Artificial Sequence
  Synthetic
aggattgccatctaatgcattgctgctacaacacaatgctgg

SEQ ID NO: 130 - DNA, 40 bp, Artificial Sequence
  Synthetic
gtgttgctagggtctccattctgtcacgtttagcgctgaa

SEQ ID NO: 131 - DNA, 41 bp, Artificial Sequence
  Synthetic
gttcggtgctgtatactgtctttgcacaaggccattgaact

SEQ ID NO: 132 - DNA, 47 bp, Artificial Sequence
  Synthetic
ccacataatacactttgtgttctgcaggtgtgcagtaatatagatgc

SEQ ID NO: 133 - DNA, 44 bp, Artificial Sequence
  Synthetic
gggttaccctcatatacaggattgtcaggaccctgcctttttac

SEQ ID NO: 134 - DNA, 41 bp, Artificial Sequence
  Synthetic
aggacgtgcgggaacaaatgatacacctatacccacatcct

SEQ ID NO: 135 - DNA, 43 bp, Artificial Sequence
  Synthetic
gaggtagctacatcaaggggtaggctatggattttaaaaccct

SEQ ID NO: 136 - DNA, 44 bp, Artificial Sequence
  Synthetic
cccgttgtaaccagtatggcttataactcctagtggctctatgg

SEQ ID NO: 137 - DNA, 48 bp, Artificial Sequence
  Synthetic
gggttataccaaagttccagtcctcagatgttatggcctatattcatg

SEQ ID NO: 138 - DNA, 35 bp, Artificial Sequence
  Synthetic
tcaggaggcaccacaggcgccgccgccttacctga

SEQ ID NO: 139 - DNA, 39 bp, Artificial Sequence
  Synthetic
acgagcccccaactgtgtactacaactctgctggctcgg

SEQ ID NO: 140 - DNA, 40 bp, Artificial Sequence
  Synthetic
ctgggcttgggtttggatgagtccctcctagccagcctac

SEQ ID NO: 141 - DNA, 39 bp, Artificial Sequence
  Synthetic
tggcagtggggtcaaactgcggaagcccccagtttatgc

SEQ ID NO: 142 - DNA, 40 bp, Artificial Sequence
  Synthetic
gtctttggcactccctggcaaaggcgagaataccagcaac

SEQ ID NO: 143 - DNA, 38 bp, Artificial Sequence
  Synthetic
ggctgatttggggggggtttcctggacccccaaagaca

SEQ ID NO: 144 - DNA, 42 bp, Artificial Sequence
  Synthetic
ggcaagattacaggcggcctttggtcgtgatgccttacaaca

SEQ ID NO: 145 - DNA, 39 bp, Artificial Sequence
  Synthetic
tcgccaggttccattggctttggaggcaggccatatcga

SEQ ID NO: 146 - DNA, 40 bp, Artificial Sequence
  Synthetic
gcatttcgaacagggtgggactccggcactagatacgcct

SEQ ID NO: 147 - DNA, 40 bp, Artificial Sequence
  Synthetic
gctggcgtaaggtaggagttccctgggcgctacctgaact

SEQ ID NO: 148 - DNA, 39 bp, Artificial Sequence
  Synthetic
tggggtaggggggcatgtagccactgtggtgttccagtc

SEQ ID NO: 149 - DNA, 40 bp, Artificial Sequence
  Synthetic
gcgaacgtggtgcaaatagacgaaggcaggtcctctcagg

SEQ ID NO: 150 - DNA, 46 bp, Artificial Sequence
  Synthetic
acacatattgaggaagtcttgggaataggcaagcctagctacataa

SEQ ID NO: 151 - DNA, 40 bp, Artificial Sequence
  Synthetic
gcgcttaccgggatgagagcatggaaaggaccacaggagg

SEQ ID NO: 152 - DNA, 42 bp, Artificial Sequence
  Synthetic
gggcaggattgcagggtttagacatcctcggtgattacagcc

SEQ ID NO: 153 - DNA, 41 bp, Artificial Sequence
  Synthetic
taggggcaggtccatgattgctcttattcagacccttgttc

SEQ ID NO: 154 - DNA, 39 bp, Artificial Sequence
  Synthetic
gcgggatcctagcgtgggacataactccctcatcctgcc

SEQ ID NO: 155 - DNA, 40 bp, Artificial Sequence
  Synthetic
ggctggaggcgatgtggttgaaaccctgagtcatccctgt

SEQ ID NO: 156 - DNA, 37 bp, Artificial Sequence
  Synthetic
agagcgggagaaagaggaggaatgcgccgtgccttct

SEQ ID NO: 157 - DNA, 40 bp, Artificial Sequence
  Synthetic
tttgcctgttccatgcccggccaaggataatagcccgtcc

SEQ ID NO: 158 - DNA, 42 bp, Artificial Sequence
  Synthetic
ggaggggagtcgagggataagggagcatcagatcacctggga

SEQ ID NO: 159 - DNA, 43 bp, Artificial Sequence
  Synthetic
tgtagtactaaagatggctggcctttggacatttaccgatggc

SEQ ID NO: 160 - DNA, 39 bp, Artificial Sequence
  Synthetic
acgtcagggcctagcctgagtaaggctctgacgtctccc

SEQ ID NO: 161 - DNA, 41 bp, Artificial Sequence
  Synthetic
ggatggcggcctcaggtaaggataaaagcgtggggacagtt

SEQ ID NO: 162 - DNA, 40 bp, Artificial Sequence
  Synthetic
gccatatggtccactgtggttaatctgatgtcgcagtctc

SEQ ID NO: 163 - DNA, 44 bp, Artificial Sequence
  Synthetic
ttgtcattggtccatttctattccaggtcagatcgagtaatggt

SEQ ID NO: 164 - DNA, 46 bp, Artificial Sequence
  Synthetic
aggagaaattttgcaatcttggagtggatactaacgtcggaatcac

SEQ ID NO: 165 - DNA, 45 bp, Artificial Sequence
  Synthetic
ctagtggatctgctgatactgctcaaagtctaattattgcagcca

SEQ ID NO: 166 - DNA, 44 bp, Artificial Sequence
  Synthetic
gcacccttattttcaatgtttggagagcgggtcatcaatcaaga

SEQ ID NO: 167 - DNA, 47 bp, Artificial Sequence
  Synthetic
gcacttttgcatctttctgaaaatggacctgaatttcgttaataggg

SEQ ID NO: 168 - DNA, 41 bp, Artificial Sequence
  Synthetic
gtttcactgacctcctcaggagttgaccggtttttgagagt

SEQ ID NO: 169 - DNA, 46 bp, Artificial Sequence
  Synthetic
ccctcatttgttggaatagagtccttctttagttcctaaggccatt

SEQ ID NO: 170 - DNA, 40 bp, Artificial Sequence
  Synthetic
tccggatgtgccttcatctgaacaattctcggaaaggatg

SEQ ID NO: 171 - DNA, 40 bp, Artificial Sequence
  Synthetic
caaagagggcctgccactttcttgaggaaatgtcaaggga

SEQ ID NO: 172 - DNA, 41 bp, Artificial Sequence
  Synthetic
tccattcaagtcctccgatgagcttccaggacatactgctg

SEQ ID NO: 173 - DNA, 40 bp, Artificial Sequence
  Synthetic
tccatggctgtatggaggatctccagcgcaaaatgccata

SEQ ID NO: 174 - DNA, 47 bp, Artificial Sequence
  Synthetic
acttccattgtttcaaggcatgaattatggctttccttgaagaatcc

SEQ ID NO: 175 - DNA, 46 bp, Artificial Sequence
  Synthetic
agcctctcttattcagtctttgtttaaggagagtaagagacaacat

SEQ ID NO: 176 - DNA, 41 bp, Artificial Sequence
  Synthetic
tctcacaacatttgccagtttgggcgaaaagcttgaacagt

SEQ ID NO: 177 - DNA, 46 bp, Artificial Sequence
  Synthetic
gctggtatttgtgttcgaatcttcatgttctcaaacaaaatggcaa

SEQ ID NO: 178 - DNA, 45 bp, Artificial Sequence
  Synthetic
agcaaaatcgtcggatgattggcaaaagaaatacaccaagacaat

SEQ ID NO: 179 - DNA, 46 bp, Artificial Sequence
  Synthetic
ccaaggtcattgtttatcatgttgttctggagtaaatgaatcagct

SEQ ID NO: 180 - DNA, 39 bp, Artificial Sequence
  Synthetic
cgccaacagtaaggtgacgacagctggtgcatgtgggga

SEQ ID NO: 181 - DNA, 40 bp, Artificial Sequence
  Synthetic
gcctcgagcttgggcttctccttttactcggaggccacgg

SEQ ID NO: 182 - DNA, 42 bp, Artificial Sequence
  Synthetic
agtttcggggattgtgaaccgtcagatcacacgctctttcct

SEQ ID NO: 183 - DNA, 38 bp, Artificial Sequence
  Synthetic
agcagcgtggcggcgaaagtagacggggtagggagatc

SEQ ID NO: 184 - DNA, 39 bp, Artificial Sequence
  Synthetic
gcagtaccactaccgccacccaacggataacgcggtggc

SEQ ID NO: 185 - DNA, 43 bp, Artificial Sequence
  Synthetic
aatgttgcgttgttggagagtatcaactcttactgctctctcc

SEQ ID NO: 186 - DNA, 40 bp, Artificial Sequence
  Synthetic
caagaagcgaccgcagtgggtcataaagctgttgaccggc

SEQ ID NO: 187 - DNA, 40 bp, Artificial Sequence
  Synthetic
gcgtgctgcatagcttggcgtacgggagatacaaggagcg

SEQ ID NO: 188 - DNA, 38 bp, Artificial Sequence
  Synthetic
cggtgctttctgcagtgtgtgggcagccggcagaggat

SEQ ID NO: 189 - DNA, 38 bp, Artificial Sequence
  Synthetic
cgaaacgagaggctcagccgctgttacatcgccggcgg

SEQ ID NO: 190 - DNA, 36 bp, Artificial Sequence
  Synthetic
tccacaggtaccgcgtctgtcactcggaccgctcct

SEQ ID NO: 191 - DNA, 34 bp, Artificial Sequence
  Synthetic
ccggcggctgcagttgttgcgaactgtgcgtgcc

SEQ ID NO: 192 - DNA, 40 bp, Artificial Sequence
  Synthetic
cgcctcgttttcctcttcggtgcctgctgtgctactggtg

SEQ ID NO: 193 - DNA, 40 bp, Artificial Sequence
  Synthetic
gcgcctctctcatggatccactggtgagctggggaacagg

SEQ ID NO: 194 - DNA, 39 bp, Artificial Sequence
  Synthetic
tgacgtacccgccgggaacttccacgctgttttcgaaac

SEQ ID NO: 195 - DNA, 36 bp, Artificial Sequence
  Synthetic
tggagtttgcgcgcgtcgcaggtagcgcatgcagtg

SEQ ID NO: 196 - DNA, 37 bp, Artificial Sequence
  Synthetic
accccgtgcaacgtcgagatgcgcttcagatcgtgga

SEQ ID NO: 197 - DNA, 39 bp, Artificial Sequence
  Synthetic
gcagctatgctcgatgaccgagggctccagaaacaggca

SEQ ID NO: 198 - DNA, 36 bp, Artificial Sequence
  Synthetic
gccgtcaacagcgtgccttttggatgggctccgggt

SEQ ID NO: 199 - DNA, 40 bp, Artificial Sequence
  Synthetic
gccgacttggaggactttgccaactcctgctgctcactgt

SEQ ID NO: 200 - DNA, 37 bp, Artificial Sequence
  Synthetic
gccgtagttgtcgcggtcccaggacgtggtgacctcg

SEQ ID NO: 201 - DNA, 37 bp, Artificial Sequence
  Synthetic
cgactgccgcatggtttcctctcaccaagggcgggct

SEQ ID NO: 202 - DNA, 39 bp, Artificial Sequence
  Synthetic
cgctcgtcagcaggtagaaggctcggacaagatcacggc

SEQ ID NO: 203 - DNA, 37 bp, Artificial Sequence
  Synthetic
cccttgaacatcccgcagcacctgcggggaaacgaga

SEQ ID NO: 204 - DNA, 36 bp, Artificial Sequence
  Synthetic
gcgcggtcattctggccaatctggccgatggctgtg

SEQ ID NO: 205 - DNA, 33 bp, Artificial Sequence
  Synthetic
gctcgcagtagtggcgcacgtgtgcgcgctctt

SEQ ID NO: 206 - DNA, 38 bp, Artificial Sequence
  Synthetic
agtgcgtatacggggctgggagggctgctccaactttg

SEQ ID NO: 207 - DNA, 36 bp, Artificial Sequence
  Synthetic
aagcagccgcgtcttaagcgattgcgggacctgcgc

SEQ ID NO: 208 - DNA, 37 bp, Artificial Sequence
  Synthetic
ctacgcacctgtggccgcagggtgcacagcgacagtg

SEQ ID NO: 209 - DNA, 35 bp, Artificial Sequence
  Synthetic
taccagcggcccatggtgccgccgcggtagagcat

SEQ ID NO: 210 - DNA, 38 bp, Artificial Sequence
  Synthetic
ccgcgcacttttgccaagtcgccgctcagattccagga

SEQ ID NO: 211 - DNA, 36 bp, Artificial Sequence
  Synthetic
tggcgcagttctggcacggccaccgggaacaaagcg

SEQ ID NO: 212 - DNA, 40 bp, Artificial Sequence
  Synthetic
agacgcgcgtactcggaaacactacatcaaagggtcggct

SEQ ID NO: 213 - DNA, 42 bp, Artificial Sequence
  Synthetic
ccagacctccagcaacaccgtcatcagcaacgtgttatcggc

SEQ ID NO: 214 - DNA, 35 bp, Artificial Sequence
  Synthetic
acggtttccacgccaccgcgcagtacgggggtcga

SEQ ID NO: 215 - DNA, 35 bp, Artificial Sequence
  Synthetic
ctgcgcgaagaactgggctgaactcgcgacccacg

SEQ ID NO: 216 - DNA, 36 bp, Artificial Sequence
  Synthetic
cgtggttggagcagcaccagggtgccgcctggaaca

SEQ ID NO: 217 - DNA, 36 bp, Artificial Sequence
  Synthetic
ttctggcggtgggtcccgacgaagcccacactgacg

SEQ ID NO: 218 - DNA, 36 bp, Artificial Sequence
  Synthetic
ggcgtccgaatggtgggtagcacgccgatgtgcagc

SEQ ID NO: 219 - DNA, 37 bp, Artificial Sequence
  Synthetic
acgcggccattttgtgtttggcgggctctcgtcctgt

SEQ ID NO: 220 - DNA, 40 bp, Artificial Sequence
  Synthetic
tgtcaaccgtcgcatcacgcccagcccagcttttgtatga

SEQ ID NO: 221 - DNA, 39 bp, Artificial Sequence
  Synthetic
cgttgtggtagaacggcaaccggcttcctgcgacaccag

SEQ ID NO: 222 - DNA, 39 bp, Artificial Sequence
  Synthetic
cgcagattctcggccaacagctacccaccacgcgtttcg

SEQ ID NO: 223 - DNA, 38 bp, Artificial Sequence
  Synthetic
gcacccaggacctccggtacccgacaccgatcacgaag

SEQ ID NO: 224 - DNA, 38 bp, Artificial Sequence
  Synthetic
ccgcagaaagtcgaagatgcccggcaccaccgagacgt

SEQ ID NO: 225 - DNA, 40 bp, Artificial Sequence
  Synthetic
gtgagcaccatcagcacctgatcggaatgtcacaacgccg

SEQ ID NO: 226 - DNA, 41 bp, Artificial Sequence
  Synthetic
ggctgcagcgctttcagaattgacattcacgacctagacgc

SEQ ID NO: 227 - DNA, 37 bp, Artificial Sequence
  Synthetic
ttcgggtagctgcaggccgggccttggtacaggagca

SEQ ID NO: 228 - DNA, 39 bp, Artificial Sequence
  Synthetic
cggttgggcgcgttgatctagcgcaccaaccactggagg

SEQ ID NO: 229 - DNA, 36 bp, Artificial Sequence
  Synthetic
cagtccgccgctcattttgtgtgagcacggcgcaga

SEQ ID NO: 230 - DNA, 38 bp, Artificial Sequence
  Synthetic
tgatgcgggtgcgtagggtgctggcttttctggaggaa

SEQ ID NO: 231 - DNA, 35 bp, Artificial Sequence
  Synthetic
gaaagcgaagacggcgcccacgtggcaggcggtct

SEQ ID NO: 232 - DNA, 41 bp, Artificial Sequence
  Synthetic
gtcatggccaatcgtcgtctccagcctggtggaactcatca

SEQ ID NO: 233 - DNA, 38 bp, Artificial Sequence
  Synthetic
ggacccgaaaacgagggcgggctttcttggcgtacagc

SEQ ID NO: 234 - DNA, 38 bp, Artificial Sequence
  Synthetic
cgtgcaggatgacgtggattcttccgcgtcctcgtcga

SEQ ID NO: 235 - DNA, 37 bp, Artificial Sequence
  Synthetic
ggtgagagtagtggtggggctgtccacgccgcctcat

SEQ ID NO: 236 - DNA, 36 bp, Artificial Sequence
  Synthetic
gagaggaggagagccggcatagttgcacacggccga

SEQ ID NO: 237 - DNA, 35 bp, Artificial Sequence
  Synthetic
cggcgtcggcgtttccaactggcgccctggtacga

SEQ ID NO: 238 - DNA, 36 bp, Artificial Sequence
  Synthetic
catctctaccgccgccgtgcaagggcggcgacatct

SEQ ID NO: 239 - DNA, 39 bp, Artificial Sequence
  Synthetic
tgcgacgaacacgaagctctccgggtgacgttgtggatg

SEQ ID NO: 240 - DNA, 36 bp, Artificial Sequence
  Synthetic
caccgacacagcagcaccaggtccgtcgccgctgtt

SEQ ID NO: 241 - DNA, 41 bp, Artificial Sequence
  Synthetic
gcgtccgacgatgtgctcttctaacttgtccatcagcgacg

SEQ ID NO: 242 - DNA, 38 bp, Artificial Sequence
  Synthetic
cgtcttttcggcgctcaacaagaggcgcacctccgaaa

SEQ ID NO: 243 - DNA, 35 bp, Artificial Sequence
  Synthetic
acgcccgccagaagtacgctcggtaggcacgcgat

SEQ ID NO: 244 - DNA, 39 bp, Artificial Sequence
  Synthetic
tctgttggcggggctcacgcgtcgtaacaaagcacaggc

SEQ ID NO: 245 - DNA, 37 bp, Artificial Sequence
  Synthetic
agaggctacccgaccgtagcacaaccgcaacgatccc

SEQ ID NO: 246 - DNA, 38 bp, Artificial Sequence
  Synthetic
gacggtcgtggtctcctcggctggaggggtccggaaca

SEQ ID NO: 247 - DNA, 39 bp, Artificial Sequence
  Synthetic
acagtacgacggcaacccaacgtcttcttgcggtaccgg

SEQ ID NO: 248 - DNA, 40 bp, Artificial Sequence
  Synthetic
catcctgctgtcacacgacgaactgttgacggatgtgcaa

SEQ ID NO: 249 - DNA, 37 bp, Artificial Sequence
  Synthetic
aagcgcgtgcccacccaagtcgtcgtcatcgaaaggc

SEQ ID NO: 250 - DNA, 39 bp, Artificial Sequence
  Synthetic
acctggcatcgcagcctctttccgagaaacggctgtcgg

SEQ ID NO: 251 - DNA, 35 bp, Artificial Sequence
  Synthetic
tggcttacgacgctgacgcggcggcccagaaaacc

SEQ ID NO: 252 - DNA, 42 bp, Artificial Sequence
  Synthetic
ggtcgaacctcataacggtgggcacgcgtcctatgatgagtt

SEQ ID NO: 253 - DNA, 40 bp, Artificial Sequence
  Synthetic
cttgcgcttaccgatccgcttagattcgacggggaacgct

SEQ ID NO: 254 - DNA, 36 bp, Artificial Sequence
  Synthetic
gctcactcaacaccgccgtgacacgcgctttgggag

SEQ ID NO: 255 - DNA, 40 bp, Artificial Sequence
  Synthetic
acgtgacgatcaaaagtgcccgacgctactacatgcccct

SEQ ID NO: 256 - DNA, 36 bp, Artificial Sequence
  Synthetic
acgatgatggcccgcgacggaatttgcccgtgcgga

SEQ ID NO: 257 - DNA, 39 bp, Artificial Sequence
  Synthetic
gcaaccagtgctccactacgtcacgaccagtctccggac

SEQ ID NO: 258 - DNA, 35 bp, Artificial Sequence
  Synthetic
acatggacgccgcctctgcccgttcttcccgcgga

SEQ ID NO: 259 - DNA, 38 bp, Artificial Sequence
  Synthetic
atgcaaagacggcgcgggacgtggatccccattatccc

SEQ ID NO: 260 - DNA, 35 bp, Artificial Sequence
  Synthetic
tgttgtgtccgccgctgctggtcaccgtggtcagt

SEQ ID NO: 261 - DNA, 36 bp, Artificial Sequence
  Synthetic
cccgggcactgatcctgaccagcgtgagagccccgt

SEQ ID NO: 262 - DNA, 39 bp, Artificial Sequence
  Synthetic
cacgctgaccggcgatcaggcggaaaaagtggatgcggc

SEQ ID NO: 263 - DNA, 34 bp, Artificial Sequence
  Synthetic
ttggcccacgacgcctgacgcagcgcaaaggcca

SEQ ID NO: 264 - DNA, 40 bp, Artificial Sequence
  Synthetic
gcgactcctggacctgcgtaaaaacagcagagaaccgagg

SEQ ID NO: 265 - DNA, 37 bp, Artificial Sequence
  Synthetic
agatgtggcaggcgcgtctactggttctgctgacgcg

SEQ ID NO: 266 - DNA, 38 bp, Artificial Sequence
  Synthetic
acaaccccacgggccgaagagcgcgtacacatagatcg

SEQ ID NO: 267 - DNA, 34 bp, Artificial Sequence
  Synthetic
tctcggtgctgggcgcttggacgccagtcgcatg

SEQ ID NO: 268 - DNA, 39 bp, Artificial Sequence
  Synthetic
agggactggaggtgcgcgtagatacgtaacgtgtgcgag

SEQ ID NO: 269 - DNA, 37 bp, Artificial Sequence
  Synthetic
cgctgtgctggcatcgagttacggctggtgagtccac

SEQ ID NO: 270 - DNA, 40 bp, Artificial Sequence
  Synthetic
ccatgacctacgtgcgcaagtttcctggcacttgacgagc

SEQ ID NO: 271 - DNA, 40 bp, Artificial Sequence
  Synthetic
tcgctcgaccgttcgtacgaaagtaatggtctgcagctgc

SEQ ID NO: 272 - DNA, 40 bp, Artificial Sequence
  Synthetic
gcggtctccacgtcaggtacgaatcgagtcttcgggggtg

SEQ ID NO: 273 - DNA, 36 bp, Artificial Sequence
  Synthetic
aacgcgctgcacgaccacttccatgttacgcggcag

SEQ ID NO: 274 - DNA, 36 bp, Artificial Sequence
  Synthetic
cggaacccgccatgcaacgagcaccgcccatgggtt

SEQ ID NO: 275 - DNA, 38 bp, Artificial Sequence
  Synthetic
cgctcgagctcctgcctaaagtccggcgctggtcttga

SEQ ID NO: 276 - DNA, 40 bp, Artificial Sequence
  Synthetic
tcccagtaacagacgacccagtgcctgtccgatacacgtg

SEQ ID NO: 277 - DNA, 41 bp, Artificial Sequence
  Synthetic
gccacgtggttttcgagaacgtgacgttgttgttgcggatc

SEQ ID NO: 278 - DNA, 37 bp, Artificial Sequence
  Synthetic
gggagcgcggtggaagacaaccgtcagaatcgacggt

SEQ ID NO: 279 - DNA, 35 bp, Artificial Sequence
  Synthetic
tctcccccgattccagcgtgtcaacggcggtcgga

SEQ ID NO: 280 - DNA, 37 bp, Artificial Sequence
  Synthetic
cgctcatccgcgtgctctgaagggctgttcgatgtgg

SEQ ID NO: 281 - DNA, 37 bp, Artificial Sequence
  Synthetic
cacggcgtgtccttgctacccacctgcgagttgaggc

SEQ ID NO: 282 - DNA, 37 bp, Artificial Sequence
  Synthetic
ttcacgtccgggtggctgccgtgttcgagcacctgac

SEQ ID NO: 283 - DNA, 42 bp, Artificial Sequence
  Synthetic
ggcgctgatgatgttgacgtcgcgtagccacctgttggaacc

SEQ ID NO: 284 - DNA, 38 bp, Artificial Sequence
  Synthetic
agatgatgcaccccgaactcgccgcagaaggccatgag

SEQ ID NO: 285 - DNA, 35 bp, Artificial Sequence
  Synthetic
gcctaacctccgctcgcactggcggccgaatctcc

SEQ ID NO: 286 - DNA, 41 bp, Artificial Sequence
  Synthetic
gcggaggaagattcgtctgagccgtcttcgtcgtccctagt

SEQ ID NO: 287 - DNA, 36 bp, Artificial Sequence
  Synthetic
ggccgacgctggttctcctcgtgatgcgtgacggag

SEQ ID NO: 288 - DNA, 39 bp, Artificial Sequence
  Synthetic
ggtcgcagatgagcagcttctgcgcgaatgttaccaccc

SEQ ID NO: 289 - DNA, 36 bp, Artificial Sequence
  Synthetic
ttctccaacgcgcggcaggcatgggtacggaggcgt

SEQ ID NO: 290 - DNA, 42 bp, Artificial Sequence
  Synthetic
cgtccaggttactcggggaacagcataatctgcgaggaggac

SEQ ID NO: 291 - DNA, 39 bp, Artificial Sequence
  Synthetic
tcgtcctccccttcgtccggtctctacgctcctacgaca

SEQ ID NO: 292 - DNA, 39 bp, Artificial Sequence
  Synthetic
accactagcttggctacgtggagcactgggcgtggaaac

SEQ ID NO: 293 - DNA, 40 bp, Artificial Sequence
  Synthetic
tcgtcgcgctccagcacatacctacgatttggccatgtcg

SEQ ID NO: 294 - DNA, 41 bp, Artificial Sequence
  Synthetic
cgcgctctcttgaacacgacaattggcgcaaactttttggc

SEQ ID NO: 295 - DNA, 37 bp, Artificial Sequence
  Synthetic
cggatctgcggctcaaacacccgcgaagtgcagcagg

SEQ ID NO: 296 - DNA, 37 bp, Artificial Sequence
  Synthetic
gactttacggtgcgcggcgatggaaaccagcagcccg

SEQ ID NO: 297 - DNA, 40 bp, Artificial Sequence
  Synthetic
tctgccgccaccaaaagatctgtggcggtcaccactttca

SEQ ID NO: 298 - DNA, 35 bp, Artificial Sequence
  Synthetic
tttccctaccgcgcgctggcgctccacaccaacag

SEQ ID NO: 299 - DNA, 36 bp, Artificial Sequence
  Synthetic
tccacgatgtcggcgatgactccagcgcctgcagat

SEQ ID NO: 300 - DNA, 41 bp, Artificial Sequence
  Synthetic
cccccagggcgttgtaaaagtccttatgctgcgctacatgc

SEQ ID NO: 301 - DNA, 36 bp, Artificial Sequence
  Synthetic
ggggatgtcgtgggtctcctccagagcgtgccggta

SEQ ID NO: 302 - DNA, 40 bp, Artificial Sequence
  Synthetic
gcgcttgagaaaaatgtcgcggggcgctgctttctttcga

SEQ ID NO: 303 - DNA, 36 bp, Artificial Sequence
  Synthetic
agccctcgagcgtgtacgtcggctccttcgtgggca

SEQ ID NO: 304 - DNA, 39 bp, Artificial Sequence
  Synthetic
tgcagactcttgccctgcgctttgtgctcgacgttaacg

SEQ ID NO: 305 - DNA, 39 bp, Artificial Sequence
  Synthetic
acagcctggatctcaccgtcagcctccggatcacatggt

SEQ ID NO: 306 - DNA, 36 bp, Artificial Sequence
  Synthetic
cgctggatgacggtgatgcgtgtacacggccggcga

SEQ ID NO: 307 - DNA, 40 bp, Artificial Sequence
  Synthetic
actgctgtggtgttgccttctggtaggagcgacgctgacg

SEQ ID NO: 308 - DNA, 42 bp, Artificial Sequence
  Synthetic
gccacgacaaacactaccgtcgtgaagtgacgttaggggagg

SEQ ID NO: 309 - DNA, 39 bp, Artificial Sequence
  Synthetic
tgcatccgtccggtggtgcccacatctggtatacacccg

SEQ ID NO: 310 - DNA, 39 bp, Artificial Sequence
  Synthetic
ttccgtgctggcgatcgcgtacttttcactcccgggtgc

SEQ ID NO: 311 - DNA, 41 bp, Artificial Sequence
  Synthetic
tctacccaccctgcgagacatcgcgtacaggagtcctaggt

SEQ ID NO: 312 - DNA, 36 bp, Artificial Sequence
  Synthetic
agtgtgccgcacaaggccgtgcaagcccattccccg

SEQ ID NO: 313 - DNA, 38 bp, Artificial Sequence
  Synthetic
cccctggtcttcaagcacacttacgcagcccagcctag

SEQ ID NO: 314 - DNA, 38 bp, Artificial Sequence
  Synthetic
gagatgccaacagtgttgctacaggaagcttacagggt

SEQ ID NO: 315 - DNA, 42 bp, Artificial Sequence
  Synthetic
cgtacttttccactccaggcgatatgtgcggtatgattttgc

SEQ ID NO: 316 - DNA, 41 bp, Artificial Sequence
  Synthetic
gttaggtcgctactcgctgggatgattccgtagacgccagg

SEQ ID NO: 317 - DNA, 40 bp, Artificial Sequence
  Synthetic
gagcaagttaccatcccctgcatgcgcgaatggaaaccat

SEQ ID NO: 318 - DNA, 39 bp, Artificial Sequence
  Synthetic
agggttgagggggccgttcggatctacgtcccagtctct

SEQ ID NO: 319 - DNA, 36 bp, Artificial Sequence
  Synthetic
aacgacgacgcggttgcccgacgtcgtacgagtcgc

SEQ ID NO: 320 - DNA, 38 bp, Artificial Sequence
  Synthetic
gccacaaaagccaccgcggcgagagattctccagcccg

SEQ ID NO: 321 - DNA, 38 bp, Artificial Sequence
  Synthetic
tgcgcgctgctggtgttttattgcaacagcttcgacgg

SEQ ID NO: 322 - DNA, 36 bp, Artificial Sequence
  Synthetic
acgaaggtccaagcggcgggcggatgctggtcgttg

SEQ ID NO: 323 - DNA, 38 bp, Artificial Sequence
  Synthetic
cgcgtgactctctgttcgatggcagctccaagcgccgt

SEQ ID NO: 324 - DNA, 38 bp, Artificial Sequence
  Synthetic
cccaacggtcacacgtccggaaagccgtcccggtcatt

SEQ ID NO: 325 - DNA, 35 bp, Artificial Sequence
  Synthetic
caacgcggcacttccaacagtgtggtgcacggcgt

SEQ ID NO: 326 - DNA, 35 bp, Artificial Sequence
  Synthetic
ttcgcacacccagcccctgggatcggtcgtcgcgt

SEQ ID NO: 327 - DNA, 35 bp, Artificial Sequence
  Synthetic
ccgacgtcccgcatccaactggcgtgcgaggaaga

SEQ ID NO: 328 - DNA, 38 bp, Artificial Sequence
  Synthetic
gaacacgcgcaacagggccgatgtcgggcgtccaccta

SEQ ID NO: 329 - DNA, 39 bp, Artificial Sequence
  Synthetic
tatcgtcgggtcggctgtccaaagcctggttggatctcg

SEQ ID NO: 330 - DNA, 39 bp, Artificial Sequence
  Synthetic
cctcgtcatcctccgtgtcggtagcctcctccaccacgg

SEQ ID NO: 331 - DNA, 40 bp, Artificial Sequence
  Synthetic
ggcccactttcgggtggaggcttgaagtacagcatgccca

SEQ ID NO: 332 - DNA, 41 bp, Artificial Sequence
  Synthetic
ggtgccgaaatcaccgtgtgaaaaaccgcgactttccacac

SEQ ID NO: 333 - DNA, 37 bp, Artificial Sequence
  Synthetic
atgtcgcgacacccgggtcgcccacccccattacacg

SEQ ID NO: 334 - DNA, 43 bp, Artificial Sequence
  Synthetic
agaacatatataatcgccgtttcgtacggatcaagaggtccat

SEQ ID NO: 335 - DNA, 35 bp, Artificial Sequence
  Synthetic
agcacggggtactcgtggcgctctcggggccgtat

SEQ ID NO: 336 - DNA, 42 bp, Artificial Sequence
  Synthetic
gaaggaaaccgaccccgaaactagcgttcataacaatcccgg

SEQ ID NO: 337 - DNA, 37 bp, Artificial Sequence
  Synthetic
ctcaacctgtgcgccacagcgttgcaggccacgaaca

SEQ ID NO: 338 - DNA, 39 bp, Artificial Sequence
  Synthetic
ccctcactgggctacgagtgcaccggtgtgcagctaagc

SEQ ID NO: 339 - DNA, 37 bp, Artificial Sequence
  Synthetic
tcatctacgtgccccccggggacccaagccagactgc

SEQ ID NO: 340 - DNA, 37 bp, Artificial Sequence
  Synthetic
tcagcgaaaccggcacccgggccggcgagtaatagca

SEQ ID NO: 341 - DNA, 35 bp, Artificial Sequence
  Synthetic
ggctgtcatgggtctgcgcagccgccgaaacacga

SEQ ID NO: 342 - DNA, 37 bp, Artificial Sequence
  Synthetic
atcgttcacgtcgccgccgccgaaagcgtcgtgagca

SEQ ID NO: 343 - DNA, 37 bp, Artificial Sequence
  Synthetic
acagcagccgcgcttgtctaggggactacctcctcga

SEQ ID NO: 344 - DNA, 39 bp, Artificial Sequence
  Synthetic
gcgtctacgtggtgatgctgcccaatcggcgtcgcttag

SEQ ID NO: 345 - DNA, 37 bp, Artificial Sequence
  Synthetic
aggcctggttacagcgcgggggacctgtttcagcgtg

SEQ ID NO: 346 - DNA, 40 bp, Artificial Sequence
  Synthetic
gcaaccccgccaactggttcgcgtaaatctgcgggatagc

SEQ ID NO: 347 - DNA, 36 bp, Artificial Sequence
  Synthetic
tgttcgacagcggcgtagactcgcctcgacagagcc

SEQ ID NO: 348 - DNA, 38 bp, Artificial Sequence
  Synthetic
ggtcatgacaccgacgcgttgaagttcacgtcgcgtcc

SEQ ID NO: 349 - DNA, 35 bp, Artificial Sequence
  Synthetic
gtcgctcggcattccgcactccggcatggtgctgc

SEQ ID NO: 350 - DNA, 38 bp, Artificial Sequence
  Synthetic
agttgtgccgccggagctataacgccatgggatcctca

SEQ ID NO: 351 - DNA, 39 bp, Artificial Sequence
  Synthetic
aaccagatggcgacggacgtcctgaacagaccgctaacc

SEQ ID NO: 352 - DNA, 39 bp, Artificial Sequence
  Synthetic
tgctaaccacgcaaccggatctgatgctgttgtcgtgca

SEQ ID NO: 353 - DNA, 36 bp, Artificial Sequence
  Synthetic
atcccggcaagttgcgcgccaccaccgcattaaccg

SEQ ID NO: 354 - DNA, 38 bp, Artificial Sequence
  Synthetic
cgcctgctctctccaggtccggaccttctgggaccagt

SEQ ID NO: 355 - DNA, 40 bp, Artificial Sequence
  Synthetic
gccttccagactgcacggccataggcagcgacgtgtatgg

SEQ ID NO: 356 - DNA, 36 bp, Artificial Sequence
  Synthetic
cagaaaacacccccccgcccggacgcccgacatcca

SEQ ID NO: 357 - DNA, 43 bp, Artificial Sequence
  Synthetic
tcttccccatattccttcattgtctctttgtgcgacagtgctt

SEQ ID NO: 358 - DNA, 44 bp, Artificial Sequence
  Synthetic
tgtagtcgtatagatccggaagaaatggacagtggtgaatagca

SEQ ID NO: 359 - DNA, 40 bp, Artificial Sequence
  Synthetic
ttcgcctctctcggactgactaagacaggaaatggcaagc

SEQ ID NO: 360 - DNA, 44 bp, Artificial Sequence
  Synthetic
tcctcaaagtccaatttttccggaaacaagccaattaatgtggg

SEQ ID NO: 361 - DNA, 40 bp, Artificial Sequence
  Synthetic
caatgtgctcaattggggcagattcgagctggatagaact

SEQ ID NO: 362 - DNA, 47 bp, Artificial Sequence
  Synthetic
ccatactcacaaagttcaccacgtgttcattataaaaggaaggtccc

SEQ ID NO: 363 - DNA, 44 bp, Artificial Sequence
  Synthetic
tctctttgatagaagactcagcctctgccttcttcaatctcttc

SEQ ID NO: 364 - DNA, 44 bp, Artificial Sequence
  Synthetic
cagatgccctgatctcagtagcgatcctatgaacagatggaaac

SEQ ID NO: 365 - DNA, 44 bp, Artificial Sequence
  Synthetic
cctctttgtcatacaggatcagctaggtccaatttacaggagaa

SEQ ID NO: 366 - DNA, 43 bp, Artificial Sequence
  Synthetic
ccattttcgcctctccagaaattcatggaactgattcggatga

SEQ ID NO: 367 - DNA, 43 bp, Artificial Sequence
  Synthetic
ttgaagcaatttgaacccctctattagagggacaagaatggtc

SEQ ID NO: 368 - DNA, 43 bp, Artificial Sequence
  Synthetic
gcatttcagttttcgcgcctaaagaaatgatgttttttgggcg

SEQ ID NO: 369 - DNA, 41 bp, Artificial Sequence
  Synthetic
tccaatatgtcgtcagcttcctgggcgccattatgagaact

SEQ ID NO: 370 - DNA, 41 bp, Artificial Sequence
  Synthetic
ccgaatcgctacagggaaagcccacaactgcaccctgaaga

SEQ ID NO: 371 - DNA, 38 bp, Artificial Sequence
  Synthetic
acatctacgcctcccagtcagaagtgcggttccagaag

SEQ ID NO: 372 - DNA, 42 bp, Artificial Sequence
  Synthetic
tactgcaagagctggcgaactcttagtaatggagttggaaac

SEQ ID NO: 373 - DNA, 42 bp, Artificial Sequence
  Synthetic
gcgccagcgagtaaatgcaaacacatgtcaatgcagctgtgg

SEQ ID NO: 374 - DNA, 44 bp, Artificial Sequence
  Synthetic
gcgcatgaagtaatggttactgtttgcttttgctaaattggcct

SEQ ID NO: 375 - DNA, 47 bp, Artificial Sequence
  Synthetic
aggcattttctgaagctgcattagtgtacttgctttaattgtagagg

SEQ ID NO: 376 - DNA, 45 bp, Artificial Sequence
  Synthetic
accccatttaaacacactctagaaagtaacttcagccactcaaac

SEQ ID NO: 377 - DNA, 42 bp, Artificial Sequence
  Synthetic
ggcgagggtccaatagttgcataggatctacagtggacggtc

SEQ ID NO: 378 - DNA, 43 bp, Artificial Sequence
  Synthetic
aggctcatctttacaaaatactggagtaagctcttgaccaccg

SEQ ID NO: 379 - DNA, 48 bp, Artificial Sequence
  Synthetic
tggttctccacaatatgaatccaagtgattgtattttgagattggcaa

SEQ ID NO: 380 - DNA, 42 bp, Artificial Sequence
  Synthetic
tgggaagtctcagttgttgcgtacagtttctggagcaggtgt

SEQ ID NO: 381 - DNA, 40 bp, Artificial Sequence
  Synthetic
cgcaacgaggaagtttgctggagcttcagcagttgcaagc

SEQ ID NO: 382 - DNA, 42 bp, Artificial Sequence
  Synthetic
ttaaatgccttcagtgtcctcacaagacaaagcctctgtagc

SEQ ID NO: 383 - DNA, 45 bp, Artificial Sequence
  Synthetic
tggtcagaattcctgtacgaggatccgtatacagatttaaggggt

SEQ ID NO: 384 - DNA, 40 bp, Artificial Sequence
  Synthetic
gtgtactcacccaaccagttgcttggtcttcatcgctttc

SEQ ID NO: 385 - DNA, 42 bp, Artificial Sequence
  Synthetic
ccaccattttccccacctggaattgcggcaatattgagttgc

SEQ ID NO: 386 - DNA, 38 bp, Artificial Sequence
  Synthetic
atgcatcggccctcacacacgcccgctcataggggtta

SEQ ID NO: 387 - DNA, 42 bp, Artificial Sequence
  Synthetic
ggttcttaccgtgcagatgcaaggtattcctccttatccttc

SEQ ID NO: 388 - DNA, 43 bp, Artificial Sequence
  Synthetic
ggacgtccctggaccctttaaaataatattttgccagctcttg

SEQ ID NO: 389 - DNA, 47 bp, Artificial Sequence
  Synthetic
actttctactgcttaaccccagaaatgtaagcggtttctataggtac

SEQ ID NO: 390 - DNA, 42 bp, Artificial Sequence
  Synthetic
acactgcgcacgcttttacaaaaagtagaaatctcgtcggcg

SEQ ID NO: 391 - DNA, 39 bp, Artificial Sequence
  Synthetic
ctggacatgcaggtcgagggtgcattgccactaccgttt

SEQ ID NO: 392 - DNA, 36 bp, Artificial Sequence
  Synthetic
ttcctccgggagctcgtccgacggttccacggtgca

SEQ ID NO: 393 - DNA, 45 bp, Artificial Sequence
  Synthetic
cactattgaacgtgcgggacatgttatcttggtaggcaatttctg

SEQ ID NO: 394 - DNA, 41 bp, Artificial Sequence
  Synthetic
cgtcgcggcgaaatgattgaaagtgggggttgtcttcttcg

SEQ ID NO: 395 - DNA, 38 bp, Artificial Sequence
  Synthetic
ttgctcagcttcctggtactcagtcacagtcacaaggt

SEQ ID NO: 396 - DNA, 40 bp, Artificial Sequence
  Synthetic
accgctttgtagatgtggatgacaagcactgcctgttgaa

SEQ ID NO: 397 - DNA, 39 bp, Artificial Sequence
  Synthetic
gctgccggcatcacatggatcttccaacatgaggcggtg

SEQ ID NO: 398 - DNA, 41 bp, Artificial Sequence
  Synthetic
ggatcctgccggtttcgaaccccgtggtttggtggaaaagt

SEQ ID NO: 399 - DNA, 39 bp, Artificial Sequence
  Synthetic
gcgaaacatgttctgacgaggcctcctgagcgtcaccca

SEQ ID NO: 400 - DNA, 42 bp, Artificial Sequence
  Synthetic
agcttctacaaagtcccaaagatggcacactaatagcgcgag

SEQ ID NO: 401 - DNA, 37 bp, Artificial Sequence
  Synthetic
cgcttggctgccaccgtaggacgggagcaggaacaga

SEQ ID NO: 402 - DNA, 42 bp, Artificial Sequence
  Synthetic
gctttgctatccaacaaagcatttcagtagtgccgtctcgta

SEQ ID NO: 403 - DNA, 43 bp, Artificial Sequence
  Synthetic
aaaagtaatcgggtccagactgatagccttgcgactaatggtt

SEQ ID NO: 404 - DNA, 44 bp, Artificial Sequence
  Synthetic
gcatttgtaaagtattccccgttcatcgagctttcattaatcgc

SEQ ID NO: 405 - DNA, 40 bp, Artificial Sequence
  Synthetic
ttttgcgtcgctgccaacgtgaatgggaggaaagacagcc

SEQ ID NO: 406 - DNA, 45 bp, Artificial Sequence
  Synthetic
ggcatgttggtatgtaagatggttttggcacgcaaactattaact

SEQ ID NO: 407 - DNA, 40 bp, Artificial Sequence
  Synthetic
ctaattgggtttcggggtccctgctggaaagtgacattgg

SEQ ID NO: 408 - DNA, 45 bp, Artificial Sequence
  Synthetic
agttgtaactgcgtcctttgggccttaaataaggctgctaggatt

SEQ ID NO: 409 - DNA, 40 bp, Artificial Sequence
  Synthetic
cgcactggatgttggctagaccgtaacaacacgggctggg

SEQ ID NO: 410 - DNA, 36 bp, Artificial Sequence
  Synthetic
gctgcccgcatcatagctcgcggccagagcgttggt

SEQ ID NO: 411 - DNA, 40 bp, Artificial Sequence
  Synthetic
aactcgacgccgtctgctgacaagcgcgatatcaagcatg

SEQ ID NO: 412 - DNA, 41 bp, Artificial Sequence
  Synthetic
cctctaacttttgccgcttaggttaaaagggaagccatgga

SEQ ID NO: 413 - DNA, 40 bp, Artificial Sequence
  Synthetic
tgatggacctcgtctacggctagggtaccgtgggacaact

SEQ ID NO: 414 - DNA, 38 bp, Artificial Sequence
  Synthetic
aacggatccgggcacagtttgcccgacgaggtaatggt

SEQ ID NO: 415 - DNA, 41 bp, Artificial Sequence
  Synthetic
gccatcttgaaagcgctggtgcctatgttagcgccagagga

SEQ ID NO: 416 - DNA, 40 bp, Artificial Sequence
  Synthetic
ccacgatccagtacccctcgaactttacgctggctgtggg

SEQ ID NO: 417 - DNA, 42 bp, Artificial Sequence
  Synthetic
tgtttgctgcattgttagctgagacaatccaaggatgacaac

SEQ ID NO: 418 - DNA, 40 bp, Artificial Sequence
  Synthetic
actgcggaattccacaaggacagttaatgctggatgcttt

SEQ ID NO: 419 - DNA, 47 bp, Artificial Sequence
  Synthetic
ggtagttttatgtttcctggagtgtgaagcttcttgtactcaaatgt

SEQ ID NO: 420 - DNA, 42 bp, Artificial Sequence
  Synthetic
agtgtgctctgaagaatcatgtttcccggttcctacacttac

SEQ ID NO: 421 - DNA, 41 bp, Artificial Sequence
  Synthetic
aggtgccgtctaaatagggaatgctgggttcagggtttgac

SEQ ID NO: 422 - DNA, 43 bp, Artificial Sequence
  Synthetic
agttgttatgttgaaactctacggtgagtaggcaagttgtgga

SEQ ID NO: 423 - DNA, 40 bp, Artificial Sequence
  Synthetic
gggtccacagcctagatctcgaccctcccagactgctgta

SEQ ID NO: 424 - DNA, 42 bp, Artificial Sequence
  Synthetic
gaacatacaacaaaacaggccgtaccctagaaaagtcaaccc

SEQ ID NO: 425 - DNA, 40 bp, Artificial Sequence
  Synthetic
gctccccccctaggcttgttatggttggtgggcagggata

SEQ ID NO: 426 - DNA, 39 bp, Artificial Sequence
  Synthetic
cttttatgctggccgactacccactggcataaggagacg

SEQ ID NO: 427 - DNA, 42 bp, Artificial Sequence
  Synthetic
ctgcgtgtgggagcataagtgtcaccatctccattccatgca

SEQ ID NO: 428 - DNA, 38 bp, Artificial Sequence
  Synthetic
gttgttgttcgcaatccggcgcttccatgcctttttcc

SEQ ID NO: 429 - DNA, 40 bp, Artificial Sequence
  Synthetic
tcctcggggggagtctcgtactactcataccccaagacgc

SEQ ID NO: 430 - DNA, 43 bp, Artificial Sequence
  Synthetic
gacaggataggggtattttgtgattagtttttgcagtgccaga

SEQ ID NO: 431 - DNA, 41 bp, Artificial Sequence
  Synthetic
gcctccgggtcttgcaagttttgagcgcagtgatgaatcag

SEQ ID NO: 432 - DNA, 40 bp, Artificial Sequence
  Synthetic
aagcattgctgccaaacaccctgcatttaccttttcctgt

SEQ ID NO: 433 - DNA, 43 bp, Artificial Sequence
  Synthetic
attgctgtcagactgcggtcactgaactattaagtgaaagtca

SEQ ID NO: 434 - DNA, 40 bp, Artificial Sequence
  Synthetic
ttgcggctttcggggacatgttccatcacctttgtgtgct

SEQ ID NO: 435 - DNA, 40 bp, Artificial Sequence
  Synthetic
catgagcagtagccccgacgtgggacaccattgaaaccag

SEQ ID NO: 436 - DNA, 40 bp, Artificial Sequence
  Synthetic
tcgtgttcttgacctcgactgaaaacgcatttttcccact

SEQ ID NO: 437 - DNA, 41 bp, Artificial Sequence
  Synthetic
gagagcggcttgttctagcagtccccacatgatttccaggg

SEQ ID NO: 438 - DNA, 43 bp, Artificial Sequence
  Synthetic
cgggaacaggacaaatgcaatagctattggtggaaaaagatca

SEQ ID NO: 439 - DNA, 42 bp, Artificial Sequence
  Synthetic
aaatgcttgcgtacagggtgatttcaacctattaacctggga

SEQ ID NO: 440 - DNA, 47 bp, Artificial Sequence
  Synthetic
agccagaaggtaaagaaaagagaaactaacttgtttctagtgcaaca

SEQ ID NO: 441 - DNA, 47 bp, Artificial Sequence
  Synthetic
ccgtagtaccatcgactgacattattgtcacattacaattaactgca

SEQ ID NO: 442 - DNA, 48 bp, Artificial Sequence
  Synthetic
gaaccgtcaccatactgtaagaaatttctaaaacagaacctcttatgc

SEQ ID NO: 443 - DNA, 49 bp, Artificial Sequence
  Synthetic
ttggatattcgggaagatcatcagtctcctctgtagtttctttacaact

SEQ ID NO: 444 - DNA, 45 bp, Artificial Sequence
  Synthetic
tgttctttgcctggtaaagattcataaaaggacttttttgcctgg

SEQ ID NO: 445 - DNA, 42 bp, Artificial Sequence
  Synthetic
gtttgcaagtctgtcaggtttgaccatggtctccgtgtactc

SEQ ID NO: 446 - DNA, 44 bp, Artificial Sequence
  Synthetic
aaggggctccaaaacattgatatcggaataaaacttaatgccca

SEQ ID NO: 447 - DNA, 42 bp, Artificial Sequence
  Synthetic
gggtaagagcgttgttgcgaactgtaaattctagcggtgccc

SEQ ID NO: 448 - DNA, 46 bp, Artificial Sequence
  Synthetic
gctcgcatcaaagggataattaacagggtcatgaaagtaaacgttg

SEQ ID NO: 449 - DNA, 50 bp, Artificial Sequence
  Synthetic
ggttgatgtgattaatcttccctgtcctaaatatccaaagtactactacc

SEQ ID NO: 450 - DNA, 45 bp, Artificial Sequence
  Synthetic
gcaatttgtgttttgtgtgtgtttaaatcagcctttctctacacc

SEQ ID NO: 451 - DNA, 43 bp, Artificial Sequence
  Synthetic
gatggacactgactgttgttactttgtcactcaagcggcattc

SEQ ID NO: 452 - DNA, 42 bp, Artificial Sequence
  Synthetic
gatgcttttgggacgctggtacaccttttgttaattaaggcg

SEQ ID NO: 453 - DNA, 46 bp, Artificial Sequence
  Synthetic
aaagctacgttgagtacttcggatgtaaagtcagactattacactc

SEQ ID NO: 454 - DNA, 45 bp, Artificial Sequence
  Synthetic
tgccacctgcgagatttacgcaaggtagaggcataaaaacttaat

SEQ ID NO: 455 - DNA, 46 bp, Artificial Sequence
  Synthetic
tgctggcttctgatttgtatgatttagatttacattaggctccaca

SEQ ID NO: 456 - DNA, 38 bp, Artificial Sequence
  Synthetic
aagcatgtttcagaggtcgcgttccgtaaagactccgg

SEQ ID NO: 457 - DNA, 44 bp, Artificial Sequence
  Synthetic
gcctaaacaagagggcgactcccatgtggaggtataacaaaatt

SEQ ID NO: 458 - DNA, 42 bp, Artificial Sequence
  Synthetic
cttctcgtaggcactttgcggaccggtacccttgtatacgct

SEQ ID NO: 459 - DNA, 42 bp, Artificial Sequence
  Synthetic
agggagacatcaaggctgggtttttctcaagacccgtccaag

SEQ ID NO: 460 - DNA, 40 bp, Artificial Sequence
  Synthetic
ccactgccaccaacaaacatccgccatggggagatctgga

SEQ ID NO: 461 - DNA, 42 bp, Artificial Sequence
  Synthetic
gtgcggtagctttaatggcctccattgctcctatcaaatcag

SEQ ID NO: 462 - DNA, 45 bp, Artificial Sequence
  Synthetic
tctttgttcttctgaagaaatgggagccttcaatcatcatgtcac

SEQ ID NO: 463 - DNA, 43 bp, Artificial Sequence
  Synthetic
gtgtgaaattcgcccatagggaatgaatgataacacaaatgcc

SEQ ID NO: 464 - DNA, 41 bp, Artificial Sequence
  Synthetic
gcaggtattgggtggctctggctaagccaaaacatacaaca

SEQ ID NO: 465 - DNA, 43 bp, Artificial Sequence
  Synthetic
cctatggttccatgtacacacaacggtgaaggaccatgttctc

SEQ ID NO: 466 - DNA, 45 bp, Artificial Sequence
  Synthetic
acttgtcaccaatccattccaagtggttgaaaaagtttactgagt

SEQ ID NO: 467 - DNA, 42 bp, Artificial Sequence
  Synthetic
ggtctcttccatctggattttgactggctacaaccaacagga

SEQ ID NO: 468 - DNA, 41 bp, Artificial Sequence
  Synthetic
ccccggagttgaatcatctccagtgtgtggagtacaatctc

SEQ ID NO: 469 - DNA, 46 bp, Artificial Sequence
  Synthetic
tccacatcattttcatctgtgacaaagtagaggacacaattctgat

SEQ ID NO: 470 - DNA, 42 bp, Artificial Sequence
  Synthetic
ggttctttttcaccggggaatataaagcctatcaacacacca

SEQ ID NO: 471 - DNA, 43 bp, Artificial Sequence
  Synthetic
aaacacccttctgaagttagctgagggaaaacaagagctatcg

SEQ ID NO: 472 - DNA, 41 bp, Artificial Sequence
  Synthetic
gaggccagaaacggctatcttgatgtgatagcttcataccc

SEQ ID NO: 473 - DNA, 42 bp, Artificial Sequence
  Synthetic
gtcgtccaaggttgcaggtcacagtgcatttctactaaatcc

SEQ ID NO: 474 - DNA, 46 bp, Artificial Sequence
  Synthetic
ctcctcctctgtaatctcatactcaaaatgacttagtgttaccagc

SEQ ID NO: 475 - DNA, 47 bp, Artificial Sequence
  Synthetic
ttctgcttcatggacaatataccaaaagaagtcttaacagaaatggc

SEQ ID NO: 476 - DNA, 47 bp, Artificial Sequence
  Synthetic
ggagttattttcacagcctgcaaccgaaagtataacaaaagtccaga

SEQ ID NO: 477 - DNA, 49 bp, Artificial Sequence
  Synthetic
aactctctgttaacatagcatgcttatatcaaatgttatgtgatcctcc

SEQ ID NO: 478 - DNA, 44 bp, Artificial Sequence
  Synthetic
tcagaattgcttcttgaagtgcatcctgaagaggaaaacaatgg

SEQ ID NO: 479 - DNA, 47 bp, Artificial Sequence
  Synthetic
acagtccagttctgctaaatctttgcgggagaaagagcttattttac

SEQ ID NO: 480 - DNA, 40 bp, Artificial Sequence
  Synthetic
gggccctgattttccttctcgtccaccacgtcccctgaaa

SEQ ID NO: 481 - DNA, 45 bp, Artificial Sequence
  Synthetic
actcatgaataagaagttgcagcaatattgttaaagggcacagca

SEQ ID NO: 482 - DNA, 41 bp, Artificial Sequence
  Synthetic
tcagcaaacgatcagcaagagtgcaattgcctacctgatgt

SEQ ID NO: 483 - DNA, 44 bp, Artificial Sequence
  Synthetic
gatgttgttgggtctattgcatctatacagtgcctgtggaaagt

SEQ ID NO: 484 - DNA, 40 bp, Artificial Sequence
  Synthetic
gccaatgctatccgttttgtggtaacgccattgcagtgtt

SEQ ID NO: 485 - DNA, 45 bp, Artificial Sequence
  Synthetic
agtaggtatttgctgaacccttctacaccacgtgacgttttaaat

SEQ ID NO: 486 - DNA, 44 bp, Artificial Sequence
  Synthetic
acttctagtttttattgtgcctcggtttcagagacagatgctgg

SEQ ID NO: 487 - DNA, 48 bp, Artificial Sequence
  Synthetic
gtctggcaaattgaatctaaacactcacaaagtattagttcctaaggt

SEQ ID NO: 488 - DNA, 46 bp, Artificial Sequence
  Synthetic
tccaaagaaaaacaagctatctccaattgccacagtttgtaaatgg

SEQ ID NO: 489 - DNA, 46 bp, Artificial Sequence
  Synthetic
cctcaattccagagggaggtgtcctaatattttggataattggcag

SEQ ID NO: 490 - DNA, 48 bp, Artificial Sequence
  Synthetic
ccaaatgactcagagagactggatgtgaactatagtgaaataaactgc

SEQ ID NO: 491 - DNA, 38 bp, Artificial Sequence
  Synthetic
gttggcagctgacgccggttgtccacgacctactcacc

SEQ ID NO: 492 - DNA, 41 bp, Artificial Sequence
  Synthetic
ttgcacagccagttgacgttttggtaatggtcattcagttc

SEQ ID NO: 493 - DNA, 46 bp, Artificial Sequence
  Synthetic
tccatccgttataaaaaagcccgaacctgataaatactcatgaagg

SEQ ID NO: 494 - DNA, 39 bp, Artificial Sequence
  Synthetic
gcacatacattgctccgtccctcgcgccttcagacctga

SEQ ID NO: 495 - DNA, 42 bp, Artificial Sequence
  Synthetic
tggaggtggccctgtataggtcaacccatatttgatgtttct

SEQ ID NO: 496 - DNA, 46 bp, Artificial Sequence
  Synthetic
gcttaaaaaatccttcccccattctttgatatcagttccttgttgg

SEQ ID NO: 497 - DNA, 46 bp, Artificial Sequence
  Synthetic
gcattgagagaagtaacagtagtctgtgagaaattgaaagaaagcg

SEQ ID NO: 498 - DNA, 45 bp, Artificial Sequence
  Synthetic
gcagctgtaaaatcaactccttcattgtccaatcttgctatggaa

SEQ ID NO: 499 - DNA, 49 bp, Artificial Sequence
  Synthetic
ttaaacatgtcgcaaaccatttgataccctattgaatacagatatgaga

SEQ ID NO: 500 - DNA, 40 bp, Artificial Sequence
  Synthetic
tatggtcgttgcagacgtgggccctaaaatttagcaaacg

SEQ ID NO: 501 - DNA, 45 bp, Artificial Sequence
  Synthetic
gttgttgcatatccagcataatcaagtgctgcctagaatttcatg

SEQ ID NO: 502 - DNA, 46 bp, Artificial Sequence
  Synthetic
agctgtctactaattgctcatagcaggatattgtattagacctgca

SEQ ID NO: 503 - DNA, 44 bp, Artificial Sequence
  Synthetic
gcactatagcttctaccataaaccaggacgattcaggtacagaa

SEQ ID NO: 504 - DNA, 45 bp, Artificial Sequence
  Synthetic
ctttccactgcctcggctatgaaagtatttaggtagtccatatgt

SEQ ID NO: 505 - DNA, 39 bp, Artificial Sequence
  Synthetic
tgctcccgtacactgtttgtgaagggacatagaggggga

SEQ ID NO: 506 - DNA, 45 bp, Artificial Sequence
  Synthetic
actctcctcgcatatgtcattatcaggcagacagtcagtttaaat

SEQ ID NO: 507 - DNA, 45 bp, Artificial Sequence
  Synthetic
cttcctcgtcctcagaatcctgggaaatgtttttttgaaagactg

SEQ ID NO: 508 - DNA, 43 bp, Artificial Sequence
  Synthetic
cggttccatactatactcagtccttgtccgaagcaaaaggaca

SEQ ID NO: 509 - DNA, 38 bp, Artificial Sequence
  Synthetic
gtttccactgtccacgggtcgagtccaacagtcccctt

SEQ ID NO: 510 - DNA, 45 bp, Artificial Sequence
  Synthetic
tggtagggggtatttttacaacatcaaacatgccattgtaactgt

SEQ ID NO: 511 - DNA, 50 bp, Artificial Sequence
  Synthetic
ggttgttaatagcagccacaatagtatggatatctgagtttattgtgtac

SEQ ID NO: 512 - DNA, 41 bp, Artificial Sequence
  Synthetic
ctatataggcccacacgaggctcatctagtgatagcggtcc

SEQ ID NO: 513 - DNA, 43 bp, Artificial Sequence
  Synthetic
ggaaaagttatatcagggccagattggggtaacaccacagttc

SEQ ID NO: 514 - DNA, 43 bp, Artificial Sequence
  Synthetic
gcatgataaaatatgttggtgcgagcctcctcctaaccctgta

SEQ ID NO: 515 - DNA, 43 bp, Artificial Sequence
  Synthetic
ggaacatctgatttattggtctgcaacaggatggcgatatggt

SEQ ID NO: 516 - DNA, 38 bp, Artificial Sequence
  Synthetic
gtccctgggctttttgtagcggctctttggtgtcctct

SEQ ID NO: 517 - DNA, 38 bp, Artificial Sequence
  Synthetic
taaggcaataccgcaccctgccaagttgcttgccaagt

SEQ ID NO: 518 - DNA, 41 bp, Artificial Sequence
  Synthetic
tcaccggttccgaagaccactagtgttgtacagcctccagg

SEQ ID NO: 519 - DNA, 42 bp, Artificial Sequence
  Synthetic
ctgcgcggcaacaagtaaactcaatggacgttaagttcccgg

SEQ ID NO: 520 - DNA, 38 bp, Artificial Sequence
  Synthetic
ctgacaccatgtgccagggccgccgacctcatgggata

SEQ ID NO: 521 - DNA, 36 bp, Artificial Sequence
  Synthetic
cggtaggagtaagggccacccttgcgtgccctgcgt

SEQ ID NO: 522 - DNA, 41 bp, Artificial Sequence
  Synthetic
cccagtggcctccagagagtaaaccttagttctcgcccagg

SEQ ID NO: 523 - DNA, 40 bp, Artificial Sequence
  Synthetic
gccttggccgtagctgtcaagacagctcagggtgttccga

SEQ ID NO: 524 - DNA, 42 bp, Artificial Sequence
  Synthetic
cggtactgttcatccacacgcattttgaactcgaccagaccg

SEQ ID NO: 525 - DNA, 40 bp, Artificial Sequence
  Synthetic
caggggtgatagctctacccgaggcatgcaactggaccag

SEQ ID NO: 526 - DNA, 42 bp, Artificial Sequence
  Synthetic
caggagaaaacagggccacagctctgcattgtctggcatgtc

SEQ ID NO: 527 - DNA, 40 bp, Artificial Sequence
  Synthetic
aatcactgagtcgcgaggcctatagctaggaccgaggctg

SEQ ID NO: 528 - DNA, 40 bp, Artificial Sequence
  Synthetic
cccttatgatgtctccgcacgcgtgttcacgcccatggag

SEQ ID NO: 529 - DNA, 40 bp, Artificial Sequence
  Synthetic
accgcagtacccaggaaggaagaattgtggcgaagtgcag

SEQ ID NO: 530 - DNA, 36 bp, Artificial Sequence
  Synthetic
acgaagtctaccgccttggcgcgccggcatattccg

SEQ ID NO: 531 - DNA, 41 bp, Artificial Sequence
  Synthetic
cgtggtgatggtcctgactccacatgtccaaggcatatggc

SEQ ID NO: 532 - DNA, 40 bp, Artificial Sequence
  Synthetic
ccccccttgatcagctccagaggccaacaacgggggaaat

SEQ ID NO: 533 - DNA, 40 bp, Artificial Sequence
  Synthetic
cctaccagtgcggcctctccgattacaaccgttccccagg

SEQ ID NO: 534 - DNA, 40 bp, Artificial Sequence
  Synthetic
tggagcgagccagaccttggatcgggtgagaatttcccgt

SEQ ID NO: 535 - DNA, 42 bp, Artificial Sequence
  Synthetic
ggtagagcacttcgcgatcagggtgattgttgggagagtcgt

SEQ ID NO: 536 - DNA, 42 bp, Artificial Sequence
  Synthetic
agggtttgttgggtggtcagagcattgcttccctcatgtcct

SEQ ID NO: 537 - DNA, 35 bp, Artificial Sequence
  Synthetic
tggcggcgcaaaatcgccattctatcgcccggagc

SEQ ID NO: 538 - DNA, 41 bp, Artificial Sequence
  Synthetic
ggggatgcctggcattaagggtgctgagtgacttcaagacg

SEQ ID NO: 539 - DNA, 41 bp, Artificial Sequence
  Synthetic
gatgccgtccacttccgtgaaacaacatcaagttcccctgc

SEQ ID NO: 540 - DNA, 38 bp, Artificial Sequence
  Synthetic
acgtggcctgaagaagacggcgaccctcgctagctagt

SEQ ID NO: 541 - DNA, 39 bp, Artificial Sequence
  Synthetic
acagggggctgctttgccgaagcagcaggactaccaagc

SEQ ID NO: 542 - DNA, 42 bp, Artificial Sequence
  Synthetic
gccccagtccacgagtatgacatcagactcttggtccactgt

SEQ ID NO: 543 - DNA, 38 bp, Artificial Sequence
  Synthetic
ttgcgggaatggctccgaacccccactcagccagatca

SEQ ID NO: 544 - DNA, 42 bp, Artificial Sequence
  Synthetic
ggagtcaaagcagcgggtatcaagcgggtggaatttcttctg

SEQ ID NO: 545 - DNA, 35 bp, Artificial Sequence
  Synthetic
ctacgccgtcgctctcagcgcggcgctgagagact

SEQ ID NO: 546 - DNA, 40 bp, Artificial Sequence
  Synthetic
atcgagtttggcagcggcagtacctctttaactgggcggt

SEQ ID NO: 547 - DNA, 44 bp, Artificial Sequence
  Synthetic
tgctgtgaccataagacaatatgaatcgtaatgagcaattccgg

SEQ ID NO: 548 - DNA, 44 bp, Artificial Sequence
  Synthetic
gcctcaacattgggtgaattcaagaaccagttaaagatctcatg

SEQ ID NO: 549 - DNA, 45 bp, Artificial Sequence
  Synthetic
cttgagtgcatctggtaatttccattggatagtaagacatggaca

SEQ ID NO: 550 - DNA, 47 bp, Artificial Sequence
  Synthetic
accaataaacaggtttgtcccaaaagttacctcataccactaaatgc

SEQ ID NO: 551 - DNA, 44 bp, Artificial Sequence
  Synthetic
cctgatgtccatggtattgtcattagcaatgctaggtactcatg

SEQ ID NO: 552 - DNA, 44 bp, Artificial Sequence
  Synthetic
acctaagccttcagtgagtgcttaggctgatgaaagatactcaa

SEQ ID NO: 553 - DNA, 39 bp, Artificial Sequence
  Synthetic
tgccatgtgtaatcgcccacaagccatgtatgttccaca

SEQ ID NO: 554 - DNA, 38 bp, Artificial Sequence
  Synthetic
gtagggtagtgctctgggtgttatcacagggcaaagct

SEQ ID NO: 555 - DNA, 44 bp, Artificial Sequence
  Synthetic
tggaatagtaaacacctgatgtacgtagtctcaacaggaggaca

SEQ ID NO: 556 - DNA, 44 bp, Artificial Sequence
  Synthetic
tgtcgtatgtcagcaaaacaaacatatgcatacatggtcccatt

SEQ ID NO: 557 - DNA, 45 bp, Artificial Sequence
  Synthetic
ggagatccatcacatccaagtagtagaaatcatgatgacttggtc

SEQ ID NO: 558 - DNA, 45 bp, Artificial Sequence
  Synthetic
cgtcccacaatggatgttgttaaagtgtgtgtattaatccatggt

SEQ ID NO: 559 - DNA, 49 bp, Artificial Sequence
  Synthetic
tgtgttagaatttgtggaggctagaccaatggctagtttagataacaag

SEQ ID NO: 560 - DNA, 50 bp, Artificial Sequence
  Synthetic
gggggtgctactcaaattaataagtactttaccaacactatcttagaagt

SEQ ID NO: 561 - DNA, 48 bp, Artificial Sequence
  Synthetic
ccttgtcacctggaaaaacatcataggagtttaacataaatccagtca

SEQ ID NO: 562 - DNA, 46 bp, Artificial Sequence
  Synthetic
ggttgcctagtttcattctcatgttaaagtccgattagggaaaagt

SEQ ID NO: 563 - DNA, 38 bp, Artificial Sequence
  Synthetic
tctgggggtgtgatggttagtggatccacaagtgttgg

SEQ ID NO: 564 - DNA, 38 bp, Artificial Sequence
  Synthetic
aacagcccatgggtccagcttgcaaagccgctatgtcc

SEQ ID NO: 565 - DNA, 40 bp, Artificial Sequence
  Synthetic
actgagccctcctgcgacaaaccacaaaagatgctcgact

SEQ ID NO: 566 - DNA, 38 bp, Artificial Sequence
  Synthetic
gcaggcagcagtggatgtgtacgcgtctcggaaaaacg

SEQ ID NO: 567 - DNA, 40 bp, Artificial Sequence
  Synthetic
cgatgagagcggaatgtcccgaaaccaaattcttccgcgc

SEQ ID NO: 568 - DNA, 40 bp, Artificial Sequence
  Synthetic
accaggataccccgtggattgtcaccatgtccaccccatg

SEQ ID NO: 569 - DNA, 43 bp, Artificial Sequence
  Synthetic
ggcgtaagataattcctgcagaaatactgcgactacttcaaca

SEQ ID NO: 570 - DNA, 43 bp, Artificial Sequence
  Synthetic
actctggctgtacaagaattacacccagaggaggagttactgt

SEQ ID NO: 571 - DNA, 45 bp, Artificial Sequence
  Synthetic
gctattccactgtcctcaaacagtggaagcaattagtctttctcc

SEQ ID NO: 572 - DNA, 45 bp, Artificial Sequence
  Synthetic
tgtttgttttacaacccaatctggtcggctgcgctatatttttac

SEQ ID NO: 573 - DNA, 50 bp, Artificial Sequence
  Synthetic
acaatctagtaatggctgaatccaaagaggtaaagtagtatcatacatga

SEQ ID NO: 574 - DNA, 39 bp, Artificial Sequence
  Synthetic
ggtggggctgcttgatctccgtcttcacctgtctccccg

SEQ ID NO: 575 - DNA, 41 bp, Artificial Sequence
  Synthetic
cctgatcgtggaacagatcgaagaacgtcatatcctctctg

SEQ ID NO: 576 - DNA, 42 bp, Artificial Sequence
  Synthetic
catggaggtacccttaggaagtgtgcaaacagtaatcaacgc

SEQ ID NO: 577 - DNA, 42 bp, Artificial Sequence
  Synthetic
tccctccctaggtgtttgagcaacttgggtattggtacggga

SEQ ID NO: 578 - DNA, 47 bp, Artificial Sequence
  Synthetic
tcatctatttcaaactgcgccatagacattggtgatccagaatacat

SEQ ID NO: 579 - DNA, 46 bp, Artificial Sequence
  Synthetic
ctgtctagaggagttgtcagctggtgatttgacagacatattcaat

SEQ ID NO: 580 - DNA, 44 bp, Artificial Sequence
  Synthetic
gggtcgaaagatacattttgcctataaactgggtgacactgaaa

SEQ ID NO: 581 - DNA, 46 bp, Artificial Sequence
  Synthetic
tctgtataaaatccggccatttgctttagtactttttcagcgagtc

SEQ ID NO: 582 - DNA, 49 bp, Artificial Sequence
  Synthetic
cctcactagtaactagagaaccactcctaaaaatggattagggaatcac

SEQ ID NO: 583 - DNA, 49 bp, Artificial Sequence
  Synthetic
acctaaaggtgtctgatccaaatcaccatataagggcttaaatttttgg

SEQ ID NO: 584 - DNA, 49 bp, Artificial Sequence
  Synthetic
cgaagttaaagtgatagaacaccgaggtttctatttgaagtttgtacac

SEQ ID NO: 585 - DNA, 40 bp, Artificial Sequence
  Synthetic
tgctggtgagagagaaaaggccctctagcagcggccaact

SEQ ID NO: 586 - DNA, 42 bp, Artificial Sequence
  Synthetic
gcgggtaggggcagtataccaaaaccctaatgtggtccaccg

SEQ ID NO: 587 - DNA, 38 bp, Artificial Sequence
  Synthetic
acaggacctcaggcgggaggcgaggctatgttccgcca

SEQ ID NO: 588 - DNA, 38 bp, Artificial Sequence
  Synthetic
agggcgtaggtgatggctccgccattggctgccacttt

SEQ ID NO: 589 - DNA, 40 bp, Artificial Sequence
  Synthetic
agcgacctcagaggcgttccgctacaaggttactgtgggc

SEQ ID NO: 590 - DNA, 39 bp, Artificial Sequence
  Synthetic
aaaaccaacacccgtgggtcatacgctcagtgtaggcgc

SEQ ID NO: 591 - DNA, 36 bp, Artificial Sequence
  Synthetic
tgccagggacgacgtaggaatgtcgaccccgctgaa

SEQ ID NO: 592 - DNA, 41 bp, Artificial Sequence
  Synthetic
cagaggcggcataggtgagacttttgatgccagtcagagca

SEQ ID NO: 593 - DNA, 39 bp, Artificial Sequence
  Synthetic
ccttagagccatccgggtaggtccggccataacccacca

SEQ ID NO: 594 - DNA, 41 bp, Artificial Sequence
  Synthetic
gcagcctcaagcatctttgggtatacattaaccccccggcc

SEQ ID NO: 595 - DNA, 40 bp, Artificial Sequence
  Synthetic
gccagatttgctgtccgtgcaaccaataggccgacctgcc

SEQ ID NO: 596 - DNA, 35 bp, Artificial Sequence
  Synthetic
aatgacaacccggcgccccggcttcgctgctttca

SEQ ID NO: 597 - DNA, 42 bp, Artificial Sequence
  Synthetic
ggaggacccgactagtggtctgctgcggatgtatgtgagctg

SEQ ID NO: 598 - DNA, 38 bp, Artificial Sequence
  Synthetic
gagatgcccacctcgcgaaggcgccacactgagaagtg

SEQ ID NO: 599 - DNA, 40 bp, Artificial Sequence
  Synthetic
aggtcgagctcaaggacggcttgtacgagctagtggaggc

SEQ ID NO: 600 - DNA, 38 bp, Artificial Sequence
  Synthetic
ccagggccccaattcttctcagccttggcgcgcttcct

SEQ ID NO: 601 - DNA, 35 bp, Artificial Sequence
  Synthetic
tgggcctggtcacgccaaggggctggacctcgtgt

SEQ ID NO: 602 - DNA, 41 bp, Artificial Sequence
  Synthetic
gggagacccgcgtgttggtatctttgccctcgaacttgagt

SEQ ID NO: 603 - DNA, 40 bp, Artificial Sequence
  Synthetic
agactgggccggtcgaagagtgtgctttggctttctctca

SEQ ID NO: 604 - DNA, 42 bp, Artificial Sequence
  Synthetic
gcacccaggctagtggtgtaagactgctagtgaccaactgct

SEQ ID NO: 605 - DNA, 40 bp, Artificial Sequence
  Synthetic
attggctgcatatcgacgacaacaatataccaaaacggcg

SEQ ID NO: 606 - DNA, 40 bp, Artificial Sequence
  Synthetic
ccaccaacgattcaggaacattaccgaaagacacagtgtt

SEQ ID NO: 607 - DNA, 48 bp, Artificial Sequence
  Synthetic
gcatgccagatttaccggttatggggttgtttattaagtttaaatcgg

SEQ ID NO: 608 - DNA, 49 bp, Artificial Sequence
  Synthetic
aaactctttcatatgccgttcctatgattcgggctatagagtattttac

SEQ ID NO: 609 - DNA, 40 bp, Artificial Sequence
  Synthetic
acaacatccaacgccgttttagtggaaacgaaaaaccgtc

SEQ ID NO: 610 - DNA, 44 bp, Artificial Sequence
  Synthetic
aatcgagtcttttcgttcccataatgtttactgctattggacga

SEQ ID NO: 611 - DNA, 40 bp, Artificial Sequence
  Synthetic
tgattaaacaatgggccgttgaggctatgttacctgcact

SEQ ID NO: 612 - DNA, 45 bp, Artificial Sequence
  Synthetic
ggaaagaccgtttgttttatagtggaggggtatgtatattagcgc

SEQ ID NO: 613 - DNA, 43 bp, Artificial Sequence
  Synthetic
tgagtggattattcgacgggactttttcatcgtcgttacttcc

SEQ ID NO: 614 - DNA, 45 bp, Artificial Sequence
  Synthetic
cctctatggttgacagcacatttcttgctgggttatttaacatcc

SEQ ID NO: 615 - DNA, 42 bp, Artificial Sequence
  Synthetic
acctcatcgaaatgcgtatagccagaaactatccgacagaga

SEQ ID NO: 616 - DNA, 38 bp, Artificial Sequence
  Synthetic
ttttcggtttaggcagccggcgtttcctccttgcagac

SEQ ID NO: 617 - DNA, 37 bp, Artificial Sequence
  Synthetic
tgtggccgcccggttttggacgaaccgtgttccgtcg

SEQ ID NO: 618 - DNA, 38 bp, Artificial Sequence
  Synthetic
cagtacgtgctgccgggtttcccagaccccgagactgt

SEQ ID NO: 619 - DNA, 38 bp, Artificial Sequence
  Synthetic
ccatccaacagggtgcggttcatcctcccagtgaccct

SEQ ID NO: 620 - DNA, 39 bp, Artificial Sequence
  Synthetic
aggaaacatgatgcccggggtatctaggtttgccccccg

SEQ ID NO: 621 - DNA, 49 bp, Artificial Sequence
  Synthetic
ccctgcttgcccatactatatgtttattagatcgatgggaaaaaattcg

SEQ ID NO: 622 - DNA, 43 bp, Artificial Sequence
  Synthetic
gtgtcctgtgtcagctgctgtttagacaagatagaggaagagc

SEQ ID NO: 623 - DNA, 39 bp, Artificial Sequence
  Synthetic
atctggcctggtgcaataggccatcaatgaggaagctgc

SEQ ID NO: 624 - DNA, 40 bp, Artificial Sequence
  Synthetic
gttcgcattttggaccaacaaggagcaagcttcacaggag

SEQ ID NO: 625 - DNA, 46 bp, Artificial Sequence
  Synthetic
tggaatattgctggtgatcctttcccaccagggattagatatcagt

SEQ ID NO: 626 - DNA, 45 bp, Artificial Sequence
  Synthetic
tctgtatgtcattgacagtccagcccatcctgataaatggacagt

SEQ ID NO: 627 - DNA, 44 bp, Artificial Sequence
  Synthetic
tggttattttttgcactgcctctgatatgcaagaatgaggggtg

SEQ ID NO: 628 - DNA, 50 bp, Artificial Sequence
  Synthetic
ccattgctctccaattactgtgatatcaggaaagtactatttttagatgg

SEQ ID NO: 629 - DNA, 45 bp, Artificial Sequence
  Synthetic
actggccatcttcctgctaattttagaagcagaagttattccagc

SEQ ID NO: 630 - DNA, 43 bp, Artificial Sequence
  Synthetic
gtgggatgtgtacttctgaacttatggaaagctaggggatggt

SEQ ID NO: 631 - DNA, 46 bp, Artificial Sequence
  Synthetic
gccaagtattgtagagatcctacctattaggacacatagttagccc

SEQ ID NO: 632 - DNA, 49 bp, Artificial Sequence
  Synthetic
gcagaattcttattatggcttccaccttagggcaacatatctatgaaac

SEQ ID NO: 633 - DNA, 43 bp, Artificial Sequence
  Synthetic
tgcttccttccacacaggtactgtagtgctacagaaaaattgt

SEQ ID NO: 634 - DNA, 45 bp, Artificial Sequence
  Synthetic
agttgatactactggcctaattccatggaacaggaccatgtacaa

SEQ ID NO: 635 - DNA, 43 bp, Artificial Sequence
  Synthetic
tctcttgttaatagcagccctgtaacaatgtatgcccctccca

SEQ ID NO: 636 - DNA, 41 bp, Artificial Sequence
  Synthetic
cgcctcaatagccctcagcaaacaatgacgctgacggtaca

SEQ ID NO: 637 - DNA, 41 bp, Artificial Sequence
  Synthetic
gctcccaccctatctgctgcttggatggcctactgtaaggg

SEQ ID NO: 638 - DNA, 42 bp, Artificial Sequence
  Synthetic
agcaagctcgatgtcagcagtttagcatttcatcacgtggcc

SEQ ID NO: 639 - DNA, 40 bp, Artificial Sequence
  Synthetic
cgtcagagattcccacctcggtcaacgacatgcagtggct

SEQ ID NO: 640 - DNA, 39 bp, Artificial Sequence
  Synthetic
ccaggggctcagtctggacagtttaggcgcaggtttccg

SEQ ID NO: 641 - DNA, 36 bp, Artificial Sequence
  Synthetic
cccccttcagcacctacgtggagccggtcagcagct

SEQ ID NO: 642 - DNA, 37 bp, Artificial Sequence
  Synthetic
tcttcgccgggctggacgacttcgagggcgtagtggc

SEQ ID NO: 643 - DNA, 36 bp, Artificial Sequence
  Synthetic
ttcgaggctgtgctgcgcggcgaactccaccgaggt

SEQ ID NO: 644 - DNA, 41 bp, Artificial Sequence
  Synthetic
cgcgtacatggccaagctccaacacaacaaactccccctcg

SEQ ID NO: 645 - DNA, 39 bp, Artificial Sequence
  Synthetic
aggtcctggactgcgtggttaacgtacatgttctgcgcc

SEQ ID NO: 646 - DNA, 37 bp, Artificial Sequence
  Synthetic
agctcgtgctcccagaggcagtacatccccgcgtacg

SEQ ID NO: 647 - DNA, 38 bp, Artificial Sequence
  Synthetic
gctccggggacagttctccaggacctccgggacttcga

SEQ ID NO: 648 - DNA, 41 bp, Artificial Sequence
  Synthetic
gggcaggactagctcgtcgtctcctgaacacgctaatgtgc

SEQ ID NO: 649 - DNA, 39 bp, Artificial Sequence
  Synthetic
cgatacacggcaacccccggctctcctccacccaaacga

SEQ ID NO: 650 - DNA, 37 bp, Artificial Sequence
  Synthetic
ctggtgttcgaactgggccacaccgcgtcctccgaca

SEQ ID NO: 651 - DNA, 39 bp, Artificial Sequence
  Synthetic
tggagcttgtggccctacacccagacggaacagctccca

SEQ ID NO: 652 - DNA, 40 bp, Artificial Sequence
  Synthetic
gcaagggggagctgctgatctaatgggcgtaaagacgggc

SEQ ID NO: 653 - DNA, 38 bp, Artificial Sequence
  Synthetic
tgaccacatggggccggtacctaaggcccaccgtcacg

SEQ ID NO: 654 - DNA, 36 bp, Artificial Sequence
  Synthetic
gctgctgccgacacaacgtctgggcggtcagcgaga

SEQ ID NO: 655 - DNA, 37 bp, Artificial Sequence
  Synthetic
tcgggctggcggtcgatctcgctaaccagcagctcca

SEQ ID NO: 656 - DNA, 36 bp, Artificial Sequence
  Synthetic
ccacgacatccgcggctttacacgatctggcgctgc

SEQ ID NO: 657 - DNA, 39 bp, Artificial Sequence
  Synthetic
caaggcggcccacttggaatcatcatctctaagcgcgcg

SEQ ID NO: 658 - DNA, 41 bp, Artificial Sequence
  Synthetic
acgaagtgaaccaactgccgaatacagcgtcctgaacacgt

SEQ ID NO: 659 - DNA, 34 bp, Artificial Sequence
  Synthetic
acgatcgtgctgcgcgagcgggtggaccacgtca

SEQ ID NO: 660 - DNA, 39 bp, Artificial Sequence
  Synthetic
gctgacgcgtgcttttgttccgccagcgcgtgtatgagt

SEQ ID NO: 661 - DNA, 40 bp, Artificial Sequence
  Synthetic
agagctacgcgtacctctgcccggaaagaccactagcccg

SEQ ID NO: 662 - DNA, 35 bp, Artificial Sequence
  Synthetic
ccaccaacgtgccctacccccaggggcaggacgaa

SEQ ID NO: 663 - DNA, 37 bp, Artificial Sequence
  Synthetic
ttgtgcgggaggggcttggcttgggggattcgcaggc

SEQ ID NO: 664 - DNA, 41 bp, Artificial Sequence
  Synthetic
ccccgcgggatcggatacaagtaggtgataaacagcgggcg

SEQ ID NO: 665 - DNA, 36 bp, Artificial Sequence
  Synthetic
tggcacaacagacccgcggcagggcgttgtagtgcg

SEQ ID NO: 666 - DNA, 36 bp, Artificial Sequence
  Synthetic
ggtccatgttcgagggcggcgccggccaattcttcc

SEQ ID NO: 667 - DNA, 40 bp, Artificial Sequence
  Synthetic
tcgaaggcggaatagtggcgcgtcctgtctctgcagtcgt

SEQ ID NO: 668 - DNA, 35 bp, Artificial Sequence
  Synthetic
tgcaggcggttgtcgaggctgcttcggcggctcct

SEQ ID NO: 669 - DNA, 40 bp, Artificial Sequence
  Synthetic
cgtcagcaccttcatcgacctggtgtagacctccaggggc

SEQ ID NO: 670 - DNA, 38 bp, Artificial Sequence
  Synthetic
gccgcacctcaaggaggaactccaatcagcgcccgaac

SEQ ID NO: 671 - DNA, 39 bp, Artificial Sequence
  Synthetic
tccagcgcaaccagctcccacgcgatggtctctatgtcc

SEQ ID NO: 672 - DNA, 35 bp, Artificial Sequence
  Synthetic
agaagttctgccggcggctttgccccccacaaccc

SEQ ID NO: 673 - DNA, 36 bp, Artificial Sequence
  Synthetic
aggttccgaacgccgtcggtggtaccgcctcaagcc

SEQ ID NO: 674 - DNA, 37 bp, Artificial Sequence
  Synthetic
tctgcgccaagtgcctgggagacgaactcgaaggcgg

SEQ ID NO: 675 - DNA, 35 bp, Artificial Sequence
  Synthetic
acgccggtgttctgcacgcatgaacgactgggccg

SEQ ID NO: 676 - DNA, 37 bp, Artificial Sequence
  Synthetic
gctgatccacatgctggccatacgacgtcaaggggcg

SEQ ID NO: 677 - DNA, 36 bp, Artificial Sequence
  Synthetic
acgtgagggctcgcaggacacaacaggtgggtgctt

SEQ ID NO: 678 - DNA, 38 bp, Artificial Sequence
  Synthetic
tccctcagatgatagggcgtgtgatgcgacgcctgtgc

SEQ ID NO: 679 - DNA, 37 bp, Artificial Sequence
  Synthetic
ggagtcgaggaccttcagggcggcgttcaacgacgcc

SEQ ID NO: 680 - DNA, 38 bp, Artificial Sequence
  Synthetic
cctgcatgccaatgcccatggaaacccacgccccagtg

SEQ ID NO: 681 - DNA, 37 bp, Artificial Sequence
  Synthetic
cggcgggatccatggcgatatacagcgctccgatcgg

SEQ ID NO: 682 - DNA, 38 bp, Artificial Sequence
  Synthetic
ccacgaacacgagctcggtctcaaccaccttcgctccc

SEQ ID NO: 683 - DNA, 36 bp, Artificial Sequence
  Synthetic
tcatccacgacgccccggacagctcggcgatggtca

SEQ ID NO: 684 - DNA, 36 bp, Artificial Sequence
  Synthetic
accgaggaggcgtgggtgaccttgtcgcggtggttc

SEQ ID NO: 685 - DNA, 37 bp, Artificial Sequence
  Synthetic
acggatcggcgggcaaaaaccgatggcgtccaccaga

SEQ ID NO: 686 - DNA, 38 bp, Artificial Sequence
  Synthetic
gcgaatagctacggccgcttgtccagacggacagcacc

SEQ ID NO: 687 - DNA, 37 bp, Artificial Sequence
  Synthetic
cccgtcggtcgcatacagcactgcgatcacgaagggc

SEQ ID NO: 688 - DNA, 35 bp, Artificial Sequence
  Synthetic
tgcacaacgtacggggcggtcctgcgccgacaaga

SEQ ID NO: 689 - DNA, 38 bp, Artificial Sequence
  Synthetic
tgacatagtccccgcccaggccccatgttttccgcggc

SEQ ID NO: 690 - DNA, 36 bp, Artificial Sequence
  Synthetic
gttggtcccgacgctcagcctgcgcttcaagcacgg

SEQ ID NO: 691 - DNA, 36 bp, Artificial Sequence
  Synthetic
tggtgaagggcgacgaacggacacccagatgcgcct

SEQ ID NO: 692 - DNA, 37 bp, Artificial Sequence
  Synthetic
agctgcaccagggtctggcacacgaaaatcacccgcc

SEQ ID NO: 693 - DNA, 42 bp, Artificial Sequence
  Synthetic
cgtggcattcagacagtacgggtcgaacctgtttttacgggc

SEQ ID NO: 694 - DNA, 37 bp, Artificial Sequence
  Synthetic
accacacgacatgcaggcttccatgcccagcccccaa

SEQ ID NO: 695 - DNA, 34 bp, Artificial Sequence
  Synthetic
aagtcgacacaccgcgcggcggaaggaaacgggc

SEQ ID NO: 696 - DNA, 37 bp, Artificial Sequence
  Synthetic
cccgtgcatgaagacctggatccaccggggtgttgca

SEQ ID NO: 697 - DNA, 36 bp, Artificial Sequence
  Synthetic
gcatcatcccgcccgcatccgtcgccccatgcacgt

SEQ ID NO: 698 - DNA, 35 bp, Artificial Sequence
  Synthetic
acgcgtggtaggtcgctgggtttccgggagcgctg

SEQ ID NO: 699 - DNA, 38 bp, Artificial Sequence
  Synthetic
tgggatcggccatcttaagcgatgggactccgcgtcgt

SEQ ID NO: 700 - DNA, 40 bp, Artificial Sequence
  Synthetic
ggcatgtaggagcacgctgccccgatcactgtgtactacg

SEQ ID NO: 701 - DNA, 39 bp, Artificial Sequence
  Synthetic
ccaaaacaaaccggctggcgtcggtctgtatgtcctgcg

SEQ ID NO: 702 - DNA, 40 bp, Artificial Sequence
  Synthetic
cgtgctggccccttgatacgatgctggttgggtgggggta

SEQ ID NO: 703 - DNA, 42 bp, Artificial Sequence
  Synthetic
ccagccttgcaagcactctagtacttatcctggggagaaggg

SEQ ID NO: 704 - DNA, 43 bp, Artificial Sequence
  Synthetic
acagcaatacaatacagcaaacagtgatctggaggggaacttg

SEQ ID NO: 705 - DNA, 42 bp, Artificial Sequence
  Synthetic
ccgtatcccagtgttgcttgcttcagtgtccattttgccagg

SEQ ID NO: 706 - DNA, 45 bp, Artificial Sequence
  Synthetic
acctccatagcacttatctcactatgacaaaacaacatcacagca

SEQ ID NO: 707 - DNA, 49 bp, Artificial Sequence
  Synthetic
gcactggtttacaattatttctggctgctgctttattcttctatcatag

SEQ ID NO: 708 - DNA, 41 bp, Artificial Sequence
  Synthetic
gacaccgcttattcacatactgtagacactacaagacagcg

SEQ ID NO: 709 - DNA, 48 bp, Artificial Sequence
  Synthetic
ggtgataaccaaaaatgtgacccatcttaacaaatttttggatggaca

SEQ ID NO: 710 - DNA, 43 bp, Artificial Sequence
  Synthetic
cccatttccacaatacaacttctgtggcagccagttaccctaa

SEQ ID NO: 711 - DNA, 38 bp, Artificial Sequence
  Synthetic
ggggttctctccctcgtggacagcgccctggtaaatgt

SEQ ID NO: 712 - DNA, 47 bp, Artificial Sequence
  Synthetic
tgcctagcaagcattgtttaatgatcaagattcctaaaaacattggg

SEQ ID NO: 713 - DNA, 38 bp, Artificial Sequence
  Synthetic
cactggatatggacgggcgtcgggcattggcacaggac

SEQ ID NO: 714 - DNA, 40 bp, Artificial Sequence
  Synthetic
gtcaattgtgtccccccgggccgtaggtgacaatgctgaa

SEQ ID NO: 715 - DNA, 40 bp, Artificial Sequence
  Synthetic
gccagtagtgcgcctctggtacgtagtgacacagacctgc

SEQ ID NO: 716 - DNA, 40 bp, Artificial Sequence
  Synthetic
gcgtagggtctcctctcacagaactagatgtactgggtga

SEQ ID NO: 717 - DNA, 41 bp, Artificial Sequence
  Synthetic
gcagcatggaggaaagtactgatacaacggacattgaacac

SEQ ID NO: 718 - DNA, 45 bp, Artificial Sequence
  Synthetic
agggattttcagcatcatcaaacttgattgaggtttctaggggac

SEQ ID NO: 719 - DNA, 44 bp, Artificial Sequence
  Synthetic
actcatgtctgcatcctcaatgtaaagcagatgacaaatgtcct

SEQ ID NO: 720 - DNA, 47 bp, Artificial Sequence
  Synthetic
ggtgtgccttaaaaactcaaaaaacctaactttaccatcagtgttcc

SEQ ID NO: 721 - DNA, 45 bp, Artificial Sequence
  Synthetic
acctcccaaaacttaagatctttgtaaatgtccctctaaggatgc

SEQ ID NO: 722 - DNA, 42 bp, Artificial Sequence
  Synthetic
ggggctattggcaagacagaccccaacattggcaaacgtctc

SEQ ID NO: 723 - DNA, 45 bp, Artificial Sequence
  Synthetic
tctccttcacaatcggatgacatatgccaattaatttactgtgtg

SEQ ID NO: 724 - DNA, 45 bp, Artificial Sequence
  Synthetic
ggtgatatgtgaacagcatgcagcgaaagtatgtgataagtccac

SEQ ID NO: 725 - DNA, 44 bp, Artificial Sequence
  Synthetic
aggagctctctcatacagattcatttggaaacacaacagacact

SEQ ID NO: 726 - DNA, 49 bp, Artificial Sequence
  Synthetic
gatcagcaagtgtttcaccttctatataggaattgtcaaatatctggtg

SEQ ID NO: 727 - DNA, 43 bp, Artificial Sequence
  Synthetic
ttgaactgcgcgggaaactttattcagcaagttaaaacaacca

SEQ ID NO: 728 - DNA, 47 bp, Artificial Sequence
  Synthetic
gctcaggaattgctgataaatccattaagggaactattcataccaga

SEQ ID NO: 729 - DNA, 47 bp, Artificial Sequence
  Synthetic
ggtttccttcacatattcatccgtagaatctggaaaattgtatctgc

SEQ ID NO: 730 - DNA, 46 bp, Artificial Sequence
  Synthetic
aggaccacccctatccatttgatcctaatagagaacgtttagtctg

SEQ ID NO: 731 - DNA, 50 bp, Artificial Sequence
  Synthetic
tttctgtaaaaatcagcaagctgttctctttacaatgtatattttgtggc

SEQ ID NO: 732 - DNA, 44 bp, Artificial Sequence
  Synthetic
ccgttgcgcactaaatagaagtgatggcaatgttagatcttgtt

SEQ ID NO: 733 - DNA, 40 bp, Artificial Sequence
  Synthetic
gaagagtacgaacagcagtagcacacctgttgtcacactt

SEQ ID NO: 734 - DNA, 47 bp, Artificial Sequence
  Synthetic
gagagatacatgaaccgtctgtacatgcgtagattttaattctctgg

SEQ ID NO: 735 - DNA, 45 bp, Artificial Sequence
  Synthetic
atagcgactacctgagaagtacttttaaactttcaggacagtgga

SEQ ID NO: 736 - DNA, 45 bp, Artificial Sequence
  Synthetic
tgctgaagctgttcgatgatctaatatggtgagtttccatcatgg

SEQ ID NO: 737 - DNA, 50 bp, Artificial Sequence
  Synthetic
tgcccaagtatcattggttatttcatttccaaataaattacctgtcactg

SEQ ID NO: 738 - DNA, 40 bp, Artificial Sequence
  Synthetic
atgtggacggggtgttgctggggaacccaccaaaaggaaa

SEQ ID NO: 739 - DNA, 39 bp, Artificial Sequence
  Synthetic
cccgttcgctgagttgatcgagccaactgctgtcccaac

SEQ ID NO: 740 - DNA, 43 bp, Artificial Sequence
  Synthetic
agcgcgctttgatctatacatttttaaacctccaaaacacacg

SEQ ID NO: 741 - DNA, 43 bp, Artificial Sequence
  Synthetic
tggtacagtctccggtaaaggtataggtccggaagaggatcag

SEQ ID NO: 742 - DNA, 43 bp, Artificial Sequence
  Synthetic
tccgctgcatctgtatatatttcatcttcctgatccagcactt

SEQ ID NO: 743 - DNA, 47 bp, Artificial Sequence
  Synthetic
tgatcctattcaagggttgtaactctccggactttaatgtatttgtg

SEQ ID NO: 744 - DNA, 45 bp, Artificial Sequence
  Synthetic
ctctctaagatcccgctcaaactctttgaatttgaaaatcccgcg

SEQ ID NO: 745 - DNA, 44 bp, Artificial Sequence
  Synthetic
cctccccctaatccatctactataggaccctgatgtgtctgatg

SEQ ID NO: 746 - DNA, 41 bp, Artificial Sequence
  Synthetic
gatgacccgatgttcccaatcgagggtaagaggtatccaaa

SEQ ID NO: 747 - DNA, 44 bp, Artificial Sequence
  Synthetic
agccaatatcacacatatccccattgattgtcctccaattcagc

SEQ ID NO: 748 - DNA, 47 bp, Artificial Sequence
  Synthetic
tcacagttgaacattcacagtacatactgtgaactagtatactgtga

SEQ ID NO: 749 - DNA, 43 bp, Artificial Sequence
  Synthetic
tctgaacttgcacttacctttacaacctagggctactttccga

SEQ ID NO: 750 - DNA, 47 bp, Artificial Sequence
  Synthetic
cgtagtgtagtttgatacagttcctaaggaatacaaaagactatgcc

SEQ ID NO: 751 - DNA, 42 bp, Artificial Sequence
  Synthetic
gtactgctctgacaccttggatatggcccatgctactcaaga

SEQ ID NO: 752 - DNA, 48 bp, Artificial Sequence
  Synthetic
acctttttgtcactaggaaggtctatctctgataatcttgaagcattt

SEQ ID NO: 753 - DNA, 44 bp, Artificial Sequence
  Synthetic
gctaacgaagtgtccatgtgttcgtcatggaatagcgataaggg

SEQ ID NO: 754 - DNA, 45 bp, Artificial Sequence
  Synthetic
aggaaatcctcaaaatgaattccctctaggctttctgctaggtat

SEQ ID NO: 755 - DNA, 50 bp, Artificial Sequence
  Synthetic
gacaaaacctcgttgcttaaaaggtaatgatctagaaataaagctggaag

SEQ ID NO: 756 - DNA, 40 bp, Artificial Sequence
  Synthetic
gactcaactcagcaacagtctgtaagcgccctaaaacgaa

SEQ ID NO: 757 - DNA, 45 bp, Artificial Sequence
  Synthetic
gcagaaatatgatttcccagtgtcactttcttacagggtgttcca

SEQ ID NO: 758 - DNA, 44 bp, Artificial Sequence
  Synthetic
ggatcttaaatcagtttctccccttcacaggaaactctgacaga

SEQ ID NO: 759 - DNA, 40 bp, Artificial Sequence
  Synthetic
tgctccggaggttcgttctcccggcccacaatcttcgatc

SEQ ID NO: 760 - DNA, 49 bp, Artificial Sequence
  Synthetic
cgatctgctaatgtattgccttctagaatttgtatagacactgtaaagc

SEQ ID NO: 761 - DNA, 39 bp, Artificial Sequence
  Synthetic
tgcttctgcatgcacacttgcagtccctatgaacctcct

SEQ ID NO: 762 - DNA, 48 bp, Artificial Sequence
  Synthetic
ggcgggattttcaaattcaaattgagttacattcaacaaatcagaaca

SEQ ID NO: 763 - DNA, 44 bp, Artificial Sequence
  Synthetic
aggctctataggttcaattgcactattagtaccagaagcggtac

SEQ ID NO: 764 - DNA, 41 bp, Artificial Sequence
  Synthetic
tttgccacaggtttagccggtgttttgatgttttgcagatg

SEQ ID NO: 765 - DNA, 45 bp, Artificial Sequence
  Synthetic
cgttcaggattgaaaattgactgatccaatatcgagtgtttaggc

SEQ ID NO: 766 - DNA, 41 bp, Artificial Sequence
  Synthetic
taggtggacagtctcctgcatattgggatgttgctaaacca

SEQ ID NO: 767 - DNA, 44 bp, Artificial Sequence
  Synthetic
aatggcgagcatacgactgcgatgtttatggcgataaatgtttc

SEQ ID NO: 768 - DNA, 46 bp, Artificial Sequence
  Synthetic
gacatcttgttgccaaagatgttatgaatggcaattagcttttgtg

SEQ ID NO: 769 - DNA, 45 bp, Artificial Sequence
  Synthetic
ggctatgttccaaacaacttaccttgctggacaggtagtattgtc

SEQ ID NO: 770 - DNA, 41 bp, Artificial Sequence
  Synthetic
cccttatcaacaaaactgcttgctcgttggatgatgctgaa

SEQ ID NO: 771 - DNA, 43 bp, Artificial Sequence
  Synthetic
gcaacaaaaaaaagccttacacctctggagccagcaaatcctt

SEQ ID NO: 772 - DNA, 47 bp, Artificial Sequence
  Synthetic
tccacaggttcatcgtctagtaaaagtttaacagctttagatgactt

SEQ ID NO: 773 - DNA, 44 bp, Artificial Sequence
  Synthetic
attcattatggcggttcccatggtggaattgtagaagatgaagc

SEQ ID NO: 774 - DNA, 40 bp, Artificial Sequence
  Synthetic
gatggtgtttcggaactgatcgggtcctctccagtctctc

SEQ ID NO: 775 - DNA, 44 bp, Artificial Sequence
  Synthetic
ttgctgttccaccaattggtttatttggcaatttaggaataggg

SEQ ID NO: 776 - DNA, 41 bp, Artificial Sequence
  Synthetic
gtgcttgtactaggacccgcagaagaaattgaattaggccc

SEQ ID NO: 777 - DNA, 44 bp, Artificial Sequence
  Synthetic
cctgtgacttttggtacttctacttgatcgcctcttaacagtgg

SEQ ID NO: 778 - DNA, 48 bp, Artificial Sequence
  Synthetic
ggccatatctaatctgttgtcttctaattagttgatgtagaaaaccct

SEQ ID NO: 779 - DNA, 50 bp, Artificial Sequence
  Synthetic
accgtcttcctaaataagactgacttccttataaagacctaaagttttgg

SEQ ID NO: 780 - DNA, 43 bp, Artificial Sequence
  Synthetic
aattgttgggtgcggtaaggaatttccatcaagcaatactgac

SEQ ID NO: 781 - DNA, 46 bp, Artificial Sequence
  Synthetic
tgcatgtgtctaaatcttcttgtctcgacaaaacagtcaaatcaac

SEQ ID NO: 782 - DNA, 40 bp, Artificial Sequence
  Synthetic
tggtgctatgtttcttggagccgtccgtagaaatgaaggg

SEQ ID NO: 783 - DNA, 46 bp, Artificial Sequence
  Synthetic
ccgcttttaatgcatctgaaacattaagaagatctgtggatacctc

SEQ ID NO: 784 - DNA, 40 bp, Artificial Sequence
  Synthetic
gcaggctaggacacggtcacccctccactagtttggtcga

SEQ ID NO: 785 - DNA, 40 bp, Artificial Sequence
  Synthetic
gtgaattcagtgctggtgcctccatctaagttcacagagc

SEQ ID NO: 786 - DNA, 44 bp, Artificial Sequence
  Synthetic
gccaaatactcccatgtccttaagaaaagctacttccaaaggct

SEQ ID NO: 787 - DNA, 39 bp, Artificial Sequence
  Synthetic
tgttgtagatggcgtcgctgatccaggagatcgaggtat

SEQ ID NO: 788 - DNA, 43 bp, Artificial Sequence
  Synthetic
ccagtaaattctgtgcacattggtgacccactggatcttctcc

SEQ ID NO: 789 - DNA, 46 bp, Artificial Sequence
  Synthetic
accaatgtagagttttgtgccaaatcaaattacctcataccactgc

SEQ ID NO: 790 - DNA, 46 bp, Artificial Sequence
  Synthetic
ggattgtaagccaatatcccatacagtggtccagaagatagaaagg

SEQ ID NO: 791 - DNA, 44 bp, Artificial Sequence
  Synthetic
tgcgttcttgtttttgatttctgtcgatgtagagagcttcctcg

SEQ ID NO: 792 - DNA, 41 bp, Artificial Sequence
  Synthetic
ctttgccatgtgtaatcatcccaaggcaatgtatgtgcctc

SEQ ID NO: 793 - DNA, 41 bp, Artificial Sequence
  Synthetic
tgcttccacatgtttggctctgatgttcataccacgattgt

SEQ ID NO: 794 - DNA, 41 bp, Artificial Sequence
  Synthetic
ggagtagtaaacaccggatgtgcctactggagcacatggag

SEQ ID NO: 795 - DNA, 42 bp, Artificial Sequence
  Synthetic
gcaaaacagacataaccgcctctagatgtatacatggcccca

SEQ ID NO: 796 - DNA, 43 bp, Artificial Sequence
  Synthetic
cgagtcatgtatggatgctatttgtaagccagggaaaagcttg

SEQ ID NO: 797 - DNA, 44 bp, Artificial Sequence
  Synthetic
tggatgtagttagtgatttgccagaaaagaactgagccagtgtg

SEQ ID NO: 798 - DNA, 45 bp, Artificial Sequence
  Synthetic
agtggggggacttagagtgtgttgtttactagtaactttgtgttg

SEQ ID NO: 799 - DNA, 42 bp, Artificial Sequence
  Synthetic
gtgttggtaagacacagatacgatcaccacagagaaagggga

SEQ ID NO: 800 - DNA, 46 bp, Artificial Sequence
  Synthetic
gccatggttattggtcctacatctactactttagtagtgcactcca

SEQ ID NO: 801 - DNA, 48 bp, Artificial Sequence
  Synthetic
cttggttttggtgggtgtgtttaattgtatctaaacaaaaggtgagag

SEQ ID NO: 802 - DNA, 42 bp, Artificial Sequence
  Synthetic
cctccccatactctttcattgtttattttgtgcgacaatgct

SEQ ID NO: 803 - DNA, 45 bp, Artificial Sequence
  Synthetic
attcggaagtctaagtggtcgtgaagtaaatgctagaattgaacc

SEQ ID NO: 804 - DNA, 42 bp, Artificial Sequence
  Synthetic
ctcatgcttgcaatgtgttcaatgctggatagagcttgatga

SEQ ID NO: 805 - DNA, 43 bp, Artificial Sequence
  Synthetic
gtcagtgagagaaaactccatgcatcccacttaaggaatgaca

SEQ ID NO: 806 - DNA, 40 bp, Artificial Sequence
  Synthetic
tttgacagaggactcagcttcacgttgtctcctccagtca

SEQ ID NO: 807 - DNA, 43 bp, Artificial Sequence
  Synthetic
ggattcttctcctgtcttcctgatgcactcgcgagatactgac

SEQ ID NO: 808 - DNA, 46 bp, Artificial Sequence
  Synthetic
catgttttagcctttcgaccttttccaagcacagtccattatccaa

SEQ ID NO: 809 - DNA, 44 bp, Artificial Sequence
  Synthetic
ccaccattaaaggggcaattttgacatcagagtcacagttaacg

SEQ ID NO: 810 - DNA, 45 bp, Artificial Sequence
  Synthetic
ggcacatctccaaaagcgaaggctgctagaaatattgttagaaga

SEQ ID NO: 811 - DNA, 42 bp, Artificial Sequence
  Synthetic
cccgaccattgtgaattcctcataggcaacctccaaacattg

SEQ ID NO: 812 - DNA, 39 bp, Artificial Sequence
  Synthetic
aggacctttgcatccttttggaaaccagcggctaaatcc

SEQ ID NO: 813 - DNA, 40 bp, Artificial Sequence
  Synthetic
cagcttttctgttccctgtgttcagaggggaaacgtactc

SEQ ID NO: 814 - DNA, 39 bp, Artificial Sequence
  Synthetic
catcctactctgcttcggcgcgtactgggaacatttgac

SEQ ID NO: 815 - DNA, 48 bp, Artificial Sequence
  Synthetic
gctaccaaatcaaatttctcttgcaaccattgcatcaaatttacatga

SEQ ID NO: 816 - DNA, 48 bp, Artificial Sequence
  Synthetic
cgagactgtagaatcacaatcacttattgtatggatgacatagagact

SEQ ID NO: 817 - DNA, 45 bp, Artificial Sequence
  Synthetic
gttcagcttcatcttcgcctaaaagaaagacaaagtaaaaggaga

SEQ ID NO: 818 - DNA, 40 bp, Artificial Sequence
  Synthetic
gctcagcgacagagttggtggtaacagcaacggtcggagg

SEQ ID NO: 819 - DNA, 43 bp, Artificial Sequence
  Synthetic
gaagtcgttcaagtctcgatagacctgctgaggaagttggaag

SEQ ID NO: 820 - DNA, 43 bp, Artificial Sequence
  Synthetic
tgacctccaccacccttaccttggaagtattctttatttgggt

SEQ ID NO: 821 - DNA, 43 bp, Artificial Sequence
  Synthetic
acaccagttacttcagaaacaagatgtcctggtttgcctacag

SEQ ID NO: 822 - DNA, 48 bp, Artificial Sequence
  Synthetic
gcgccttatattagcaggatgtatcagcaatattttacctcttactcc

SEQ ID NO: 823 - DNA, 47 bp, Artificial Sequence
  Synthetic
cgtcattcaaaacgtcaaagtaaggtctttattttcatgccaattcg

SEQ ID NO: 824 - DNA, 43 bp, Artificial Sequence
  Synthetic
gggcataaacattaggattttccgtcctctaggcataggaacg

SEQ ID NO: 825 - DNA, 41 bp, Artificial Sequence
  Synthetic
ggaggctgcacgacactcatactcactcccctgtgaggaac

SEQ ID NO: 826 - DNA, 39 bp, Artificial Sequence
  Synthetic
accaacgatctggccgccgaaagaaacaccaaccgtcgc

SEQ ID NO: 827 - DNA, 38 bp, Artificial Sequence
  Synthetic
gctctcacgcaaggcacacatagtgctggaagcggagg

SEQ ID NO: 828 - DNA, 42 bp, Artificial Sequence
  Synthetic
ttcgggcactctcagaatgctcatgatgatgaactggtcgcc

SEQ ID NO: 829 - DNA, 40 bp, Artificial Sequence
  Synthetic
gttccaagggcttgcatgcgaccgcagcaatttcaactcc

SEQ ID NO: 830 - DNA, 40 bp, Artificial Sequence
  Synthetic
agagttcatccacgtgcaccctcatgctagagagcctgcg

SEQ ID NO: 831 - DNA, 41 bp, Artificial Sequence
  Synthetic
gggcatggtggtaaagctgcagtcccctcctcttttcaacc

SEQ ID NO: 832 - DNA, 36 bp, Artificial Sequence
  Synthetic
acaccaaccggcggtaccccggcaaggtcgaagcag

SEQ ID NO: 833 - DNA, 36 bp, Artificial Sequence
  Synthetic
acgcagcggtgtctgcaccgccgtagctgttgagcc

SEQ ID NO: 834 - DNA, 42 bp, Artificial Sequence
  Synthetic
agccagcaccgtgataaacagtaacagccactcagagtttcc

SEQ ID NO: 835 - DNA, 38 bp, Artificial Sequence
  Synthetic
ttggccacgcccctcgtaccatcagggcacgtagtagg

SEQ ID NO: 836 - DNA, 42 bp, Artificial Sequence
  Synthetic
ggagtggcactcgtcacagatgatatgggaagtttctggccg

SEQ ID NO: 837 - DNA, 40 bp, Artificial Sequence
  Synthetic
cgcctgaggtggggatcacattaggtctcaatgctgtcgc

SEQ ID NO: 838 - DNA, 39 bp, Artificial Sequence
  Synthetic
agcttcacagagcacgacgcaaagccgggggtgtatagg

SEQ ID NO: 839 - DNA, 42 bp, Artificial Sequence
  Synthetic
taggaggggggtaggacctgtggggacgtgatgtggaaatgt

SEQ ID NO: 840 - DNA, 42 bp, Artificial Sequence
  Synthetic
cagcccaaggaccttttgcttggctctaagcacatcccctac

SEQ ID NO: 841 - DNA, 38 bp, Artificial Sequence
  Synthetic
aagctgtggacgcggagggtcaacatattgggcggctg

SEQ ID NO: 842 - DNA, 40 bp, Artificial Sequence
  Synthetic
gtttgatgcgtccgtctcgggatagcctttgcctccaggg

SEQ ID NO: 843 - DNA, 41 bp, Artificial Sequence
  Synthetic
tccggggtcctgtgatcttcatgtgtgtcacaccacttgct

SEQ ID NO: 844 - DNA, 42 bp, Artificial Sequence
  Synthetic
gcccacagagaagctcacctcaaggatacatcgttatgcgcc

SEQ ID NO: 845 - DNA, 42 bp, Artificial Sequence
  Synthetic
ggtggtctatggcactctgctgtcctcgactcgtttgatcct

SEQ ID NO: 846 - DNA, 40 bp, Artificial Sequence
  Synthetic
gccggctattgaccctccgacaacagctggctgataaggt

SEQ ID NO: 847 - DNA, 42 bp, Artificial Sequence
  Synthetic
acccgcacggataagtctggatagtcttctgtgtagacccgt

SEQ ID NO: 848 - DNA, 38 bp, Artificial Sequence
  Synthetic
tggcacggcatctgcgatagccctcacagaacgcctct

SEQ ID NO: 849 - DNA, 42 bp, Artificial Sequence
  Synthetic
tggtacagtcacgggtgaggtaaacatcatgctcgtccaacg

SEQ ID NO: 850 - DNA, 40 bp, Artificial Sequence
  Synthetic
cgctcccaccctgttgagtttggtatggcagctttttccc

SEQ ID NO: 851 - DNA, 44 bp, Artificial Sequence
  Synthetic
gcaatgtaggcttcaatgttctcatgtcaaaacagaaagacgcc

SEQ ID NO: 852 - DNA, 45 bp, Artificial Sequence
  Synthetic
gtcaattcaacaactgcatggtagggattccattgggatcagact

SEQ ID NO: 853 - DNA, 45 bp, Artificial Sequence
  Synthetic
cgatgtgcttttccattatccattttctgctgaattgttcactct

SEQ ID NO: 854 - DNA, 43 bp, Artificial Sequence
  Synthetic
ggagtgatgcttctgcgatggtaaaagcaaactacaatgatgc

SEQ ID NO: 855 - DNA, 46 bp, Artificial Sequence
  Synthetic
ctaaccatagcagagaccaaactggtattaatgatggcatgctttg

SEQ ID NO: 856 - DNA, 46 bp, Artificial Sequence
  Synthetic
tggttttttgggtcttttcactcttacaccctttctttttcgaatt

SEQ ID NO: 857 - DNA, 42 bp, Artificial Sequence
  Synthetic
gccaaatcttgtaagcatacaggaaacgtttggggtatcgtt

SEQ ID NO: 858 - DNA, 39 bp, Artificial Sequence
  Synthetic
acacctgttccacaagtgtgagaggaggagcagcaagaa

SEQ ID NO: 859 - DNA, 50 bp, Artificial Sequence
  Synthetic
tcttctaggattccactgtcatcaaactttatcatctagaaagcaaactc

SEQ ID NO: 860 - DNA, 47 bp, Artificial Sequence
  Synthetic
ccaaacacatatgaagcatttccaaaaaattcgtagtgtacctgttg

SEQ ID NO: 861 - DNA, 47 bp, Artificial Sequence
  Synthetic
gaaggttctgttggcacatctatatagatagtaaacatagacagcct

SEQ ID NO: 862 - DNA, 43 bp, Artificial Sequence
  Synthetic
cattgtattcagaaactaccagtgccacgtcagcaaggcatta

SEQ ID NO: 863 - DNA, 43 bp, Artificial Sequence
  Synthetic
gcacagtccattctccagttttacttacagagccatcagggga

SEQ ID NO: 864 - DNA, 44 bp, Artificial Sequence
  Synthetic
gcatttgcccctcctctaattatatctgtctagacttagagcgt

SEQ ID NO: 865 - DNA, 42 bp, Artificial Sequence
  Synthetic
tgccatctggaattactctgctaggtacaggaggttctatgg

SEQ ID NO: 866 - DNA, 45 bp, Artificial Sequence
  Synthetic
cgtatcctattcaaaccttgactgaaatcaaagggaggagtttca

SEQ ID NO: 867 - DNA, 43 bp, Artificial Sequence
  Synthetic
agcctcagtaaatgctgtattctgtgttgatcagcttgccgaa

SEQ ID NO: 868 - DNA, 48 bp, Artificial Sequence
  Synthetic
gaccaacaccttagattgatctacattcattctgctactgatagactc

SEQ ID NO: 869 - DNA, 48 bp, Artificial Sequence
  Synthetic
ccttgttctcgctttccataaaagaatggcctgatttacttaaaatgt

SEQ ID NO: 870 - DNA, 50 bp, Artificial Sequence
  Synthetic
cctgtagtggaattttacaaagctgaacattatctcagacatgtagaaga

SEQ ID NO: 871 - DNA, 47 bp, Artificial Sequence
  Synthetic
actcaagctgaagtgtgcaaattgattactactgtgaaactactctg

SEQ ID NO: 872 - DNA, 44 bp, Artificial Sequence
  Synthetic
acgttatctccctcttaagtttcctcctcaatgggaatggagat

SEQ ID NO: 873 - DNA, 43 bp, Artificial Sequence
  Synthetic
cgcatttgaaaaaaagacgatcaagttgccgcgagtatcattg

SEQ ID NO: 874 - DNA, 44 bp, Artificial Sequence
  Synthetic
tcatctgatatagcatcccctgtttggtacgggatgtaatggat

SEQ ID NO: 875 - DNA, 46 bp, Artificial Sequence
  Synthetic
ctgctgagtttccacttcagtataaaaaggagattatttgaaagcg

SEQ ID NO: 876 - DNA, 43 bp, Artificial Sequence
  Synthetic
tgtgttagtattttgtcctgacacagaggacgaggacaaggaa

SEQ ID NO: 877 - DNA, 45 bp, Artificial Sequence
  Synthetic
gcacttccactgtatatccatgtttacattacaagacgttagcct

SEQ ID NO: 878 - DNA, 46 bp, Artificial Sequence
  Synthetic
aggtgtggtatcagttgaagtagtaaacatctgtaccttccattcc

SEQ ID NO: 879 - DNA, 46 bp, Artificial Sequence
  Synthetic
gcttacaaccttagatactgggacatttttcagatgtctctttggc

SEQ ID NO: 880 - DNA, 40 bp, Artificial Sequence
  Synthetic
ctacacaggcccaaaccagcaagtttggttttcctgacac

SEQ ID NO: 881 - DNA, 42 bp, Artificial Sequence
  Synthetic
tcaccatcctgaataactgtgtttaaggatccccatgtacca

SEQ ID NO: 882 - DNA, 50 bp, Artificial Sequence
  Synthetic
cagtagacccagagcctttaatgtattagacatttatttaatagggctgg

SEQ ID NO: 883 - DNA, 49 bp, Artificial Sequence
  Synthetic
ctgatctaggtctgcagaaaactttccccttaaaaaatacactttttgg

SEQ ID NO: 884 - DNA, 43 bp, Artificial Sequence
  Synthetic
gcaggaaacgtacaagtttaaaccacggttgcatgctttttgg

SEQ ID NO: 885 - DNA, 47 bp, Artificial Sequence
  Synthetic
tgtgcataactgtggtaactttctgcaaaagagaactgcaatgtttc

SEQ ID NO: 886 - DNA, 47 bp, Artificial Sequence
  Synthetic
tctttgctttttgtccagatgtcttgtgtattaactgtcaaaagcca

SEQ ID NO: 887 - DNA, 43 bp, Artificial Sequence
  Synthetic
gttctgcttgtccagctggaactgttatgagcaattaaatgac

SEQ ID NO: 888 - DNA, 44 bp, Artificial Sequence
  Synthetic
tcgattttcggatcttccccatatgcttcaatccaatgatcgtc

SEQ ID NO: 889 - DNA, 45 bp, Artificial Sequence
  Synthetic
agtcatacagatccgggagaaattggtgaatagtatctgcaacac

SEQ ID NO: 890 - DNA, 42 bp, Artificial Sequence
  Synthetic
tcttcatgttctttgtccttggaaggtgctagcagaacttca

SEQ ID NO: 891 - DNA, 41 bp, Artificial Sequence
  Synthetic
ccgtctcatgcttgcaatgtagaacttgatgaaatagggga

SEQ ID NO: 892 - DNA, 44 bp, Artificial Sequence
  Synthetic
cttgggtcggtaagggaaaattcatttgaggaatgataccgacg

SEQ ID NO: 893 - DNA, 47 bp, Artificial Sequence
  Synthetic
tcaaagaattctttggtcaggtcttcagattgagagcatgattgaag

SEQ ID NO: 894 - DNA, 46 bp, Artificial Sequence
  Synthetic
ttctctgtgtgaccattttcttgggattacaacacatttccagagg

SEQ ID NO: 895 - DNA, 41 bp, Artificial Sequence
  Synthetic
gctttcttctcattccctccgaccgaggagcatctgtgaga

SEQ ID NO: 896 - DNA, 44 bp, Artificial Sequence
  Synthetic
tgtgtccgtaacttcatactcttactgttctcaaacaagatggc

SEQ ID NO: 897 - DNA, 38 bp, Artificial Sequence
  Synthetic
tctgaggattggagtccgtcatctcgggcagaagaagt

SEQ ID NO: 898 - DNA, 45 bp, Artificial Sequence
  Synthetic
ctggtccaagatcgttgtttatcatagtgtccgggattaatgagt

SEQ ID NO: 899 - DNA, 43 bp, Artificial Sequence
  Synthetic
atcaattcccatttcaagcagacctagggccaaacctgtacaa

SEQ ID NO: 900 - DNA, 45 bp, Artificial Sequence
  Synthetic
caagagaaattcccaccagagtttgttctaacacgaacgtttacg

SEQ ID NO: 901 - DNA, 43 bp, Artificial Sequence
  Synthetic
tcagatacctcgaaagactcctgatttgcttgttgtcagtgct

SEQ ID NO: 902 - DNA, 45 bp, Artificial Sequence
  Synthetic
cctcagcaggtatatcctcataacaagagcagccaaatataggtg

SEQ ID NO: 903 - DNA, 43 bp, Artificial Sequence
  Synthetic
tgcctcatccacaatataccaatcactgtgtgccattcgacac

SEQ ID NO: 904 - DNA, 38 bp, Artificial Sequence
  Synthetic
ggcagtctctgtggcacttgcagaacgagcaggaccta

SEQ ID NO: 905 - DNA, 43 bp, Artificial Sequence
  Synthetic
ggcaagtagagcagatcttgtattagtacagtctctgggaggt

SEQ ID NO: 906 - DNA, 46 bp, Artificial Sequence
  Synthetic
aagtctaactggctccaaaaccttgcattttccttaacagacatca

SEQ ID NO: 907 - DNA, 43 bp, Artificial Sequence
  Synthetic
tgaggccactaagataaagagtcatcaagttgtgccttccctt

SEQ ID NO: 908 - DNA, 42 bp, Artificial Sequence
  Synthetic
cgatttcgggtggtgtctcgacaggacaatccacccaaactg

SEQ ID NO: 909 - DNA, 47 bp, Artificial Sequence
  Synthetic
cgtcgtttacgtactcttaacatgattctgttattttaggggcattt

SEQ ID NO: 910 - DNA, 43 bp, Artificial Sequence
  Synthetic
tgggaacgtgtgattgtacgtgatctagttcagctgttcttca

SEQ ID NO: 911 - DNA, 43 bp, Artificial Sequence
  Synthetic
agaaacgtgtaggcctttcctaactgagttcacaactagtaca

SEQ ID NO: 912 - DNA, 47 bp, Artificial Sequence
  Synthetic
gccatcatttgaggagatagagctagaagtggtgttactataggtgc

SEQ ID NO: 913 - DNA, 47 bp, Artificial Sequence
  Synthetic
atgaactaatttgcgacgtttacgtttagataattcaacaggggatt

SEQ ID NO: 914 - DNA, 44 bp, Artificial Sequence
  Synthetic
ctggaaatctaacacgaaagactctccgtgcaaatgataacact

SEQ ID NO: 915 - DNA, 41 bp, Artificial Sequence
  Synthetic
ttgaccagtgttccccagtgcaaaatgttgcttttgatgca

SEQ ID NO: 916 - DNA, 40 bp, Artificial Sequence
  Synthetic
cagtttttggaacagaacgctgttcctttaggccgcaaat

SEQ ID NO: 917 - DNA, 48 bp, Artificial Sequence
  Synthetic
gtcatgaggctatatgactaggcaattgttaataaacgtttatgctgc

SEQ ID NO: 918 - DNA, 45 bp, Artificial Sequence
  Synthetic
cagatgctctgatttctgtggcgatcatatgaacaaatggagact

SEQ ID NO: 919 - DNA, 47 bp, Artificial Sequence
  Synthetic
cctccagaaatttcggtcattgatgaacaatagcaatggagttaatc

SEQ ID NO: 920 - DNA, 41 bp, Artificial Sequence
  Synthetic
gtcatgcccacttgctactgcatgaggggatcagttgcaca

SEQ ID NO: 921 - DNA, 45 bp, Artificial Sequence
  Synthetic
tggacccctcttgtggaaagcaagtttcataagaggaaagaaagt

SEQ ID NO: 922 - DNA, 48 bp, Artificial Sequence
  Synthetic
gagaacatgaaataaagggctctctaagacaatagcataagaattggt

SEQ ID NO: 923 - DNA, 44 bp, Artificial Sequence
  Synthetic
cgttgtattttaatacagccactgccatgggctggctaacaatc

SEQ ID NO: 924 - DNA, 45 bp, Artificial Sequence
  Synthetic
tctgcacacacacatcactttgaattctcactatgaggaatgttc

SEQ ID NO: 925 - DNA, 43 bp, Artificial Sequence
  Synthetic
gatcccaaatcatctcaaacccattggtgtttggataggaagg

SEQ ID NO: 926 - DNA, 43 bp, Artificial Sequence
  Synthetic
gagttttcaaagatccctgggtgcagattgtgtattggaagca

SEQ ID NO: 927 - DNA, 43 bp, Artificial Sequence
  Synthetic
gccttcttttcattccctccgatactttgtcgaaacactagcg

SEQ ID NO: 928 - DNA, 48 bp, Artificial Sequence
  Synthetic
ctttccctaatcttgccatcttgtgtttagaaatgtcttaagcattgc

SEQ ID NO: 929 - DNA, 41 bp, Artificial Sequence
  Synthetic
gtccgtcccaccagtatgtgagtcttaggagtttcaatcct

SEQ ID NO: 930 - DNA, 42 bp, Artificial Sequence
  Synthetic
accaatgctcatgtcagccgatagccaacttcagtatggagc

SEQ ID NO: 931 - DNA, 45 bp, Artificial Sequence
  Synthetic
atcctcaaagcgcgccatagcgaaaacggtgtatataaaagatgt

SEQ ID NO: 932 - DNA, 44 bp, Artificial Sequence
  Synthetic
tgtctccatacacagagtctgaatatgctgcatgccataaatgt

SEQ ID NO: 933 - DNA, 48 bp, Artificial Sequence
  Synthetic
ttggggctctaaatgcaatacaaaatattaagtatgcatggacctaag

SEQ ID NO: 934 - DNA, 39 bp, Artificial Sequence
  Synthetic
gcatcattgtggacctcctgaacattttgtgaacaggca

SEQ ID NO: 935 - DNA, 38 bp, Artificial Sequence
  Synthetic
atacattgccgccatgttcgtgttctgaagtggaagca

SEQ ID NO: 936 - DNA, 43 bp, Artificial Sequence
  Synthetic
acatctaaatcgtatccactgtgacgtgccacaatgtgcaaac

SEQ ID NO: 937 - DNA, 44 bp, Artificial Sequence
  Synthetic
atgttcccttgctgcaaagaatgacatagacagccaaatacagt

SEQ ID NO: 938 - DNA, 45 bp, Artificial Sequence
  Synthetic
ccatgttcctgcatcagtcatatggcaacaaagacaattgtatga

SEQ ID NO: 939 - DNA, 40 bp, Artificial Sequence
  Synthetic
ggtgctggaatacggtgagggcggtatccgctactcagct

SEQ ID NO: 940 - DNA, 48 bp, Artificial Sequence
  Synthetic
tgccaggtggatgatatatctctatacagtttaaaatgtttacggtac

SEQ ID NO: 941 - DNA, 40 bp, Artificial Sequence
  Synthetic
ataccaatacccatgcatacgctatgtgtgctgccatgtc

SEQ ID NO: 942 - DNA, 50 bp, Artificial Sequence
  Synthetic
aacatcactacgaggatcaaatgtttcctctttaattacatatgacaacc

SEQ ID NO: 943 - DNA, 41 bp, Artificial Sequence
  Synthetic
agggtccatgtcatctgcatattgcagcctttagtatctgc

SEQ ID NO: 944 - DNA, 42 bp, Artificial Sequence
  Synthetic
cacagcccaaaatacataactgtgtgaggacgttagggacaa

SEQ ID NO: 945 - DNA, 44 bp, Artificial Sequence
  Synthetic
tgctctattccaaaaatgcctagcgggattccatgtttttttgc

SEQ ID NO: 946 - DNA, 45 bp, Artificial Sequence
  Synthetic
gagactgtgtagaagcacatattgttgtttgctggcataatcaat

SEQ ID NO: 947 - DNA, 42 bp, Artificial Sequence
  Synthetic
tgctgtaaggtgtgcagttttaatttgtgtttgtggtatggg

SEQ ID NO: 948 - DNA, 43 bp, Artificial Sequence
  Synthetic
cggtataagggaaagttgtgcttatggatgtcaatccgacctt

SEQ ID NO: 949 - DNA, 45 bp, Artificial Sequence
  Synthetic
cgagttttcaaaaataccaggatggacagattgtgtattggaagc

SEQ ID NO: 950 - DNA, 38 bp, Artificial Sequence
  Synthetic
tctcattgcctccaactggcttgagacactggcaagga

SEQ ID NO: 951 - DNA, 42 bp, Artificial Sequence
  Synthetic
ccatcccaccagtaagtagtcttgttaggcgtctccatcctg

SEQ ID NO: 952 - DNA, 39 bp, Artificial Sequence
  Synthetic
ctgactcgttgctcccagactttgttgccaatttcagca

SEQ ID NO: 953 - DNA, 47 bp, Artificial Sequence
  Synthetic
actgctggggaagaatttttcaaattgaatacaagtcaaagaggagt

SEQ ID NO: 954 - DNA, 36 bp, Artificial Sequence
  Synthetic
acaggatccaccgcctttcgcgccccaccacctcaa

SEQ ID NO: 955 - DNA, 39 bp, Artificial Sequence
  Synthetic
ggagcccacaacaatagtgggctcggggacagctatgcg

SEQ ID NO: 956 - DNA, 37 bp, Artificial Sequence
  Synthetic
ggctccgccaaacttcccaatggagttgctacgcggc

SEQ ID NO: 957 - DNA, 38 bp, Artificial Sequence
  Synthetic
gtgcctcgcccaccactaaattggtgttggagcaacgc

SEQ ID NO: 958 - DNA, 42 bp, Artificial Sequence
  Synthetic
gccgacactgtgccaagaacctccgagagggaactgtgtgga

SEQ ID NO: 959 - DNA, 42 bp, Artificial Sequence
  Synthetic
gctcacagtcatgttgaccccaaaggccaaaatacctgggtc

SEQ ID NO: 960 - DNA, 40 bp, Artificial Sequence
  Synthetic
ggcggccctttttgacatggatgcgtggacgtctgcaatg

SEQ ID NO: 961 - DNA, 41 bp, Artificial Sequence
  Synthetic
ggcggcgttactgactgaatcaccccactgtcaagcctttg

SEQ ID NO: 962 - DNA, 41 bp, Artificial Sequence
  Synthetic
agcatctggcagtgccgagaactggggttcctagcagtgtg

SEQ ID NO: 963 - DNA, 39 bp, Artificial Sequence
  Synthetic
gcggttgcctatgggagtgtctggtgcgtgttctaccaa

SEQ ID NO: 964 - DNA, 35 bp, Artificial Sequence
  Synthetic
ctggcttcacagcgacgggcagcggcagagcggtt

SEQ ID NO: 965 - DNA, 39 bp, Artificial Sequence
  Synthetic
ctggttgaccaccacctggctcatggcactaacgggagg

SEQ ID NO: 966 - DNA, 39 bp, Artificial Sequence
  Synthetic
gacccgattgccacgatgcaatcttgtgtgacgagggcc

SEQ ID NO: 967 - DNA, 42 bp, Artificial Sequence
  Synthetic
catgcccagaacactaacgccgggccatgacgtggtgatctg

SEQ ID NO: 968 - DNA, 41 bp, Artificial Sequence
  Synthetic
cgtcctctcgcactcaacctttttgcaagatacgccactgg

SEQ ID NO: 969 - DNA, 40 bp, Artificial Sequence
  Synthetic
ccagcgcggagtagtagtgtcctgaggatgcaacgcaggg

SEQ ID NO: 970 - DNA, 38 bp, Artificial Sequence
  Synthetic
ggcccccccacctgagtaataatgggcccccagctgat

SEQ ID NO: 971 - DNA, 35 bp, Artificial Sequence
  Synthetic
tcacaggggtagcgctccccggcgaggagtcccaa

SEQ ID NO: 972 - DNA, 41 bp, Artificial Sequence
  Synthetic
ccaccccgagaggtggattccttttcaccaatggtcgctcg

SEQ ID NO: 973 - DNA, 40 bp, Artificial Sequence
  Synthetic
gccaggcaggagatgatgcattgacctcctttctggcaag

SEQ ID NO: 974 - DNA, 38 bp, Artificial Sequence
  Synthetic
agagggattttgaggcgcgggccttggtcgctacctgt

SEQ ID NO: 975 - DNA, 37 bp, Artificial Sequence
  Synthetic
cgtcaccgtaaccgtgccagccagcttggttgcgcag

SEQ ID NO: 976 - DNA, 41 bp, Artificial Sequence
  Synthetic
catcctccagagcctgcaaggttgaggctatagggtctgca

SEQ ID NO: 977 - DNA, 41 bp, Artificial Sequence
  Synthetic
caatgtcccccactgtgtctgtatccgtgatgaggtgaggg

SEQ ID NO: 978 - DNA, 42 bp, Artificial Sequence
  Synthetic
acagttatcgcagccggatgttccaaaccagcgtgtaaaagc

SEQ ID NO: 979 - DNA, 42 bp, Artificial Sequence
  Synthetic
gccgagcaacactcagctgtatttaaggctgctttggctgac

SEQ ID NO: 980 - DNA, 41 bp, Artificial Sequence
  Synthetic
atccggtgatgaaccacttcggacccagtggtgagatacgt

SEQ ID NO: 981 - DNA, 49 bp, Artificial Sequence
  Synthetic
tgccacagaaattgcaaggtattatacctttaagtattagagacttagc

SEQ ID NO: 982 - DNA, 42 bp, Artificial Sequence
  Synthetic
attcccttccaggcgttccttagaaaagttagattgctgtgg

SEQ ID NO: 983 - DNA, 50 bp, Artificial Sequence
  Synthetic
tgctccagttcagtatcatctaacaacaattatttgagagagatacagac

SEQ ID NO: 984 - DNA, 43 bp, Artificial Sequence
  Synthetic
gcagtgtaatgtatatctacgtcccgtggaggtaccggctatt

SEQ ID NO: 985 - DNA, 46 bp, Artificial Sequence
  Synthetic
ggacccagatatagtcacaatgccatgatgatctatttgaaagctc

SEQ ID NO: 986 - DNA, 48 bp, Artificial Sequence
  Synthetic
tggtatgctatatctgcttcgtctaggcaagtacttttgatttttcag

SEQ ID NO: 987 - DNA, 47 bp, Artificial Sequence
  Synthetic
acactctacccttcaacactcttattgcattttaatttatggtcctc

SEQ ID NO: 988 - DNA, 48 bp, Artificial Sequence
  Synthetic
gccttgtaaaaaaagatttccagcttatgaaagcagataatacacctc

SEQ ID NO: 989 - DNA, 35 bp, Artificial Sequence
  Synthetic
gtcgcgggggtggtgtttgcagctccacgcctcca

SEQ ID NO: 990 - DNA, 38 bp, Artificial Sequence
  Synthetic
ctccccttctgcaggtggttgtcgggcccttacaagca

SEQ ID NO: 991 - DNA, 42 bp, Artificial Sequence
  Synthetic
agcttcttccagtaatcttccaaggagggtcacttcgatcag

SEQ ID NO: 992 - DNA, 43 bp, Artificial Sequence
  Synthetic
caggttgccataggccttatcaaggagagattttgatgaagcg

SEQ ID NO: 993 - DNA, 42 bp, Artificial Sequence
  Synthetic
gcccctcaggtacaggatggattctaactgagtccacaggcg

SEQ ID NO: 994 - DNA, 48 bp, Artificial Sequence
  Synthetic
ggttcttcaaagacatccagatcatttcgttttgcatttgataatcct

SEQ ID NO: 995 - DNA, 49 bp, Artificial Sequence
  Synthetic
tttctgcattattacgtgactctggcatactatacacaagacacaaagg

SEQ ID NO: 996 - DNA, 48 bp, Artificial Sequence
  Synthetic
ggatcaaaagatgtatcctgtctgtaaagatacagaaaacagtaatgc

SEQ ID NO: 997 - DNA, 49 bp, Artificial Sequence
  Synthetic
ccactaacagttgggaaatacatggcaaaaatcagttttacattccagg

SEQ ID NO: 998 - DNA, 43 bp, Artificial Sequence
  Synthetic
cgttttgttcctctattagacccttccaagctgggttacaaca

SEQ ID NO: 999 - DNA, 48 bp, Artificial Sequence
  Synthetic
tgggttggtacattcattgaaatgtgacaatatgtttactcatgcaga

SEQ ID NO: 1000 - DNA, 45 bp, Artificial Sequence
  Synthetic
acataaggttctcttgtcacccaaactttctccaaggacaactca

SEQ ID NO: 1001 - DNA, 41 bp, Artificial Sequence
  Synthetic
ccccagtgacacaaacatgtaacatagcatggtccagctca

SEQ ID NO: 1002 - DNA, 38 bp, Artificial Sequence
  Synthetic
ataccgggggtaacaggagccacattggtccactgtca

SEQ ID NO: 1003 - DNA, 40 bp, Artificial Sequence
  Synthetic
agcgcgaatctttcttgattgtggtgggcctttgacaatg

SEQ ID NO: 1004 - DNA, 47 bp, Artificial Sequence
  Synthetic
ggtgttttatcgattgttccggtatgcttcgagcactaataaaactg

SEQ ID NO: 1005 - DNA, 44 bp, Artificial Sequence
  Synthetic
gtccagctttgaccatcatctgagagataaagaagagcgtctac

SEQ ID NO: 1006 - DNA, 47 bp, Artificial Sequence
  Synthetic
tgggattgactttgtttttgtctgatgattcaatggcaaagaaaacc

SEQ ID NO: 1007 - DNA, 43 bp, Artificial Sequence
  Synthetic
ccgaaagtggtgcatagtttcttaaacctttaagttttggcgc

SEQ ID NO: 1008 - DNA, 48 bp, Artificial Sequence
  Synthetic
ctacagcaatttctccaatgacaacaattgattgttgttatgctgaac

SEQ ID NO: 1009 - DNA, 43 bp, Artificial Sequence
  Synthetic
gctctccaatcaataattgctcaaacttgtggagcaggtgtac

SEQ ID NO: 1010 - DNA, 45 bp, Artificial Sequence
  Synthetic
gttcattaaacaatgccagggaattactgatggatctgatgtctc

SEQ ID NO: 1011 - DNA, 43 bp, Artificial Sequence
  Synthetic
tggctcatcatggagattgttatcagtcatgagtcagctgcta

SEQ ID NO: 1012 - DNA, 47 bp, Artificial Sequence
  Synthetic
cacccaggataggttacatcatctaacagatgtagtacattttggtt

SEQ ID NO: 1013 - DNA, 48 bp, Artificial Sequence
  Synthetic
tggatcttctttaggctctagatcatactaataaaacctggacatgtt

SEQ ID NO: 1014 - DNA, 41 bp, Artificial Sequence
  Synthetic
tcgtcttggggtttgcggtacctccggatctcttcaagggt

SEQ ID NO: 1015 - DNA, 47 bp, Artificial Sequence
  Synthetic
tgatgtggtgtctgttacaatgtttaccagatacaatagtgacaact

SEQ ID NO: 1016 - DNA, 48 bp, Artificial Sequence
  Synthetic
tgctagtagttggtaagtcctcaattaacatttggtgaggaaatacca

SEQ ID NO: 1017 - DNA, 48 bp, Artificial Sequence
  Synthetic
tgcgtttcagtacactaggatgtattacctctaatacctggaagatcc

SEQ ID NO: 1018 - DNA, 47 bp, Artificial Sequence
  Synthetic
tgtttggatctggaaattgtagtctttaccgatgagtctaaagtagc

SEQ ID NO: 1019 - DNA, 43 bp, Artificial Sequence
  Synthetic
ccccatcctctgcttgcttttaataagtatgtggatgctgaga

SEQ ID NO: 1020 - DNA, 45 bp, Artificial Sequence
  Synthetic
aggccaaatactgatttcattcgtatggaaatgcaaactttgagc

SEQ ID NO: 1021 - DNA, 41 bp, Artificial Sequence
  Synthetic
tggctcctaatgccctatgtaaaagtggctcacttgtctcc

SEQ ID NO: 1022 - DNA, 50 bp, Artificial Sequence
  Synthetic
gctgtcctctttgatacaaaaatcgtaaacttgagtgaaaagttaactgg

SEQ ID NO: 1023 - DNA, 42 bp, Artificial Sequence
  Synthetic
gggaatgtggtgcttatggcagatgtcaatccgactctactg

SEQ ID NO: 1024 - DNA, 41 bp, Artificial Sequence
  Synthetic
tcaaagatacctgggtgggattacaaacagactgtgtcctg

SEQ ID NO: 1025 - DNA, 46 bp, Artificial Sequence
  Synthetic
ggtcatgttgtctcttactctccttaggatgtgatggaatcaatgg

SEQ ID NO: 1026 - DNA, 42 bp, Artificial Sequence
  Synthetic
attacccccaaccggaagtccgttgaaactttagctagaagc

SEQ ID NO: 1027 - DNA, 45 bp, Artificial Sequence
  Synthetic
tctcttactctcgaacatgtatcctcatcgcaccaataatgttct

SEQ ID NO: 1028 - DNA, 41 bp, Artificial Sequence
  Synthetic
gcccatcccaccagtatgttgagtctcggtactgaatcttg

SEQ ID NO: 1029 - DNA, 45 bp, Artificial Sequence
  Synthetic
ccaaggtcattgtttatcatgttgttggagtgtctggaataaacg

SEQ ID NO: 1030 - DNA, 44 bp, Artificial Sequence
  Synthetic
ggatgtgaaggttccggatattgtaccaatcaagggcaggacta

SEQ ID NO: 1031 - DNA, 40 bp, Artificial Sequence
  Synthetic
ctcgaacaagttgcagcacttagccaaaggggaattcttg

SEQ ID NO: 1032 - DNA, 41 bp, Artificial Sequence
  Synthetic
tcagtctccttcaaatctgtgctagacgtgacaaccgacta

SEQ ID NO: 1033 - DNA, 48 bp, Artificial Sequence
  Synthetic
tcagattctgctatgtcatcagtttcctgatattgttttagaagagct

SEQ ID NO: 1034 - DNA, 38 bp, Artificial Sequence
  Synthetic
atgcaccgctgaaagtctcgaagttttatgccaccccg

SEQ ID NO: 1035 - DNA, 43 bp, Artificial Sequence
  Synthetic
gctagtgacagaggaatgaatagttttcaacctgatgccactg

SEQ ID NO: 1036 - DNA, 42 bp, Artificial Sequence
  Synthetic
gcaatttagcatcacccctgtatcgttgtagctctgcatgga

SEQ ID NO: 1037 - DNA, 46 bp, Artificial Sequence
  Synthetic
tccaattcccaaattgccaaagtataatttgaaggcaacacaatcg

SEQ ID NO: 1038 - DNA, 44 bp, Artificial Sequence
  Synthetic
atcagttccacctgctgcagtcaatagttccattagtagaaggc

SEQ ID NO: 1039 - DNA, 48 bp, Artificial Sequence
  Synthetic
aaacgttccaaaggtatctcttcattgttaatgtattagttgacccca

SEQ ID NO: 1040 - DNA, 46 bp, Artificial Sequence
  Synthetic
cccgctcaaagtataggctcatgttcagtttgaatatagaaatccc

SEQ ID NO: 1041 - DNA, 43 bp, Artificial Sequence
  Synthetic
gcgtgcatgaaagtaaacatcagttaagtactcctgttgccag

SEQ ID NO: 1042 - DNA, 48 bp, Artificial Sequence
  Synthetic
gatgaccagtagatccaacacctattggaaactagtaggtatagaagt

SEQ ID NO: 1043 - DNA, 45 bp, Artificial Sequence
  Synthetic
aggaaagtttgcattaccaaatcctaagtgtcctccaatacaact

SEQ ID NO: 1044 - DNA, 48 bp, Artificial Sequence
  Synthetic
cgttacaaagcagattaacaggcaaaggttgatattaaggacattgtc

SEQ ID NO: 1045 - DNA, 45 bp, Artificial Sequence
  Synthetic
actgtccacaaatagacgtcttttaagatgtagatttgagtccgc

SEQ ID NO: 1046 - DNA, 40 bp, Artificial Sequence
  Synthetic
ctggtgtccccgtcgctttggacgaagacccagatcatcc

SEQ ID NO: 1047 - DNA, 43 bp, Artificial Sequence
  Synthetic
agcgatatctccagcattttaatgtctacaagaagaggctcgg

SEQ ID NO: 1048 - DNA, 42 bp, Artificial Sequence
  Synthetic
acaggttcaaccactatgtttggtggaggtggtggaagagtc

SEQ ID NO: 1049 - DNA, 38 bp, Artificial Sequence
  Synthetic
tataggggctgctggttgcacccgctgtttctacaact

SEQ ID NO: 1050 - DNA, 46 bp, Artificial Sequence
  Synthetic
gctctactaaaagctcttggtgtaggaatttaatattgaagagcca

SEQ ID NO: 1051 - DNA, 44 bp, Artificial Sequence
  Synthetic
catgtgagttactgaaatcctctgtgaaaacagtgatgcacctt

SEQ ID NO: 1052 - DNA, 47 bp, Artificial Sequence
  Synthetic
ggcagccaatatgacatctgtaaagtattacatcccagtcatatccc

SEQ ID NO: 1053 - DNA, 45 bp, Artificial Sequence
  Synthetic
accctattgcaacacgtttacgagacggtttgtttatcaaattgg

SEQ ID NO: 1054 - DNA, 46 bp, Artificial Sequence
  Synthetic
caggatatacctatgaagggtgggttttccaatcttctcatctgac

SEQ ID NO: 1055 - DNA, 47 bp, Artificial Sequence
  Synthetic
gcgacaaaaggtacaaggtagtctactactcctgtaactattaccga

SEQ ID NO: 1056 - DNA, 44 bp, Artificial Sequence
  Synthetic
caaactctgcacactgaatctattcacgaagttttgtcaccaga

SEQ ID NO: 1057 - DNA, 45 bp, Artificial Sequence
  Synthetic
ccactgttctcaaacaatcgtctttgcagacatagatttgagtcc

SEQ ID NO: 1058 - DNA, 48 bp, Artificial Sequence
  Synthetic
tgtagcatttccagttgtacacttatattcaaattatgtgtgaccctc

SEQ ID NO: 1059 - DNA, 49 bp, Artificial Sequence
  Synthetic
gttgaatccaaaaatgactgtgactgtattcactaatacgttttctgga

SEQ ID NO: 1060 - DNA, 39 bp, Artificial Sequence
  Synthetic
gcttcttgcacagcatcgaactcaccagaagaagagcag

SEQ ID NO: 1061 - DNA, 46 bp, Artificial Sequence
  Synthetic
agaggtaacagagggagaaatagttttgatgaaaaagcacaaacct

SEQ ID NO: 1062 - DNA, 50 bp, Artificial Sequence
  Synthetic
caattgtctttgtgcagtgtctttaatgggtagattatgatagtagtagc

SEQ ID NO: 1063 - DNA, 42 bp, Artificial Sequence
  Synthetic
ccttcatttagaggcaccaaagctggatcctttgggacctac

SEQ ID NO: 1064 - DNA, 43 bp, Artificial Sequence
  Synthetic
tgtacttgttgtacccgcctattctaaggcttttcaaagagca

SEQ ID NO: 1065 - DNA, 46 bp, Artificial Sequence
  Synthetic
agtggttgtgctatatctgttacaaatcacaatgccaactattcct

SEQ ID NO: 1066 - DNA, 42 bp, Artificial Sequence
  Synthetic
ggatctggcagcataacccttaatacaaggttgtggtgccta

SEQ ID NO: 1067 - DNA, 46 bp, Artificial Sequence
  Synthetic
tccccataggattcctttgtcatttgtgtacctttggacatagtgg

SEQ ID NO: 1068 - DNA, 44 bp, Artificial Sequence
  Synthetic
ggaacaaatgctaaattccagtcttttcctctggaacctgatgt

SEQ ID NO: 1069 - DNA, 44 bp, Artificial Sequence
  Synthetic
caatgaaacattaaggtgcaagcatacatgttttgagcctctcc

SEQ ID NO: 1070 - DNA, 38 bp, Artificial Sequence
  Synthetic
gcagttaccactcccggtacacagtctttggctgcaac

SEQ ID NO: 1071 - DNA, 42 bp, Artificial Sequence
  Synthetic
aggcagtcccccgtgatagtctccatctcgggggtctctagc

SEQ ID NO: 1072 - DNA, 36 bp, Artificial Sequence
  Synthetic
gacgcaatggacccgagggatgctctggggcacaca

SEQ ID NO: 1073 - DNA, 37 bp, Artificial Sequence
  Synthetic
gcgggagtcgtatctggcgattggggctggacgttcg

SEQ ID NO: 1074 - DNA, 37 bp, Artificial Sequence
  Synthetic
ctggacaaggtcgccatctgcgccacgtacgcgctgt

SEQ ID NO: 1075 - DNA, 39 bp, Artificial Sequence
  Synthetic
ccccctgccttacgtggtctttgttggtgttgacgacgg

SEQ ID NO: 1076 - DNA, 35 bp, Artificial Sequence
  Synthetic
agagccaggaccaggacgcgccacgaccagctgct

SEQ ID NO: 1077 - DNA, 40 bp, Artificial Sequence
  Synthetic
cacgcctacctgaaggtgaccccgtaagcacggggagggt

SEQ ID NO: 1078 - DNA, 35 bp, Artificial Sequence
  Synthetic
agacggcgtccctggagtctctggcggacggaaca

SEQ ID NO: 1079 - DNA, 41 bp, Artificial Sequence
  Synthetic
ccaggtacatcagcagacaggcttctccctgttcaacccca

SEQ ID NO: 1080 - DNA, 40 bp, Artificial Sequence
  Synthetic
tcgtcgtcgaacggttttacgtcagttgccactgggtcct

SEQ ID NO: 1081 - DNA, 38 bp, Artificial Sequence
  Synthetic
gcggtggcgctgttcaagattgcttttggccatctgca

SEQ ID NO: 1082 - DNA, 39 bp, Artificial Sequence
  Synthetic
cccgatgacgtgctggacctatcgaacaccagctgcatg

SEQ ID NO: 1083 - DNA, 37 bp, Artificial Sequence
  Synthetic
cgtcagtttacggaccgcgtggtggtcacgtccccga

SEQ ID NO: 1084 - DNA, 40 bp, Artificial Sequence
  Synthetic
cgggaaaaactaccgcgctgatacactcgtgtccggagag

SEQ ID NO: 1085 - DNA, 40 bp, Artificial Sequence
  Synthetic
ggacgtaaaccaggtgggccagcagatcaccgtcctgttg

SEQ ID NO: 1086 - DNA, 37 bp, Artificial Sequence
  Synthetic
ctcgccgagctatgggcctcgttgtttcggcagcagc

SEQ ID NO: 1087 - DNA, 35 bp, Artificial Sequence
  Synthetic
ggagggcgtaacgttccgcttgctgggtcctgcgg

SEQ ID NO: 1088 - DNA, 35 bp, Artificial Sequence
  Synthetic
gcccgttaaccccccacgtgcccggggcttttcgt

SEQ ID NO: 1089 - DNA, 35 bp, Artificial Sequence
  Synthetic
actgtcgtcggtggcgctgacacaggcgggacacc

SEQ ID NO: 1090 - DNA, 38 bp, Artificial Sequence
  Synthetic
tcaaccccgccctacactacaccagaccccccgaagct

SEQ ID NO: 1091 - DNA, 36 bp, Artificial Sequence
  Synthetic
ttggtgagcgcctggacgctcgctgcttcctcgagt

SEQ ID NO: 1092 - DNA, 38 bp, Artificial Sequence
  Synthetic
cggtttgttggcgcctttatggcgcgcgggactttagc

SEQ ID NO: 1093 - DNA, 37 bp, Artificial Sequence
  Synthetic
ctcctgtgcaccctcacgttctcgggggtttcctccg

SEQ ID NO: 1094 - DNA, 40 bp, Artificial Sequence
  Synthetic
cttcctaacccagaccccggggggcgcgtcagatacagaa

SEQ ID NO: 1095 - DNA, 36 bp, Artificial Sequence
  Synthetic
cccacccccgaaccatgaacccgtggccgagatcgt

SEQ ID NO: 1096 - DNA, 37 bp, Artificial Sequence
  Synthetic
tcagaacgggccggtcgtcggccgattccttcatgca

SEQ ID NO: 1097 - DNA, 36 bp, Artificial Sequence
  Synthetic
aaggtcatccgaggcgccgtcccccaacactgacgt

SEQ ID NO: 1098 - DNA, 38 bp, Artificial Sequence
  Synthetic
aaggctgccgctttacgagggtctcctagttggcccgc

SEQ ID NO: 1099 - DNA, 35 bp, Artificial Sequence
  Synthetic
aatcgtggcgcggctcgtgcggggtttctggggct

SEQ ID NO: 1100 - DNA, 36 bp, Artificial Sequence
  Synthetic
gcgcctgatcgtggagacggctgtacgtcgctggcg

SEQ ID NO: 1101 - DNA, 38 bp, Artificial Sequence
  Synthetic
cgctttgtgactgagaacgtgctggagctggcccagga

SEQ ID NO: 1102 - DNA, 37 bp, Artificial Sequence
  Synthetic
ggctcgtggtccagtgcatcagttcacgaacgccgcg

SEQ ID NO: 1103 - DNA, 41 bp, Artificial Sequence
  Synthetic
gaccagatgctgcacgtgctgtgcatcggcaacaacaaagc

SEQ ID NO: 1104 - DNA, 40 bp, Artificial Sequence
  Synthetic
ctcgtgcgctttctggagctagctccggaaacttggtaca

SEQ ID NO: 1105 - DNA, 35 bp, Artificial Sequence
  Synthetic
accttcagtccggacgggcggtgggcggcagcatt

SEQ ID NO: 1106 - DNA, 35 bp, Artificial Sequence
  Synthetic
taagctccatcgcgggcggacccacgcccacatcc

SEQ ID NO: 1107 - DNA, 36 bp, Artificial Sequence
  Synthetic
tcctggcccagcagacccaggcgttgtagtgtgccc

SEQ ID NO: 1108 - DNA, 34 bp, Artificial Sequence
  Synthetic
tgctcgcgacgtcgggttgcagaccgcgccgttt

SEQ ID NO: 1109 - DNA, 35 bp, Artificial Sequence
  Synthetic
tcgaccgcctggccaaacgcgaatcgcggccagca

SEQ ID NO: 1110 - DNA, 35 bp, Artificial Sequence
  Synthetic
gtggcgtgaaactcccgcaacgaagccatacgcgc

SEQ ID NO: 1111 - DNA, 38 bp, Artificial Sequence
  Synthetic
ggagggggaaggaacgaaacactcttctgcgtgcccgt

SEQ ID NO: 1112 - DNA, 41 bp, Artificial Sequence
  Synthetic
gggaactcgggggtgatgaagtgacgtctgggaacacaggc

SEQ ID NO: 1113 - DNA, 41 bp, Artificial Sequence
  Synthetic
tcttggacatacggccgtcccaccatcacggactttcccct

SEQ ID NO: 1114 - DNA, 36 bp, Artificial Sequence
  Synthetic
gaggccaagctagccgaggctgcgctccatggcaga

SEQ ID NO: 1115 - DNA, 42 bp, Artificial Sequence
  Synthetic
acatcaccaccgtcagcaccttcaaactcgtgatcctccagc

SEQ ID NO: 1116 - DNA, 35 bp, Artificial Sequence
  Synthetic
accccaacgccatcgcctcacgtcgccgagcatcc

SEQ ID NO: 1117 - DNA, 39 bp, Artificial Sequence
  Synthetic
gcgacgcacatcaaggtgggcgatcagaaagcccccatt

SEQ ID NO: 1118 - DNA, 37 bp, Artificial Sequence
  Synthetic
cgagatgctgcgctccgatggatatggcgtcggaaga

SEQ ID NO: 1119 - DNA, 35 bp, Artificial Sequence
  Synthetic
ttccccaacggcaagcccgccgtccagaaccactg

SEQ ID NO: 1120 - DNA, 40 bp, Artificial Sequence
  Synthetic
atcaattccaaccggtgctgcgccgacagaaacccgttgt

SEQ ID NO: 1121 - DNA, 35 bp, Artificial Sequence
  Synthetic
agtacgtggaccaggcggtgcctcgcggttggtga

SEQ ID NO: 1122 - DNA, 39 bp, Artificial Sequence
  Synthetic
acaaggtaaccataggcggggctgaacagctgcaacggg

SEQ ID NO: 1123 - DNA, 36 bp, Artificial Sequence
  Synthetic
caccatcaaggtcccccccgttcggacggacacgcg

SEQ ID NO: 1124 - DNA, 36 bp, Artificial Sequence
  Synthetic
cggtaaaacagagcggggcgttcgaggcggaggtgg

SEQ ID NO: 1125 - DNA, 38 bp, Artificial Sequence
  Synthetic
cgcgagcggatctgctttcgagagcctcctcagcatcc

SEQ ID NO: 1126 - DNA, 39 bp, Artificial Sequence
  Synthetic
atcttgtcgcccacggccgactccatctttgtgctgtgc

SEQ ID NO: 1127 - DNA, 36 bp, Artificial Sequence
  Synthetic
ccacttacgggggccacatgtagtgcaggtgggcgg

SEQ ID NO: 1128 - DNA, 39 bp, Artificial Sequence
  Synthetic
gctcttaacgaggctctctgcggggcggcacacctatca

SEQ ID NO: 1129 - DNA, 36 bp, Artificial Sequence
  Synthetic
acatgctggccatcatcggcctcggcgacctggaca

SEQ ID NO: 1130 - DNA, 40 bp, Artificial Sequence
  Synthetic
ccgccaaccaagggctgatagataatgtcgcggatgctgc

SEQ ID NO: 1131 - DNA, 37 bp, Artificial Sequence
  Synthetic
acacgttcttcgccggcccccctagggggccaatggt

SEQ ID NO: 1132 - DNA, 37 bp, Artificial Sequence
  Synthetic
tcgtggtcaccggtgctcggcatgcacgataccgacc

SEQ ID NO: 1133 - DNA, 36 bp, Artificial Sequence
  Synthetic
ttccccgcccggtcgagttggagatagcccagccca

SEQ ID NO: 1134 - DNA, 39 bp, Artificial Sequence
  Synthetic
cggttcttggccctggtgagttctatgcgctggaggtgc

SEQ ID NO: 1135 - DNA, 37 bp, Artificial Sequence
  Synthetic
accccacagccaaacgcggtgtgtatacggacgcgcc

SEQ ID NO: 1136 - DNA, 37 bp, Artificial Sequence
  Synthetic
tccacatcgcgcaggggtactcaggacatcggtgtgt

SEQ ID NO: 1137 - DNA, 35 bp, Artificial Sequence
  Synthetic
tagcccgatgcccccgttgacaaggcgaccctgcg

SEQ ID NO: 1138 - DNA, 38 bp, Artificial Sequence
  Synthetic
aggttggagccggcgatggtgttcaaagacgcggtgaa

SEQ ID NO: 1139 - DNA, 39 bp, Artificial Sequence
  Synthetic
atcgccgacaggtttctggagtccttgtagaacgcgggt

SEQ ID NO: 1140 - DNA, 37 bp, Artificial Sequence
  Synthetic
gccagtgacgtggacgcctagagctgggtctggagtc

SEQ ID NO: 1141 - DNA, 40 bp, Artificial Sequence
  Synthetic
agtgttccaggggcaggaacaccggggcatccttatccat

SEQ ID NO: 1142 - DNA, 35 bp, Artificial Sequence
  Synthetic
tgggcgtggcactatcggctgacgaggccgcagct

SEQ ID NO: 1143 - DNA, 42 bp, Artificial Sequence
  Synthetic
ttccggaatttatacccgggccggtgtgtgatgatttcgcca

SEQ ID NO: 1144 - DNA, 37 bp, Artificial Sequence
  Synthetic
cacggggttacgcgggtagtggagggtcagccgttca

SEQ ID NO: 1145 - DNA, 35 bp, Artificial Sequence
  Synthetic
tgggcacgtacacccccctcgtacaggggctgggt

SEQ ID NO: 1146 - DNA, 37 bp, Artificial Sequence
  Synthetic
acgcgcagactgtcgacggcgccgtctaagtggagct

SEQ ID NO: 1147 - DNA, 37 bp, Artificial Sequence
  Synthetic
gggctgtcattcctcgggaacggaccggacggacctt

SEQ ID NO: 1148 - DNA, 37 bp, Artificial Sequence
  Synthetic
tggtgaatccagacgtggtgccgcagaacgccctcga

SEQ ID NO: 1149 - DNA, 38 bp, Artificial Sequence
  Synthetic
gctcgacctctccacacctgctgcgcggacaattaggc

SEQ ID NO: 1150 - DNA, 35 bp, Artificial Sequence
  Synthetic
agaacgactggcgcgccactcctgatgggccgcca

SEQ ID NO: 1151 - DNA, 39 bp, Artificial Sequence
  Synthetic
gagaaccgtggacgacgtacgcgacaagatcggactgcg

SEQ ID NO: 1152 - DNA, 35 bp, Artificial Sequence
  Synthetic
tgttggccccgacgctcagttaagcacggccgggc

SEQ ID NO: 1153 - DNA, 36 bp, Artificial Sequence
  Synthetic
accacacgagcacgaggcctccctgcagcacctctc

SEQ ID NO: 1154 - DNA, 36 bp, Artificial Sequence
  Synthetic
atcggcgttggtggagggcgtgcgtctggtggtcgt

SEQ ID NO: 1155 - DNA, 36 bp, Artificial Sequence
  Synthetic
attccaggtcgtcgcggcgtggacctctccgacagc

SEQ ID NO: 1156 - DNA, 34 bp, Artificial Sequence
  Synthetic
tttcggcctgccaggtggcgggccccggacataa

SEQ ID NO: 1157 - DNA, 35 bp, Artificial Sequence
  Synthetic
tcgaccgaacagccgtccgcgcgcccgagttttgc

SEQ ID NO: 1158 - DNA, 38 bp, Artificial Sequence
  Synthetic
tctggacacccccacggaccattggcacggacaacagg

SEQ ID NO: 1159 - DNA, 38 bp, Artificial Sequence
  Synthetic
tggggagtagggccttttccatggatgcgccccaaagc

SEQ ID NO: 1160 - DNA, 38 bp, Artificial Sequence
  Synthetic
cgccctcgacgagtgggatcttcacccccagtaccctc

SEQ ID NO: 1161 - DNA, 34 bp, Artificial Sequence
  Synthetic
aaaccgccccccaagcctaggatgaagccccccg

SEQ ID NO: 1162 - DNA, 41 bp, Artificial Sequence
  Synthetic
actgaccctctgatcgccgttaccggatagcagatgtgagg

SEQ ID NO: 1163 - DNA, 35 bp, Artificial Sequence
  Synthetic
cagccccttggagagcacccggtgcagcagtcgga

SEQ ID NO: 1164 - DNA, 35 bp, Artificial Sequence
  Synthetic
ggcagtgccgcattttggctggccggacgaacgac

SEQ ID NO: 1165 - DNA, 37 bp, Artificial Sequence
  Synthetic
gggccccggggttttaaggatacgggggggtaggtca

SEQ ID NO: 1166 - DNA, 35 bp, Artificial Sequence
  Synthetic
agtccaggcacgcgtcctcgccgtcccgggtgttt

SEQ ID NO: 1167 - DNA, 40 bp, Artificial Sequence
  Synthetic
ctcttccgcggtaaatcccgtgccccccggtatacgacga

SEQ ID NO: 1168 - DNA, 40 bp, Artificial Sequence
  Synthetic
cgccttcacgattacccgttggtcggaggggtgtgtcttt

SEQ ID NO: 1169 - DNA, 40 bp, Artificial Sequence
  Synthetic
tgggttcaggcgcctactcatctggtcctccccaagtacc

SEQ ID NO: 1170 - DNA, 36 bp, Artificial Sequence
  Synthetic
tcgcacgggccccttttggactgccgtccacaacgc

SEQ ID NO: 1171 - DNA, 37 bp, Artificial Sequence
  Synthetic
tggcggtgggagagtcggttcgtccctcgcatgaagc

SEQ ID NO: 1172 - DNA, 36 bp, Artificial Sequence
  Synthetic
cgcgcatgcttcatgggtcccggggcggtcattgga

SEQ ID NO: 1173 - DNA, 36 bp, Artificial Sequence
  Synthetic
gggtggcggcaagaacagcgcgcagtctggcatctg

SEQ ID NO: 1174 - DNA, 38 bp, Artificial Sequence
  Synthetic
gtgttgttgggtgccctccgccccccaaaccatgtccg

SEQ ID NO: 1175 - DNA, 38 bp, Artificial Sequence
  Synthetic
cccggcgtccacaaatgagttccagcctggttgtccgt

SEQ ID NO: 1176 - DNA, 35 bp, Artificial Sequence
  Synthetic
tttggcgcgtcaccgaccgcaacgcgggactatgc

SEQ ID NO: 1177 - DNA, 34 bp, Artificial Sequence
  Synthetic
aggccgctgtccgtctctgcggccgtggttaacc

SEQ ID NO: 1178 - DNA, 37 bp, Artificial Sequence
  Synthetic
gcttcgaccgaaactggcgagtcagcgcgatccgaca

SEQ ID NO: 1179 - DNA, 37 bp, Artificial Sequence
  Synthetic
agccacatcaggagcgcccgatcgcctgtctcctcgt

SEQ ID NO: 1180 - DNA, 50 bp, Artificial Sequence
  Synthetic
tgttcccaatttgtaacatcaagctatcagaagataataaccattggatc

SEQ ID NO: 1181 - DNA, 39 bp, Artificial Sequence
  Synthetic
attgtcaaccaactggtgccaaggtttgagtctgttgct

SEQ ID NO: 1182 - DNA, 47 bp, Artificial Sequence
  Synthetic
atcaggataacaggagcactccgaaaaagggaaagtagttaaatcag

SEQ ID NO: 1183 - DNA, 48 bp, Artificial Sequence
  Synthetic
cctggaattagtgcttttggttctcaaagggttttcatttaaatacgg

SEQ ID NO: 1184 - DNA, 42 bp, Artificial Sequence
  Synthetic
ttccgaaagcccaggatgatggtgtatccctcctgttgctgt

SEQ ID NO: 1185 - DNA, 48 bp, Artificial Sequence
  Synthetic
cccataacatccaatgacataacccctttgggtatacatttaaaccct

SEQ ID NO: 1186 - DNA, 40 bp, Artificial Sequence
  Synthetic
gtggtctccatgcgacgtgccgtctgtgccttctcatctg

SEQ ID NO: 1187 - DNA, 41 bp, Artificial Sequence
  Synthetic
gttccccccagcaaagaattgttagagtctcctgagcattg

SEQ ID NO: 1188 - DNA, 42 bp, Artificial Sequence
  Synthetic
tggaaagattctgccccatgctgaaacaacacatagcgcctc

SEQ ID NO: 1189 - DNA, 45 bp, Artificial Sequence
  Synthetic
tgtggtttttgtcagtatctcgcaataaaagaactacggaacctg

SEQ ID NO: 1190 - DNA, 41 bp, Artificial Sequence
  Synthetic
ccacgggtccatttctattccagatcagatcgagtgatggt

SEQ ID NO: 1191 - DNA, 41 bp, Artificial Sequence
  Synthetic
agatgctagtggatctgctgatctaattattgcggccagga

SEQ ID NO: 1192 - DNA, 43 bp, Artificial Sequence
  Synthetic
acccctcatgtactcttatcttcaaaagcgggtcatcagtcaa

SEQ ID NO: 1193 - DNA, 43 bp, Artificial Sequence
  Synthetic
aatgccttaaaagctgatgcatggacctgaatttcgtcaacag

SEQ ID NO: 1194 - DNA, 42 bp, Artificial Sequence
  Synthetic
gtttcactgacctcctcaggagtgatcggtttttgagagttc

SEQ ID NO: 1195 - DNA, 43 bp, Artificial Sequence
  Synthetic
caagtacgtctctcatttgttggaaccaaggccattagaagcc

SEQ ID NO: 1196 - DNA, 38 bp, Artificial Sequence
  Synthetic
gaaaccctctcaagacggcggaaaagatgccggcactt

SEQ ID NO: 1197 - DNA, 46 bp, Artificial Sequence
  Synthetic
cacacaaatcacgacgacagaaatattttgatgttactcctgatgt

SEQ ID NO: 1198 - DNA, 46 bp, Artificial Sequence
  Synthetic
cgcgataatatcaatcttctcctcaaagagttaaatgtgaggtgtc

SEQ ID NO: 1199 - DNA, 48 bp, Artificial Sequence
  Synthetic
gcaacaacaacgacacgaattactaggagcatccagtatataaagttg

SEQ ID NO: 1200 - DNA, 50 bp, Artificial Sequence
  Synthetic
tgtcgtctaacagatttgagatgttgtggatgatatacaatgtattgatg

SEQ ID NO: 1201 - DNA, 45 bp, Artificial Sequence
  Synthetic
gatctctacctgcgacgtaaaagtattgaattttcaggacagtgg

SEQ ID NO: 1202 - DNA, 48 bp, Artificial Sequence
  Synthetic
tgaggccttcttttctcccataattggactcccaaataaattattgga

SEQ ID NO: 1203 - DNA, 41 bp, Artificial Sequence
  Synthetic
tttcggtgggactggaaacggcagctctgcaagttccttct

SEQ ID NO: 1204 - DNA, 44 bp, Artificial Sequence
  Synthetic
gttcctatacccagtcctccaaaatcgactcttgctgatcgatt

SEQ ID NO: 1205 - DNA, 47 bp, Artificial Sequence
  Synthetic
agttgtaagtacaggtggttctgccaacattaattgaatcaggagga

SEQ ID NO: 1206 - DNA, 43 bp, Artificial Sequence
  Synthetic
gatctggagtagcagctacattctctttagcactgacgtcact

SEQ ID NO: 1207 - DNA, 39 bp, Artificial Sequence
  Synthetic
tcgcctgaatgttggcctatctataggttctgacgctgc

SEQ ID NO: 1208 - DNA, 43 bp, Artificial Sequence
  Synthetic
ctgtaccagcatagaaaaacagactcaagaccaatcgccagag

SEQ ID NO: 1209 - DNA, 48 bp, Artificial Sequence
  Synthetic
ttaaataatggattgcctgttgtggttaagaggtattgaaataggtcg

SEQ ID NO: 1210 - DNA, 48 bp, Artificial Sequence
  Synthetic
caccaaagccaatgtcacacatattccacctgtgcaattaattaattc

SEQ ID NO: 1211 - DNA, 44 bp, Artificial Sequence
  Synthetic
tcgttcagtcatatctatttgccaactaagtgtcctactgctgc

SEQ ID NO: 1212 - DNA, 50 bp, Artificial Sequence
  Synthetic
agtacattcagagaccattcacagtattgtgataaaatactgtgaatccc

SEQ ID NO: 1213 - DNA, 40 bp, Artificial Sequence
  Synthetic
cctttggcgccaaaaacttaccgagggtcgatactgccaa

SEQ ID NO: 1214 - DNA, 47 bp, Artificial Sequence
  Synthetic
cgtcagaaattaagttagcaggcaagggagataaggctactattcct

SEQ ID NO: 1215 - DNA, 42 bp, Artificial Sequence
  Synthetic
gcttagatgctctctcaggcgacagatctcagagctaagtcc

SEQ ID NO: 1216 - DNA, 42 bp, Artificial Sequence
  Synthetic
gcagagtcggaccccaatttccccgagagaatctggaaccac

SEQ ID NO: 1217 - DNA, 43 bp, Artificial Sequence
  Synthetic
atcccccagacccttttccatttggaagtttggtatattttgg

SEQ ID NO: 1218 - DNA, 48 bp, Artificial Sequence
  Synthetic
gctggatctctaaaggtgaatagttgggcctgatatatcttttattgc

SEQ ID NO: 1219 - DNA, 50 bp, Artificial Sequence
  Synthetic
tctcttcaaatatgttgtccccaatgtgatactaatgtgtttgtagatcc

SEQ ID NO: 1220 - DNA, 44 bp, Artificial Sequence
  Synthetic
gctatttacatcacgctggaactgtttgagtttgaaaatcccgc

SEQ ID NO: 1221 - DNA, 44 bp, Artificial Sequence
  Synthetic
cgctctgtcatatctaaagtccagacctactgctgaaccagaag

SEQ ID NO: 1222 - DNA, 45 bp, Artificial Sequence
  Synthetic
caggagtttataggtcagaacccatgaatattttaccgtggtgtc

SEQ ID NO: 1223 - DNA, 43 bp, Artificial Sequence
  Synthetic
gccaatctggtattatcccttccaggaggagacatagaatcct

SEQ ID NO: 1224 - DNA, 38 bp, Artificial Sequence
  Synthetic
ccagctcctcccatgtccctctgaggctgcagggactt

SEQ ID NO: 1225 - DNA, 40 bp, Artificial Sequence
  Synthetic
gcgccaacctgctagggatttctgttaggacccttctcgc

SEQ ID NO: 1226 - DNA, 41 bp, Artificial Sequence
  Synthetic
cgggccgtaacctaactttttctgcgagaaactccgtcttg

SEQ ID NO: 1227 - DNA, 40 bp, Artificial Sequence
  Synthetic
ccgcttgttgcacggggtagacaagtagaccaacagcacc

SEQ ID NO: 1228 - DNA, 44 bp, Artificial Sequence
  Synthetic
gcctatacatccactggatctgttccaagagggtctgacatagc

SEQ ID NO: 1229 - DNA, 40 bp, Artificial Sequence
  Synthetic
cgagtgtccctcctttccacagggaccaagccctatccca

SEQ ID NO: 1230 - DNA, 44 bp, Artificial Sequence
  Synthetic
gacatgcctaaggctgtcagaataccataatgacaggagatacc

SEQ ID NO: 1231 - DNA, 48 bp, Artificial Sequence
  Synthetic
ccttttctttttggctagtcctgcaaataaggtgactcaagatttcac

SEQ ID NO: 1232 - DNA, 43 bp, Artificial Sequence
  Synthetic
ccctaggccatttagaagttctttgacaggacaggtttagagc

SEQ ID NO: 1233 - DNA, 43 bp, Artificial Sequence
  Synthetic
gttcctggctcaagataattttgttcagaagaagtgcagtgga

SEQ ID NO: 1234 - DNA, 46 bp, Artificial Sequence
  Synthetic
gcctggtataggatctcctactagggagtgggactttgtatctacc

SEQ ID NO: 1235 - DNA, 44 bp, Artificial Sequence
  Synthetic
gccttgacttactaaatggtctactagtctatgttgcatgggtc

SEQ ID NO: 1236 - DNA, 42 bp, Artificial Sequence
  Synthetic
tgcgttattggccacctactgggaagcagaagtcatcccaca

SEQ ID NO: 1237 - DNA, 44 bp, Artificial Sequence
  Synthetic
tcttgttctgtggtaatcatgttgaaagaaggggaggaataggg

SEQ ID NO: 1238 - DNA, 46 bp, Artificial Sequence
  Synthetic
ggtaacatctgtccagaacttttctgaacctaacaccagaaaaagg

SEQ ID NO: 1239 - DNA, 43 bp, Artificial Sequence
  Synthetic
acacctggaaaatgagctctcgccatagaagccttaaacaggg

SEQ ID NO: 1240 - DNA, 45 bp, Artificial Sequence
  Synthetic
gggtgtctccatgtctattatggataggaagaagccttaagacat

SEQ ID NO: 1241 - DNA, 39 bp, Artificial Sequence
  Synthetic
actcacttgtctggtgcagaaagacgaagaaggactcca

SEQ ID NO: 1242 - DNA, 47 bp, Artificial Sequence
  Synthetic
gcttgacacatggttttattgatgttggaataatacagtgacagaac

SEQ ID NO: 1243 - DNA, 46 bp, Artificial Sequence
  Synthetic
gcaatgtctcatgtaacatgtgcccatggtatttagaagatgtggt

SEQ ID NO: 1244 - DNA, 48 bp, Artificial Sequence
  Synthetic
gagagtgaaacactaatcctgacatgtaagagaccaggaaataagaca

SEQ ID NO: 1245 - DNA, 46 bp, Artificial Sequence
  Synthetic
ttttccctactttatgccaggtattcaattgggtagaagacaagaa

SEQ ID NO: 1246 - DNA, 41 bp, Artificial Sequence
  Synthetic
cgcacatccccatgaatttagcaagagtcactgctatcgag

SEQ ID NO: 1247 - DNA, 42 bp, Artificial Sequence
  Synthetic
cagccagtccctgattgctgttactatccaagaactccccga

SEQ ID NO: 1248 - DNA, 43 bp, Artificial Sequence
  Synthetic
tgctgcctatacaaatctttctgtcagagtacatgaacagccc

SEQ ID NO: 1249 - DNA, 41 bp, Artificial Sequence
  Synthetic
cagcatggagtcaaactgccaacaagcagacatgatgatga

SEQ ID NO: 1250 - DNA, 39 bp, Artificial Sequence
  Synthetic
agggaacacccaggctctaccgagaggctggcagatcga

SEQ ID NO: 1251 - DNA, 44 bp, Artificial Sequence
  Synthetic
tcccagtgcagattcgatctgaaggcaataattgtactactcat

SEQ ID NO: 1252 - DNA, 44 bp, Artificial Sequence
  Synthetic
gcaggtttgacttcatggagtattgcctaggcagaccaaaatgc

SEQ ID NO: 1253 - DNA, 43 bp, Artificial Sequence
  Synthetic
actggatttattgctgtcttgttgtatgggaacggcttcttca

SEQ ID NO: 1254 - DNA, 45 bp, Artificial Sequence
  Synthetic
tccaggtttttgtaccatgtaatcaccaaatcaaacagaagacga

SEQ ID NO: 1255 - DNA, 44 bp, Artificial Sequence
  Synthetic
tcctttaatagttttgcaggcggtccaatatgggtgaaaacacc

SEQ ID NO: 1256 - DNA, 43 bp, Artificial Sequence
  Synthetic
gctcttagatcatccactttttcgtcggagcaatgaatgagct

SEQ ID NO: 1257 - DNA, 39 bp, Artificial Sequence
  Synthetic
gcattaaaggtgccagcagctgctttgaaaccaaacaca

SEQ ID NO: 1258 - DNA, 47 bp, Artificial Sequence
  Synthetic
gccccatggaatgttatttctcttttggagatccaaacaatatggat

SEQ ID NO: 1259 - DNA, 41 bp, Artificial Sequence
  Synthetic
tcgatccagccatctgctccatgagaacagaatggtgctgg

SEQ ID NO: 1260 - DNA, 43 bp, Artificial Sequence
  Synthetic
cacaatatcaagtgcagtatcccaagcagcgattcaagtgatc

SEQ ID NO: 1261 - DNA, 43 bp, Artificial Sequence
  Synthetic
tccgcgcaataattcttcaaaaaggtgtaagggtttgtgttgc

SEQ ID NO: 1262 - DNA, 49 bp, Artificial Sequence
  Synthetic
gcttgttatacaatgccagggaattctaacgtttcccaattaatagacg

SEQ ID NO: 1263 - DNA, 46 bp, Artificial Sequence
  Synthetic
tcttgtaactctaattgcactgcaaaaattactgatgctgaatgga

SEQ ID NO: 1264 - DNA, 46 bp, Artificial Sequence
  Synthetic
tccattgtaatctgcatcaccttttgggattggatatactatcagg

SEQ ID NO: 1265 - DNA, 50 bp, Artificial Sequence
  Synthetic
ggacaatcaccagtaaagcattgtttgacagtttataatgtatagagctg

SEQ ID NO: 1266 - DNA, 41 bp, Artificial Sequence
  Synthetic
accaataggctccacaggtactgaggtacaacaaggcctat

SEQ ID NO: 1267 - DNA, 50 bp, Artificial Sequence
  Synthetic
gcctgaacgtggttcattatttacaatgatactgcagctatattagatgt

SEQ ID NO: 1268 - DNA, 45 bp, Artificial Sequence
  Synthetic
cgttcaactatttgggtgggagttggctgaatttgaaataatgga

SEQ ID NO: 1269 - DNA, 46 bp, Artificial Sequence
  Synthetic
caccttcacggctcactcttaattacataggcctacttatactaca

SEQ ID NO: 1270 - DNA, 45 bp, Artificial Sequence
  Synthetic
acatctgagcgtttgcgtttcatcagatgactattttctacatcc

SEQ ID NO: 1271 - DNA, 47 bp, Artificial Sequence
  Synthetic
tgggatctggacacagtaatctaaagaacacagtctgtagtagtacc

SEQ ID NO: 1272 - DNA, 50 bp, Artificial Sequence
  Synthetic
gtgcaacctactataaacacctgatgatgaaaatgatcacagattgaatg

SEQ ID NO: 1273 - DNA, 43 bp, Artificial Sequence
  Synthetic
ctccggagatatcctttgacatttagatctggtgttcctttgg

SEQ ID NO: 1274 - DNA, 46 bp, Artificial Sequence
  Synthetic
cccaatcatctaacactgttggatttttgcaaagtttctctggatc

SEQ ID NO: 1275 - DNA, 45 bp, Artificial Sequence
  Synthetic
cagtttttctggatactttcggagacgccgctttctatatcaaac

SEQ ID NO: 1276 - DNA, 39 bp, Artificial Sequence
  Synthetic
gacaaacagctttcgcaacagaaacagctgagtctggtt

SEQ ID NO: 1277 - DNA, 39 bp, Artificial Sequence
  Synthetic
atgactcctcctctggggtgagcccatctattgtgtgaa

SEQ ID NO: 1278 - DNA, 46 bp, Artificial Sequence
  Synthetic
cctagtccactgtcctgaaacagttggaagcaataagaatttctcc

SEQ ID NO: 1279 - DNA, 49 bp, Artificial Sequence
  Synthetic
gcttgagaagccatttgatgatttctgggaaatcatatatttatggaac

SEQ ID NO: 1280 - DNA, 46 bp, Artificial Sequence
  Synthetic
agtcattaattgctcttgtagtgcaacccgaagataatgaatcaga

SEQ ID NO: 1281 - DNA, 40 bp, Artificial Sequence
  Synthetic
ttttcctcttcggcctcggcgtctctatccgactcccctg

SEQ ID NO: 1282 - DNA, 42 bp, Artificial Sequence
  Synthetic
tgacatcttctggacagtccctaaacgaataaagcgagcttc

SEQ ID NO: 1283 - DNA, 45 bp, Artificial Sequence
  Synthetic
gcatctggagtgattggtagtacttccccaagaccttctattcca

SEQ ID NO: 1284 - DNA, 43 bp, Artificial Sequence
  Synthetic
aggaacctgttgaacaaatctatgaagggccctttaaggagta

SEQ ID NO: 1285 - DNA, 45 bp, Artificial Sequence
  Synthetic
gtgtcaggaatgttaacaaatgtgttataggagggttcagggatg

SEQ ID NO: 1286 - DNA, 47 bp, Artificial Sequence
  Synthetic
gcaaactggttaggatctggtaattaataatgtccaagttccaaagg

SEQ ID NO: 1287 - DNA, 50 bp, Artificial Sequence
  Synthetic
cccgccgtccataaaaaaataatttattaattctacatgtaaatggccag

SEQ ID NO: 1288 - DNA, 44 bp, Artificial Sequence
  Synthetic
ccagctgccagttttctaatattgacctttagaggctgatgtgt

SEQ ID NO: 1289 - DNA, 45 bp, Artificial Sequence
  Synthetic
ggtcgggtatcaaatacagcagtttacatatcagtcgttcaaagg

SEQ ID NO: 1290 - DNA, 43 bp, Artificial Sequence
  Synthetic
cctgtcttcctgatgtgtacttcttcactcgcgagatactgac

SEQ ID NO: 1291 - DNA, 39 bp, Artificial Sequence
  Synthetic
ggtccatttctgttccaccacgctggatcagacagggta

SEQ ID NO: 1292 - DNA, 45 bp, Artificial Sequence
  Synthetic
cctttgttattgtcagctgtgattcgtcgttttcccaaatgaagt

SEQ ID NO: 1293 - DNA, 43 bp, Artificial Sequence
  Synthetic
cctgacaatgttcctagcagcgggaggtaagaaatgatgatgt

SEQ ID NO: 1294 - DNA, 46 bp, Artificial Sequence
  Synthetic
gtccaaccattgtgaattcctcataaagagaggaagaagtgcttac

SEQ ID NO: 1295 - DNA, 41 bp, Artificial Sequence
  Synthetic
ggagttggtgcatgggattcaccgaggtgatttgaatttcg

SEQ ID NO: 1296 - DNA, 43 bp, Artificial Sequence
  Synthetic
tgtttcactaacttcttcaggggatcgtttcttaagggtccga

SEQ ID NO: 1297 - DNA, 41 bp, Artificial Sequence
  Synthetic
cccaaaacatcacgcatctgcgccagaagccaatatagtgg

SEQ ID NO: 1298 - DNA, 42 bp, Artificial Sequence
  Synthetic
tcctgctgttccttcatctggttacaatacttgggaaggacg

SEQ ID NO: 1299 - DNA, 41 bp, Artificial Sequence
  Synthetic
actttggttccgtttgacacggcgatcattccaacaaatgc

SEQ ID NO: 1300 - DNA, 47 bp, Artificial Sequence
  Synthetic
tcttcattcacgaatttcccaggatccgatttaattattgagaggcg

SEQ ID NO: 1301 - DNA, 42 bp, Artificial Sequence
  Synthetic
ccagtttgtttccactcccatatgggatccatcattccgtat

SEQ ID NO: 1302 - DNA, 40 bp, Artificial Sequence
  Synthetic
ttgtccctccactatgatagcatccagagtggagtacagg

SEQ ID NO: 1303 - DNA, 43 bp, Artificial Sequence
  Synthetic
tctgaaaccataccaaccatcaatttttggtgctatagcgggt

SEQ ID NO: 1304 - DNA, 42 bp, Artificial Sequence
  Synthetic
tgtccatttctgaatcagccagctgaactcttggtagcaatg

SEQ ID NO: 1305 - DNA, 42 bp, Artificial Sequence
  Synthetic
acttgccattctgccttaacaagggtttaaccgaaaacggtg

SEQ ID NO: 1306 - DNA, 47 bp, Artificial Sequence
  Synthetic
gcttttgacatatagcacagcgaatattttggcatacagtagaacaa

SEQ ID NO: 1307 - DNA, 47 bp, Artificial Sequence
  Synthetic
ttctgtaacgttgtatgtcctgtttaatttgacacctcagatgaaga

SEQ ID NO: 1308 - DNA, 39 bp, Artificial Sequence
  Synthetic
tttcctgattttcctgcacccacgggagtatgggtaacg

SEQ ID NO: 1309 - DNA, 46 bp, Artificial Sequence
  Synthetic
gcgattcttgccacatttaaatctcatacaatggttaacctgtacc

SEQ ID NO: 1310 - DNA, 45 bp, Artificial Sequence
  Synthetic
cagcacgttgggcatattcagcatatgataatgatttaaccgaag

SEQ ID NO: 1311 - DNA, 42 bp, Artificial Sequence
  Synthetic
acgcatctaaacgtttggccgaatttcaagaatcagaggacg

SEQ ID NO: 1312 - DNA, 44 bp, Artificial Sequence
  Synthetic
gcgtccctgtttttttaaacactttccatggacattgcaagaga

SEQ ID NO: 1313 - DNA, 42 bp, Artificial Sequence
  Synthetic
ggtcggggtggggtctttgtatcacctacacccacaaccatc

SEQ ID NO: 1314 - DNA, 47 bp, Artificial Sequence
  Synthetic
cacgcagcaacaactataaacaatattactgtgagtccactattgtg

SEQ ID NO: 1315 - DNA, 46 bp, Artificial Sequence
  Synthetic
ctaaaaaccacagcagcagccttgtacatacgtgataatatggtac

SEQ ID NO: 1316 - DNA, 47 bp, Artificial Sequence
  Synthetic
tgcagaggacgtaatattaaacccaattgattctagcataccagtgc

SEQ ID NO: 1317 - DNA, 39 bp, Artificial Sequence
  Synthetic
tgatggcctagtgattgggctgggctcgtattgggtcta

SEQ ID NO: 1318 - DNA, 46 bp, Artificial Sequence
  Synthetic
gaggaggcagataaaccttgttgtaccatatttttttgcagatgtc

SEQ ID NO: 1319 - DNA, 43 bp, Artificial Sequence
  Synthetic
accatcctgaataacactgttttgtctgcttgctctgcacaat

SEQ ID NO: 1320 - DNA, 50 bp, Artificial Sequence
  Synthetic
cgtctagtatgtcaggattcatggttgcaaaattacattatctgtagagg

SEQ ID NO: 1321 - DNA, 48 bp, Artificial Sequence
  Synthetic
gcatgtgcttgctaaatttaatggacaatcctccattttagtacatgc

SEQ ID NO: 1322 - DNA, 44 bp, Artificial Sequence
  Synthetic
cttaattgaaatgtgtctgcctgtggtgtgttacctgaatgggt

SEQ ID NO: 1323 - DNA, 47 bp, Artificial Sequence
  Synthetic
cactgtgccattgtcatatttttcaacaggtcaagtttgtaaaagac

SEQ ID NO: 1324 - DNA, 41 bp, Artificial Sequence
  Synthetic
cctccgaccgtctcttcagtctctgaatcccagagcaacgg

SEQ ID NO: 1325 - DNA, 39 bp, Artificial Sequence
  Synthetic
agacctgctgctggtactgactgctgacattactgctga

SEQ ID NO: 1326 - DNA, 43 bp, Artificial Sequence
  Synthetic
ccaactacttctgaaactggatcaagcccaggtcttgatgttg

SEQ ID NO: 1327 - DNA, 47 bp, Artificial Sequence
  Synthetic
caggccatttacaagtggagttaaacttttcagcattttcagaaagt

SEQ ID NO: 1328 - DNA, 38 bp, Artificial Sequence
  Synthetic
accactgggcgtcggataatgacaatgctacacctcca

SEQ ID NO: 1329 - DNA, 39 bp, Artificial Sequence
  Synthetic
gggctagcacatcagcttcctttgaagtggagcttgtga

SEQ ID NO: 1330 - DNA, 48 bp, Artificial Sequence
  Synthetic
acgggaattaagtaatcccatctgaatttgcgagataaatttacctcc

SEQ ID NO: 1331 - DNA, 45 bp, Artificial Sequence
  Synthetic
atgagtcagcaatgccttgtttaacatatggtgctatgtatcctg

SEQ ID NO: 1332 - DNA, 44 bp, Artificial Sequence
  Synthetic
acgatcgttaacggttggatttgttgaacttagaccgaatttgg

SEQ ID NO: 1333 - DNA, 40 bp, Artificial Sequence
  Synthetic
gccgtagtgctggctagtaccaggcagatggcgactacca

SEQ ID NO: 1334 - DNA, 45 bp, Artificial Sequence
  Synthetic
ccacaatatcaagtgcaatatcccagcaaatgcagagattcaagt

SEQ ID NO: 1335 - DNA, 43 bp, Artificial Sequence
  Synthetic
gagctctggattggcataagctggataatgagaaacaacatgc

SEQ ID NO: 1336 - DNA, 46 bp, Artificial Sequence
  Synthetic
tgaccagaactatccagatctgtattcaacaattgaagaccttgtc

SEQ ID NO: 1337 - DNA, 46 bp, Artificial Sequence
  Synthetic
tgttgcatggctctattttgtacaacaactatcctgccatatggag

SEQ ID NO: 1338 - DNA, 45 bp, Artificial Sequence
  Synthetic
tcttcccaagaatccatgatttgattttagagtttgcttgcaact

SEQ ID NO: 1339 - DNA, 42 bp, Artificial Sequence
  Synthetic
gaccacagtctcagctctactagaaactgtacagagaggacc

SEQ ID NO: 1340 - DNA, 48 bp, Artificial Sequence
  Synthetic
gtgttcctgatgattctgtctgtatgaaaatctcaaaaacaacaacca

SEQ ID NO: 1341 - DNA, 50 bp, Artificial Sequence
  Synthetic
cctgcatgtcgatatagatcaggtagaaaagatcaagaaaactaggtttg

SEQ ID NO: 1342 - DNA, 46 bp, Artificial Sequence
  Synthetic
ttgactttgagtggtaatggttctatacacattcccagaatcatca

SEQ ID NO: 1343 - DNA, 43 bp, Artificial Sequence
  Synthetic
tggcatcgaacagcattcctataaaaccagaactatacccatg

SEQ ID NO: 1344 - DNA, 44 bp, Artificial Sequence
  Synthetic
ttcccaactccttttgcgataatcaagagtggatgcaattttcc

SEQ ID NO: 1345 - DNA, 47 bp, Artificial Sequence
  Synthetic
gggatgatcagtctatccaataacctagaagactctaactcttgtgg

SEQ ID NO: 1346 - DNA, 42 bp, Artificial Sequence
  Synthetic
tctgagtgttcagcagcctagtgattactcaatcaccctcca

SEQ ID NO: 1347 - DNA, 46 bp, Artificial Sequence
  Synthetic
ctccttgattaggtggttgattgattgcaaactgtataacaaccac

SEQ ID NO: 1348 - DNA, 49 bp, Artificial Sequence
  Synthetic
ccagtattccatctcgaatttggataatccaactctactcatacaattg

SEQ ID NO: 1349 - DNA, 45 bp, Artificial Sequence
  Synthetic
gaagaccagacgtgcacctctaacacatgatgtaggtataaaacc

SEQ ID NO: 1350 - DNA, 42 bp, Artificial Sequence
  Synthetic
aagacctccatacccgagaaattatgctgcactatacccatc

SEQ ID NO: 1351 - DNA, 39 bp, Artificial Sequence
  Synthetic
tgactgggttcactctcgattcacagggagcattgtgtc

SEQ ID NO: 1352 - DNA, 42 bp, Artificial Sequence
  Synthetic
gcagagtttgaaccgtaagcatttgcctcctgtgacattacc

SEQ ID NO: 1353 - DNA, 50 bp, Artificial Sequence
  Synthetic
ctctgaccaaaagacacatctagattagcaaaagaatctattatgatggg

SEQ ID NO: 1354 - DNA, 48 bp, Artificial Sequence
  Synthetic
gcaggtattaaagaggcatattgcaatcaatccaactataacacagaa

SEQ ID NO: 1355 - DNA, 50 bp, Artificial Sequence
  Synthetic
ccttcctcctgataaatgaatccacatcagatatgaagatatgtgttcag

SEQ ID NO: 1356 - DNA, 46 bp, Artificial Sequence
  Synthetic
agtgtaaaatttgcacgtgtttgtgatgggcatttggtaatgatga

SEQ ID NO: 1357 - DNA, 45 bp, Artificial Sequence
  Synthetic
ctacgactccagcatcaaagatggactttgtgtctacttttctca

SEQ ID NO: 1358 - DNA, 40 bp, Artificial Sequence
  Synthetic
aaaccattgctagcggcctcaatttctgcaaatggctgtt

SEQ ID NO: 1359 - DNA, 45 bp, Artificial Sequence
  Synthetic
cttagtaagccaagcacaaacgtaattatggcagtttgttgacca

SEQ ID NO: 1360 - DNA, 46 bp, Artificial Sequence
  Synthetic
ccacaagtacattgaactaatgcactctcctgttatgacaaatggt

SEQ ID NO: 1361 - DNA, 45 bp, Artificial Sequence
  Synthetic
atgttcctcttctacaaaagtggaaagagtgattgctcttcagag

SEQ ID NO: 1362 - DNA, 45 bp, Artificial Sequence
  Synthetic
acagcacagtcaaagacagtttgatgcctgagaagtttttgaatg

SEQ ID NO: 1363 - DNA, 43 bp, Artificial Sequence
  Synthetic
agcagtgctacgttcaacacaaagttaagtatgcaacagttgt

SEQ ID NO: 1364 - DNA, 46 bp, Artificial Sequence
  Synthetic
tcctcaaaccaagactcgttactactttatgtgagagactatgttg

SEQ ID NO: 1365 - DNA, 43 bp, Artificial Sequence
  Synthetic
agtgtctaaaaacgcattataggccgaacatgtgcaaagcgtt

SEQ ID NO: 1366 - DNA, 50 bp, Artificial Sequence
  Synthetic
gtcaaaatgtgtagggtctgcaattcaggattaagtcttttagtactttc

SEQ ID NO: 1367 - DNA, 48 bp, Artificial Sequence
  Synthetic
tcccagtcaccttcatgtttaattttgagtttgaagatgaaaaacttg

SEQ ID NO: 1368 - DNA, 50 bp, Artificial Sequence
  Synthetic
gcatagtcaccatcaagtataccagtactcaaacaattggataacaactg

SEQ ID NO: 1369 - DNA, 43 bp, Artificial Sequence
  Synthetic
agtgggcgtacaaaacaaaacaaaatgtagttgtaccagtggt

SEQ ID NO: 1370 - DNA, 48 bp, Artificial Sequence
  Synthetic
gcgttcaacttctctttaacaacaaaagttgaaatatctgttacacca

SEQ ID NO: 1371 - DNA, 47 bp, Artificial Sequence
  Synthetic
tggttctattttaggttgctcaactaaggttaaggattttgtgtctg

SEQ ID NO: 1372 - DNA, 44 bp, Artificial Sequence
  Synthetic
acgtgtgcatcgttgaacattagttctgttgttgtctacatgtg

SEQ ID NO: 1373 - DNA, 47 bp, Artificial Sequence
  Synthetic
cgacccaatcaacatctattgcttttaaggacaaagatctttctggt

SEQ ID NO: 1374 - DNA, 43 bp, Artificial Sequence
  Synthetic
cctctaacacttctaacacgtgaattgtgctagtgtcaaacgt

SEQ ID NO: 1375 - DNA, 45 bp, Artificial Sequence
  Synthetic
agctgctgacgcttttaagttatgttaaaataatggccaaagcac

SEQ ID NO: 1376 - DNA, 47 bp, Artificial Sequence
  Synthetic
tggctaaattgacttaactcttggttcaaggatgattactgtgatgg

SEQ ID NO: 1377 - DNA, 44 bp, Artificial Sequence
  Synthetic
gggaatctcttaagtctagcactcttgtgctttttggttgtgaa

SEQ ID NO: 1378 - DNA, 44 bp, Artificial Sequence
  Synthetic
aacgatgtgcattagaaatagcacttatgtctttagccgagtgc

SEQ ID NO: 1379 - DNA, 47 bp, Artificial Sequence
  Synthetic
gcgtgacagcttggttttcattacgcaagtatattgtaaaaactagc

SEQ ID NO: 1380 - DNA, 46 bp, Artificial Sequence
  Synthetic
gccagcgacagtattaacaatttcaggcttcacacctttaaacaag

SEQ ID NO: 1381 - DNA, 41 bp, Artificial Sequence
  Synthetic
attcacctacgcggcagtatcaaggctttggttttagaaca

SEQ ID NO: 1382 - DNA, 50 bp, Artificial Sequence
  Synthetic
gcaattaaatatgcagcacaccaaaattgtatttctttgctactagaagc

SEQ ID NO: 1383 - DNA, 47 bp, Artificial Sequence
  Synthetic
ccagcctgtaatgtagaaccataaccttttcgcgtgatcataatgac

SEQ ID NO: 1384 - DNA, 48 bp, Artificial Sequence
  Synthetic
ctaaaagaatgtctaggtgtgtgcatgcatggagtaactcttaaaatt

SEQ ID NO: 1385 - DNA, 46 bp, Artificial Sequence
  Synthetic
gcaaccacattaactgttaacatctggttttgaagaccaacctaat

SEQ ID NO: 1386 - DNA, 47 bp, Artificial Sequence
  Synthetic
acccaaatagtggtggtataaacaaaatccataagcttatttgctgg

SEQ ID NO: 1387 - DNA, 44 bp, Artificial Sequence
  Synthetic
accaatgtgtacaacgctctttaatttgtctttttgttgcactg

SEQ ID NO: 1388 - DNA, 48 bp, Artificial Sequence
  Synthetic
ggctggactaacacagaaatcataagctgtatgtactatggtttgttg

SEQ ID NO: 1389 - DNA, 44 bp, Artificial Sequence
  Synthetic
gcccactcctttgaattagaagctacaaacgtcgttctaatggg

SEQ ID NO: 1390 - DNA, 47 bp, Artificial Sequence
  Synthetic
gcttgttcagccattctgttaatttttgaagaaggctatgaatgttg

SEQ ID NO: 1391 - DNA, 48 bp, Artificial Sequence
  Synthetic
tgcacattcttaccatcattatcctaaatgatggtagatggttttgtg

SEQ ID NO: 1392 - DNA, 43 bp, Artificial Sequence
  Synthetic
ccagagtcatgttcccatttaacatggtggacgtgcattcatg

SEQ ID NO: 1393 - DNA, 43 bp, Artificial Sequence
  Synthetic
acatctttacacaattgccaacaggcagctgcagcctatcttg

SEQ ID NO: 1394 - DNA, 46 bp, Artificial Sequence
  Synthetic
cccggactcgtttaaataactgtttaatcatggctgtacatgtgac

SEQ ID NO: 1395 - DNA, 48 bp, Artificial Sequence
  Synthetic
cagtctttttcatcaaagttacgcatatggtaatgttagtagacagga

SEQ ID NO: 1396 - DNA, 46 bp, Artificial Sequence
  Synthetic
tgacgtgcagtagggtattcctcttaatgggaatttctatgacttc

SEQ ID NO: 1397 - DNA, 44 bp, Artificial Sequence
  Synthetic
cgggtacaccatcaataaacacttttcttcgcaaccacaattcc

SEQ ID NO: 1398 - DNA, 48 bp, Artificial Sequence
  Synthetic
cccctgagaacgtaagaagtcataagctttgagtacaggattaacatc

SEQ ID NO: 1399 - DNA, 45 bp, Artificial Sequence
  Synthetic
aagagacgccacccactgtatgactcagttaaatcttaaatacgc

SEQ ID NO: 1400 - DNA, 48 bp, Artificial Sequence
  Synthetic
caatgtaaccaagtccagcataagtgcaaaagcatttttctatgatga

SEQ ID NO: 1401 - DNA, 44 bp, Artificial Sequence
  Synthetic
ggtaggcatctatagccagagaaacatcactaagactgatgctg

SEQ ID NO: 1402 - DNA, 45 bp, Artificial Sequence
  Synthetic
gcagaacttttgtacaaaccaaagaaccacaaaccacatctttca

SEQ ID NO: 1403 - DNA, 48 bp, Artificial Sequence
  Synthetic
accgtaatctactttctcaaacacacatgcttccaaattacaaaagac

SEQ ID NO: 1404 - DNA, 39 bp, Artificial Sequence
  Synthetic
tcgctccagggtaatacacactcctcctggtagtggaaa

SEQ ID NO: 1405 - DNA, 47 bp, Artificial Sequence
  Synthetic
tgttgaggatcaccaacatatacaatctatgtgcactaactatgact

SEQ ID NO: 1406 - DNA, 50 bp, Artificial Sequence
  Synthetic
cctggcagctacataattttgactaagcgatttatacataaaaactccac

SEQ ID NO: 1407 - DNA, 44 bp, Artificial Sequence
  Synthetic
agacaatgacaaataagtagtggcagtttaaggattgtgcacgt

SEQ ID NO: 1408 - DNA, 41 bp, Artificial Sequence
  Synthetic
tgccaacattgtcacctgtgatcatgtcagaggttggttag

SEQ ID NO: 1409 - DNA, 43 bp, Artificial Sequence
  Synthetic
gctccaatcttaacaaaataacgcaggtgtttgtactttgggc

SEQ ID NO: 1410 - DNA, 48 bp, Artificial Sequence
  Synthetic
gcccttgtttatggcattttcattagtatgactgctttgttaagaatg

SEQ ID NO: 1411 - DNA, 44 bp, Artificial Sequence
  Synthetic
cccaccatttacaccttcaaggtgaattctcaattgtttgcagg

SEQ ID NO: 1412 - DNA, 46 bp, Artificial Sequence
  Synthetic
tctgtgaatgtctgccacaaattataacatttttactcaagctggt

SEQ ID NO: 1413 - DNA, 41 bp, Artificial Sequence
  Synthetic
aagcttgtcaagggacgctcttgtcgccacatataagtttg

SEQ ID NO: 1414 - DNA, 47 bp, Artificial Sequence
  Synthetic
cgaccttgggtataaaaaccatcatttaactggtttgtttacgtacg

SEQ ID NO: 1415 - DNA, 47 bp, Artificial Sequence
  Synthetic
caacagtcaaatccaaagacttcaatcctagttctaagactgtttgt

SEQ ID NO: 1416 - DNA, 50 bp, Artificial Sequence
  Synthetic
gcacccaagtgtaacactctcatattgtgtcaatattttaacagtaccac

SEQ ID NO: 1417 - DNA, 48 bp, Artificial Sequence
  Synthetic
cgccaaaatacataatttgcgtgtagttgtcggaattaactatcttgg

SEQ ID NO: 1418 - DNA, 44 bp, Artificial Sequence
  Synthetic
cgttgcaaacagagtaactagtgtttgccttgttgcatattgct

SEQ ID NO: 1419 - DNA, 45 bp, Artificial Sequence
  Synthetic
acgtagtttcattgccaatagtagtgatgctcacataccatttgg

SEQ ID NO: 1420 - DNA, 45 bp, Artificial Sequence
  Synthetic
agcgacacaatagacacaggtaagatggtttttattctacaagcc

SEQ ID NO: 1421 - DNA, 50 bp, Artificial Sequence
  Synthetic
tgaagttgatgtgtacgtaattccaaatatttatgatgtatctggtgtgg

SEQ ID NO: 1422 - DNA, 50 bp, Artificial Sequence
  Synthetic
gaaacattacgtggttgaacagcaagttttaacttattctagttttggcg

SEQ ID NO: 1423 - DNA, 45 bp, Artificial Sequence
  Synthetic
gctaaggttgtagtcaccaaaactactgcagatgttagtgagatg

SEQ ID NO: 1424 - DNA, 47 bp, Artificial Sequence
  Synthetic
tgcctgaattgctaatgaaaatggtttctttaattggtggaattgct

SEQ ID NO: 1425 - DNA, 47 bp, Artificial Sequence
  Synthetic
ccaatctaccagtaatcagcctatctctatgacagacttgacactat

SEQ ID NO: 1426 - DNA, 43 bp, Artificial Sequence
  Synthetic
tgccttctttgtaaagagcaagattggttgtgcgttgatggta

SEQ ID NO: 1427 - DNA, 47 bp, Artificial Sequence
  Synthetic
gtgctaatttcactggtcaaattcatacaaattgccaaattacactg

SEQ ID NO: 1428 - DNA, 44 bp, Artificial Sequence
  Synthetic
tgtggatcttttcaacgtcgtaatggcttctttagttgttttgc

SEQ ID NO: 1429 - DNA, 49 bp, Artificial Sequence
  Synthetic
aaaattacagcaatcaaagttgcgtttctaatccttttcgtttatgtgc

SEQ ID NO: 1430 - DNA, 42 bp, Artificial Sequence
  Synthetic
atcactataagcaccacacaccaagctagtggatgatcatgc

SEQ ID NO: 1431 - DNA, 41 bp, Artificial Sequence
  Synthetic
agcccaggtgtcaaagattgattgaagatgcttgtactgtg

SEQ ID NO: 1432 - DNA, 45 bp, Artificial Sequence
  Synthetic
acgtagaaaacccagcctgtgtaatttatagtagagtcggaaggt

SEQ ID NO: 1433 - DNA, 46 bp, Artificial Sequence
  Synthetic
ttctgaaacgtttttgaacattccatacccatcaacaagaaagaca

SEQ ID NO: 1434 - DNA, 43 bp, Artificial Sequence
  Synthetic
acctaaagatttaagagccgcagggaatccttcaagtgacaga

SEQ ID NO: 1435 - DNA, 43 bp, Artificial Sequence
  Synthetic
ggccaaaacattgtgtgacattagaaaatgcaaaagccacggt

SEQ ID NO: 1436 - DNA, 45 bp, Artificial Sequence
  Synthetic
gagatgggttgaattctagtgcaattcactagagaaatgcaacaa

SEQ ID NO: 1437 - DNA, 47 bp, Artificial Sequence
  Synthetic
accactggcttaccattgtgtattcagagctgcttttaattaacatg

SEQ ID NO: 1438 - DNA, 40 bp, Artificial Sequence
  Synthetic
ccaggtgtggcaaatggacactcatgtcctgtttctgtgt

SEQ ID NO: 1439 - DNA, 40 bp, Artificial Sequence
  Synthetic
agaaacatctgtcccatcgctgcgatgagtgtctagactc

SEQ ID NO: 1440 - DNA, 42 bp, Artificial Sequence
  Synthetic
gcgatgctaccttttccaccctaaaagacggctgtttgaggg

SEQ ID NO: 1441 - DNA, 43 bp, Artificial Sequence
  Synthetic
ggcattacaccctctgtaaagctaaccgcggcataaaagtgtt

SEQ ID NO: 1442 - DNA, 47 bp, Artificial Sequence
  Synthetic
ggcgcatttcgtatcttttatacatgcatggctaaaaagtaacaatc

SEQ ID NO: 1443 - DNA, 42 bp, Artificial Sequence
  Synthetic
tccacttgtgcaccacctttagtcatgaactgtatacaacac

SEQ ID NO: 1444 - DNA, 45 bp, Artificial Sequence
  Synthetic
gcagaagtgtcagaagcagattctagaaagaaaacatagatcgcg

SEQ ID NO: 1445 - DNA, 49 bp, Artificial Sequence
  Synthetic
tcagctaatgtggtttgttctacttatatatatagacattgtgtggggt

SEQ ID NO: 1446 - DNA, 41 bp, Artificial Sequence
  Synthetic
cgtgtcgggggttaccacatctcttaggccaagtgtggtgg

SEQ ID NO: 1447 - DNA, 43 bp, Artificial Sequence
  Synthetic
acagaaatatatgatggggtggcatcacttccacgcctaaacg

SEQ ID NO: 1448 - DNA, 40 bp, Artificial Sequence
  Synthetic
tgacgtgggcggtttaagaagttccaaagggcaagggacc

SEQ ID NO: 1449 - DNA, 43 bp, Artificial Sequence
  Synthetic
agaaacaccctgaaggcctgttagaagatacttatgctgagga

SEQ ID NO: 1450 - DNA, 42 bp, Artificial Sequence
  Synthetic
ggtaaccacagtgacatctgaaacttggtacgtaaacgcaaa

SEQ ID NO: 1451 - DNA, 41 bp, Artificial Sequence
  Synthetic
ccaacgcaagcttgttaggatatctgggaatcagtacagag

SEQ ID NO: 1452 - DNA, 42 bp, Artificial Sequence
  Synthetic
gccatcccgtgtaaaaaagtgactgccatgtttttctttggt

SEQ ID NO: 1453 - DNA, 45 bp, Artificial Sequence
  Synthetic
ggggtacaaagcctaactgctctcatattaatgtaatggatccag

SEQ ID NO: 1454 - DNA, 36 bp, Artificial Sequence
  Synthetic
tgcccatctccacgcgaaggtccgcggaaatccagc

SEQ ID NO: 1455 - DNA, 41 bp, Artificial Sequence
  Synthetic
tgcttgtgaggcatgactccaggcatggacatctctccgtc

SEQ ID NO: 1456 - DNA, 39 bp, Artificial Sequence
  Synthetic
gcgttcagcagcgcctcagagtgtcgttggatctgaggg

SEQ ID NO: 1457 - DNA, 38 bp, Artificial Sequence
  Synthetic
ccaccggcatagtgatggtcacgcctggtgacctgcct

SEQ ID NO: 1458 - DNA, 41 bp, Artificial Sequence
  Synthetic
gccgtgctgcacctcaaacattaacatgtacccggcagtcc

SEQ ID NO: 1459 - DNA, 37 bp, Artificial Sequence
  Synthetic
acaaggcaggacgcagcccaacattagcatcccggcg

SEQ ID NO: 1460 - DNA, 42 bp, Artificial Sequence
  Synthetic
ctacctgaactaagactgggtgtaccatccttttgccaatca

SEQ ID NO: 1461 - DNA, 42 bp, Artificial Sequence
  Synthetic
cgaggcaggcttacatgggagtccaggggggactttatgtga

SEQ ID NO: 1462 - DNA, 35 bp, Artificial Sequence
  Synthetic
cgggttggtccagggccttgtcgctgactccgcca

SEQ ID NO: 1463 - DNA, 39 bp, Artificial Sequence
  Synthetic
ctcgtctgggttcttggccccagctcctaagaaggcacc

SEQ ID NO: 1464 - DNA, 36 bp, Artificial Sequence
  Synthetic
aagaggcccctctccgcgagaccctaggcgtcccct

SEQ ID NO: 1465 - DNA, 39 bp, Artificial Sequence
  Synthetic
cctctggtaggactgggcgacccacacacccacccgtct

SEQ ID NO: 1466 - DNA, 39 bp, Artificial Sequence
  Synthetic
cgtaaacgcgctggactgagaaaaggtcagggcccaagg

SEQ ID NO: 1467 - DNA, 39 bp, Artificial Sequence
  Synthetic
gccttcttaggagctgtccgagacacccaggcacacact

SEQ ID NO: 1468 - DNA, 42 bp, Artificial Sequence
  Synthetic
gagttgagctgcctaccatgctccaaaattggtgccttgctc

SEQ ID NO: 1469 - DNA, 38 bp, Artificial Sequence
  Synthetic
cctcgtcttcggtctcagcttcacacgttagggggcgc

SEQ ID NO: 1470 - DNA, 38 bp, Artificial Sequence
  Synthetic
aggggctggtctgtgacctgttgtcggaggtggagagg

SEQ ID NO: 1471 - DNA, 38 bp, Artificial Sequence
  Synthetic
agtccaggcccgggacataaactctaggcctgtggagc

SEQ ID NO: 1472 - DNA, 38 bp, Artificial Sequence
  Synthetic
agagcccagaccggtctccgctccagggaatctttggg

SEQ ID NO: 1473 - DNA, 38 bp, Artificial Sequence
  Synthetic
gcaacgtccaggagctgttctctccccgctgaccagtc

SEQ ID NO: 1474 - DNA, 38 bp, Artificial Sequence
  Synthetic
tcgtggtggaggctgccaggcagcttgtccttgaggag

SEQ ID NO: 1475 - DNA, 35 bp, Artificial Sequence
  Synthetic
cacgttggaccccaagcggtcgggagaggcgcctt

SEQ ID NO: 1476 - DNA, 35 bp, Artificial Sequence
  Synthetic
ggcggagagaatggaggccagagggccggtctcga

SEQ ID NO: 1477 - DNA, 34 bp, Artificial Sequence
  Synthetic
aatgcggccctgcacgtggccgaggccaccttgt

SEQ ID NO: 1478 - DNA, 39 bp, Artificial Sequence
  Synthetic
aaagctggaagcgcctcctatccctgttgtctggccacg

SEQ ID NO: 1479 - DNA, 42 bp, Artificial Sequence
  Synthetic
gccctcctttggggatgatgcatctaggtcagacaggtagcg

SEQ ID NO: 1480 - DNA, 37 bp, Artificial Sequence
  Synthetic
acccgtgggacaaacgcccgagaatggccgcgagttt

SEQ ID NO: 1481 - DNA, 37 bp, Artificial Sequence
  Synthetic
tccccccgccactactccactggatgccctccacgac

SEQ ID NO: 1482 - DNA, 36 bp, Artificial Sequence
  Synthetic
ccgctttctggtctcgggtgagctgcccccgtcaag

SEQ ID NO: 1483 - DNA, 38 bp, Artificial Sequence
  Synthetic
cggccgccttcatcgagttcagctcgttggagaggacc

SEQ ID NO: 1484 - DNA, 41 bp, Artificial Sequence
  Synthetic
gcttgaagaagagctcggggacgagaaccacgagaggtgcc

SEQ ID NO: 1485 - DNA, 42 bp, Artificial Sequence
  Synthetic
acggcgcagttgacgatagagagacagcgggcaagttttgtg

SEQ ID NO: 1486 - DNA, 35 bp, Artificial Sequence
  Synthetic
cgggaggcagatgttggccgtgctgcagccctcga

SEQ ID NO: 1487 - DNA, 37 bp, Artificial Sequence
  Synthetic
agacaacgtgggcctcaacggccttcactggccctgt

SEQ ID NO: 1488 - DNA, 39 bp, Artificial Sequence
  Synthetic
cgagggtgtctctggccttgccacctccgccacctccta

SEQ ID NO: 1489 - DNA, 41 bp, Artificial Sequence
  Synthetic
ctcatgagcaccctggcaacaacgtgacatggagaaactgg

SEQ ID NO: 1490 - DNA, 35 bp, Artificial Sequence
  Synthetic
aatccgcatggagcccccgccaggcccgcatgagt

SEQ ID NO: 1491 - DNA, 34 bp, Artificial Sequence
  Synthetic
tccaccacgtggcgggttcagccgcttcttgggc

SEQ ID NO: 1492 - DNA, 40 bp, Artificial Sequence
  Synthetic
ccttcagatatgccaccccccaggggtactgggggtggtt

SEQ ID NO: 1493 - DNA, 39 bp, Artificial Sequence
  Synthetic
cccgagggtcatgggctcatcaacatgagacgtgaccgg

SEQ ID NO: 1494 - DNA, 37 bp, Artificial Sequence
  Synthetic
tcagtcagggaagccgccgcacctggcttctgaccgg

SEQ ID NO: 1495 - DNA, 40 bp, Artificial Sequence
  Synthetic
cagcagcgtgttcacaaacttatagcctcagccatctacc

SEQ ID NO: 1496 - DNA, 38 bp, Artificial Sequence
  Synthetic
gcctgtgctaccggacacggagcagctcagggaatggc

SEQ ID NO: 1497 - DNA, 35 bp, Artificial Sequence
  Synthetic
aacggggtggatttggcgtgcattagacgcgcgcg

SEQ ID NO: 1498 - DNA, 41 bp, Artificial Sequence
  Synthetic
caccctcctcttgaacaggcctttgtcaatccatggcaggc

SEQ ID NO: 1499 - DNA, 39 bp, Artificial Sequence
  Synthetic
ggacattgtccccccctgactgtatgggttaccgcacgc

SEQ ID NO: 1500 - DNA, 39 bp, Artificial Sequence
  Synthetic
acttggctgaaccaccggccaacttagcagttcggcacc

SEQ ID NO: 1501 - DNA, 36 bp, Artificial Sequence
  Synthetic
ctgaagcccggtgcccaaacgagtcactgctgctgg

SEQ ID NO: 1502 - DNA, 42 bp, Artificial Sequence
  Synthetic
agccagatgttcaggaaccaaagcatcgcttaagtatgagtg

SEQ ID NO: 1503 - DNA, 39 bp, Artificial Sequence
  Synthetic
gggaacagcaggggaggtccagggaatgaaagctcacgg

SEQ ID NO: 1504 - DNA, 40 bp, Artificial Sequence
  Synthetic
gctctcgctgtagtcagactcgtgagggcagtgatagcga

SEQ ID NO: 1505 - DNA, 35 bp, Artificial Sequence
  Synthetic
ttggtgctgtgcccctgccgcagttcgcccagctc

SEQ ID NO: 1506 - DNA, 35 bp, Artificial Sequence
  Synthetic
catgcaccaggggcagctgcgttccagcttcgtcc

SEQ ID NO: 1507 - DNA, 35 bp, Artificial Sequence
  Synthetic
gcagcgggtcagcagtcatcgccgctggagttcct

SEQ ID NO: 1508 - DNA, 40 bp, Artificial Sequence
  Synthetic
gggaagagcacatgcagcctgaggagcgacgagtatgtgg

SEQ ID NO: 1509 - DNA, 39 bp, Artificial Sequence
  Synthetic
gctgatggtgcttgccggatgcgaaaatactgccccgcg

SEQ ID NO: 1510 - DNA, 39 bp, Artificial Sequence
  Synthetic
atccgggccttgacgtgggttctacaatgccagggggga

SEQ ID NO: 1511 - DNA, 38 bp, Artificial Sequence
  Synthetic
gctctacgccttcctccgcaggcttggtgcctctgtgg

SEQ ID NO: 1512 - DNA, 39 bp, Artificial Sequence
  Synthetic
ggaccaacaacccccacctgtggcatgtctgttccccct

SEQ ID NO: 1513 - DNA, 46 bp, Artificial Sequence
  Synthetic
gtctcagttgagcattcaccttttaactggaccctttaaaacatcc

SEQ ID NO: 1514 - DNA, 42 bp, Artificial Sequence
  Synthetic
tgccggactctgtcatccgtaaattgtctgcgtacgctttcc

SEQ ID NO: 1515 - DNA, 40 bp, Artificial Sequence
  Synthetic
ccgatccgacccgctctactttgacagcacctccaacagc

SEQ ID NO: 1516 - DNA, 42 bp, Artificial Sequence
  Synthetic
gcaaaaggggccctattctgctaatgcctctatgttggcaca

SEQ ID NO: 1517 - DNA, 36 bp, Artificial Sequence
  Synthetic
gcacagtgcggctcaggctgcaccgagctgatgggt

SEQ ID NO: 1518 - DNA, 39 bp, Artificial Sequence
  Synthetic
caccgacaacgttctgcgccaatctggttgtcggcctcc

SEQ ID NO: 1519 - DNA, 38 bp, Artificial Sequence
  Synthetic
tcccttcgcaggagggccacagacggatgtcaggtcgg

SEQ ID NO: 1520 - DNA, 38 bp, Artificial Sequence
  Synthetic
tcccgatggcaggtgcacgctcaagtgtaagcagcccg

SEQ ID NO: 1521 - DNA, 39 bp, Artificial Sequence
  Synthetic
ggggctccggtgcctttttcgtgctctcatccctgcaac

SEQ ID NO: 1522 - DNA, 41 bp, Artificial Sequence
  Synthetic
gcacacgttgttttggcaataaaccagaaagatacccagag

SEQ ID NO: 1523 - DNA, 41 bp, Artificial Sequence
  Synthetic
cggccgtttcaaatgctgtggacacgcatccctgtcttctc

SEQ ID NO: 1524 - DNA, 34 bp, Artificial Sequence
  Synthetic
tgctgtccaccgccctgtggctagcccccgcaaa

SEQ ID NO: 1525 - DNA, 39 bp, Artificial Sequence
  Synthetic
cggggtttacagtggcctcattgaaaagggggtggcggt

SEQ ID NO: 1526 - DNA, 39 bp, Artificial Sequence
  Synthetic
gctgaagcggctaagtgggaggtgtcttgggcatcatcc

SEQ ID NO: 1527 - DNA, 35 bp, Artificial Sequence
  Synthetic
tcccgctctgccagctcgagccccaagccttcgca

SEQ ID NO: 1528 - DNA, 42 bp, Artificial Sequence
  Synthetic
tgctcttcaaccttggcagtgtgacaaggcagtagaggacac

SEQ ID NO: 1529 - DNA, 39 bp, Artificial Sequence
  Synthetic
aggcaggcgtccttgggtgcaggcaccgtctgtatacgt

SEQ ID NO: 1530 - DNA, 38 bp, Artificial Sequence
  Synthetic
tggcgccctaagaccacctggccaccacagcacaagtg

SEQ ID NO: 1531 - DNA, 36 bp, Artificial Sequence
  Synthetic
gcagcacacgcccccattccttccccgggaatgtgt

SEQ ID NO: 1532 - DNA, 40 bp, Artificial Sequence
  Synthetic
aaggctggcaaagatccccagtctcctaggaatgccgagc

SEQ ID NO: 1533 - DNA, 39 bp, Artificial Sequence
  Synthetic
tcagcctacaagagcacccagagttgcgctcgacgaact

SEQ ID NO: 1534 - DNA, 38 bp, Artificial Sequence
  Synthetic
gccgagaagaccttctcctgcccgtcagcacccccaca

SEQ ID NO: 1535 - DNA, 40 bp, Artificial Sequence
  Synthetic
gccatcaagtgcacgtgcaacggggaaagaggccgttggc

SEQ ID NO: 1536 - DNA, 38 bp, Artificial Sequence
  Synthetic
gccgggacaagctcagcctccccagtaggtgcctggct

SEQ ID NO: 1537 - DNA, 39 bp, Artificial Sequence
  Synthetic
aggaggccgggcgctataggaccccctctatgtcttcgc

SEQ ID NO: 1538 - DNA, 40 bp, Artificial Sequence
  Synthetic
gggacgtggtctactgggagcgaaggcccgtctgtagagg

SEQ ID NO: 1539 - DNA, 38 bp, Artificial Sequence
  Synthetic
cgctgtgtgggcgagctgatgtcccctctgccgtggaa

SEQ ID NO: 1540 - DNA, 38 bp, Artificial Sequence
  Synthetic
agctagagaaggagccccatgggccgcatccacgtcct

SEQ ID NO: 1541 - DNA, 41 bp, Artificial Sequence
  Synthetic
tgtggctgcgttacaccgatatgcaaagatctgcgtggaca

SEQ ID NO: 1542 - DNA, 38 bp, Artificial Sequence
  Synthetic
ccctggccacctaccctcttagacctgtggcccgcgta

SEQ ID NO: 1543 - DNA, 40 bp, Artificial Sequence
  Synthetic
tcaaggcctccctgaggaaggacgatgtcggctgtcctgc

SEQ ID NO: 1544 - DNA, 37 bp, Artificial Sequence
  Synthetic
cctcccctacggttaccccaccgggaggccgtgcttt

SEQ ID NO: 1545 - DNA, 43 bp, Artificial Sequence
  Synthetic
cgagtcagccatggaagaagaaagagcggtctgtataaaaacg

SEQ ID NO: 1546 - DNA, 50 bp, Artificial Sequence
  Synthetic
aggtagtactaaagcatgcaaatctagacaaatatgattggaaatagacc

SEQ ID NO: 1547 - DNA, 48 bp, Artificial Sequence
  Synthetic
cgtttgtactggagaaccaactaacgttagtgcaagattccaataacg

SEQ ID NO: 1548 - DNA, 48 bp, Artificial Sequence
  Synthetic
tgaaagaagaaaatggcaactggtgactgtactgaattccaaatgatt

SEQ ID NO: 1549 - DNA, 49 bp, Artificial Sequence
  Synthetic
ggtctatttgtgtggcgagttttcagtttatgaaataactaatgccacc

SEQ ID NO: 1550 - DNA, 43 bp, Artificial Sequence
  Synthetic
accatatctttgggcatctgatgtattttgaggatgcaaacgg

SEQ ID NO: 1551 - DNA, 40 bp, Artificial Sequence
  Synthetic
cgaaaacggtcgtgtaggtcttaacaattgcaccgactcg

SEQ ID NO: 1552 - DNA, 49 bp, Artificial Sequence
  Synthetic
aggttggggttcttcaatttcaaattggagaagaaattcctttagatcc

SEQ ID NO: 1553 - DNA, 44 bp, Artificial Sequence
  Synthetic
tgcctccatgaaagtaatatccagtatcttccacctcaaaagcc

SEQ ID NO: 1554 - DNA, 48 bp, Artificial Sequence
  Synthetic
gcatttccaaatccaaattcacacagagattgtcctcctattgaatta

SEQ ID NO: 1555 - DNA, 44 bp, Artificial Sequence
  Synthetic
tgcaggacattttgtagctaatgatgggaacttgcctttgtacc

SEQ ID NO: 1556 - DNA, 50 bp, Artificial Sequence
  Synthetic
ggtatgttggcttggctttatactccacgtatattttatttttcaaccgc

SEQ ID NO: 1557 - DNA, 45 bp, Artificial Sequence
  Synthetic
cgcatggtagcctatacatattgtgctactggtcctgttatgtgc

SEQ ID NO: 1558 - DNA, 43 bp, Artificial Sequence
  Synthetic
gtcgatgaaatctcctggataacatctgcttccagtgagatca

SEQ ID NO: 1559 - DNA, 43 bp, Artificial Sequence
  Synthetic
acttctttccctttcttgttcacatatttgctatggctgacgg

SEQ ID NO: 1560 - DNA, 43 bp, Artificial Sequence
  Synthetic
agcataccttggtgctattagatttttgctaaaacccggagac

SEQ ID NO: 1561 - DNA, 42 bp, Artificial Sequence
  Synthetic
aaccggcaatggctccaaatgttacaggactaaggaacattc

SEQ ID NO: 1562 - DNA, 50 bp, Artificial Sequence
  Synthetic
cccattgattccaatttcactccattgattatcccaaatattcagaagag

SEQ ID NO: 1563 - DNA, 39 bp, Artificial Sequence
  Synthetic
acgtgccaagacttaccgttacaaggttcgttggcagac

SEQ ID NO: 1564 - DNA, 44 bp, Artificial Sequence
  Synthetic
acaccaaatcctcctctgtcctgagctacttaattttgatcaca

SEQ ID NO: 1565 - DNA, 50 bp, Artificial Sequence
  Synthetic
cctttccagctgtttctgaccttattaagttattagacttagtggagaag

SEQ ID NO: 1566 - DNA, 45 bp, Artificial Sequence
  Synthetic
accagttgtatatcacccagcaaacgtgcttgctacaaatttagg

SEQ ID NO: 1567 - DNA, 41 bp, Artificial Sequence
  Synthetic
ccctgtacagcatctccatcatatttgacgaagggacagac

SEQ ID NO: 1568 - DNA, 43 bp, Artificial Sequence
  Synthetic
ctgttgttggtggattggccaaatgaagctgaagatctttctg

SEQ ID NO: 1569 - DNA, 47 bp, Artificial Sequence
  Synthetic
tggtggcatataatgtagccaaattgaatgatgacttaattgaaagc

SEQ ID NO: 1570 - DNA, 45 bp, Artificial Sequence
  Synthetic
agtcaaattgtgtagcatttgcagtcctgaatggatacttacaca

SEQ ID NO: 1571 - DNA, 46 bp, Artificial Sequence
  Synthetic
ggtcagtaagttcaaattgtggtttcagcagagttaaatcctttgc

SEQ ID NO: 1572 - DNA, 44 bp, Artificial Sequence
  Synthetic
ccccaatcgcataactccatttagactttaagacaagagcaaat

SEQ ID NO: 1573 - DNA, 38 bp, Artificial Sequence
  Synthetic
accccgacctggaaagggtgtcttcgccaccaactgga

SEQ ID NO: 1574 - DNA, 37 bp, Artificial Sequence
  Synthetic
ggtgggggtagtggagtctgcaaaggggaggggagcg

SEQ ID NO: 1575 - DNA, 39 bp, Artificial Sequence
  Synthetic
gcacttaagcacattggcgtccacgattactggctgagg

SEQ ID NO: 1576 - DNA, 48 bp, Artificial Sequence
  Synthetic
cgaaccatgttagttagtatgggttatgatctgtaagctttactaacg

SEQ ID NO: 1577 - DNA, 40 bp, Artificial Sequence
  Synthetic
cctggcccttcccctaatggaataagtacaggccgtggca

SEQ ID NO: 1578 - DNA, 47 bp, Artificial Sequence
  Synthetic
accttctgttacaactggagtatctagaatcaattgctgagatacac

SEQ ID NO: 1579 - DNA, 49 bp, Artificial Sequence
  Synthetic
ggcgttgtacatctaaaaattgccttgaggtcacacaaatatttgaaag

SEQ ID NO: 1580 - DNA, 42 bp, Artificial Sequence
  Synthetic
actttcaactgggccttgtactgaaatgcaattattggggga

SEQ ID NO: 1581 - DNA, 44 bp, Artificial Sequence
  Synthetic
gcaaacggtcactaattgcatgatacagtggcgagagttcaaag

SEQ ID NO: 1582 - DNA, 40 bp, Artificial Sequence
  Synthetic
acctgatgttccaacccctaaagtttgggcctgtagaggt

SEQ ID NO: 1583 - DNA, 47 bp, Artificial Sequence
  Synthetic
tgctggcaaaaagaaattatgatccttatgttagaggaggttcagtt

SEQ ID NO: 1584 - DNA, 43 bp, Artificial Sequence
  Synthetic
aggggccgttttttatcgaaattagatcactgaaagccagaga

SEQ ID NO: 1585 - DNA, 40 bp, Artificial Sequence
  Synthetic
atgcacagctagcgccatatctttcttctagcatggacca

SEQ ID NO: 1586 - DNA, 42 bp, Artificial Sequence
  Synthetic
tgttgggatcttctggcctattctcaagggcgttatattgga

SEQ ID NO: 1587 - DNA, 43 bp, Artificial Sequence
  Synthetic
gcttaatgccactgtatcgtttcaagcaagaagcttgtggatg

SEQ ID NO: 1588 - DNA, 42 bp, Artificial Sequence
  Synthetic
acacgttaacagtactcgattcctggcaggagaaatcccatc

SEQ ID NO: 1589 - DNA, 42 bp, Artificial Sequence
  Synthetic
cgttttgatttagcctcagtcttcatgggggttaaagggaga

SEQ ID NO: 1590 - DNA, 42 bp, Artificial Sequence
  Synthetic
gtgaaatggcgaactgtttgttcgcatggtatcaacagtggg

SEQ ID NO: 1591 - DNA, 43 bp, Artificial Sequence
  Synthetic
agaacggttaggattcgtttttcttgtgtagctgcttctggtg

SEQ ID NO: 1592 - DNA, 44 bp, Artificial Sequence
  Synthetic
actcggagacaagtgatataatggacagttagtctggacggatg

SEQ ID NO: 1593 - DNA, 49 bp, Artificial Sequence
  Synthetic
ccatctttacatgagaaggcattccctaccttcctttagtaaagaatgt

SEQ ID NO: 1594 - DNA, 42 bp, Artificial Sequence
  Synthetic
aaccatgatccaccatgttcaatattgggttgattggtttgg

SEQ ID NO: 1595 - DNA, 45 bp, Artificial Sequence
  Synthetic
cgcaccttgacaaatcctttagaaattctcaaaagggattgacgg

SEQ ID NO: 1596 - DNA, 44 bp, Artificial Sequence
  Synthetic
agcatcaactgatgagccagaatctgaagctaacagaacattgc

SEQ ID NO: 1597 - DNA, 41 bp, Artificial Sequence
  Synthetic
agacaaagagtatgcagcggtcatcgcaatcgtaagtatcc

SEQ ID NO: 1598 - DNA, 43 bp, Artificial Sequence
  Synthetic
tgttccatagtcccttgtcgatatcctctttgtgaacagtgtc

SEQ ID NO: 1599 - DNA, 44 bp, Artificial Sequence
  Synthetic
atcaccctctacaaaaagctcctatacagggtgttatgttttgc

SEQ ID NO: 1600 - DNA, 45 bp, Artificial Sequence
  Synthetic
cacagtatcgcaagttgaaggttaactttttggatatctgccttc

SEQ ID NO: 1601 - DNA, 45 bp, Artificial Sequence
  Synthetic
tttgcaggcctgtagtccctgaagaagataaaactaagaatcagg

SEQ ID NO: 1602 - DNA, 42 bp, Artificial Sequence
  Synthetic
cccccgaaaagctctatccatgggctcttttgttgagtttga

SEQ ID NO: 1603 - DNA, 45 bp, Artificial Sequence
  Synthetic
gccaaccattgcttatccgaaatcaatgttctgttatctccagat

SEQ ID NO: 1604 - DNA, 41 bp, Artificial Sequence
  Synthetic
cctttgctacctcttccatggaatgcggttttaaagatggc

SEQ ID NO: 1605 - DNA, 47 bp, Artificial Sequence
  Synthetic
ttttgctatccaatttcctgagtcttctgattgagggacttctatca

SEQ ID NO: 1606 - DNA, 46 bp, Artificial Sequence
  Synthetic
aaagcgttctagttgtgtgtgataagtttctcggaaatcacaaact

SEQ ID NO: 1607 - DNA, 43 bp, Artificial Sequence
  Synthetic
gttcgcatattggaagacggagctgaataggaattcctcgacc

SEQ ID NO: 1608 - DNA, 41 bp, Artificial Sequence
  Synthetic
aggtttaacaaaagccaaggaggcttcgccaagctttgagt

SEQ ID NO: 1609 - DNA, 46 bp, Artificial Sequence
  Synthetic
cggagtagagaaatcagcagactgcttcgcattcttattaccaatg

SEQ ID NO: 1610 - DNA, 42 bp, Artificial Sequence
  Synthetic
catgcaccaatagttacggtgttttacagtttgtggagggtt

SEQ ID NO: 1611 - DNA, 47 bp, Artificial Sequence
  Synthetic
gcttgtgtgtcttttgtctttttcataaacaatatgctcaatacggg

SEQ ID NO: 1612 - DNA, 42 bp, Artificial Sequence
  Synthetic
gtttcacctcctaagaagaaccgctttcggaacaacaactgc

SEQ ID NO: 1613 - DNA, 45 bp, Artificial Sequence
  Synthetic
catcctgttcagctttacgaaggaaagcctgtacagaatacaaga

SEQ ID NO: 1614 - DNA, 48 bp, Artificial Sequence
  Synthetic
ccttcggttatcggagtagttacaagtttaacagtagatcaactttcc

SEQ ID NO: 1615 - DNA, 44 bp, Artificial Sequence
  Synthetic
ggaagcagataatttagaggaagctcttgccctttatgtggtct

SEQ ID NO: 1616 - DNA, 49 bp, Artificial Sequence
  Synthetic
cctaagatagcgatcaaaggttgatcctacttaacctattttacagatg

SEQ ID NO: 1617 - DNA, 42 bp, Artificial Sequence
  Synthetic
gcaggtttagatgttgtgggttttggctatggcttttatggg

SEQ ID NO: 1618 - DNA, 44 bp, Artificial Sequence
  Synthetic
aatgttctaaaggggatgtggatttaagcactcctcctatcaca

SEQ ID NO: 1619 - DNA, 42 bp, Artificial Sequence
  Synthetic
ggagtggattcctcggttgttccaacaacattatactcccct

SEQ ID NO: 1620 - DNA, 44 bp, Artificial Sequence
  Synthetic
catgggtgatttcttctgggaattactgttgaagtacgtccctt

SEQ ID NO: 1621 - DNA, 43 bp, Artificial Sequence
  Synthetic
agaactgctgcctctaaaagatcaggctgataaatgttttcgg

SEQ ID NO: 1622 - DNA, 43 bp, Artificial Sequence
  Synthetic
ctggtaaaagaagggctgtttgatattgtcgcgaatagtcaca

SEQ ID NO: 1623 - DNA, 43 bp, Artificial Sequence
  Synthetic
ggctgcagaggctattgaagtttgattttctctactaagtcgt

SEQ ID NO: 1624 - DNA, 38 bp, Artificial Sequence
  Synthetic
agacgtcacaggtgtggtaagttatccccaggcatgac

SEQ ID NO: 1625 - DNA, 42 bp, Artificial Sequence
  Synthetic
gattgctcctcagaggtattggtagtttggcaagcaaacaac

SEQ ID NO: 1626 - DNA, 41 bp, Artificial Sequence
  Synthetic
tggtttcttgcccaagatctcacctcttacaaaccgcattt

SEQ ID NO: 1627 - DNA, 45 bp, Artificial Sequence
  Synthetic
ttcacagatcctccgtaaagaatgattgcttctctcttttccaaa

SEQ ID NO: 1628 - DNA, 42 bp, Artificial Sequence
  Synthetic
aggttatggaatcgcggttatcaggagcctgtgcagaatgtg

SEQ ID NO: 1629 - DNA, 42 bp, Artificial Sequence
  Synthetic
tggaatttctcgaggcgctctaaagtaacaggactatcccct

SEQ ID NO: 1630 - DNA, 43 bp, Artificial Sequence
  Synthetic
gaagtggatactgagacagaaagttaccggtactttgcaacac

SEQ ID NO: 1631 - DNA, 47 bp, Artificial Sequence
  Synthetic
ggtgcatattacgctgtccttcgaaacaagaagttctttttcaacac

SEQ ID NO: 1632 - DNA, 43 bp, Artificial Sequence
  Synthetic
tggtcaaagacgcaagctgtgaccttatctttgggatacagat

SEQ ID NO: 1633 - DNA, 40 bp, Artificial Sequence
  Synthetic
atgattttgttcgttggcggagagaaaacaggcaagccat

SEQ ID NO: 1634 - DNA, 45 bp, Artificial Sequence
  Synthetic
agctagcttcatggagtatgtctaccaacataaaactggagttct

SEQ ID NO: 1635 - DNA, 45 bp, Artificial Sequence
  Synthetic
gggaaaggggttttcaagaagaatatcattctctgtaacaacctc

SEQ ID NO: 1636 - DNA, 47 bp, Artificial Sequence
  Synthetic
tttcaggaatttctgtcggtggcggtcttaattccattaataagact

SEQ ID NO: 1637 - DNA, 39 bp, Artificial Sequence
  Synthetic
agaaggaagaccgcaaaggaagcagacactacatgccaa

SEQ ID NO: 1638 - DNA, 42 bp, Artificial Sequence
  Synthetic
catggtagtcgtaaaagaaagggattgttgtgtccttccgtt

SEQ ID NO: 1639 - DNA, 39 bp, Artificial Sequence
  Synthetic
tagaggcccaggaatggagacgtagcaaaaatctcccca

SEQ ID NO: 1640 - DNA, 41 bp, Artificial Sequence
  Synthetic
gctcagtatttagcagggcagtcttcccaaaagacttcaga

SEQ ID NO: 1641 - DNA, 42 bp, Artificial Sequence
  Synthetic
gttagcatggcaggagaatttcttaactgacaaaagctgccg

SEQ ID NO: 1642 - DNA, 42 bp, Artificial Sequence
  Synthetic
aggctgctaatatgtcttcacgttccgtagtggttcgggatt

SEQ ID NO: 1643 - DNA, 38 bp, Artificial Sequence
  Synthetic
tcagaaagggctgaaggcagaaacggtgcaactcgatc

SEQ ID NO: 1644 - DNA, 48 bp, Artificial Sequence
  Synthetic
agttgcacagaaataacagctcccaaaaataggattagaagaacttcc

SEQ ID NO: 1645 - DNA, 46 bp, Artificial Sequence
  Synthetic
tgctttcgagaggatacaaaggggctggattcacaatagtaaatgc

SEQ ID NO: 1646 - DNA, 41 bp, Artificial Sequence
  Synthetic
taaggggtccccagacatggcagaacacatcacttcagaag

SEQ ID NO: 1647 - DNA, 41 bp, Artificial Sequence
  Synthetic
tggctcagtcggttcttcagtaatccagactcttcctcatc

SEQ ID NO: 1648 - DNA, 40 bp, Artificial Sequence
  Synthetic
tctacggcgagcttgtttactaaggcagaaggatcttgtt

SEQ ID NO: 1649 - DNA, 44 bp, Artificial Sequence
  Synthetic
cttgaatttcgaaagaggatgttgccttgcttgcgttattttcg

SEQ ID NO: 1650 - DNA, 43 bp, Artificial Sequence
  Synthetic
ggttgtcagtaagatcgtcggacctttaattacagctgggatg

SEQ ID NO: 1651 - DNA, 43 bp, Artificial Sequence
  Synthetic
acaggattcttgctttggcagaatttcaacattgcgatcatca

SEQ ID NO: 1652 - DNA, 46 bp, Artificial Sequence
  Synthetic
cattgatcgttttgctagggatttcttaaacacgtacagaaagcaa

SEQ ID NO: 1653 - DNA, 41 bp, Artificial Sequence
  Synthetic
cacgagtgtttgagtgctaagtctgactgcgctatgaggat

SEQ ID NO: 1654 - DNA, 43 bp, Artificial Sequence
  Synthetic
gtaggggctcaaggacgaactcaaatcaatgatttccacttca

SEQ ID NO: 1655 - DNA, 42 bp, Artificial Sequence
  Synthetic
gattgtagagtgggatcagcaagttggacaataaaatgcgcg

SEQ ID NO: 1656 - DNA, 49 bp, Artificial Sequence
  Synthetic
cctacctggttgattatggagaaattaccgaatctctaataatggatca

SEQ ID NO: 1657 - DNA, 38 bp, Artificial Sequence
  Synthetic
aaagctcctttttcgtgcccgtgctgctatccccgata

SEQ ID NO: 1658 - DNA, 40 bp, Artificial Sequence
  Synthetic
tcccattctcttcacgaggtttatccaccatccctgcttc

SEQ ID NO: 1659 - DNA, 43 bp, Artificial Sequence
  Synthetic
tgttcaatgttcctttggagcagaaattcactgctttagcctg

SEQ ID NO: 1660 - DNA, 38 bp, Artificial Sequence
  Synthetic
cgtgcgtgctagaacttcttaaaacgacgaggacccta

SEQ ID NO: 1661 - DNA, 46 bp, Artificial Sequence
  Synthetic
gcatttgtacgttgatatcgagcatgtgctgcttgagaattcttac

SEQ ID NO: 1662 - DNA, 43 bp, Artificial Sequence
  Synthetic
gcatgcagggttgctatcaacgaaaactcgaatccaaactttc

SEQ ID NO: 1663 - DNA, 42 bp, Artificial Sequence
  Synthetic
tggtataagaacggtcgtgtgcgacgctgtagcataatcaat

SEQ ID NO: 1664 - DNA, 41 bp, Artificial Sequence
  Synthetic
gatggcgctattgcaaatgcaagaacgcaaagattttcacg

SEQ ID NO: 1665 - DNA, 44 bp, Artificial Sequence
  Synthetic
agaagaaaactccaatcaaaacgtggtgtgcccaatcatttcag

SEQ ID NO: 1666 - DNA, 42 bp, Artificial Sequence
  Synthetic
ggcagctcctcaattccgagatatgctgatcaaattttggct

SEQ ID NO: 1667 - DNA, 45 bp, Artificial Sequence
  Synthetic
gggaagcagaccagagaagaagaatccccttagaagttacttaaa

SEQ ID NO: 1668 - DNA, 42 bp, Artificial Sequence
  Synthetic
tccccagggaatttctttgcaaggattaaccagcaaatacac

SEQ ID NO: 1669 - DNA, 42 bp, Artificial Sequence
  Synthetic
gggaggtaaatcaagactccgatttcctgctttcatcatggg

SEQ ID NO: 1670 - DNA, 43 bp, Artificial Sequence
  Synthetic
atcgtagagtcttgtatcacctgaaaaattgggatagcgctct

SEQ ID NO: 1671 - DNA, 42 bp, Artificial Sequence
  Synthetic
ttacgctaaaaacgggcctattttgattaaccaaaagagcgc

SEQ ID NO: 1672 - DNA, 41 bp, Artificial Sequence
  Synthetic
tcatcaagctatcggcgatgtatagctttcgatgctcaacc

SEQ ID NO: 1673 - DNA, 41 bp, Artificial Sequence
  Synthetic
gcaagagcagcttctttgtctatcgcagaagaaaaattccc

SEQ ID NO: 1674 - DNA, 39 bp, Artificial Sequence
  Synthetic
ctccaggagttgcggatacaacctatgaagaagctcgtc

SEQ ID NO: 1675 - DNA, 45 bp, Artificial Sequence
  Synthetic
caatcaatgcagaattcgtcacaaaagactttaggagatcgtgtg

SEQ ID NO: 1676 - DNA, 47 bp, Artificial Sequence
  Synthetic
gctatcgaagtggattgccgaattatcctttatctaacagtctctct

SEQ ID NO: 1677 - DNA, 48 bp, Artificial Sequence
  Synthetic
cttcgtcaagggttcttgtgattgtctctttactattaggaattaacg

SEQ ID NO: 1678 - DNA, 42 bp, Artificial Sequence
  Synthetic
ttgcgcatggatgactgttagtcaatgaccttcctatgtctc

SEQ ID NO: 1679 - DNA, 44 bp, Artificial Sequence
  Synthetic
cgagcagcaagaaggaattaattgtcatcgacaagattccctcc

SEQ ID NO: 1680 - DNA, 41 bp, Artificial Sequence
  Synthetic
gctgtttcatctgcggaactttaaagcagtgaaaacttgcc

SEQ ID NO: 1681 - DNA, 45 bp, Artificial Sequence
  Synthetic
gagaagtctttattcaagccaaaggctttcaatcttcgggacaac

SEQ ID NO: 1682 - DNA, 39 bp, Artificial Sequence
  Synthetic
aacagaaagcctgagccagctcgtgcaagtatgttcaac

SEQ ID NO: 1683 - DNA, 48 bp, Artificial Sequence
  Synthetic
gtcctccgctgatgatattagaagacgtttagaaattctagaagatgc

SEQ ID NO: 1684 - DNA, 42 bp, Artificial Sequence
  Synthetic
cagcaaatggtgaatgctgcctaaaaattcgtctaactgctg

SEQ ID NO: 1685 - DNA, 41 bp, Artificial Sequence
  Synthetic
tgcgagtgttatatgagcacgaacttctacaatagcgtgca

SEQ ID NO: 1686 - DNA, 43 bp, Artificial Sequence
  Synthetic
tgtccatttatttggtcttggagtctcttgaacgcaacgagaa

SEQ ID NO: 1687 - DNA, 41 bp, Artificial Sequence
  Synthetic
cgcttcatcgataggcatagccaacaggaaaatggagaggt

SEQ ID NO: 1688 - DNA, 43 bp, Artificial Sequence
  Synthetic
tccaagaattagacaaaagatcgcaccatttgttcgcgagtca

SEQ ID NO: 1689 - DNA, 43 bp, Artificial Sequence
  Synthetic
caaccaccttgatgaaaaacaaagtttgtctcggacgttttgc

SEQ ID NO: 1690 - DNA, 46 bp, Artificial Sequence
  Synthetic
cgatgtagtattttgctcttgccttacatttctcgcatatgaacag

SEQ ID NO: 1691 - DNA, 44 bp, Artificial Sequence
  Synthetic
agctaatcactcacagcaccatctgtgcgatcaaaaatacgttt

SEQ ID NO: 1692 - DNA, 41 bp, Artificial Sequence
  Synthetic
taccgtcgtatgtcggctgaccattttcaccatttcacaga

SEQ ID NO: 1693 - DNA, 45 bp, Artificial Sequence
  Synthetic
ctttccgactgcagttgatcatttatcacagatacatcaagagct

SEQ ID NO: 1694 - DNA, 43 bp, Artificial Sequence
  Synthetic
gttgttcttttgggtacaacaatctccaaagcgacgaagaact

SEQ ID NO: 1695 - DNA, 39 bp, Artificial Sequence
  Synthetic
caaaggagttgccggacctccaagagatgcaaccagaag

SEQ ID NO: 1696 - DNA, 46 bp, Artificial Sequence
  Synthetic
cgttgaaaccgattttgttgctaactcggacaataaactcgtaacg

SEQ ID NO: 1697 - DNA, 39 bp, Artificial Sequence
  Synthetic
acctgcggaagaagctgttgagcttcatcttgagcttct

SEQ ID NO: 1698 - DNA, 46 bp, Artificial Sequence
  Synthetic
ggatcctaaatagcgcttcactaaagtcattttctgttcatttcgg

SEQ ID NO: 1699 - DNA, 42 bp, Artificial Sequence
  Synthetic
tcacctaacctaggattatgcgttcgctatcgtcaacagcat

SEQ ID NO: 1700 - DNA, 39 bp, Artificial Sequence
  Synthetic
gccctttcccaactccttgagtttagtgcaccgttacga

SEQ ID NO: 1701 - DNA, 43 bp, Artificial Sequence
  Synthetic
ttaggcccagaggtcgattgtcgtctattaatccttctaacga

SEQ ID NO: 1702 - DNA, 45 bp, Artificial Sequence
  Synthetic
gtcaccggagcatcattatttactttacgctcttttgaacatgtc

SEQ ID NO: 1703 - DNA, 42 bp, Artificial Sequence
  Synthetic
gtgggagcgttcgagacatgattagttgctatgtctacctct

SEQ ID NO: 1704 - DNA, 41 bp, Artificial Sequence
  Synthetic
ggacaattccgcataatttcggaagctctgtttggttcctt

SEQ ID NO: 1705 - DNA, 41 bp, Artificial Sequence
  Synthetic
caatgcaccccttctttctgatccaagaggttccttctcaa

SEQ ID NO: 1706 - DNA, 43 bp, Artificial Sequence
  Synthetic
ccaccttcaatcacagcacttaaggaattcgatacttggattc

SEQ ID NO: 1707 - DNA, 45 bp, Artificial Sequence
  Synthetic
cgggatgattgaagtacagtccatgacttttttcaagctaacatc

SEQ ID NO: 1708 - DNA, 47 bp, Artificial Sequence
  Synthetic
ccagtcctcttgtctttcgacttcttagatagtcgcttattagtgaa

SEQ ID NO: 1709 - DNA, 42 bp, Artificial Sequence
  Synthetic
ctgttttattcttgcgtattggctgttgacaatggcttgagc

SEQ ID NO: 1710 - DNA, 44 bp, Artificial Sequence
  Synthetic
cggctttgcgcataaaaaacattttcaggttgagtatatggaag

SEQ ID NO: 1711 - DNA, 49 bp, Artificial Sequence
  Synthetic
gcgattttaaccacaagcttcaaatagaaactattgatcaaagtatccg

SEQ ID NO: 1712 - DNA, 45 bp, Artificial Sequence
  Synthetic
caaagttctggcattacagatcctagagttagtggtcatacaagg

SEQ ID NO: 1713 - DNA, 45 bp, Artificial Sequence
  Synthetic
gccctgaagtcagattttcttgccaaaaaaattatcaggacgctt

SEQ ID NO: 1714 - DNA, 40 bp, Artificial Sequence
  Synthetic
atgcagggttcgggaaaacaccatcacacacagcttttac

SEQ ID NO: 1715 - DNA, 44 bp, Artificial Sequence
  Synthetic
cctccgtagacaaaaacaacggactggaatatacacttcttccg

SEQ ID NO: 1716 - DNA, 45 bp, Artificial Sequence
  Synthetic
gcactctttaaatgattgctgcctaaggaagtgatgattcgaaga

SEQ ID NO: 1717 - DNA, 38 bp, Artificial Sequence
  Synthetic
gagtttgggcaagccgatgaagaaatccccgccagaaa

SEQ ID NO: 1718 - DNA, 39 bp, Artificial Sequence
  Synthetic
ctgttcgaaacgcatggcagcccatggatcgtttagagc

SEQ ID NO: 1719 - DNA, 43 bp, Artificial Sequence
  Synthetic
tcccaaccaactgcttaaacatctagctttgatcaattccgta

SEQ ID NO: 1720 - DNA, 42 bp, Artificial Sequence
  Synthetic
agtgattgttacctctttgcaacctttggcagtcattgagga

SEQ ID NO: 1721 - DNA, 41 bp, Artificial Sequence
  Synthetic
ccataggatctggaaccggagttgctgattttgtggttctt

SEQ ID NO: 1722 - DNA, 43 bp, Artificial Sequence
  Synthetic
actctttttagactctgtgcgtgtcagcagagcaatacgttgg

SEQ ID NO: 1723 - DNA, 43 bp, Artificial Sequence
  Synthetic
gccccaatcgaaaatctctcctattattcccccttaggtctgg

SEQ ID NO: 1724 - DNA, 45 bp, Artificial Sequence
  Synthetic
tgggatgcgatcttctgtgtattagcttttcttctttcagttctg

SEQ ID NO: 1725 - DNA, 42 bp, Artificial Sequence
  Synthetic
aggagaacacataccctcttctttattcatgcttcgatccca

SEQ ID NO: 1726 - DNA, 41 bp, Artificial Sequence
  Synthetic
tgaagaaccaggatccagctaatttctcggaagggagttgt

SEQ ID NO: 1727 - DNA, 38 bp, Artificial Sequence
  Synthetic
gctcgcaatagcagttctcctttttgggcttctctgcg

SEQ ID NO: 1728 - DNA, 39 bp, Artificial Sequence
  Synthetic
agagtgcgcaataaccacccgtgaaagcacaggttcatg

SEQ ID NO: 1729 - DNA, 46 bp, Artificial Sequence
  Synthetic
gtcacgaatattttcctgagaaggaatgacaatgctctttatcgac

SEQ ID NO: 1730 - DNA, 46 bp, Artificial Sequence
  Synthetic
aagaccctgctttccctgtaaagaattattaagcaaggatttaccg

SEQ ID NO: 1731 - DNA, 43 bp, Artificial Sequence
  Synthetic
ccaaagctccgtacactttttccttgcaaccgatagattctga

SEQ ID NO: 1732 - DNA, 38 bp, Artificial Sequence
  Synthetic
atctcccgcagccatatcacccggaagtggctactacc

SEQ ID NO: 1733 - DNA, 43 bp, Artificial Sequence
  Synthetic
gtgtctcgaaaagctgcttctaaatgtttgttcctttcgatcg

SEQ ID NO: 1734 - DNA, 41 bp, Artificial Sequence
  Synthetic
cgatttccctaacgcttccttatttatgcctttgttgctgc

SEQ ID NO: 1735 - DNA, 42 bp, Artificial Sequence
  Synthetic
accacaactcttgctcgcttatcaaagagcatcatacgaaga

SEQ ID NO: 1736 - DNA, 44 bp, Artificial Sequence
  Synthetic
catccgcaaaagttactttgttttgtgtcgttcggaaaatctcc

SEQ ID NO: 1737 - DNA, 40 bp, Artificial Sequence
  Synthetic
acaagcttgctgttaaactcctccttatggctcagcttca

SEQ ID NO: 1738 - DNA, 43 bp, Artificial Sequence
  Synthetic
gcgcattgaaactatgcagatcaatatttgttttcctccggga

SEQ ID NO: 1739 - DNA, 40 bp, Artificial Sequence
  Synthetic
tccagcacacatgagacaggttggagattgaaagacacga

SEQ ID NO: 1740 - DNA, 46 bp, Artificial Sequence
  Synthetic
ccagaaagtttaatctgcgctctttgtgtcagtcttttttctggat

SEQ ID NO: 1741 - DNA, 45 bp, Artificial Sequence
  Synthetic
cctactcatgcggaatgttttggtccgaataattacatctgttgc

SEQ ID NO: 1742 - DNA, 44 bp, Artificial Sequence
  Synthetic
cctaatccacaacgaggtcctggtgctttggttaaaattgctac

SEQ ID NO: 1743 - DNA, 42 bp, Artificial Sequence
  Synthetic
ttcctcattatctttggtcttgccaccacaggatacggcata

SEQ ID NO: 1744 - DNA, 45 bp, Artificial Sequence
  Synthetic
acaaaccgatcgcgaattggagcttagtctatttgtaaagtagtg

SEQ ID NO: 1745 - DNA, 39 bp, Artificial Sequence
  Synthetic
cgcaaatgattacgcccctctagtttggttggtgagtga

SEQ ID NO: 1746 - DNA, 41 bp, Artificial Sequence
  Synthetic
gccctgatagaaggagctatggtgaaatggcgttatgttcc

SEQ ID NO: 1747 - DNA, 45 bp, Artificial Sequence
  Synthetic
ttggaggtggcatcctttccgataagactatcatgattaaagctg

SEQ ID NO: 1748 - DNA, 43 bp, Artificial Sequence
  Synthetic
accggccaaactccatcaaggcccattaaagataatcattgga

SEQ ID NO: 1749 - DNA, 44 bp, Artificial Sequence
  Synthetic
ccagcagctacattgctactaaagaactctggatcagtttcctt

SEQ ID NO: 1750 - DNA, 43 bp, Artificial Sequence
  Synthetic
tgaatgcgcagatcgtatatctaaagcgagtagcttctttggt

SEQ ID NO: 1751 - DNA, 40 bp, Artificial Sequence
  Synthetic
aggttttcatatgctggttcccatttgttcggagatgcgt

SEQ ID NO: 1752 - DNA, 40 bp, Artificial Sequence
  Synthetic
acccgctgctgaattattttgtgcttccggactatcgaag

SEQ ID NO: 1753 - DNA, 46 bp, Artificial Sequence
  Synthetic
gacaaaccatgattcacctcgatacagccttgtttttattaaaccc

SEQ ID NO: 1754 - DNA, 42 bp, Artificial Sequence
  Synthetic
ccgcatctgtaagctcacagaatgcaagaagatataatcgcc

SEQ ID NO: 1755 - DNA, 39 bp, Artificial Sequence
  Synthetic
tcatcttcccgacggatgctagatggaaactgatgggga

SEQ ID NO: 1756 - DNA, 46 bp, Artificial Sequence
  Synthetic
gccagattcgccttatttcttctttaggacccatatacaagagagt

SEQ ID NO: 1757 - DNA, 42 bp, Artificial Sequence
  Synthetic
tctccagaagttccgatcattgagacaatggtgatggagttg

SEQ ID NO: 1758 - DNA, 45 bp, Artificial Sequence
  Synthetic
ggcccagtacctgcttcttagcaaatgaaaacatggatactatgg

SEQ ID NO: 1759 - DNA, 41 bp, Artificial Sequence
  Synthetic
ccttggaaccgattcttacactgctctgccctgttagtgga

SEQ ID NO: 1760 - DNA, 42 bp, Artificial Sequence
  Synthetic
tgtactttaacacagccactgcccaagtgcttgtcatgatgg

SEQ ID NO: 1761 - DNA, 50 bp, Artificial Sequence
  Synthetic
cactagaatcaggataacaggagcagaaaagggaaagatagtcaaatcag

SEQ ID NO: 1762 - DNA, 47 bp, Artificial Sequence
  Synthetic
aaaccgtttcttgaactaatgctttggagtaaaagggttttcattca

SEQ ID NO: 1763 - DNA, 43 bp, Artificial Sequence
  Synthetic
tcagaccgtgtttaaagaagcgtattgtggattcttgatcgtc

SEQ ID NO: 1764 - DNA, 47 bp, Artificial Sequence
  Synthetic
ttgtgtaggctgaagctactgtagaggctgaaaaaataaagatatgc

SEQ ID NO: 1765 - DNA, 44 bp, Artificial Sequence
  Synthetic
tccacatccttggtaaaggtagtcttctttgtctggtggatcct

SEQ ID NO: 1766 - DNA, 41 bp, Artificial Sequence
  Synthetic
aagctgttgttgcaattttttgccttggtgaatgccttgga

SEQ ID NO: 1767 - DNA, 46 bp, Artificial Sequence
  Synthetic
cctgttatctagtcctccaacaacttgtgacaactactttcaagtg

SEQ ID NO: 1768 - DNA, 41 bp, Artificial Sequence
  Synthetic
cctgacagcaactccctcatcatacattggagaagctgatg

SEQ ID NO: 1769 - DNA, 45 bp, Artificial Sequence
  Synthetic
tggttacagtggtatcagttccacaatccattccaaaaatcccag

SEQ ID NO: 1770 - DNA, 49 bp, Artificial Sequence
  Synthetic
agcttcagatcttgcattttcaattgaatgacagaatttctcatgatga

SEQ ID NO: 1771 - DNA, 48 bp, Artificial Sequence
  Synthetic
cagatcaatttttgtgtcaagagggtattttcaagttcaacgaaactg

SEQ ID NO: 1772 - DNA, 47 bp, Artificial Sequence
  Synthetic
gttgaatagcttagtgacacctcctatacaagaagctcaaaagagaa

SEQ ID NO: 1773 - DNA, 40 bp, Artificial Sequence
  Synthetic
tagcaacctccatggcctccgtagcactacggcaaaggct

SEQ ID NO: 1774 - DNA, 44 bp, Artificial Sequence
  Synthetic
ggaacactttcactgcctgtattgccatagaaaaacacgtaacc

SEQ ID NO: 1775 - DNA, 40 bp, Artificial Sequence
  Synthetic
tcaatgggctggacaaggtcggaaacaggctactatacca

SEQ ID NO: 1776 - DNA, 46 bp, Artificial Sequence
  Synthetic
ccatctacatcactacaatcagcttgcaaaaatggcagataaaggt

SEQ ID NO: 1777 - DNA, 47 bp, Artificial Sequence
  Synthetic
tgcgttgaggcgaaatagtaatagaagtattttagtcctaaagctgt

SEQ ID NO: 1778 - DNA, 38 bp, Artificial Sequence
  Synthetic
caaagctgctactacgctgcaaatgttggggatgcaca

SEQ ID NO: 1779 - DNA, 42 bp, Artificial Sequence
  Synthetic
cattgaaacggtcgctgagagggcaattagatctaagtgacc

SEQ ID NO: 1780 - DNA, 48 bp, Artificial Sequence
  Synthetic
gtgcgtcttgagcaaatctgatattatcatggtgcctattttatggat

SEQ ID NO: 1781 - DNA, 40 bp, Artificial Sequence
  Synthetic
tttggatccccctggaggcgtctaaaggaaggtacgggcg

SEQ ID NO: 1782 - DNA, 36 bp, Artificial Sequence
  Synthetic
tcccccgttcccttccgtcgggagcaggagaaggag

SEQ ID NO: 1783 - DNA, 49 bp, Artificial Sequence
  Synthetic
gaccatgtagtactgaagcaatcataatactcttaagtgttatcgctac

SEQ ID NO: 1784 - DNA, 38 bp, Artificial Sequence
  Synthetic
ggcaccaaagcaggcctaatggtgaagggacgagtgta

SEQ ID NO: 1785 - DNA, 45 bp, Artificial Sequence
  Synthetic
ccaagtctgctaacccttatatagcacaaaaacttggtaggccta

SEQ ID NO: 1786 - DNA, 50 bp, Artificial Sequence
  Synthetic
tcgtttcttccattttaagctaggagataataccccaacagtaataattc

SEQ ID NO: 1787 - DNA, 44 bp, Artificial Sequence
  Synthetic
tccctgacaccttaggcactaagttggacacccttattttgaag

SEQ ID NO: 1788 - DNA, 46 bp, Artificial Sequence
  Synthetic
agcatggtgtacatcctaaaacaaacaatactggaacaaaggatga

SEQ ID NO: 1789 - DNA, 48 bp, Artificial Sequence
  Synthetic
ccatagaaaaaacatgagttgccatttggatatagtagactccacatg

SEQ ID NO: 1790 - DNA, 49 bp, Artificial Sequence
  Synthetic
ggccgattaaataattgtgcatcagaaattgccagttctatctatttcc

SEQ ID NO: 1791 - DNA, 49 bp, Artificial Sequence
  Synthetic
caccactatgaaaaatctacgcccaaactttataaaaacatccactccc

SEQ ID NO: 1792 - DNA, 42 bp, Artificial Sequence
  Synthetic
gctagactgcacacaacactcaaaatcatgtgatggtggatt

SEQ ID NO: 1793 - DNA, 38 bp, Artificial Sequence
  Synthetic
atttccgggattgcacaggcgtgtctgtcttggtgcag

SEQ ID NO: 1794 - DNA, 44 bp, Artificial Sequence
  Synthetic
tgcaatctcataacataacgtggattcctacttggagtcaggaa

SEQ ID NO: 1795 - DNA, 45 bp, Artificial Sequence
  Synthetic
aatccaacctttaaaatcacacgagggttttgttatgcagtttgg

SEQ ID NO: 1796 - DNA, 45 bp, Artificial Sequence
  Synthetic
gccacacttgtgttgaacataatcagttttaggttgcaaggctat

SEQ ID NO: 1797 - DNA, 44 bp, Artificial Sequence
  Synthetic
ccaatcttaaaacaagaaaggccatgcacaagcatttcagagtg

SEQ ID NO: 1798 - DNA, 45 bp, Artificial Sequence
  Synthetic
ccagccttggccatataaacattaattctgaaccacctaaagttg

SEQ ID NO: 1799 - DNA, 48 bp, Artificial Sequence
  Synthetic
agtttcctcaccttctacatcatcttcctgaagatgatgactttcttg

SEQ ID NO: 1800 - DNA, 48 bp, Artificial Sequence
  Synthetic
ccaaggtatcaacaaacaactgactataaaaatttgcaggatctttgg

SEQ ID NO: 1801 - DNA, 44 bp, Artificial Sequence
  Synthetic
gccccctgtagagacataacaccgatatggttaagtctaaagga

SEQ ID NO: 1802 - DNA, 43 bp, Artificial Sequence
  Synthetic
tctgtttcgtaaacaatggaacgtcgggcactaagaaattggc

SEQ ID NO: 1803 - DNA, 48 bp, Artificial Sequence
  Synthetic
aacaggcacaaacctattagtgaaaaagccttgtttttggataaagtg

SEQ ID NO: 1804 - DNA, 44 bp, Artificial Sequence
  Synthetic
tctggagcattaagcaagaaacattgcaggttgttgttaatggt

SEQ ID NO: 1805 - DNA, 44 bp, Artificial Sequence
  Synthetic
tgtaccaaaatgcataacagcgtatgtaaatgtggtgtaaagca

SEQ ID NO: 1806 - DNA, 48 bp, Artificial Sequence
  Synthetic
acaccatctactttctcgaatgtttaatattattgtgacggaggtaag

SEQ ID NO: 1807 - DNA, 48 bp, Artificial Sequence
  Synthetic
ccatcgtcaacatcatccacttttataatagaccttcattggttgatg

SEQ ID NO: 1808 - DNA, 46 bp, Artificial Sequence
  Synthetic
ccagcaacctaaaactccaatgtaatgcccttatcagtattcagat

SEQ ID NO: 1809 - DNA, 47 bp, Artificial Sequence
  Synthetic
gcggcctcaacagtaataaaagtatactggcttttgttcaaaacatc

SEQ ID NO: 1810 - DNA, 44 bp, Artificial Sequence
  Synthetic
actgattaaaagcatccacagaccagcatgtgcagggtaatgtt

SEQ ID NO: 1811 - DNA, 48 bp, Artificial Sequence
  Synthetic
accatatcgtaacactttggtaggggctgtaatagatcaggattttgg

SEQ ID NO: 1812 - DNA, 41 bp, Artificial Sequence
  Synthetic
acgcacgatacgtacaagccatgctaaaggttttatccgtt

SEQ ID NO: 1813 - DNA, 43 bp, Artificial Sequence
  Synthetic
acaacaattacagcgagtatagcacgcctgtggattttttggc

SEQ ID NO: 1814 - DNA, 43 bp, Artificial Sequence
  Synthetic
gttggtaaagcacatcactaccatttgcatatagggaggctgc

SEQ ID NO: 1815 - DNA, 45 bp, Artificial Sequence
  Synthetic
cgcataaaaaggaacccttaatggttttagctgcttataacggca

SEQ ID NO: 1816 - DNA, 50 bp, Artificial Sequence
  Synthetic
acaaggtcagatttaacttggctaagtgttctgtagaagattttaatgtg

SEQ ID NO: 1817 - DNA, 46 bp, Artificial Sequence
  Synthetic
acagtgtaaaaagcacaggagttatttgtgttataagtttggccat

SEQ ID NO: 1818 - DNA, 47 bp, Artificial Sequence
  Synthetic
ccatgtgtaagtaccaaaaagggaaaagggttctaacttagaggaag

SEQ ID NO: 1819 - DNA, 43 bp, Artificial Sequence
  Synthetic
acctccaatacccaacagctccctcctaagaatagttttgaag

SEQ ID NO: 1820 - DNA, 44 bp, Artificial Sequence
  Synthetic
tcaacgaagctagccatattaacaacgatgattacgcaaaggac

SEQ ID NO: 1821 - DNA, 44 bp, Artificial Sequence
  Synthetic
acccgcataggtaacatagacattatggcagcaaatactctgaa

SEQ ID NO: 1822 - DNA, 48 bp, Artificial Sequence
  Synthetic
cagcttgcaatctaactgtagaagattttgtaaaaggttgtaacacac

SEQ ID NO: 1823 - DNA, 45 bp, Artificial Sequence
  Synthetic
cgtaatttgcacaacccatcaacatctgtttgtatatattgccgc

SEQ ID NO: 1824 - DNA, 48 bp, Artificial Sequence
  Synthetic
gctgaaaacggcaacaattaactttaagggcatttgatatttacaatg

SEQ ID NO: 1825 - DNA, 43 bp, Artificial Sequence
  Synthetic
agtgttaaaacgcctactaagcctaccctagttagcgctactg

SEQ ID NO: 1826 - DNA, 47 bp, Artificial Sequence
  Synthetic
cagcagcatataaaagcaagtctttattgtgatgaatatggatgtgg

SEQ ID NO: 1827 - DNA, 50 bp, Artificial Sequence
  Synthetic
aatggatagccagcactcttatcatagtattttgagatttatgatggtgg

SEQ ID NO: 1828 - DNA, 48 bp, Artificial Sequence
  Synthetic
ccaccataaaatttagtggtgcctaaaatgtttgaaaagtatagcagc

SEQ ID NO: 1829 - DNA, 45 bp, Artificial Sequence
  Synthetic
gcttctgaagagcacgtatactaaggccaatgtatgtgccttaat

SEQ ID NO: 1830 - DNA, 43 bp, Artificial Sequence
  Synthetic
caagcattgtgtgttgtgaacagttgggttgaacatgacataa

SEQ ID NO: 1831 - DNA, 45 bp, Artificial Sequence
  Synthetic
aaggactcatcagtgaacttttgtatcttggatagctacagtgtt

SEQ ID NO: 1832 - DNA, 50 bp, Artificial Sequence
  Synthetic
cgctctgtacattcattagctagtataatcgtatagctagttgtaaatgg

SEQ ID NO: 1833 - DNA, 47 bp, Artificial Sequence
  Synthetic
acgtctcaagcacactataaacactagctaatttaagtgctcctacg

SEQ ID NO: 1834 - DNA, 43 bp, Artificial Sequence
  Synthetic
acacatacttacgagtggtgtcatttattgttccggccaaggt

SEQ ID NO: 1835 - DNA, 49 bp, Artificial Sequence
  Synthetic
gcttagctgcaaagttctgactatttaataagtttttgaaggctaaccc

SEQ ID NO: 1836 - DNA, 46 bp, Artificial Sequence
  Synthetic
ccgctataactcttgctacaatcttccttagataaagtgccacagg

SEQ ID NO: 1837 - DNA, 43 bp, Artificial Sequence
  Synthetic
cacaacaaaatcaattcctgtggaagcgtgatagcattgggac

SEQ ID NO: 1838 - DNA, 40 bp, Artificial Sequence
  Synthetic
tcacgccctacttttgcaaagtagttacatgggcagccaa

SEQ ID NO: 1839 - DNA, 47 bp, Artificial Sequence
  Synthetic
tggttgggcatcatagaacttaaaactttgtgttatgatattggcaa

SEQ ID NO: 1840 - DNA, 43 bp, Artificial Sequence
  Synthetic
atccatatacacacaaggcgtatctggcagcctttgagcattt

SEQ ID NO: 1841 - DNA, 47 bp, Artificial Sequence
  Synthetic
tcgatcttagccacaactttatcattcaagactggtcattatacagg

SEQ ID NO: 1842 - DNA, 45 bp, Artificial Sequence
  Synthetic
tcgtggaaatgtaaacgccattaaattgaatgtcctttttgatgg

SEQ ID NO: 1843 - DNA, 48 bp, Artificial Sequence
  Synthetic
ccaccaataatcttctggttgaagttattcagaagtatggtttggagg

SEQ ID NO: 1844 - DNA, 43 bp, Artificial Sequence
  Synthetic
ggcttccagtcagatgcagcgtaacgatgagaaagttatgact

SEQ ID NO: 1845 - DNA, 50 bp, Artificial Sequence
  Synthetic
tctgcattccaagaaaactctgttaacatacatttgtcatatgattcgag

SEQ ID NO: 1846 - DNA, 43 bp, Artificial Sequence
  Synthetic
tgtgtggcgctgtttgtattaggtttacaatttcaaattctcg

SEQ ID NO: 1847 - DNA, 41 bp, Artificial Sequence
  Synthetic
tgatgaggggttgatggtgatttgatgcagcactgtccatt

SEQ ID NO: 1848 - DNA, 44 bp, Artificial Sequence
  Synthetic
aaggcgtaaaattaacaccctcataggagttttcactttaccga

SEQ ID NO: 1849 - DNA, 46 bp, Artificial Sequence
  Synthetic
acagattgctttcgtaggaacagttccctctggtaattatttagcc

SEQ ID NO: 1850 - DNA, 48 bp, Artificial Sequence
  Synthetic
tgattgtacgtggttgtactaccagtgagttccctgctataactatag

SEQ ID NO: 1851 - DNA, 49 bp, Artificial Sequence
  Synthetic
gcttactattacaagtcagaggcatgtttaatgtttatttaggcatggc

SEQ ID NO: 1852 - DNA, 45 bp, Artificial Sequence
  Synthetic
tcccaatttaatggagagggcaccgtaaacctaatcttcccaatt

SEQ ID NO: 1853 - DNA, 46 bp, Artificial Sequence
  Synthetic
tcgaggcttaaaaacagaatcttctctgctaatgtttctgttagca

SEQ ID NO: 1854 - DNA, 39 bp, Artificial Sequence
  Synthetic
caagacccgaacagtgctcaacttataagtgcccccaaa

SEQ ID NO: 1855 - DNA, 43 bp, Artificial Sequence
  Synthetic
agagttagcgtgaaaggccgcaaacagaacttttatgattcgt

SEQ ID NO: 1856 - DNA, 48 bp, Artificial Sequence
  Synthetic
gacaaatgcagcacaatcaatagtaccttcagagtttactataggtaa

SEQ ID NO: 1857 - DNA, 47 bp, Artificial Sequence
  Synthetic
actttgcacacaaatgaggtccgttgaggcttataataattgtacag

SEQ ID NO: 1858 - DNA, 50 bp, Artificial Sequence
  Synthetic
gcggtaagacgaccattaataagtccaagaaattctatctagacttgatg

SEQ ID NO: 1859 - DNA, 43 bp, Artificial Sequence
  Synthetic
ccactcttaggagctatacctctattatgtcacagcgagggtt

SEQ ID NO: 1860 - DNA, 46 bp, Artificial Sequence
  Synthetic
ccttgagattgatgtagctctgatttgttacattcttggacctaca

SEQ ID NO: 1861 - DNA, 47 bp, Artificial Sequence
  Synthetic
acaagcatcttctaattctgagacaagacctgagaagaaatatctcc

SEQ ID NO: 1862 - DNA, 47 bp, Artificial Sequence
  Synthetic
ggcctaacatacattgttcctttcaattagaactggaagtttttgga

SEQ ID NO: 1863 - DNA, 43 bp, Artificial Sequence
  Synthetic
gcttaccaggagtaaaagacatcctccaaaagggttctggcat

SEQ ID NO: 1864 - DNA, 40 bp, Artificial Sequence
  Synthetic
agcgacccagtagactccgtcgaacaggaccgcatgctaa

SEQ ID NO: 1865 - DNA, 39 bp, Artificial Sequence
  Synthetic
cagccatgtcaggtgttacaccgcgtagtagagccaatt

SEQ ID NO: 1866 - DNA, 41 bp, Artificial Sequence
  Synthetic
aacctaattgcgccgttatagctatctgggaatcctgacga

SEQ ID NO: 1867 - DNA, 41 bp, Artificial Sequence
  Synthetic
ggttaccaccagatgccgacatactgaagacacctcagaaa

SEQ ID NO: 1868 - DNA, 43 bp, Artificial Sequence
  Synthetic
actttctgcttgggcattagcaaactgacatgactattgagga

SEQ ID NO: 1869 - DNA, 45 bp, Artificial Sequence
  Synthetic
tccattcaagtcctccgatgagttttccaggacatactattgagg

SEQ ID NO: 1870 - DNA, 42 bp, Artificial Sequence
  Synthetic
ggtcaaggaatggggcatcaccctgctttctttggcatgtcc

SEQ ID NO: 1871 - DNA, 43 bp, Artificial Sequence
  Synthetic
gcttgggaatgagcattaaccagctacctaactgaaatgactc

SEQ ID NO: 1872 - DNA, 41 bp, Artificial Sequence
  Synthetic
tccattcaagtcctccgatgagcttccaggacatactgacg

SEQ ID NO: 1873 - DNA, 42 bp, Artificial Sequence
  Synthetic
tggaggctgcacgacactcgtagatcactcccctgtgaggaa

SEQ ID NO: 1874 - DNA, 40 bp, Artificial Sequence
  Synthetic
ccaacgatctgtccgccaccaaagaaacaccatccgtcgc

SEQ ID NO: 1875 - DNA, 39 bp, Artificial Sequence
  Synthetic
ccccatgaggtcggcgaatccggaggtcccgcaatttgg

SEQ ID NO: 1876 - DNA, 40 bp, Artificial Sequence
  Synthetic
tggggtccagcacgtagatgtacattctgcacacacccgg

SEQ ID NO: 1877 - DNA, 39 bp, Artificial Sequence
  Synthetic
ccaccaccatacccacagcgggacatcgaatggcttggg

SEQ ID NO: 1878 - DNA, 40 bp, Artificial Sequence
  Synthetic
ggtctgtcatcagaaggaccggagctgcaagcccatcact

SEQ ID NO: 1879 - DNA, 37 bp, Artificial Sequence
  Synthetic
gccgctgggacttcagcagggcgtgccaacctacacc

SEQ ID NO: 1880 - DNA, 41 bp, Artificial Sequence
  Synthetic
cgatcctcgatatcgcagcgctgaacatcgatttaccgccg

SEQ ID NO: 1881 - DNA, 40 bp, Artificial Sequence
  Synthetic
cagcgtgaccaggttctccaaccctttggctgatgctgat

SEQ ID NO: 1882 - DNA, 42 bp, Artificial Sequence
  Synthetic
gtggccactgctaggtctttgaacctatacgaccacctagcg

SEQ ID NO: 1883 - DNA, 40 bp, Artificial Sequence
  Synthetic
aggaaggtctgggtagccgtgagacaagaacgtggtgacc

SEQ ID NO: 1884 - DNA, 41 bp, Artificial Sequence
  Synthetic
gaagggcacataacgggacctcgctcagtcctaggcctctc

SEQ ID NO: 1885 - DNA, 39 bp, Artificial Sequence
  Synthetic
gtgcggatgttggggtcgatccacattaggcttcggctc

SEQ ID NO: 1886 - DNA, 40 bp, Artificial Sequence
  Synthetic
tctacctcgacccgttcggcaccttttccattgagacccg

SEQ ID NO: 1887 - DNA, 39 bp, Artificial Sequence
  Synthetic
gcgcacacagtggcttggtaagactaagcagcagggact

SEQ ID NO: 1888 - DNA, 39 bp, Artificial Sequence
  Synthetic
gtctggaacgagtgctggctttcggctgcgttgtgattg

SEQ ID NO: 1889 - DNA, 39 bp, Artificial Sequence
  Synthetic
tttggttggtcgtcaggggactttgcctggcaaccctgc

SEQ ID NO: 1890 - DNA, 38 bp, Artificial Sequence
  Synthetic
tgtcggcgcagtatggctggcccgccatactatctccg

SEQ ID NO: 1891 - DNA, 39 bp, Artificial Sequence
  Synthetic
ggaaatgaagggcagcccaggccgacttcaaggcatggc

SEQ ID NO: 1892 - DNA, 39 bp, Artificial Sequence
  Synthetic
cttggcacggacacttgagctgggtgggggacttccatt

SEQ ID NO: 1893 - DNA, 40 bp, Artificial Sequence
  Synthetic
gatgaggcctatgcgtctggcatccgccagccaactatca

SEQ ID NO: 1894 - DNA, 41 bp, Artificial Sequence
  Synthetic
gtccttttcctccgagggggatgtaccaccaactgtccatg

SEQ ID NO: 1895 - DNA, 41 bp, Artificial Sequence
  Synthetic
cgccggtccaagaatacgacataccgttagtgacagcgagg

SEQ ID NO: 1896 - DNA, 39 bp, Artificial Sequence
  Synthetic
ccctgctggacaaggagcgaatcactctgcccgatcgaa

SEQ ID NO: 1897 - DNA, 42 bp, Artificial Sequence
  Synthetic
gcctccggttcaaggttacagccactgaacaggacatcaggg

SEQ ID NO: 1898 - DNA, 40 bp, Artificial Sequence
  Synthetic
tcagccaccacgaccaaatcatcaaaggccgcaaacctcc

SEQ ID NO: 1899 - DNA, 48 bp, Artificial Sequence
  Synthetic
ccacggtggtttttgtgagtatcaaagaactaagaaatctaatgtcgc

SEQ ID NO: 1900 - DNA, 42 bp, Artificial Sequence
  Synthetic
gtcattggtccattcctattccacggatcagaccgagtgatg

SEQ ID NO: 1901 - DNA, 45 bp, Artificial Sequence
  Synthetic
ttggttatcgttagttgcgattccaagttgttttccctaacgaag

SEQ ID NO: 1902 - DNA, 43 bp, Artificial Sequence
  Synthetic
gtgggtctgctgatactgcagaatgatgatgttgatcaaagct

SEQ ID NO: 1903 - DNA, 43 bp, Artificial Sequence
  Synthetic
cctcatgcactcttatcttcaatgtacaagcggatcatcagtc

SEQ ID NO: 1904 - DNA, 47 bp, Artificial Sequence
  Synthetic
cgcatccttctgaaaatgtcttaaagatctgaatttcgtcaataggg

SEQ ID NO: 1905 - DNA, 39 bp, Artificial Sequence
  Synthetic
ttcactgacctcctcgggagattgaccggttcttgagag

SEQ ID NO: 1906 - DNA, 46 bp, Artificial Sequence
  Synthetic
cctcatttgttggaacagagttcttagtacctaaggccattagagg

SEQ ID NO: 1907 - DNA, 41 bp, Artificial Sequence
  Synthetic
tcccctcagaacagcggactcggcactttaaccgaagaccc

SEQ ID NO: 1908 - DNA, 41 bp, Artificial Sequence
  Synthetic
gccaacctctcaggacagcctatgaaagccttaacaccggc

SEQ ID NO: 1909 - DNA, 42 bp, Artificial Sequence; identical to SEQ ID NO: 94
  Synthetic

SEQ ID NO: 1910 - DNA, 36 bp, Artificial Sequence
  Synthetic
tgagctcggacctgtccctggcctgcaactggacgc

SEQ ID NO: 1911 - DNA, 42 bp, Artificial Sequence
  Synthetic
cgcaaagcagaagaacacgaggtactcaatgcagcatccctg

SEQ ID NO: 1912 - DNA, 41 bp, Artificial Sequence
  Synthetic
ggtccgaagatggccaggagttgtgttgtacacccgactct

SEQ ID NO: 1913 - DNA, 39 bp, Artificial Sequence
  Synthetic
cacgtgatgagcttggtctccactgcgagatctggccgt

SEQ ID NO: 1914 - DNA, 39 bp, Artificial Sequence
  Synthetic
gcgatggtcctcgttccggccaacgtgcatcaatggggt

SEQ ID NO: 1915 - DNA, 38 bp, Artificial Sequence
  Synthetic
acaccggggatctcatggttgtggtgtgcacccgtgga

SEQ ID NO: 1916 - DNA, 39 bp, Artificial Sequence
  Synthetic
taagcacctcctgagcacccggcagccccatcacgtact

SEQ ID NO: 1917 - DNA, 41 bp, Artificial Sequence
  Synthetic
agtaggccacggcattgatgctcaaagaagaagtgcgacga

SEQ ID NO: 1918 - DNA, 41 bp, Artificial Sequence
  Synthetic
acagaggacggacgagtcgaatctacagatttgtggcaccg

SEQ ID NO: 1919 - DNA, 38 bp, Artificial Sequence
  Synthetic
gggtgcgtcagggtgacttcggccaacacccctgctat

SEQ ID NO: 1920 - DNA, 41 bp, Artificial Sequence
  Synthetic
ggtgataacctctgcttggcggaagggatgatgctcgctga

SEQ ID NO: 1921 - DNA, 38 bp, Artificial Sequence
  Synthetic
ccctgcaagaatgtccacgaggtgggcgctggcttagc

SEQ ID NO: 1922 - DNA, 38 bp, Artificial Sequence
  Synthetic
tatggcagtgacgcgggcgggaaccatgtttcccccac

SEQ ID NO: 1923 - DNA, 42 bp, Artificial Sequence
  Synthetic
ctccacatgttcctgcaggtcctggacatgtcaaaaacggga

SEQ ID NO: 1924 - DNA, 37 bp, Artificial Sequence
  Synthetic
aggtaattgcgaccccaccggtgctgcgggaggaggt

SEQ ID NO: 1925 - DNA, 39 bp, Artificial Sequence
  Synthetic
cgaatctccgagacttccgcagtcgatccgcttgtggca

SEQ ID NO: 1926 - DNA, 37 bp, Artificial Sequence
  Synthetic
gactcaacgtcggagtcgggggcattacgggcgacaa

SEQ ID NO: 1927 - DNA, 42 bp, Artificial Sequence
  Synthetic
gctgcaagcttcctctacggatattaccaggacgtgctcaag

SEQ ID NO: 1928 - DNA, 38 bp, Artificial Sequence
  Synthetic
ggccatcttctcgcacacgccctgagaaggggggtcgt

SEQ ID NO: 1929 - DNA, 38 bp, Artificial Sequence
  Synthetic
ttgtcagtacgccgctcgcttatgttgggggccctctt

SEQ ID NO: 1930 - DNA, 38 bp, Artificial Sequence
  Synthetic
gtcttgctgtctcccacgcggcgctggaaagagggtct

SEQ ID NO: 1931 - DNA, 40 bp, Artificial Sequence
  Synthetic
tgtctccaagctcgcaagggtgaaatcaatagggtggccg

SEQ ID NO: 1932 - DNA, 44 bp, Artificial Sequence
  Synthetic
tgcacccatggacatagcttcgaatggggtacatataaaacaag

SEQ ID NO: 1933 - DNA, 49 bp, Artificial Sequence
  Synthetic
tgtagcatctgatcagctgtgtattattcatattatgtagaaggtgtgg

SEQ ID NO: 1934 - DNA, 41 bp, Artificial Sequence
  Synthetic
tggttccaccgcatctgtatggatatccctgtatgcaatgt

SEQ ID NO: 1935 - DNA, 40 bp, Artificial Sequence
  Synthetic
ccccagctttatggcgtctagcatttcagccccgtgtgtg

SEQ ID NO: 1936 - DNA, 45 bp, Artificial Sequence
  Synthetic
cattggcatggtagcacttgtatgcataaagaccctaatacaacc

SEQ ID NO: 1937 - DNA, 47 bp, Artificial Sequence
  Synthetic
gctcatacaaaagtatgatttgccaaggagtaccaaaaaaaagttgt

SEQ ID NO: 1938 - DNA, 44 bp, Artificial Sequence
  Synthetic
accttcgaaaaaagcatttccaatttgacaacacaaggagaacc

SEQ ID NO: 1939 - DNA, 45 bp, Artificial Sequence
  Synthetic
accctcgtatgagacttttcctgttatgtgcagaactatagtgac

SEQ ID NO: 1940 - DNA, 41 bp, Artificial Sequence
  Synthetic
tctttggacccttgtcgctgctaaagcgacagcgactcgag

SEQ ID NO: 1941 - DNA, 43 bp, Artificial Sequence
  Synthetic
ccaaaacaaacacagcagcagtggatttttacttgtgtcgact

SEQ ID NO: 1942 - DNA, 41 bp, Artificial Sequence
  Synthetic
ggtggtgccctctactttgggaataggacctgcaaggcctc

SEQ ID NO: 1943 - DNA, 40 bp, Artificial Sequence
  Synthetic
gttgtggcagaggatgtaacttagggtccaccatacctac

SEQ ID NO: 1944 - DNA, 43 bp, Artificial Sequence
  Synthetic
ggttccatttcaatgtcctcgatcccgggtacattactatcag

SEQ ID NO: 1945 - DNA, 40 bp, Artificial Sequence
  Synthetic
tccgtgctgagaactttagacagcgctctagtgacaactt

SEQ ID NO: 1946 - DNA, 47 bp, Artificial Sequence
  Synthetic
aggcacgtcagacttatttaattgtctattcaggatggtgatatggt

SEQ ID NO: 1947 - DNA, 45 bp, Artificial Sequence
  Synthetic
gccataatatccggggtcaatgtaggaatatgatttgcagttcat

SEQ ID NO: 1948 - DNA, 46 bp, Artificial Sequence
  Synthetic
cacaggaacagcaattacacaaatttgttatgagcatgtatgtgtg

SEQ ID NO: 1949 - DNA, 38 bp, Artificial Sequence
  Synthetic
atcgtacacctgtcccacagctgaggaggaggagcaat

SEQ ID NO: 1950 - DNA, 45 bp, Artificial Sequence
  Synthetic
atccatatcgtctatcaggttggaccactctggaggatttgtttg

SEQ ID NO: 1951 - DNA, 46 bp, Artificial Sequence
  Synthetic
gtcccagtttgtataaggaaacacatttcaaaaaacatggctacac

SEQ ID NO: 1952 - DNA, 40 bp, Artificial Sequence
  Synthetic
ggggtagaggggtatgcggttctagttctaccaggcagcc

SEQ ID NO: 1953 - DNA, 40 bp, Artificial Sequence
  Synthetic
gttcccactgcttcaggagctgacgaaccaccgagacaga

SEQ ID NO: 1954 - DNA, 43 bp, Artificial Sequence
  Synthetic
ctaacgatgaataacctgtagtcccatttgggcaacttgggta

SEQ ID NO: 1955 - DNA, 44 bp, Artificial Sequence
  Synthetic
tcctggatcagcagtgataactatgagctcttcaattgttcctt

SEQ ID NO: 1956 - DNA, 42 bp, Artificial Sequence
  Synthetic
tcatcatcaaaggcgggattttcattttgtaaggcaaccgtc

SEQ ID NO: 1957 - DNA, 46 bp, Artificial Sequence
  Synthetic
catcaggtactataggtctgtcagtacattggcctctaatattcct

SEQ ID NO: 1958 - DNA, 47 bp, Artificial Sequence
  Synthetic
cccttctacatattcatccgtactcaatcgtggaaagttatatctgc

SEQ ID NO: 1959 - DNA, 49 bp, Artificial Sequence
  Synthetic
gggatgacctgatgtactaatacctgttggtttggaaattgataggatt

SEQ ID NO: 1960 - DNA, 45 bp, Artificial Sequence
  Synthetic
acatgtcaccatcctgaatagtagtaaaggtttgcgaaaatgtcc

SEQ ID NO: 1961 - DNA, 44 bp, Artificial Sequence
  Synthetic
cctgctgagcaccataaataaagtttttacgcgaggcactttta

SEQ ID NO: 1962 - DNA, 38 bp, Artificial Sequence
  Synthetic
tggcgccaaaaacttaccgaatgctgccttttaagcca

SEQ ID NO: 1963 - DNA, 41 bp, Artificial Sequence
  Synthetic
ggtctaccgttgtctgtctcaactaaagcagctgttaaggg

SEQ ID NO: 1964 - DNA, 44 bp, Artificial Sequence
  Synthetic
ccttttcaaacccttcagtatcccttcaatagcagcagttacct

SEQ ID NO: 1965 - DNA, 48 bp, Artificial Sequence
  Synthetic
catcgttcccttcaatttttctcttaataccaagagaatctacttgga

SEQ ID NO: 1966 - DNA, 40 bp, Artificial Sequence
  Synthetic
agctctagtgggtttgatgcaatgattgtagcttgcagga

SEQ ID NO: 1967 - DNA, 42 bp, Artificial Sequence
  Synthetic
gctttttttcaatatccccctgcatatgggacggagaagagg

SEQ ID NO: 1968 - DNA, 43 bp, Artificial Sequence
  Synthetic
cattgatcaaaaaggtcattgctccgccaacttttatccccca

SEQ ID NO: 1969 - DNA, 45 bp, Artificial Sequence
  Synthetic
acgttatcattagctgtgcttgtgaagttataatgggagccaatg

SEQ ID NO: 1970 - DNA, 45 bp, Artificial Sequence
  Synthetic
ggtcagttttcataacctcttggtcggtcagtacagtggatttgc

SEQ ID NO: 1971 - DNA, 43 bp, Artificial Sequence
  Synthetic
ggttttgaaatctccaagatcagggatggggaatgcagtactg

SEQ ID NO: 1972 - DNA, 47 bp, Artificial Sequence
  Synthetic
gcatggataacagggaatcttgtttgtctatcagcttacgatctctt

SEQ ID NO: 1973 - DNA, 43 bp, Artificial Sequence
  Synthetic
agcgacaatctatcttcacatgattgttatgcccctctactgg

SEQ ID NO: 1974 - DNA, 49 bp, Artificial Sequence
  Synthetic
cacaatggacaagaaaaaccatccgataattgtgatttttatggttggg

SEQ ID NO: 1975 - DNA, 47 bp, Artificial Sequence
  Synthetic
caccaagaattattaacgccaagaattatgttcaatgtaagtgtggt

SEQ ID NO: 1976 - DNA, 45 bp, Artificial Sequence
  Synthetic
caccacacttacccatgtacatattgagtattgtcaaccacctaa

SEQ ID NO: 1977 - DNA, 46 bp, Artificial Sequence
  Synthetic
cagctttaacaagtctagcaacattacctcaattgtatggtttgtg

SEQ ID NO: 1978 - DNA, 48 bp, Artificial Sequence
  Synthetic
gcaacataagacaagctacattcaccggtccatttttttcttttgaac

SEQ ID NO: 1979 - DNA, 42 bp, Artificial Sequence
  Synthetic
acctgcacaattacagccaatttggtacattagcaaagactg

SEQ ID NO: 1980 - DNA, 48 bp, Artificial Sequence
  Synthetic
tgagcacaaatatcatgtccaactattaaaccatttgctaaagttgac

SEQ ID NO: 1981 - DNA, 48 bp, Artificial Sequence
  Synthetic
accagctttattacaaccatagacacggttttatatagttgttactgc

SEQ ID NO: 1982 - DNA, 45 bp, Artificial Sequence
  Synthetic
caacatctgaatcaatggaacaacagggtgtgcaattagaaaagg

SEQ ID NO: 1983 - DNA, 50 bp, Artificial Sequence
  Synthetic
agcattcttcataacaccatctgaactttgtgtactatgtttaaaagagg

SEQ ID NO: 1984 - DNA, 39 bp, Artificial Sequence
  Synthetic
acaagttgacagccctgcattaatgtctggtcggatgag

SEQ ID NO: 1985 - DNA, 47 bp, Artificial Sequence
  Synthetic
gcaataacattaacagtctggacgtttatggtccatatagagatgct

SEQ ID NO: 1986 - DNA, 45 bp, Artificial Sequence
  Synthetic
gttagtaagtgctaggtctgccattgtatgaacgtgataaagctg

SEQ ID NO: 1987 - DNA, 45 bp, Artificial Sequence
  Synthetic
gcaccaccataagaatcttggttaaatcatgctggtactggtatg

SEQ ID NO: 1988 - DNA, 46 bp, Artificial Sequence
  Synthetic
accattgaccatacaaatcttggtttactgtcatttttgcagacac

SEQ ID NO: 1989 - DNA, 46 bp, Artificial Sequence
  Synthetic
ggtgtgtgtcaacatctaagttcatccgtttgttgtttctattggt

SEQ ID NO: 1990 - DNA, 47 bp, Artificial Sequence
  Synthetic
gtgggcagaacattacgtttagtataagccagactttattatgaggc

SEQ ID NO: 1991 - DNA, 44 bp, Artificial Sequence
  Synthetic
cgggccaaaactaaactactaacaacctgttcttatgggttggg

SEQ ID NO: 1992 - DNA, 49 bp, Artificial Sequence
  Synthetic
gctctatcaaaagaacactgtcagttccagatccttctagaattttagg

SEQ ID NO: 1993 - DNA, 43 bp, Artificial Sequence
  Synthetic
tgccagaacataatcatcaacttctaatcttgcacgggttcac

SEQ ID NO: 1994 - DNA, 43 bp, Artificial Sequence
  Synthetic
acaccaatggaacactataaacactgtgcacctacacttgtcc

SEQ ID NO: 1995 - DNA, 41 bp, Artificial Sequence
  Synthetic
tgttccaatgttttcgcgagtagtgttagaggttgggttgg

SEQ ID NO: 1996 - DNA, 43 bp, Artificial Sequence
  Synthetic
aaacctttaggattgcctatgtcatggttattgcagcgtgtca

SEQ ID NO: 1997 - DNA, 50 bp, Artificial Sequence
  Synthetic
gcgcttcttaaaggaacgtaatcaaccttttttctattattcagatacgc

SEQ ID NO: 1998 - DNA, 50 bp, Artificial Sequence
  Synthetic
caactttatccacaatcacaccattagtaggttatcaatgattaaaggtc

SEQ ID NO: 1999 - DNA, 45 bp, Artificial Sequence
  Synthetic
cgcatattaacaggaacagctaatgacaggctgtatgatgaatgt

SEQ ID NO: 2000 - DNA, 41 bp, Artificial Sequence
  Synthetic
accaataggacaggaagcagaaaccttcttttgcttcaagt

SEQ ID NO: 2001 - DNA, 49 bp, Artificial Sequence
  Synthetic
cgaagaggaagaagaaggtgagttactgattattctgtttcttcttgtg

SEQ ID NO: 2002 - DNA, 50 bp, Artificial Sequence
  Synthetic
gcagttaaacgaccattaataagccttacaagaaattttatctcgtctcg

SEQ ID NO: 2003 - DNA, 47 bp, Artificial Sequence
  Synthetic
tgaccacgaataacagtagcagttaattgatatgaaaggcaagatgt

SEQ ID NO: 2004 - DNA, 40 bp, Artificial Sequence
  Synthetic
ggtcagcccaagaagttttctcggtcattatgctggaagt

SEQ ID NO: 2005 - DNA, 45 bp, Artificial Sequence
  Synthetic
gcttttggcgaggttttgttaaagtaaagattctaaacctcagca

SEQ ID NO: 2006 - DNA, 46 bp, Artificial Sequence
  Synthetic
agagtcaaactgttctggtaattgtcagaacactgattctgattcg

SEQ ID NO: 2007 - DNA, 44 bp, Artificial Sequence
  Synthetic
cctctccatactctttcattgctttagattttgtgcgacaatgc

SEQ ID NO: 2008 - DNA, 39 bp, Artificial Sequence
  Synthetic
cctctgttggccatttcttgtgaaagcagggctaggatt

SEQ ID NO: 2009 - DNA, 43 bp, Artificial Sequence
  Synthetic
gtttgattggtcttggtgttgtcatgtccaaagaagtgaatgc

SEQ ID NO: 2010 - DNA, 45 bp, Artificial Sequence
  Synthetic
tcatgtttttagtccttgggatctttggaagcaagtattgtcaga

SEQ ID NO: 2011 - DNA, 43 bp, Artificial Sequence
  Synthetic
ctcctcatgcttgcaatgtactgatagagctcgatgaaattgg

SEQ ID NO: 2012 - DNA, 41 bp, Artificial Sequence
  Synthetic
atgtggctcaagtctcgggtcacagatgtggtaaactttgt

SEQ ID NO: 2013 - DNA, 44 bp, Artificial Sequence
  Synthetic
ggccatgcttctgatttattctcaatcgagagcatgattgaagc

SEQ ID NO: 2014 - DNA, 41 bp, Artificial Sequence
  Synthetic
caccaaccattcttccaacagatgaaactggtggagaacgc

SEQ ID NO: 2015 - DNA, 42 bp, Artificial Sequence
  Synthetic
tctccagaagttccggtcattagggacaatggtaatggaact

SEQ ID NO: 2016 - DNA, 40 bp, Artificial Sequence
  Synthetic
tgagtgcagaccgtgccagaagcagaaatcctgggaatgc

SEQ ID NO: 2017 - DNA, 43 bp, Artificial Sequence
  Synthetic
gggatcactcttgttcctctaatgacatgccattctgcagcat

SEQ ID NO: 2018 - DNA, 43 bp, Artificial Sequence
  Synthetic
attccaaaggacgacgcgacgatacttattgctttgattgctc

SEQ ID NO: 2019 - DNA, 39 bp, Artificial Sequence
  Synthetic
tggatggggtgtccggggagtctcaaggtccgttccaga

SEQ ID NO: 2020 - DNA, 41 bp, Artificial Sequence
  Synthetic
gcctcttcttgaagtcgtctaaggggcaggaactagatcag

SEQ ID NO: 2021 - DNA, 45 bp, Artificial Sequence
  Synthetic
ctcgctttcttcttataggcatgttctttaccaaaaggcacatca

SEQ ID NO: 2022 - DNA, 43 bp, Artificial Sequence
  Synthetic
ttaccaaaaggacgcccagtctggtggttcattaggatatagg

SEQ ID NO: 2023 - DNA, 42 bp, Artificial Sequence
  Synthetic
catccaatacagcagaaacacccggtgattcaatagggggga

SEQ ID NO: 2024 - DNA, 44 bp, Artificial Sequence
  Synthetic
gtctccaatctttgtgtaggagtacggactcaggatttggtcag

SEQ ID NO: 2025 - DNA, 43 bp, Artificial Sequence
  Synthetic
ctggagcatactcagttaaccgccaatgaagattttgctgaca

SEQ ID NO: 2026 - DNA, 41 bp, Artificial Sequence
  Synthetic
gctggtgcacatcctacaataaacagaacagcggatggatt

SEQ ID NO: 2027 - DNA, 45 bp, Artificial Sequence
  Synthetic
tgtcatccgtaaataatctggccatgcaggaagacagatctagtg

SEQ ID NO: 2028 - DNA, 46 bp, Artificial Sequence
  Synthetic
aaaagctaattgccattgatcaagtatgtaaggtaaagcttgaacc

SEQ ID NO: 2029 - DNA, 48 bp, Artificial Sequence
  Synthetic
ccatttagcaggcctatctgatacaaacggttttcttcagatttaagc

SEQ ID NO: 2030 - DNA, 49 bp, Artificial Sequence
  Synthetic
caccaactgttactgaagaactgatgtcataatacactataaaaggctg

SEQ ID NO: 2031 - DNA, 47 bp, Artificial Sequence
  Synthetic
gaaacaaacttccaaatgtgtgcataaaggcaatgaaagaatatggg

SEQ ID NO: 2032 - DNA, 48 bp, Artificial Sequence
  Synthetic
accggttctctttgtaatcatacaatggtgaacagtatatgtaacaca

SEQ ID NO: 2033 - DNA, 46 bp, Artificial Sequence
  Synthetic
tcggactgacgaaaggaatcccttttcactataagacaagaaatgg

SEQ ID NO: 2034 - DNA, 41 bp, Artificial Sequence
  Synthetic
gccatattttcaccgagtgccagatcccaaggacaaagaac

SEQ ID NO: 2035 - DNA, 48 bp, Artificial Sequence
  Synthetic
gctgtaaaatagttcctcctcatgctgatgaaataggagaagatgttg

SEQ ID NO: 2036 - DNA, 43 bp, Artificial Sequence
  Synthetic
tcccatttgtgtggctccagtgaactttgtaagtatggagttc

SEQ ID NO: 2037 - DNA, 44 bp, Artificial Sequence
  Synthetic
gccatgtttccgatttgttttcaaattgagagcatgattgaggc

SEQ ID NO: 2038 - DNA, 44 bp, Artificial Sequence
  Synthetic
acatgtctctcatactgagtagcttcgataacctcgtttcaggt

SEQ ID NO: 2039 - DNA, 42 bp, Artificial Sequence
  Synthetic
cctaggcatcagcatgtaccaggtatatcaccgatatgagca

SEQ ID NO: 2040 - DNA, 47 bp, Artificial Sequence
  Synthetic
cgctcgaattgagttatcattccatttacagaggatgtcaaaaatgc

SEQ ID NO: 2041 - DNA, 49 bp, Artificial Sequence
  Synthetic
cactcttctctttctctggaaatgtgtaatggaatcaatggataaggaa

SEQ ID NO: 2042 - DNA, 42 bp, Artificial Sequence
  Synthetic
gtccagattgctcaagtttttcacaggattcgtgcactttgt

SEQ ID NO: 2043 - DNA, 45 bp, Artificial Sequence
  Synthetic
gcccatcccaccagtatgtgttaggagtctcaatcttaaatcttg

SEQ ID NO: 2044 - DNA, 43 bp, Artificial Sequence
  Synthetic
tcatgtcagccgattcattaattcctagccaacttcagcatgg

SEQ ID NO: 2045 - DNA, 44 bp, Artificial Sequence
  Synthetic
tggtacatttgttcatcctcaagaaattcccaagagaaatcgct

SEQ ID NO: 2046 - DNA, 47 bp, Artificial Sequence
  Synthetic
attgccaaattcagccatcctatgaaatcggtgcatatatataaccc

SEQ ID NO: 2047 - DNA, 43 bp, Artificial Sequence
  Synthetic
acacaatgtcatgtacagtaggtttccgcagagaaacacaagt

SEQ ID NO: 2048 - DNA, 47 bp, Artificial Sequence
  Synthetic
cctgtgcatgtaatagcgcttgctagtaatacaaattatatgcaggc

SEQ ID NO: 2049 - DNA, 45 bp, Artificial Sequence
  Synthetic
ctcaggtgtgtctcctgttactgcactatattggtataggacagg

SEQ ID NO: 2050 - DNA, 47 bp, Artificial Sequence
  Synthetic
acactggattgccattgctatcgtagggtaacagtatttacatttcc

SEQ ID NO: 2051 - DNA, 50 bp, Artificial Sequence
  Synthetic
aatttgaaatgttggtaccacgtgggtctggaaaatgcaatatattatgc

SEQ ID NO: 2052 - DNA, 46 bp, Artificial Sequence
  Synthetic
agcaattgcagtagcggatactacaatgttctgaatctatgtacag

SEQ ID NO: 2053 - DNA, 44 bp, Artificial Sequence
  Synthetic
ccacagattcaattacaacaggtgggtggcagacctaatactgt

SEQ ID NO: 2054 - DNA, 43 bp, Artificial Sequence
  Synthetic
tcccagatgtaggggtagtaataaatgcatttaccgacccttc

SEQ ID NO: 2055 - DNA, 50 bp, Artificial Sequence
  Synthetic
ggcctatgtaaacgaacaatatccaatagacactacattaaccttttcac

SEQ ID NO: 2056 - DNA, 42 bp, Artificial Sequence
  Synthetic
tcaggtaatgtaacccgaaacactcgcaagcaagacattcct

SEQ ID NO: 2057 - DNA, 44 bp, Artificial Sequence
  Synthetic
gggtttgtttataatccactgacaccccatgttgctacttctgt

SEQ ID NO: 2058 - DNA, 41 bp, Artificial Sequence
  Synthetic
ctgtccccatatgcatctgcaggttcccttagacatttgtc

SEQ ID NO: 2059 - DNA, 44 bp, Artificial Sequence
  Synthetic
tcttgtgactaaaacatccgagctggcacatatatgggaaagac

SEQ ID NO: 2060 - DNA, 44 bp, Artificial Sequence
  Synthetic
tgcattgttgtttggtcctgatatgtggtcaagtactagttgcc

SEQ ID NO: 2061 - DNA, 40 bp, Artificial Sequence
  Synthetic
ccaattgtccctgcatgtgcactggaactgctaagcatat

SEQ ID NO: 2062 - DNA, 44 bp, Artificial Sequence
  Synthetic
gctgtgcttattgtcctccctaggagtcaagggattctcatacc

SEQ ID NO: 2063 - DNA, 40 bp, Artificial Sequence
  Synthetic
gccatatggtccacagtggtcagatctaatgtcgcagtcc

SEQ ID NO: 2064 - DNA, 43 bp, Artificial Sequence
  Synthetic
agggtaatgaactgtacttgttgttgtatcacctctggccgta

SEQ ID NO: 2065 - DNA, 45 bp, Artificial Sequence
  Synthetic
gtacgccaccatcaagggagataacaaaagagaagaaagaagagc

SEQ ID NO: 2066 - DNA, 42 bp, Artificial Sequence
  Synthetic
tgctaatgggtctgctgacacagtttgattatcgctgctaga

SEQ ID NO: 2067 - DNA, 45 bp, Artificial Sequence
  Synthetic
tcccaaccattgtgaattcttcataagaagaagaagtgctaacgg

SEQ ID NO: 2068 - DNA, 45 bp, Artificial Sequence
  Synthetic
cccacatcattgatgacgaataagtgaacgtactattgtctcccg

SEQ ID NO: 2069 - DNA, 40 bp, Artificial Sequence
  Synthetic
gcagcaaaggggagaagttttaggacactgttccagcaaa

SEQ ID NO: 2070 - DNA, 43 bp, Artificial Sequence
  Synthetic
gtcttctttgcccaaaatgagaaatgatgaaggcacatctggg

SEQ ID NO: 2071 - DNA, 43 bp, Artificial Sequence
  Synthetic
tcttggtttggattccatcagaattatttgtgaccgggagaga

SEQ ID NO: 2072 - DNA, 47 bp, Artificial Sequence
  Synthetic
agcgtgtcaactctaaataattgctttaagcaatgaatctctgtcac

SEQ ID NO: 2073 - DNA, 43 bp, Artificial Sequence
  Synthetic
gacactctttgtggagaaatgtgaaggatcgctcatttgcaga

SEQ ID NO: 2074 - DNA, 41 bp, Artificial Sequence
  Synthetic
acttcttcaggagatgggacacacaacaaggagaacgttcc

SEQ ID NO: 2075 - DNA, 43 bp, Artificial Sequence
  Synthetic
cagcttcacctaatggtctgtaactttgggaattggatctggg

SEQ ID NO: 2076 - DNA, 48 bp, Artificial Sequence
  Synthetic
ggtagcagtagagtcagtgattgtatttagattttgtagctcctgatg

SEQ ID NO: 2077 - DNA, 39 bp, Artificial Sequence
  Synthetic
gctacttctgccaagtcccgaatttgaaaatgccgccta

SEQ ID NO: 2078 - DNA, 46 bp, Artificial Sequence
  Synthetic
cgttgtagctagtatgtcgtcaactagaattgcagactatagctgg

SEQ ID NO: 2079 - DNA, 48 bp, Artificial Sequence
  Synthetic
ctttgttaaagtaaggatggcctgttatcaggtgtagaaattaaacgt

SEQ ID NO: 2080 - DNA, 47 bp, Artificial Sequence
  Synthetic
ctgctttatcttcttgtaaacggcttaatagccctattcaggatggt

SEQ ID NO: 2081 - DNA, 46 bp, Artificial Sequence
  Synthetic
ggtgttaagaatgcacccccattcattaacctgctatgtatttgtc

SEQ ID NO: 2082 - DNA, 41 bp, Artificial Sequence
  Synthetic
gtttctaatgccctcctccgtggtggtgacagattgcaagt

SEQ ID NO: 2083 - DNA, 43 bp, Artificial Sequence
  Synthetic
gcattttcatccccattagtcaatgaggtggaaaaggtagcgt

SEQ ID NO: 2084 - DNA, 50 bp, Artificial Sequence
  Synthetic
cgcggaggatctgttattatttgatatgtagagatactgtacaaaaactg

SEQ ID NO: 2085 - DNA, 47 bp, Artificial Sequence
  Synthetic
aaagcacttctcatatacacatccaccactaacagatgctaaattgg

SEQ ID NO: 2086 - DNA, 41 bp, Artificial Sequence
  Synthetic
gtttgtatgccctgccttctgccaaatacaacactgggatc

SEQ ID NO: 2087 - DNA, 50 bp, Artificial Sequence
  Synthetic
atgtctataaagtacaggccatccgatatattatcaagatgcagatgagc

SEQ ID NO: 2088 - DNA, 46 bp, Artificial Sequence
  Synthetic
gctgtgctaatacactgaaataagccattgaaatgttggaggtaca

SEQ ID NO: 2089 - DNA, 40 bp, Artificial Sequence
  Synthetic
tgggaacatagccagaggcccactttgggggtctgggtat

SEQ ID NO: 2090 - DNA, 42 bp, Artificial Sequence
  Synthetic
aggatgcccatatacagagatgtaaaagggtctctgtaggca

SEQ ID NO: 2091 - DNA, 44 bp, Artificial Sequence
  Synthetic
aggccacttcttgtacgaatagtctgaaggccacattagactaa

SEQ ID NO: 2092 - DNA, 48 bp, Artificial Sequence
  Synthetic
agccacaaagacatctgcaaaatactacattttatttacatcctggac

SEQ ID NO: 2093 - DNA, 45 bp, Artificial Sequence
  Synthetic
caaacaaggagtacagcctactacgacaaagtgtctctatggacc

SEQ ID NO: 2094 - DNA, 45 bp, Artificial Sequence
  Synthetic
gccagcgtctgacttaacatttattacattggttgataacacaca

SEQ ID NO: 2095 - DNA, 45 bp, Artificial Sequence
  Synthetic
ccagtttgagataaaaatctgcgactacagaacgtttgtcctctg

SEQ ID NO: 2096 - DNA, 45 bp, Artificial Sequence
  Synthetic
aatattacaaaacatcgctgccggtcaacaacaagattactcagc

SEQ ID NO: 2097 - DNA, 42 bp, Artificial Sequence
  Synthetic
cctcctcctcaggatcaccattttacctgtcagtcttttagc

SEQ ID NO: 2098 - DNA, 43 bp, Artificial Sequence
  Synthetic
tgcccctcatttaattcaagagaatctgtttgaggtgctccag

SEQ ID NO: 2099 - DNA, 46 bp, Artificial Sequence
  Synthetic
tgtgacagcttccaaccttgggttaactaaaacacctttgaaaagc

SEQ ID NO: 2100 - DNA, 47 bp, Artificial Sequence
  Synthetic
taacccagttttcacaacatgatctaaagaatactttggtgtagcat

SEQ ID NO: 2101 - DNA, 49 bp, Artificial Sequence
  Synthetic
atgtcccagtttgtgaatatgtttgatggaaatagagcatattttctcc

SEQ ID NO: 2102 - DNA, 40 bp, Artificial Sequence
  Synthetic
tgctcgttggatcttcggcgtctctagctctaccacgtcg

SEQ ID NO: 2103 - DNA, 43 bp, Artificial Sequence
  Synthetic
gctggtgtaatgtctaatgtagcaacagatgtggtcggtgttg

SEQ ID NO: 2104 - DNA, 39 bp, Artificial Sequence
  Synthetic
aggtgtactggtacgtggagaggccctattaatcagcct

SEQ ID NO: 2105 - DNA, 42 bp, Artificial Sequence
  Synthetic
ctgcagatgtttctgaaaaccgaggccagaccaggattttgc

SEQ ID NO: 2106 - DNA, 49 bp, Artificial Sequence
  Synthetic
tgttgcaaatatcagctgtgcattaaatacctgacaatatactagagga

SEQ ID NO: 2107 - DNA, 45 bp, Artificial Sequence
  Synthetic
cgtttgcgtcgcctaagaagatatggcagtagatgtttatgatga

SEQ ID NO: 2108 - DNA, 48 bp, Artificial Sequence
  Synthetic
gctctgtctatcattgcaaatttgtgtagtggaaatcagtttagagtt

SEQ ID NO: 2109 - DNA, 45 bp, Artificial Sequence
  Synthetic
gcatttgttttggatccattgaaacccgcatatcctttaaagcag

SEQ ID NO: 2110 - DNA, 45 bp, Artificial Sequence
  Synthetic
agtgtgccaagtgattgtttcttaggggtctacatttttgtctac

SEQ ID NO: 2111 - DNA, 38 bp, Artificial Sequence
  Synthetic
ctgcccatctccacgcgaagccgcggaaatccagcaat

SEQ ID NO: 2112 - DNA, 41 bp, Artificial Sequence; identical to SEQ ID NO: 1458
  Synthetic

SEQ ID NO: 2113 - DNA, 42 bp, Artificial Sequence
  Synthetic
ctgaactaagactgggtgtccatccactaaccatccttttgc

SEQ ID NO: 2114 - DNA, 41 bp, Artificial Sequence
  Synthetic
cgaggcaggcttacatgggagggggggactttatgtgaccc

SEQ ID NO: 2115 - DNA, 35 bp, Artificial Sequence
  Synthetic
cgggctggtccagggacttgtcgctgactccgcca

SEQ ID NO: 2116 - DNA, 35 bp, Artificial Sequence
  Synthetic
cgcagggcaagacgagggatccaaggactcgggcc

SEQ ID NO: 2117 - DNA, 39 bp, Artificial Sequence
  Synthetic
cacgctggagggacattgtccgccacttcctgggtcatg

SEQ ID NO: 2118 - DNA, 43 bp, Artificial Sequence
  Synthetic
cccagctcattttggaaaataaacacaatccaacacgaggcaa

SEQ ID NO: 2119 - DNA, 35 bp, Artificial Sequence
  Synthetic
tgcgccgcctaatgcatcctatgcgccgaggcctt

SEQ ID NO: 2120 - DNA, 38 bp, Artificial Sequence
  Synthetic
tccttcttccacggcgccgcgagttacgctccttggag

SEQ ID NO: 2121 - DNA, 37 bp, Artificial Sequence
  Synthetic
tcgagctcgctggcgtgagaagctgtgtgacggtccc

SEQ ID NO: 2122 - DNA, 39 bp, Artificial Sequence
  Synthetic
acttgtaggcccggggaccccgatcgtaagccgcaatgt

SEQ ID NO: 2123 - DNA, 41 bp, Artificial Sequence
  Synthetic
cccacaccatcagcagcgtcttcctgagaggaggcttgtgt

SEQ ID NO: 2124 - DNA, 36 bp, Artificial Sequence
  Synthetic
cccccatcactctcccaggcctcgtttcggccccga

SEQ ID NO: 2125 - DNA, 39 bp, Artificial Sequence
  Synthetic
actcggcctggtctcggctgagtccgacaggaggtctcc

SEQ ID NO: 2126 - DNA, 38 bp, Artificial Sequence
  Synthetic
ccctgcgacccccttaaccctgtagttgagcggctcct

SEQ ID NO: 2127 - DNA, 36 bp, Artificial Sequence
  Synthetic
agcactcggcggggctttcttcgtcgcgtgacctgg

SEQ ID NO: 2128 - DNA, 40 bp, Artificial Sequence
  Synthetic
aattaggaaggcgctgggggcgggtgttccagtcatcggg

SEQ ID NO: 2129 - DNA, 39 bp, Artificial Sequence
  Synthetic
cgtccctggccacgaaggatttcagccagcatcttagca

SEQ ID NO: 2130 - DNA, 36 bp, Artificial Sequence
  Synthetic
gcaaccaggcccactgcaagacgcagttgctgacgc

SEQ ID NO: 2131 - DNA, 35 bp, Artificial Sequence
  Synthetic
agacccaccacctcgtgccgggcgtttgtcccacg

SEQ ID NO: 2132 - DNA, 38 bp, Artificial Sequence
  Synthetic
cggaagaggaggaggaggcggcggggggaggatgaaac

SEQ ID NO: 2133 - DNA, 38 bp, Artificial Sequence
  Synthetic
ggggtggtgaggatgcagctcctttatgcgctttgccg

SEQ ID NO: 2134 - DNA, 42 bp, Artificial Sequence
  Synthetic
cgttgcaggcctccttcaaaagttctctatcgtcaactgcgc

SEQ ID NO: 2135 - DNA, 37 bp, Artificial Sequence
  Synthetic
tcatccccctgcgtgtcggccaacatctgcctcccgc

SEQ ID NO: 2136 - DNA, 36 bp, Artificial Sequence
  Synthetic
tgtcaaccggccccgcaacgagtcccgctgagcaga

SEQ ID NO: 2137 - DNA, 35 bp, Artificial Sequence
  Synthetic
tgcggcagaggctaagcgcccgttgaggcccacgt

SEQ ID NO: 2138 - DNA, 38 bp, Artificial Sequence
  Synthetic
ctctccagtgcggtgttgctcaaggccagagacaccct

SEQ ID NO: 2139 - DNA, 35 bp, Artificial Sequence
  Synthetic
tctcgtcccacctggcggaacgtgtctgggaggcg

SEQ ID NO: 2140 - DNA, 38 bp, Artificial Sequence
  Synthetic
tcacgtccctggccgagctaaaagcctcggtctgctcc

SEQ ID NO: 2141 - DNA, 39 bp, Artificial Sequence
  Synthetic
accgcgttaacatctcggccagaactgggcctcgtggga

SEQ ID NO: 2142 - DNA, 39 bp, Artificial Sequence
  Synthetic
ggcttccgcctgttttgtttgtacgagagaacccgccac

SEQ ID NO: 2143 - DNA, 39 bp, Artificial Sequence
  Synthetic
cggagttgatgaaaggggccggatctcggccgttgtctc

SEQ ID NO: 2144 - DNA, 38 bp, Artificial Sequence
  Synthetic
aactccacgctgcgtccatcggggggtggcatatctga

SEQ ID NO: 2145 - DNA, 35 bp, Artificial Sequence
  Synthetic
agacgaggcacaggcacccctggctcgcctggagt

SEQ ID NO: 2146 - DNA, 38 bp, Artificial Sequence
  Synthetic
accggtgacaccaagtccatctgtcatgtcgggggcct

SEQ ID NO: 2147 - DNA, 41 bp, Artificial Sequence
  Synthetic
tgttcaggttttgctcaaggaaattggtttcagcaatcgga

SEQ ID NO: 2148 - DNA, 40 bp, Artificial Sequence
  Synthetic
cgccaaccaacacctccctctacaggcagcgtcttcagga

SEQ ID NO: 2149 - DNA, 38 bp, Artificial Sequence
  Synthetic
ggagtccggacagtttcatgctcgggcttcaggggcat

SEQ ID NO: 2150 - DNA, 41 bp, Artificial Sequence
  Synthetic
ggcagacatccgcgattacctttgtcgctgcagtactacga

SEQ ID NO: 2151 - DNA, 37 bp, Artificial Sequence
  Synthetic
tggccctgatcctgagccgggaagaggacgaggacga

SEQ ID NO: 2152 - DNA, 38 bp, Artificial Sequence
  Synthetic
tcacgtcctctaccccggcgcggggtcgaggaggtagt

SEQ ID NO: 2153 - DNA, 42 bp, Artificial Sequence
  Synthetic
cgtgtgctgcctggaacacaatgaggttcagggacttgtcct

SEQ ID NO: 2154 - DNA, 36 bp, Artificial Sequence
  Synthetic
actcgggagtctctggcccccatagctgcccctggt

SEQ ID NO: 2155 - DNA, 40 bp, Artificial Sequence
  Synthetic
accgtctatagcgcctttgggtccatgactgctgacccgc

SEQ ID NO: 2156 - DNA, 39 bp, Artificial Sequence
  Synthetic
cgcgcaggcttactttttgcatcatccggcaagcaccat

SEQ ID NO: 2157 - DNA, 42 bp, Artificial Sequence
  Synthetic
cagggggatctttacgtgggtgttcgtgccaaaccaaaaagg

SEQ ID NO: 2158 - DNA, 40 bp, Artificial Sequence
  Synthetic
acctgggcttatgcagacgagttcctctgaaggatgggcg

SEQ ID NO: 2159 - DNA, 39 bp, Artificial Sequence
  Synthetic
ggtggtctgccaaagctgctatcaacaggtgggggttgt

SEQ ID NO: 2160 - DNA, 40 bp, Artificial Sequence
  Synthetic
ctgcgaagagcgtcactgtgtgtagcagaatagggcccct

SEQ ID NO: 2161 - DNA, 36 bp, Artificial Sequence
  Synthetic
tgttcaacgcggtcaaggcctgcccatacctgcggg

SEQ ID NO: 2162 - DNA, 36 bp, Artificial Sequence
  Synthetic
tggttggggctgcttcccagtggccaggtggacgca

SEQ ID NO: 2163 - DNA, 37 bp, Artificial Sequence
  Synthetic
aactgcgagggggcctggtagaccctcgtgagacccg

SEQ ID NO: 2164 - DNA, 39 bp, Artificial Sequence
  Synthetic
acaggcaactacatggggccgtgtcggatctcggtccag

SEQ ID NO: 2165 - DNA, 36 bp, Artificial Sequence
  Synthetic
caacccggcagagctccaggtagcctgagccgcact

SEQ ID NO: 2166 - DNA, 42 bp, Artificial Sequence
  Synthetic
agcgtcccctgttaggtccttgcctaacagggtcatcgtcct

SEQ ID NO: 2167 - DNA, 39 bp, Artificial Sequence
  Synthetic
ggtcctaactggtcaggggcaagccggtcaacacgacat

SEQ ID NO: 2168 - DNA, 36 bp, Artificial Sequence
  Synthetic
agcagctggccccgaatcccaccagcccgttcacca

SEQ ID NO: 2169 - DNA, 37 bp, Artificial Sequence
  Synthetic
cctacacgaccgccaaggggcagaacgttgtcggtga

SEQ ID NO: 2170 - DNA, 38 bp, Artificial Sequence
  Synthetic
gttgagaccgtcctggcaggaagcggggtcttttggac

SEQ ID NO: 2171 - DNA, 39 bp, Artificial Sequence
  Synthetic
ttccccaggcagtcccagccgggacagattgtcttccac

SEQ ID NO: 2172 - DNA, 40 bp, Artificial Sequence
  Synthetic
cccggactcgttttacggactccccccttttccgcatcag

SEQ ID NO: 2173 - DNA, 40 bp, Artificial Sequence
  Synthetic
caacgggactgtcatggaaattattgccaaaacaacgtgt

SEQ ID NO: 2174 - DNA, 36 bp, Artificial Sequence
  Synthetic
gcggctgaacgtgactacccggcggtggacagcagt

SEQ ID NO: 2175 - DNA, 38 bp, Artificial Sequence
  Synthetic
atcctgccagcgggagaggcaaaagaccctccccacct

SEQ ID NO: 2176 - DNA, 36 bp, Artificial Sequence
  Synthetic
tggaggggggccaaagaggtaccacccccacccaca

SEQ ID NO: 2177 - DNA, 40 bp, Artificial Sequence
  Synthetic
caccagtttctttccgcggtggcgggaggacaccaaccct

SEQ ID NO: 2178 - DNA, 40 bp, Artificial Sequence
  Synthetic
ggcacaggagcgattaagtcctttctggagtgcctttcgc

SEQ ID NO: 2179 - DNA, 41 bp, Artificial Sequence
  Synthetic
tggccaacatgacttccgtcaaaggaaggcgctgtaggatt

SEQ ID NO: 2180 - DNA, 40 bp, Artificial Sequence
  Synthetic
cagatccacgaccgcatccagttttctcgcccccttcact

SEQ ID NO: 2181 - DNA, 36 bp, Artificial Sequence
  Synthetic
aggcgaccccatgatgcggggtgatgcggaccttgg

SEQ ID NO: 2182 - DNA, 37 bp, Artificial Sequence
  Synthetic
ggggtgacgaggatggaaaggccttgccgtgccctct

SEQ ID NO: 2183 - DNA, 39 bp, Artificial Sequence
  Synthetic
tggctcgctgctgtgacgcctggccatatcagggaagtc

SEQ ID NO: 2184 - DNA, 40 bp, Artificial Sequence
  Synthetic
cgagggtgccgcctttgagacagggtctgggtaaacaggt

SEQ ID NO: 2185 - DNA, 35 bp, Artificial Sequence
  Synthetic
tggcggtgccggtgaatccccagcctgccggactt

SEQ ID NO: 2186 - DNA, 35 bp, Artificial Sequence
  Synthetic
tggaggcctcgcacgagacgtcggcaaacaggggc

SEQ ID NO: 2187 - DNA, 40 bp, Artificial Sequence
  Synthetic
acaggaggtagcggtggggccacctccttgtcgtagagcg

SEQ ID NO: 2188 - DNA, 39 bp, Artificial Sequence
  Synthetic
cgctcctttgtggcatcaccgcctgtgcagagccttgac

SEQ ID NO: 2189 - DNA, 35 bp, Artificial Sequence
  Synthetic
tggtttgcgaggctgggccacgtcacggggaactg

SEQ ID NO: 2190 - DNA, 37 bp, Artificial Sequence
  Synthetic
gctcatcatcagcgtcctgcgctgagccgcgaccagt

SEQ ID NO: 2191 - DNA, 42 bp, Artificial Sequence
  Synthetic
gctacctcatgttcagggccatgcaaaggcaggtctttctca

SEQ ID NO: 2192 - DNA, 36 bp, Artificial Sequence
  Synthetic
cccttggtcacgcttggctgggctgaccccggcaaa

SEQ ID NO: 2193 - DNA, 43 bp, Artificial Sequence
  Synthetic
tgccaatatctaagttgccttagttgttttccgtttgctgcat

SEQ ID NO: 2194 - DNA, 42 bp, Artificial Sequence
  Synthetic
gctggcaaattgctcgtgacaaaaagacattgtcctgcagct

SEQ ID NO: 2195 - DNA, 47 bp, Artificial Sequence
  Synthetic
ttgccgtaccaattccatatatgattgttaaactccagtaatcgaag

SEQ ID NO: 2196 - DNA, 47 bp, Artificial Sequence
  Synthetic
tggtggttctattagcatgtttgttgtgtgctaaaaacagagatacc

SEQ ID NO: 2197 - DNA, 47 bp, Artificial Sequence
  Synthetic
gcatctttcacatatttggcttgactggctgatgtagatagtaatgc

SEQ ID NO: 2198 - DNA, 44 bp, Artificial Sequence
  Synthetic
aaccgtaataggctcatgcaaatgtttagtattttatgggcctg

SEQ ID NO: 2199 - DNA, 46 bp, Artificial Sequence
  Synthetic
gcacgtgttgccagtgtttaaagaactgtatgaaaaagatagtgac

SEQ ID NO: 2200 - DNA, 39 bp, Artificial Sequence
  Synthetic
attgcttaggcactgcgtcctatagcaacgaacgatgga

SEQ ID NO: 2201 - DNA, 42 bp, Artificial Sequence
  Synthetic
ggtgtcctgggtgctagacacagtacatgtgggttcaagggt

SEQ ID NO: 2202 - DNA, 41 bp, Artificial Sequence
  Synthetic
ggcctctatgcccttaggaataatgatagtgtggaacagcg

SEQ ID NO: 2203 - DNA, 44 bp, Artificial Sequence
  Synthetic
gctggttgtgtggtagtcacgtttctagcactatatatacaggc

SEQ ID NO: 2204 - DNA, 38 bp, Artificial Sequence
  Synthetic
tagtggcatgggaggtggaaggagcagatgttccagtg

SEQ ID NO: 2205 - DNA, 46 bp, Artificial Sequence
  Synthetic
acttgcctggcgaataggaaaatgctggtagttctagattacttac

SEQ ID NO: 2206 - DNA, 43 bp, Artificial Sequence
  Synthetic
gcattttcagtgtcattaagcttgtcggacagcctttaggaat

SEQ ID NO: 2207 - DNA, 39 bp, Artificial Sequence
  Synthetic
ccaagggaacgtcagacctatcacaggttttggggcaat

SEQ ID NO: 2208 - DNA, 43 bp, Artificial Sequence
  Synthetic
aaggcttgttaaacaactgtgacttctttatgcatccacacct

SEQ ID NO: 2209 - DNA, 43 bp, Artificial Sequence
  Synthetic
aagactagcagtaggaggtggtacatggatgctacattactgg

SEQ ID NO: 2210 - DNA, 40 bp, Artificial Sequence
  Synthetic
caccggacagggggggttattgcgtgtcatgtatgtgtgt

SEQ ID NO: 2211 - DNA, 43 bp, Artificial Sequence
  Synthetic
tgcacggtgagtaacacatgtattatgcctggcagttatttgg

SEQ ID NO: 2212 - DNA, 50 bp, Artificial Sequence
  Synthetic
ccaaactttgattcaccttttcctggtttctggtattgttagaaagatgg

SEQ ID NO: 2213 - DNA, 45 bp, Artificial Sequence
  Synthetic
cgacaaactctcttctgctaaaagagcctactgctgaaaatttgg

SEQ ID NO: 2214 - DNA, 43 bp, Artificial Sequence
  Synthetic
gctttattgcaatcctctgctaactacgatgcttcacagggaa

SEQ ID NO: 2215 - DNA, 50 bp, Artificial Sequence
  Synthetic
ggtaaccgtttctctactttttcctactgtaggattatatgctttaatgc

SEQ ID NO: 2216 - DNA, 50 bp, Artificial Sequence
  Synthetic
gtcatttggcgcatttcatatctttcaaagcaataatcaagctaaacatg

SEQ ID NO: 2217 - DNA, 43 bp, Artificial Sequence
  Synthetic
tgaaacagtttttgggttgggtattcgtatgcagcagaaacct

SEQ ID NO: 2218 - DNA, 40 bp, Artificial Sequence
  Synthetic
cttcgtcctccagctcgaagaccgccacaccttccacatc

SEQ ID NO: 2219 - DNA, 43 bp, Artificial Sequence
  Synthetic
gacgaaatccagtggcacccatttggcagtgttatttatttgg

SEQ ID NO: 2220 - DNA, 46 bp, Artificial Sequence
  Synthetic
gctatgtcttcttggccatgtagaaatgtatttgaggacttgtcca

SEQ ID NO: 2221 - DNA, 44 bp, Artificial Sequence
  Synthetic
tggtaatgcaccttttgtgtcaaagtttggtacgttttagcaga

SEQ ID NO: 2222 - DNA, 47 bp, Artificial Sequence
  Synthetic
tctacgtttcaataaagcaggatgtctaactctataccgtacacacc

SEQ ID NO: 2223 - DNA, 43 bp, Artificial Sequence
  Synthetic
acctgcttaggatccatactaagagccgatacagaaaatccca

SEQ ID NO: 2224 - DNA, 43 bp, Artificial Sequence
  Synthetic
cgctctgttaaatctacgttccaaaacgagatgtcctccagaa

SEQ ID NO: 2225 - DNA, 42 bp, Artificial Sequence
  Synthetic
aacacgcaggttatgttcaggatcttcctattgtgcaaagtc

SEQ ID NO: 2226 - DNA, 41 bp, Artificial Sequence
  Synthetic
cctcgccaaagcccagctattctgtgcagtgaggaaaagga

SEQ ID NO: 2227 - DNA, 41 bp, Artificial Sequence
  Synthetic
tctccaccaccagccttactgtcctacagaaccagcacagc

SEQ ID NO: 2228 - DNA, 42 bp, Artificial Sequence
  Synthetic
tccatccccgggatgcctactatagtgatgaggacgaggagg

SEQ ID NO: 2229 - DNA, 42 bp, Artificial Sequence
  Synthetic
gtcgcgtcaatatccacttgcgacgtagactgtttgagctgc

SEQ ID NO: 2230 - DNA, 41 bp, Artificial Sequence
  Synthetic
tgacaccctctgcaactgtgaaaagtaataggaccacgtgt

SEQ ID NO: 2231 - DNA, 45 bp, Artificial Sequence
  Synthetic
ccaattatttcactagcattgcccaccaaaataagacatccagcg

SEQ ID NO: 2232 - DNA, 42 bp, Artificial Sequence
  Synthetic
tgctctgcccgtttgtaatggccaagcaaaatatgtaaagga

SEQ ID NO: 2233 - DNA, 44 bp, Artificial Sequence
  Synthetic
gtggagttggcataggaaatcaatacttttgtatgagcctgttg

SEQ ID NO: 2234 - DNA, 44 bp, Artificial Sequence
  Synthetic
acaggaaatgcattaggaaaggtaatagaggaagacaggtggaa

SEQ ID NO: 2235 - DNA, 43 bp, Artificial Sequence
  Synthetic
tcatcatcaccgctttgtacatatacgttaagtttgatggcga

SEQ ID NO: 2236 - DNA, 36 bp, Artificial Sequence
  Synthetic
ccgagtcgctgacgcttatgcaacccgacgccacca

SEQ ID NO: 2237 - DNA, 43 bp, Artificial Sequence
  Synthetic
gccaggtggaggttactttgttaaggtatagattgcacaaaca

SEQ ID NO: 2238 - DNA, 46 bp, Artificial Sequence
  Synthetic
ggaaggatagacagccaaaagaagaagtgtggagacctttatttgc

SEQ ID NO: 2239 - DNA, 40 bp, Artificial Sequence
  Synthetic
cccccccatctctatcacgtacttgtgttgtagtgtgcaa

SEQ ID NO: 2240 - DNA, 39 bp, Artificial Sequence
  Synthetic
gggatgtatccagtgcgcccattctttgggggtttgggc

SEQ ID NO: 2241 - DNA, 45 bp, Artificial Sequence
  Synthetic
caggattgtcataggtaacaagtgtccaacaagtacatgtacagg

SEQ ID NO: 2242 - DNA, 44 bp, Artificial Sequence
  Synthetic
cactatagggttttttcctgattgcttcccgactgttaactgtt

SEQ ID NO: 2243 - DNA, 43 bp, Artificial Sequence
  Synthetic
ccatagtaagattgtcccgggtgtgacactgaaaacaccaatt

SEQ ID NO: 2244 - DNA, 44 bp, Artificial Sequence
  Synthetic
caccatatggctcagctgccgatgtgcctttagatattgtaacc

SEQ ID NO: 2245 - DNA, 41 bp, Artificial Sequence
  Synthetic
gcagataccattgttagggccatcccagttgtttaacaagc

SEQ ID NO: 2246 - DNA, 40 bp, Artificial Sequence
  Synthetic
aaggaacccgtgtacagacacccaaacgttcctaagcatg

SEQ ID NO: 2247 - DNA, 40 bp, Artificial Sequence
  Synthetic
ccgaaatcggtccgggggtagtggtgtcctgtatgtgacc

SEQ ID NO: 2248 - DNA, 40 bp, Artificial Sequence
  Synthetic
cgccatggctagacgctttctgccatgaatcactcccctg

SEQ ID NO: 2249 - DNA, 41 bp, Artificial Sequence
  Synthetic
cggcaacaagtatactccgccaaagaaacaccaaccgtcgc

SEQ ID NO: 2250 - DNA, 37 bp, Artificial Sequence
  Synthetic
gtaccccatgaggtcggcaaagtcgcgcaacgtgggt

SEQ ID NO: 2251 - DNA, 39 bp, Artificial Sequence
  Synthetic
ccggtatccagcactgagatgcgctgctgtcctccacgt

SEQ ID NO: 2252 - DNA, 42 bp, Artificial Sequence
  Synthetic
cccaatgagccccgctaatgatcacggctaccatgatcttgg

SEQ ID NO: 2253 - DNA, 40 bp, Artificial Sequence
  Synthetic
tcgggacatcctgacgagttgaccttgcacaccggcttta

SEQ ID NO: 2254 - DNA, 39 bp, Artificial Sequence
  Synthetic
gctctagtacggcagggtggtgtcatggttcggctgcac

SEQ ID NO: 2255 - DNA, 40 bp, Artificial Sequence
  Synthetic
cgtggtggagtgcaacaaaggattcactcgtggggatcgt

SEQ ID NO: 2256 - DNA, 40 bp, Artificial Sequence
  Synthetic
cccttgatgtaccaagcagccacagctagctgcaatggct

SEQ ID NO: 2257 - DNA, 39 bp, Artificial Sequence
  Synthetic
gtaagcaggcccaagcaccgccgtcgccatattctaccc

SEQ ID NO: 2258 - DNA, 40 bp, Artificial Sequence
  Synthetic
gaggacctcccgaccaagtcgagacagctgcttgtgggga

SEQ ID NO: 2259 - DNA, 38 bp, Artificial Sequence
  Synthetic
cgtgagccggccagagtctttctcgggggttttgtgga

SEQ ID NO: 2260 - DNA, 42 bp, Artificial Sequence
  Synthetic
caggtggtgtgctgttgtcacttttcatccccgttgagacac

SEQ ID NO: 2261 - DNA, 42 bp, Artificial Sequence
  Synthetic
ccacggcatggcattcatcacaatatggcaaattcctcgccg

SEQ ID NO: 2262 - DNA, 40 bp, Artificial Sequence
  Synthetic
cgaccactacgtctccctgagttcggggtatgggcttgaa

SEQ ID NO: 2263 - DNA, 42 bp, Artificial Sequence
  Synthetic
ggtctccgatggtgtgagctcagtgtagtgctctgtgagtgc

SEQ ID NO: 2264 - DNA, 38 bp, Artificial Sequence
  Synthetic
cacgggatgtgtgagggtgaccacactcgtgggcccca

SEQ ID NO: 2265 - DNA, 40 bp, Artificial Sequence
  Synthetic
gcctgcacagtgggttgtatgtgccgagatgctgaagtcc

SEQ ID NO: 2266 - DNA, 41 bp, Artificial Sequence
  Synthetic
cgacgagagcccccgaaatgcaggtaaggtgctagtggaca

SEQ ID NO: 2267 - DNA, 40 bp, Artificial Sequence
  Synthetic
cactggccctccgtgtaacaatcatgagaatcacggggcc

SEQ ID NO: 2268 - DNA, 39 bp, Artificial Sequence
  Synthetic
gcagtctccgccgtgatatgagcagcttccttgcgaccc

SEQ ID NO: 2269 - DNA, 41 bp, Artificial Sequence
  Synthetic
ccggtaaagctggtgggaacccgaccttgagccttcgatac

SEQ ID NO: 2270 - DNA, 39 bp, Artificial Sequence
  Synthetic
tccaagctccccctcgaggcctgatgagttggccctttc

SEQ ID NO: 2271 - DNA, 42 bp, Artificial Sequence
  Synthetic
ggaggccgctagcttaatgtcctgataggatgcaagtgctcg

SEQ ID NO: 2272 - DNA, 40 bp, Artificial Sequence
  Synthetic
ccatcaccgcctgaggaagttttttaccctgacctcggcg

SEQ ID NO: 2273 - DNA, 42 bp, Artificial Sequence
  Synthetic
ccctgcagctttacaagccgctggtgctcaccactagcatgg

SEQ ID NO: 2274 - DNA, 42 bp, Artificial Sequence
  Synthetic
gtggtagggtctctggtcaggttcctcaaatgtgtctgtggc

SEQ ID NO: 2275 - DNA, 42 bp, Artificial Sequence
  Synthetic
ccccaagttttctgagggctgactctgcacacatacactccc

SEQ ID NO: 2276 - DNA, 38 bp, Artificial Sequence
  Synthetic
caggctgcataggcaaggcggttgagggcagccagttg

SEQ ID NO: 2277 - DNA, 39 bp, Artificial Sequence
  Synthetic
gcacgggcaactaccaccaagcggtaatgaggccgaagt

SEQ ID NO: 2278 - DNA, 40 bp, Artificial Sequence
  Synthetic
acgtcaaaggctgccaccagtcttcgtcaacggtcaagtc

SEQ ID NO: 2279 - DNA, 41 bp, Artificial Sequence
  Synthetic
gctccgaccgaacaacaaccaagaggatgcggttttgttcg

SEQ ID NO: 2280 - DNA, 40 bp, Artificial Sequence
  Synthetic
aacagtaccgacaagcccggcgaaaagaaaatcgccctcc

SEQ ID NO: 2281 - DNA, 40 bp, Artificial Sequence
  Synthetic
ccttggctttgcagcttggctggacggcttggattttcag

SEQ ID NO: 2282 - DNA, 40 bp, Artificial Sequence
  Synthetic
gaccgcgccccagtatttcgatgtcgcccaagttttcaga

SEQ ID NO: 2283 - DNA, 38 bp, Artificial Sequence
  Synthetic
cgcgcagtttgccgttgacttgacgaagccgccctggt

SEQ ID NO: 2284 - DNA, 38 bp, Artificial Sequence
  Synthetic
ggcgttaaaaagccgagcggggcttcgatgcccttgtt

SEQ ID NO: 2285 - DNA, 37 bp, Artificial Sequence
  Synthetic
cccgaatggcagatacaggcacggctgccgtcttggt

SEQ ID NO: 2286 - DNA, 37 bp, Artificial Sequence
  Synthetic
attggcacgccgatccgcccgaacaggcggtatttgc

SEQ ID NO: 2287 - DNA, 39 bp, Artificial Sequence
  Synthetic
tcgggctgcccatgaccctttgttgcgatgtgatgacgc

SEQ ID NO: 2288 - DNA, 40 bp, Artificial Sequence
  Synthetic
cgcgcggcagttgatacaggcgggttctgccttttcaaac

SEQ ID NO: 2289 - DNA, 38 bp, Artificial Sequence
  Synthetic
gccgccaaaggcaaaggacgaggcggacaccttgttgc

SEQ ID NO: 2290 - DNA, 42 bp, Artificial Sequence
  Synthetic
gcccatttgtaaccggttctgcacaatttcagccacaactgc

SEQ ID NO: 2291 - DNA, 35 bp, Artificial Sequence
  Synthetic
aacggcggcctgattaccgcacaccagcgcaccga

SEQ ID NO: 2292 - DNA, 39 bp, Artificial Sequence
  Synthetic
agttgccgcacctgccctcgcaagataaaccacgtcgcc

SEQ ID NO: 2293 - DNA, 38 bp, Artificial Sequence
  Synthetic
gaatcggggcgaactcgggttccaatgcctgcgtttca

SEQ ID NO: 2294 - DNA, 37 bp, Artificial Sequence
  Synthetic
cgccagttgaccgaatcgggaactcttgccgcgttcc

SEQ ID NO: 2295 - DNA, 38 bp, Artificial Sequence
  Synthetic
cgcaaagactaccgcagcaacgtcagcggtgcaggcga

SEQ ID NO: 2296 - DNA, 36 bp, Artificial Sequence
  Synthetic
acttcctcgaccgcctcgcgtaacgcgcaaaccccg

SEQ ID NO: 2297 - DNA, 42 bp, Artificial Sequence
  Synthetic
gcatcctgctcgacaacatcctaggttttgtggacataggcg

SEQ ID NO: 2298 - DNA, 38 bp, Artificial Sequence
  Synthetic
cgaggctttgggcttgggtccttttgggcggcaggacg

SEQ ID NO: 2299 - DNA, 41 bp, Artificial Sequence
  Synthetic
gtccgcaacaaaatcgccctggttcatgttcgtgccttccg

SEQ ID NO: 2300 - DNA, 38 bp, Artificial Sequence
  Synthetic
agacattgccctccccgagggttttccagtgcgaacgc

SEQ ID NO: 2301 - DNA, 34 bp, Artificial Sequence
  Synthetic
acggcggcgaagagaaaggtttcttgggcgcggc

SEQ ID NO: 2302 - DNA, 35 bp, Artificial Sequence
  Synthetic
ttggcgttggctcaggcgggcatcggacggcaaag

SEQ ID NO: 2303 - DNA, 38 bp, Artificial Sequence
  Synthetic
ggcaatttgttcggcaatggcgcgaagctgcgttgggc

SEQ ID NO: 2304 - DNA, 35 bp, Artificial Sequence
  Synthetic
tcgaagatgcctgcgccgcataccgggttcgccga

SEQ ID NO: 2305 - DNA, 36 bp, Artificial Sequence
  Synthetic
ccgacaccatccgcctgatggcacgcctgccgctat

SEQ ID NO: 2306 - DNA, 34 bp, Artificial Sequence
  Synthetic
cgtgtgcatcggtcctgccttcggcggcggcaat

SEQ ID NO: 2307 - DNA, 38 bp, Artificial Sequence
  Synthetic
tgccgctcgccaaagtcggcgccttgttctttcaggga

SEQ ID NO: 2308 - DNA, 38 bp, Artificial Sequence
  Synthetic
ttggaaatcgtccgcaccgagggtttgaccgccgtaat

SEQ ID NO: 2309 - DNA, 38 bp, Artificial Sequence
  Synthetic
cgcctgaccatgctgttgcgccgcacctgtcagaatcg

SEQ ID NO: 2310 - DNA, 41 bp, Artificial Sequence
  Synthetic
cgccgatgccgtacaagaaaccatggacagatggatgtgcg

SEQ ID NO: 2311 - DNA, 38 bp, Artificial Sequence
  Synthetic
agtcgcgcccgtcgacaaagaaaatcaccgccatcagc

SEQ ID NO: 2312 - DNA, 37 bp, Artificial Sequence
  Synthetic
gcgcaggtggggcaggtaatcgccttaagccttgccg

SEQ ID NO: 2313 - DNA, 39 bp, Artificial Sequence
  Synthetic
gctgttttcgggcatctggctgaacacctgccccggtat

SEQ ID NO: 2314 - DNA, 37 bp, Artificial Sequence
  Synthetic
ccgatcataccggtcgcgccattgcgccgcttccaac

SEQ ID NO: 2315 - DNA, 38 bp, Artificial Sequence
  Synthetic
ccgatttccaaaaccgcgcctgctgcaaggctacgact

SEQ ID NO: 2316 - DNA, 39 bp, Artificial Sequence
  Synthetic
acggcagggcggggttttgtcgttttcgaaccccaaccc

SEQ ID NO: 2317 - DNA, 41 bp, Artificial Sequence
  Synthetic
cctgtcgctcggtaaatcagcgaatcgaacacagctacgcc

SEQ ID NO: 2318 - DNA, 37 bp, Artificial Sequence
  Synthetic
actgcttcgcgcgcttcgaaaaagccgaagccgaact

SEQ ID NO: 2319 - DNA, 38 bp, Artificial Sequence
  Synthetic
gcgttcttccctgcgtttgctgcctgcctcaacatcgg

SEQ ID NO: 2320 - DNA, 37 bp, Artificial Sequence
  Synthetic
tcgagcgggcaggctgaaatcaggcagtcggcgcagt

SEQ ID NO: 2321 - DNA, 37 bp, Artificial Sequence
  Synthetic
accgcgccatgctcttggcgcgttggcggctttttgg

SEQ ID NO: 2322 - DNA, 41 bp, Artificial Sequence
  Synthetic
cgcctcgcccgtatccatgtacgaacttcaccaaacccacg

SEQ ID NO: 2323 - DNA, 35 bp, Artificial Sequence
  Synthetic
ccgcagcattcccacgactccttttgggcgagccg

SEQ ID NO: 2324 - DNA, 40 bp, Artificial Sequence
  Synthetic
gcgcgtgaacacggcattcctaatgttggggaacggcatt

SEQ ID NO: 2325 - DNA, 36 bp, Artificial Sequence
  Synthetic
actctccgccctgctcgacctcgcggattgcctgct

SEQ ID NO: 2326 - DNA, 37 bp, Artificial Sequence
  Synthetic
ggctgaaaaacgccgtcgaacttcagcgtcgggtgca

SEQ ID NO: 2327 - DNA, 42 bp, Artificial Sequence
  Synthetic
ccatgctgaacaccgccctttcaaacggcatcggcttcttct

SEQ ID NO: 2328 - DNA, 42 bp, Artificial Sequence
  Synthetic
tcaagacagaaagctcctgccgtgtgcatataaagcggcagg

SEQ ID NO: 2329 - DNA, 40 bp, Artificial Sequence
  Synthetic
cgctgttttacacgctgaccgacgatcggacgcgttttgc

SEQ ID NO: 2330 - DNA, 36 bp, Artificial Sequence
  Synthetic
tgctgcactttccggcgaacaaggtttgccagcgcg

SEQ ID NO: 2331 - DNA, 41 bp, Artificial Sequence
  Synthetic
gggactgacggtgtcggtattgcggcatagtattcgcggac

SEQ ID NO: 2332 - DNA, 35 bp, Artificial Sequence
  Synthetic
aagctgcgcggtgctgaccgacgttgagccgggga

SEQ ID NO: 2333 - DNA, 39 bp, Artificial Sequence
  Synthetic
cctccgcaacgacctgacctcaatctgttcgggtgtcag

SEQ ID NO: 2334 - DNA, 36 bp, Artificial Sequence
  Synthetic
cgtgcgcgcctaccagattccttgcgaggctttgcg

SEQ ID NO: 2335 - DNA, 39 bp, Artificial Sequence
  Synthetic
tatggctgcacggcgaggcccagttgttcggacaaacgc

SEQ ID NO: 2336 - DNA, 42 bp, Artificial Sequence
  Synthetic
ggcacatttttcacgcttgccatgcttttgtcttcttcgccc

SEQ ID NO: 2337 - DNA, 41 bp, Artificial Sequence
  Synthetic
cccagcagtttcgccgttttgtctacgagcttttgggcgag

SEQ ID NO: 2338 - DNA, 36 bp, Artificial Sequence
  Synthetic
tgaccgccatgtacaagccgctgcccgcctgcatga

SEQ ID NO: 2339 - DNA, 38 bp, Artificial Sequence
  Synthetic
cgccgtttatgacgcccccaaggcgcgcaccataacca

SEQ ID NO: 2340 - DNA, 38 bp, Artificial Sequence
  Synthetic
gctcgcgcgaaaacttaaaccacgttttcaggcggccc

SEQ ID NO: 2341 - DNA, 37 bp, Artificial Sequence
  Synthetic
gcctgccggggctacatcactggagctgttcgtcggt

SEQ ID NO: 2342 - DNA, 37 bp, Artificial Sequence
  Synthetic
gtcccgaaagccgctgcacgaaatccgtgtcgatgca

SEQ ID NO: 2343 - DNA, 34 bp, Artificial Sequence
  Synthetic
ggcaaggtgcggcagcttcgctgcacgacacgct

SEQ ID NO: 2344 - DNA, 39 bp, Artificial Sequence
  Synthetic
cgatgacggtggtggcaaccaaaaggccgaagtcatggc

SEQ ID NO: 2345 - DNA, 39 bp, Artificial Sequence
  Synthetic
atcagcatcggggcggtttcgccaagctcgaagaagact

SEQ ID NO: 2346 - DNA, 35 bp, Artificial Sequence
  Synthetic
acacccgaaacccgcagcgcgcctgacggatgctg

SEQ ID NO: 2347 - DNA, 35 bp, Artificial Sequence
  Synthetic
gcttcaggacggcatcgccgcgtatcatcggcgcg

SEQ ID NO: 2348 - DNA, 35 bp, Artificial Sequence
  Synthetic
ccgccgacttccgcatacggcgtgggtcatgccgt

SEQ ID NO: 2349 - DNA, 37 bp, Artificial Sequence
  Synthetic
actttccaagtctgcgcggcaaacctgcctcgtcggg

SEQ ID NO: 2350 - DNA, 38 bp, Artificial Sequence
  Synthetic
ggagtagcgttgggattcgctctcggcaaagaacgtac

SEQ ID NO: 2351 - DNA, 38 bp, Artificial Sequence
  Synthetic
ttccgacccattctccggagatttcggcggcacagaag

SEQ ID NO: 2352 - DNA, 42 bp, Artificial Sequence
  Synthetic
ggtaggatgcggatttcctgcttttggaactgtggccaaaca

SEQ ID NO: 2353 - DNA, 42 bp, Artificial Sequence
  Synthetic
gcccacgtcgtttatccgcaagtgtttgagccagatttcgga

SEQ ID NO: 2354 - DNA, 41 bp, Artificial Sequence
  Synthetic
gcaactgccttatgccctgacgagacccaatgcgaggtagc

SEQ ID NO: 2355 - DNA, 40 bp, Artificial Sequence
  Synthetic
tatgctgccgattgccgccgatacacgggataatcagcgc

SEQ ID NO: 2356 - DNA, 38 bp, Artificial Sequence
  Synthetic
cgcccatgtgcgtgctgatcaagcgtggcgataatcga

SEQ ID NO: 2357 - DNA, 37 bp, Artificial Sequence
  Synthetic
cgtcgacggtctgacacacctaatcgccgtctgccca

SEQ ID NO: 2358 - DNA, 41 bp, Artificial Sequence
  Synthetic
gcaaatatacagccgcagcggttcatggcaacgtcaatcgg

SEQ ID NO: 2359 - DNA, 39 bp, Artificial Sequence
  Synthetic
tttccggttgccgatacgcctgtattccatcacgccgtc

SEQ ID NO: 2360 - DNA, 40 bp, Artificial Sequence
  Synthetic
gccattaccgccgaaccgagacctgtcgttttattggggc

SEQ ID NO: 2361 - DNA, 39 bp, Artificial Sequence
  Synthetic
cggtattcctgagcgtcggatccgtttggcgcaggttgg

SEQ ID NO: 2362 - DNA, 38 bp, Artificial Sequence
  Synthetic
cggcttggacgttgcacactttgggcgcaggtcatcga

SEQ ID NO: 2363 - DNA, 36 bp, Artificial Sequence
  Synthetic
cgcgccctatcatgatgccgccgcaaaaagccgccg

SEQ ID NO: 2364 - DNA, 38 bp, Artificial Sequence
  Synthetic
acggcggcatggcaatactgaaaaaccgaccgttgggc

SEQ ID NO: 2365 - DNA, 36 bp, Artificial Sequence
  Synthetic
gaccaaagccgccaatgccaatccggcatcgacgct

SEQ ID NO: 2366 - DNA, 35 bp, Artificial Sequence
  Synthetic
agcttgcccggaaagccgcgccgagggcgaatgtg

SEQ ID NO: 2367 - DNA, 36 bp, Artificial Sequence
  Synthetic
gcaggtcgtcgtcgctgtacctgctgcgcgggttca

SEQ ID NO: 2368 - DNA, 39 bp, Artificial Sequence
  Synthetic
tctgcctgtccctcagcgccctatcaggctcatacggcg

SEQ ID NO: 2369 - DNA, 41 bp, Artificial Sequence
  Synthetic
ccgtctgcaagcctacgaaggagttgctgttcaaaccacgg

SEQ ID NO: 2370 - DNA, 36 bp, Artificial Sequence
  Synthetic
ccacgttggcacgcctgtggcatcccttgccgtcca

SEQ ID NO: 2371 - DNA, 40 bp, Artificial Sequence
  Synthetic
cgcaagaacacaggcaaagcccggcactctgcatttttgc

SEQ ID NO: 2372 - DNA, 39 bp, Artificial Sequence
  Synthetic
cgctttgccgaactcgacggggatgacggtcagtgtgtg

SEQ ID NO: 2373 - DNA, 37 bp, Artificial Sequence
  Synthetic
aaatcccgccctgctcgccttggacggcgttatgggt

SEQ ID NO: 2374 - DNA, 35 bp, Artificial Sequence
  Synthetic
ctgaccggcacacccacacgcgggcaagctgacgt

SEQ ID NO: 2375 - DNA, 35 bp, Artificial Sequence
  Synthetic
acgccgacgacctcgaagctcgggacaggggtgga

SEQ ID NO: 2376 - DNA, 41 bp, Artificial Sequence
  Synthetic
ccaaaaccgccgtcctacaccaggattgcgctgaacagcct

SEQ ID NO: 2377 - DNA, 39 bp, Artificial Sequence
  Synthetic
caacagcatctccgtcagcgactttgacggatgcctggc

SEQ ID NO: 2378 - DNA, 42 bp, Artificial Sequence
  Synthetic
gccatattcgcaggattgctgccgggggaaaaggagttaacc

SEQ ID NO: 2379 - DNA, 37 bp, Artificial Sequence
  Synthetic
ccgacaaagaccgcgcatggtgtacgacaggtgcggc

SEQ ID NO: 2380 - DNA, 38 bp, Artificial Sequence
  Synthetic
catcacccgcatcggtttcaacctgcaaccggggatgc

SEQ ID NO: 2381 - DNA, 42 bp, Artificial Sequence
  Synthetic
gctatcggagttggaccaggtgcgggttttttgacggttcag

SEQ ID NO: 2382 - DNA, 37 bp, Artificial Sequence
  Synthetic
agccggcggattctgcctgtcggcaatggcatgcatg

SEQ ID NO: 2383 - DNA, 36 bp, Artificial Sequence
  Synthetic
accccggggcaaaccatccgcgcaatgcctgctcga

SEQ ID NO: 2384 - DNA, 43 bp, Artificial Sequence
  Synthetic
tccattatttaccaattcctcaccggacgttactttgcgccaa

SEQ ID NO: 2385 - DNA, 37 bp, Artificial Sequence
  Synthetic
cgccgctacgccatcaacgttgaccgatggcacgacc

SEQ ID NO: 2386 - DNA, 38 bp, Artificial Sequence
  Synthetic
ggcgaacccaaacccagcatcacgggtcggcgtggatt

SEQ ID NO: 2387 - DNA, 40 bp, Artificial Sequence
  Synthetic
gggaaatctttacccacggcggatttcgaccgcccattcc

SEQ ID NO: 2388 - DNA, 37 bp, Artificial Sequence
  Synthetic
acgcaccgttgccgacattgatgctgactttgtccgc

SEQ ID NO: 2389 - DNA, 34 bp, Artificial Sequence
  Synthetic
agcaggcgcgattaccggctgctgcgcttgggca

SEQ ID NO: 2390 - DNA, 35 bp, Artificial Sequence
  Synthetic
acgtcttgagcgtcggcccccgcgagacaggtcgt

SEQ ID NO: 2391 - DNA, 41 bp, Artificial Sequence
  Synthetic
ggcacaccaattgaaccttgccaaaccttccaatacgcccg

SEQ ID NO: 2392 - DNA, 40 bp, Artificial Sequence
  Synthetic
cgacgcactggtcggcaaaggatgccttcgatgacgaggt

SEQ ID NO: 2393 - DNA, 39 bp, Artificial Sequence
  Synthetic
cgacagcgcatcgaagccatgggatagcgtccggcaagt

SEQ ID NO: 2394 - DNA, 38 bp, Artificial Sequence
  Synthetic
gctgaccgccgacgatgtcgtccgatgtgtattcccaa

SEQ ID NO: 2395 - DNA, 37 bp, Artificial Sequence
  Synthetic
accggttgccgccaaaaaaggtaaacgacgacgcgcg

SEQ ID NO: 2396 - DNA, 39 bp, Artificial Sequence
  Synthetic
gcgtcaaccgtatgccgctccgctgaatcggataggtcg

SEQ ID NO: 2397 - DNA, 38 bp, Artificial Sequence
  Synthetic
aaacccaagcccgaagacgcggggtgaggatgtagcgt

SEQ ID NO: 2398 - DNA, 36 bp, Artificial Sequence
  Synthetic
tcctacggctggttcggcttgcctgttggacgggga

SEQ ID NO: 2399 - DNA, 36 bp, Artificial Sequence
  Synthetic
tcggcggcattgcccgatccggattcaaacgcgcca

SEQ ID NO: 2400 - DNA, 38 bp, Artificial Sequence
  Synthetic
gatgggttggttcgatgccgttggaaaacccgcccagc

SEQ ID NO: 2401 - DNA, 39 bp, Artificial Sequence
  Synthetic
ccttgccgtcgccatcctgtcggctttgaataactgcgt

SEQ ID NO: 2402 - DNA, 38 bp, Artificial Sequence
  Synthetic
tacgccttttcggacggcgccggaaagggtaacggtcg

SEQ ID NO: 2403 - DNA, 35 bp, Artificial Sequence
  Synthetic
aactgaccgcgctgctcggccgtcagccagagggt

SEQ ID NO: 2404 - DNA, 39 bp, Artificial Sequence
  Synthetic
accgactacgtcgtcgccgcaaggcattggctttttcca

SEQ ID NO: 2405 - DNA, 40 bp, Artificial Sequence
  Synthetic
gctccataagccctaccgcctgtcgcgttcgatttcgctg

SEQ ID NO: 2406 - DNA, 39 bp, Artificial Sequence
  Synthetic
cgatgccgaatacgaccgccctcgggatggtttcgttcc

SEQ ID NO: 2407 - DNA, 39 bp, Artificial Sequence
  Synthetic
ccgcactggacgcattctgcggtcggcgaaaccaaatgg

SEQ ID NO: 2408 - DNA, 35 bp, Artificial Sequence
  Synthetic
ccatcccgggcatccgctacgttgcggctgactgc

SEQ ID NO: 2409 - DNA, 41 bp, Artificial Sequence
  Synthetic
gcgttttccatcggcatcgaaccgaacggtattgcgcttcg

SEQ ID NO: 2410 - DNA, 42 bp, Artificial Sequence
  Synthetic
ggaaaagctgtttgccaaccggtgcaaagtgtgtatcaggct

SEQ ID NO: 2411 - DNA, 38 bp, Artificial Sequence
  Synthetic
ccgatacgcgccatcgatacttggtttgcgccccgatt

SEQ ID NO: 2412 - DNA, 41 bp, Artificial Sequence
  Synthetic
acggaacagcagcaaaggctcatgtattgaatgccgcgagc

SEQ ID NO: 2413 - DNA, 39 bp, Artificial Sequence
  Synthetic
cgcgcagttgttccagcgatcgctatgccgaaatgagcg

SEQ ID NO: 2414 - DNA, 41 bp, Artificial Sequence
  Synthetic
caccctgtacgaaacgctcgctgaattccgctttatcggcg

SEQ ID NO: 2415 - DNA, 40 bp, Artificial Sequence
  Synthetic
gccataatgcgcgctttgtaggccaacctcaaaccgccag

SEQ ID NO: 2416 - DNA, 37 bp, Artificial Sequence
  Synthetic
tcggcggtggtgatgtgttcaacccgttttggcgcaa

SEQ ID NO: 2417 - DNA, 37 bp, Artificial Sequence
  Synthetic
ggtaacggcggcgaccaatgtttctgcctgcccgtcc

SEQ ID NO: 2418 - DNA, 36 bp, Artificial Sequence
  Synthetic
tccatcgcgtccgccagtatgggcgggcgagttgaa

SEQ ID NO: 2419 - DNA, 36 bp, Artificial Sequence
  Synthetic
acatccacaccgccgagcgttcaaaccgaccaccgc

SEQ ID NO: 2420 - DNA, 38 bp, Artificial Sequence
  Synthetic
gcggaagcggtcgacgtatctggcggggtcttttttgc

SEQ ID NO: 2421 - DNA, 41 bp, Artificial Sequence
  Synthetic
ggcaggaaatcctatgccgtcgcaaatcgtaggcaagcgca

SEQ ID NO: 2422 - DNA, 34 bp, Artificial Sequence
  Synthetic
ggaaaccgccgccgacaacggcggcagaaggctt

SEQ ID NO: 2423 - DNA, 38 bp, Artificial Sequence
  Synthetic
tgccggtggacattggtgcagcgtccgggattttcaac

SEQ ID NO: 2424 - DNA, 39 bp, Artificial Sequence
  Synthetic
cctgcatcagatagctgcggaaccgcgccgattacttcg

SEQ ID NO: 2425 - DNA, 41 bp, Artificial Sequence
  Synthetic
cggcgcgaatttaaacggaaattggacgacctgataacaag

SEQ ID NO: 2426 - DNA, 43 bp, Artificial Sequence
  Synthetic
atccccaatatgccgtcagcattggccgtaataaaaagtatgg

SEQ ID NO: 2427 - DNA, 34 bp, Artificial Sequence
  Synthetic
tgggacagctcggggcaaggcaactggacgggga

SEQ ID NO: 2428 - DNA, 38 bp, Artificial Sequence
  Synthetic
ctcgcgcatatggacgcggtacatcgaatgctcgctcg

SEQ ID NO: 2429 - DNA, 38 bp, Artificial Sequence
  Synthetic
gcgtctgcctcgatacccaaacggcggctttgccccaa

SEQ ID NO: 2430 - DNA, 35 bp, Artificial Sequence
  Synthetic
tccacgcgcctgccagttgcgcaaaccgccgttgc

SEQ ID NO: 2431 - DNA, 36 bp, Artificial Sequence
  Synthetic
tgaggctgttgcggacggatattcggcttgccgctg

SEQ ID NO: 2432 - DNA, 36 bp, Artificial Sequence
  Synthetic
ttcaagacgacggcggactgtcggcagatacgccgt

SEQ ID NO: 2433 - DNA, 38 bp, Artificial Sequence
  Synthetic
tccatcgcgcgcggctatccttcctgaatcaggtcggc

SEQ ID NO: 2434 - DNA, 38 bp, Artificial Sequence
  Synthetic
gcctgcttccggccattctgatcggtttgttgggcggt

SEQ ID NO: 2435 - DNA, 35 bp, Artificial Sequence
  Synthetic
acgacgtttccggcctgccaaggtaggcgggcagc

SEQ ID NO: 2436 - DNA, 36 bp, Artificial Sequence
  Synthetic
ggtgtacggaatcgtcgccgggcgcatcagcagcat

SEQ ID NO: 2437 - DNA, 40 bp, Artificial Sequence
  Synthetic
ttcggttcgggcttgttgggaacgacgattcctgtgatgg

SEQ ID NO: 2438 - DNA, 37 bp, Artificial Sequence
  Synthetic
tggcgcacggcatcgatatgtccagccgttgcgtgca

SEQ ID NO: 2439 - DNA, 39 bp, Artificial Sequence
  Synthetic
tttccgtggcgatgtcgtaagcaaaaatggttatcggcc

SEQ ID NO: 2440 - DNA, 41 bp, Artificial Sequence
  Synthetic
ttgacggccttccattttggaaaagaagatttggctgaagt

SEQ ID NO: 2441 - DNA, 45 bp, Artificial Sequence
  Synthetic
ccctttggatattgcgctcaatttaaaaagcggtaataaagggaa

SEQ ID NO: 2442 - DNA, 39 bp, Artificial Sequence
  Synthetic
cacagcattcccggggtgtcccgaacaacgccttttcct

SEQ ID NO: 2443 - DNA, 42 bp, Artificial Sequence
  Synthetic
cctcaggcaaatacgcggacaaacgcagttgttcggaaaacg

SEQ ID NO: 2444 - DNA, 41 bp, Artificial Sequence
  Synthetic
tgccgtctgaagcaccgtttgaggttgatgctgtcgaactg

SEQ ID NO: 2445 - DNA, 37 bp, Artificial Sequence
  Synthetic
cgcgccacccatgcattggcatggcggcgacaaatgc

SEQ ID NO: 2446 - DNA, 45 bp, Artificial Sequence
  Synthetic
gttgatttgaaaaaaatgccgtctgaaacagtttctcgaacggta

SEQ ID NO: 2447 - DNA, 38 bp, Artificial Sequence
  Synthetic
acacccgaccaccaaaagctggcgattgcggcatgggc

SEQ ID NO: 2448 - DNA, 43 bp, Artificial Sequence
  Synthetic
gtctgaatgtttcgacaatccgattgctatctctctacgccac

SEQ ID NO: 2449 - DNA, 39 bp, Artificial Sequence
  Synthetic
cacaaccgccgacatcaagctttctttttcggcgagcgt

SEQ ID NO: 2450 - DNA, 42 bp, Artificial Sequence
  Synthetic
gtcaattcgcaccggactgcgtttcaaacccttgcccaaacc

SEQ ID NO: 2451 - DNA, 35 bp, Artificial Sequence
  Synthetic
tcctcaggctccgccacacccgctccttcgcatgg

SEQ ID NO: 2452 - DNA, 48 bp, Artificial Sequence
  Synthetic
cattggcaaaaatagcagcacaatattaaatcccaaaacagaaatgac

SEQ ID NO: 2453 - DNA, 35 bp, Artificial Sequence
  Synthetic
cgcaccttcgggcagactgggcaacgacagcgagg

SEQ ID NO: 2454 - DNA, 35 bp, Artificial Sequence
  Synthetic
ttgccggttcggaagccgcggtacgcgcatgacgg

SEQ ID NO: 2455 - DNA, 39 bp, Artificial Sequence
  Synthetic
cgcatgaagattggcttccgccttctgctggcggaatcg

SEQ ID NO: 2456 - DNA, 40 bp, Artificial Sequence
  Synthetic
cgcttcaaggtagccttttgccgatgtatctcggccggct

SEQ ID NO: 2457 - DNA, 35 bp, Artificial Sequence
  Synthetic
ggcgtgttggttgatgccgggctacggacacggca

SEQ ID NO: 2458 - DNA, 50 bp, Artificial Sequence
  Synthetic
gcgaaagtttccgtaaaaatatcggtcggattaatttgttcaatatcacc

SEQ ID NO: 2459 - DNA, 40 bp, Artificial Sequence
  Synthetic
ccgccgcccaagattggaatcttcaggaaagctttgccgc

SEQ ID NO: 2460 - DNA, 42 bp, Artificial Sequence
  Synthetic
acttcaaactgcgcggacaaccccaatccgtgcaaaaacagg

SEQ ID NO: 2461 - DNA, 38 bp, Artificial Sequence
  Synthetic
cgccgtacctatgcgtgtgaaagcattgtccgccacgc

SEQ ID NO: 2462 - DNA, 37 bp, Artificial Sequence
  Synthetic
acggtttcgtcgacggcacgtcggggatgatggcgac

SEQ ID NO: 2463 - DNA, 41 bp, Artificial Sequence
  Synthetic
gctctacttcgcagccgtcaacattgtggctgccggtaatc

SEQ ID NO: 2464 - DNA, 38 bp, Artificial Sequence
  Synthetic
tggtattcgtcatcggcatcgcgttaggcggcgtggca

SEQ ID NO: 2465 - DNA, 38 bp, Artificial Sequence
  Synthetic
gcatttccaatcccgacaccgtgccacgccgaagacga

SEQ ID NO: 2466 - DNA, 40 bp, Artificial Sequence
  Synthetic
catcgtcaggcgagcaaccggcttcccgattaccctgaaa

SEQ ID NO: 2467 - DNA, 38 bp, Artificial Sequence
  Synthetic
atcggacgaattggcacggattatgtcggtggcacggc

SEQ ID NO: 2468 - DNA, 37 bp, Artificial Sequence
  Synthetic
tgctcgacaacggcgttcccgttcggcgcaataaagc

SEQ ID NO: 2469 - DNA, 37 bp, Artificial Sequence
  Synthetic
cgtcgccgccataaaacgctcgaggtgtatgggcagg

SEQ ID NO: 2470 - DNA, 39 bp, Artificial Sequence
  Synthetic
atccgcagcccgacggttcctttcagacggcattggtcg

SEQ ID NO: 2471 - DNA, 38 bp, Artificial Sequence
  Synthetic
attgcgcgacatcgtccgaccgcccagccataaaacag

SEQ ID NO: 2472 - DNA, 40 bp, Artificial Sequence
  Synthetic
cgcccgataaagctgcgtaagtttgggcggatatttcggc

SEQ ID NO: 2473 - DNA, 41 bp, Artificial Sequence
  Synthetic
gcccgaaccgatgaagcaatccattttgcgcctgattccga

SEQ ID NO: 2474 - DNA, 37 bp, Artificial Sequence
  Synthetic
gccgattttgcctttgccgcgccttaccacatcgcgc

SEQ ID NO: 2475 - DNA, 40 bp, Artificial Sequence
  Synthetic
acgaagtggaagccgtgttggcgtcagcgtaaccatgtcg

SEQ ID NO: 2476 - DNA, 36 bp, Artificial Sequence
  Synthetic
agtcgaacccgccgccaagttgccggcaacaacgac

SEQ ID NO: 2477 - DNA, 42 bp, Artificial Sequence
  Synthetic
tcttcgcggaagatttcgccttcgcatccccttcctttatgc

SEQ ID NO: 2478 - DNA, 37 bp, Artificial Sequence
  Synthetic
agtccgctacacgcaaggccgctcgttgatgtagcgg

SEQ ID NO: 2479 - DNA, 38 bp, Artificial Sequence
  Synthetic
ggcttccaacgcgtcatccaggccaagcctttgcctgc

SEQ ID NO: 2480 - DNA, 40 bp, Artificial Sequence
  Synthetic
tgtcttcggcaaccacaccgacaattacccgcaaacacgt

SEQ ID NO: 2481 - DNA, 38 bp, Artificial Sequence
  Synthetic
gcgcattttgcccgaacgcaccacaacaaccgcatcct

SEQ ID NO: 2482 - DNA, 40 bp, Artificial Sequence
  Synthetic
aacggtctttgaggcggctgtatcgcgacgacttccatca

SEQ ID NO: 2483 - DNA, 34 bp, Artificial Sequence
  Synthetic
aagctcggcggcgcaaagcgttggaacaggcgca

SEQ ID NO: 2484 - DNA, 40 bp, Artificial Sequence
  Synthetic
cgaagccccggaatttgcctggcaaatgtggcgacatagc

SEQ ID NO: 2485 - DNA, 39 bp, Artificial Sequence
  Synthetic
gccaaaccgccgtggacatcaactcaaacaggttgcggg

SEQ ID NO: 2486 - DNA, 40 bp, Artificial Sequence
  Synthetic
cggaattccgcgcatttgcagaggtcaaactcgaaggcgg

SEQ ID NO: 2487 - DNA, 38 bp, Artificial Sequence
  Synthetic
ctgccctttctgcaaagccgttcagtgggcgaacgggt

SEQ ID NO: 2488 - DNA, 38 bp, Artificial Sequence
  Synthetic
gaacaggtattccggcgcggaccgcagggattacgcca

SEQ ID NO: 2489 - DNA, 39 bp, Artificial Sequence
  Synthetic
atcggcaggctgaaacactcggcaggattttatgtgctg

SEQ ID NO: 2490 - DNA, 37 bp, Artificial Sequence
  Synthetic
gcgcgctggatgccaaagttgtgatgaatgtcgcgca

SEQ ID NO: 2491 - DNA, 35 bp, Artificial Sequence
  Synthetic
gcgtgctgctgccggaaacgcgaacatcatgcccg

SEQ ID NO: 2492 - DNA, 41 bp, Artificial Sequence
  Synthetic
gctgaccactgaaaacacgcccgatgtagtaggcgtgttcc

SEQ ID NO: 2493 - DNA, 41 bp, Artificial Sequence
  Synthetic
accgtcatatgccttattgtcgtgggtaagaaggaacaggg

SEQ ID NO: 2494 - DNA, 40 bp, Artificial Sequence
  Synthetic
gcccggtcaaaagcgcaaaaagttccgatacctttgcgcc

SEQ ID NO: 2495 - DNA, 40 bp, Artificial Sequence
  Synthetic
agctacaccccgaaacatccgcaatcggggtctgacaggt

SEQ ID NO: 2496 - DNA, 38 bp, Artificial Sequence
  Synthetic
gcacggcgatgcggaagtgataagcggtttcgggatgg

SEQ ID NO: 2497 - DNA, 40 bp, Artificial Sequence
  Synthetic
gcggcggcggtttttgtagatgatggtacagaccgtgcgc

SEQ ID NO: 2498 - DNA, 35 bp, Artificial Sequence
  Synthetic
ccagcggtttgcaatcgcccggttgccaagcgtcc

SEQ ID NO: 2499 - DNA, 38 bp, Artificial Sequence
  Synthetic
taccgcgtctttgccgactgggacggtcgcagaaaagc

SEQ ID NO: 2500 - DNA, 38 bp, Artificial Sequence
  Synthetic
ccgatacggggtaaggcaggatgcctgtggacgcaacc

SEQ ID NO: 2501 - DNA, 35 bp, Artificial Sequence
  Synthetic
gtttgcgccgccgtctttgggcgcggttgccgtat

SEQ ID NO: 2502 - DNA, 37 bp, Artificial Sequence
  Synthetic
gttcctcgtaggctgcctgcgccgcaacaagaggccg

SEQ ID NO: 2503 - DNA, 37 bp, Artificial Sequence
  Synthetic
ggtcgtacagggcgttgccggtccttgaccgcgaacc

SEQ ID NO: 2504 - DNA, 46 bp, Artificial Sequence
  Synthetic
agtgccatttcattctaacttccttaaaacgctaatcataagaggg

SEQ ID NO: 2505 - DNA, 39 bp, Artificial Sequence
  Synthetic
gcttcatctgctttgtgcgggtcaggcatcgggagggat

SEQ ID NO: 2506 - DNA, 37 bp, Artificial Sequence
  Synthetic
cgaccacatcggacaatcccgcgcggcaggggttgtt

SEQ ID NO: 2507 - DNA, 41 bp, Artificial Sequence
  Synthetic
gtttccgttcgggcaatggttcccgcctgaaagaatcccat

SEQ ID NO: 2508 - DNA, 38 bp, Artificial Sequence
  Synthetic
gcccgtcgtcttccacgttgcgagatgcacggctcaaa

SEQ ID NO: 2509 - DNA, 41 bp, Artificial Sequence
  Synthetic
ggcggttacttttttgcctgccgttccgcccgaaaatctgc

SEQ ID NO: 2510 - DNA, 37 bp, Artificial Sequence
  Synthetic
gcagcttcggcttcggctgcaggacaatccgaacctg

SEQ ID NO: 2511 - DNA, 40 bp, Artificial Sequence
  Synthetic
cgcccgatataggcttccgcgacgatttcttcctcagcgt

SEQ ID NO: 2512 - DNA, 39 bp, Artificial Sequence
  Synthetic
cgttgacactgcccgcgaatcgatacgaacgtccgttac

SEQ ID NO: 2513 - DNA, 39 bp, Artificial Sequence
  Synthetic
ccctgcgtttcaagcccgatcggcaacatgaacgaagtg

SEQ ID NO: 2514 - DNA, 37 bp, Artificial Sequence
  Synthetic
tccaatacgccgcccagggcgcccgattacaggcttg

SEQ ID NO: 2515 - DNA, 41 bp, Artificial Sequence
  Synthetic
ccgcctgataaatgttgcgcgtgacgtgaaatccgacatcg

SEQ ID NO: 2516 - DNA, 36 bp, Artificial Sequence
  Synthetic
tcaaacccgcgttgcgcccctgacggctggttttcg

SEQ ID NO: 2517 - DNA, 36 bp, Artificial Sequence
  Synthetic
atcgcggctgtcctgctctgggcgtggaaatttcgg

SEQ ID NO: 2518 - DNA, 35 bp, Artificial Sequence
  Synthetic
cgggcgtgtgtctgaaccgcgtcgaggcagtccga

SEQ ID NO: 2519 - DNA, 41 bp, Artificial Sequence
  Synthetic
cgaacgggaacacatccgccttttatcgtgaatgccgaccg

SEQ ID NO: 2520 - DNA, 37 bp, Artificial Sequence
  Synthetic
cggcaagaagcggcggtatgttgccttgtgttgccgt

SEQ ID NO: 2521 - DNA, 41 bp, Artificial Sequence
  Synthetic
cggacaggagggcgtttgatgtggggtcgaaggcaagatgg

SEQ ID NO: 2522 - DNA, 36 bp, Artificial Sequence
  Synthetic
gcgggggcttcgagtttcgggactggtatcgcgcca

SEQ ID NO: 2523 - DNA, 35 bp, Artificial Sequence
  Synthetic
acaccgccgcaccgtatccccggcgcgtggcaata

SEQ ID NO: 2524 - DNA, 35 bp, Artificial Sequence
  Synthetic
ttcccaccgcttccccgacgatgtgattcgggcgg

SEQ ID NO: 2525 - DNA, 36 bp, Artificial Sequence
  Synthetic
tccgggcggttttggcgtgttcacgaagccgatgcc

SEQ ID NO: 2526 - DNA, 38 bp, Artificial Sequence
  Synthetic
gccttgagcttgtcgattgccgacgcatcgcacttgcc

SEQ ID NO: 2527 - DNA, 39 bp, Artificial Sequence
  Synthetic
cgcccatcaaccccatcactgcccgattcttgccgttgc

SEQ ID NO: 2528 - DNA, 40 bp, Artificial Sequence
  Synthetic
gcgaagtgggcgaactgatcgtgcggcaggcatattgagg

SEQ ID NO: 2529 - DNA, 34 bp, Artificial Sequence
  Synthetic
ttttggcgggcgcggtgtcggcgggaaaatgcgc

SEQ ID NO: 2530 - DNA, 38 bp, Artificial Sequence
  Synthetic
ggctggcaggcgagttttctcaagcactgccatcaccg

SEQ ID NO: 2531 - DNA, 41 bp, Artificial Sequence
  Synthetic
cgacaggggttctttttgctctagatcgtcaaagtttagca

SEQ ID NO: 2532 - DNA, 38 bp, Artificial Sequence
  Synthetic
ttttcgcaaatcttccgccccggcgagattctgaactt

SEQ ID NO: 2533 - DNA, 36 bp, Artificial Sequence
  Synthetic
caggaaatcatcgcgcgcgacaataccgccaagccg

SEQ ID NO: 2534 - DNA, 35 bp, Artificial Sequence
  Synthetic
gcacatcgcccccgaaacccgccacgcgttttcgg

SEQ ID NO: 2535 - DNA, 35 bp, Artificial Sequence
  Synthetic
actgccgacgtgcttgccctgccttgtccgagccg

SEQ ID NO: 2536 - DNA, 35 bp, Artificial Sequence
  Synthetic
cgccgacgcccgatttcacgcagcatcgcggtgga

SEQ ID NO: 2537 - DNA, 42 bp, Artificial Sequence
  Synthetic
cggaagacaaatccatgccgccatctgtggcgcatcaaaacc

SEQ ID NO: 2538 - DNA, 36 bp, Artificial Sequence
  Synthetic
atcagcgcgggcttgtgccgcacaaggtgcggcagt

SEQ ID NO: 2539 - DNA, 40 bp, Artificial Sequence
  Synthetic
cttgcattggaagccttgggcgcgttgacgtgatccatcg

SEQ ID NO: 2540 - DNA, 41 bp, Artificial Sequence
  Synthetic
gctggccggaaaccatatctcgaaaacgctgcaaaatgaac

SEQ ID NO: 2541 - DNA, 39 bp, Artificial Sequence
  Synthetic
tccacccgcacccgaccttatacacccaaagccacttcc

SEQ ID NO: 2542 - DNA, 35 bp, Artificial Sequence
  Synthetic
ccgtacgacgctgaacggctcggcctggatgtggc

SEQ ID NO: 2543 - DNA, 40 bp, Artificial Sequence
  Synthetic
ggcatcagcagctccacgctaaagtcgaaaacgtcgtgcg

SEQ ID NO: 2544 - DNA, 38 bp, Artificial Sequence
  Synthetic
ctccgatcggcaactggcaagaagaggtcagcgcgatg

SEQ ID NO: 2545 - DNA, 39 bp, Artificial Sequence
  Synthetic
aaggcgcatctgctcgatgtggccgcgatttgttcatcg

SEQ ID NO: 2546 - DNA, 37 bp, Artificial Sequence
  Synthetic
cgccgcgttcgtactgcatggacaccatcgagcagcg

SEQ ID NO: 2547 - DNA, 35 bp, Artificial Sequence
  Synthetic
atcaggctgcggtgggagcagtgtccctcgtcgcc

SEQ ID NO: 2548 - DNA, 37 bp, Artificial Sequence
  Synthetic
aaggcggtgcggacgttgttgaccgaatgctgcatca

SEQ ID NO: 2549 - DNA, 38 bp, Artificial Sequence
  Synthetic
cggtgaaacacggcatttggttgacggcatcgacgtgg

SEQ ID NO: 2550 - DNA, 34 bp, Artificial Sequence
  Synthetic
ggcgggcggcaaagtgttcgcggtacaccacgct

SEQ ID NO: 2551 - DNA, 38 bp, Artificial Sequence
  Synthetic
gcagcagcaatgtcggcattacagaaagccggtgtgga

SEQ ID NO: 2552 - DNA, 37 bp, Artificial Sequence
  Synthetic
cccgcccataaagccatcggcgccggagagtgcaatc

SEQ ID NO: 2553 - DNA, 40 bp, Artificial Sequence
  Synthetic
gctcgacagccttgccgacatttgtaggcaataagcgcgg

SEQ ID NO: 2554 - DNA, 35 bp, Artificial Sequence
  Synthetic
tgtttgccgcgctgatccgccggcggcagcagttt

SEQ ID NO: 2555 - DNA, 40 bp, Artificial Sequence
  Synthetic
cgacaggcagggagtcggcatacctgacggtcttcagccc

SEQ ID NO: 2556 - DNA, 39 bp, Artificial Sequence
  Synthetic
cggtgtcaacgataaggcacgggaacatctttgaccagt

SEQ ID NO: 2557 - DNA, 43 bp, Artificial Sequence
  Synthetic
accgtaaacgcaggtctgaaatttgagcgtttttgaattcagc

SEQ ID NO: 2558 - DNA, 38 bp, Artificial Sequence
  Synthetic
gcagcgcaacctcaaaccgaaacctgcgcgagtgttgc

SEQ ID NO: 2559 - DNA, 39 bp, Artificial Sequence
  Synthetic
cgacatctcgacggcaaccggttcaggttgttgaggcgt

SEQ ID NO: 2560 - DNA, 36 bp, Artificial Sequence
  Synthetic
cgcccttgcccaacgctatagcggtattgacggcgg

SEQ ID NO: 2561 - DNA, 38 bp, Artificial Sequence
  Synthetic
tggaaatccgcggcgcaggcgacctgcatcatttcgcc

SEQ ID NO: 2562 - DNA, 38 bp, Artificial Sequence
  Synthetic
cgaccacgcttctggtcgaggggaaatcggcgaaacgg

SEQ ID NO: 2563 - DNA, 33 bp, Artificial Sequence
  Synthetic
tcgccctgcacaagctcgttcggcggctttgcg

SEQ ID NO: 2564 - DNA, 37 bp, Artificial Sequence
  Synthetic
tgttgttcgtaccggttgccaccccgccaaaaacggc

SEQ ID NO: 2565 - DNA, 39 bp, Artificial Sequence
  Synthetic
tcctcgccgcctacatccattccgaagatgaagttgccg

SEQ ID NO: 2566 - DNA, 39 bp, Artificial Sequence
  Synthetic
tacagcacccgccacctgcttgttttcggtaatgctgcg

SEQ ID NO: 2567 - DNA, 38 bp, Artificial Sequence
  Synthetic
cgatctcatccgtatcgccccgcgttggagggcgacga

SEQ ID NO: 2568 - DNA, 39 bp, Artificial Sequence
  Synthetic
ggtatcgccgtcggtatggccgttgatggtgtcggtgag

SEQ ID NO: 2569 - DNA, 38 bp, Artificial Sequence
  Synthetic
gcaacgacgaactggcgcactcttcggtggtcatgcgg

SEQ ID NO: 2570 - DNA, 39 bp, Artificial Sequence
  Synthetic
ccaagttcgcccaatacctgctcgccgagtttcagcgtg

SEQ ID NO: 2571 - DNA, 42 bp, Artificial Sequence
  Synthetic
cgggcatcgttgcttttcattcatagtaacggatgtggaaag

SEQ ID NO: 2572 - DNA, 38 bp, Artificial Sequence
  Synthetic
tgcccctgcccgatgacataatgcaaactgcccacgcc

SEQ ID NO: 2573 - DNA, 42 bp, Artificial Sequence
  Synthetic
cgcagtcaggggcagaaacttcgaacaagcctgttttcctgc

SEQ ID NO: 2574 - DNA, 37 bp, Artificial Sequence
  Synthetic
atggtaggcagcacgcgcgacaaattcacacgggcgg

SEQ ID NO: 2575 - DNA, 40 bp, Artificial Sequence
  Synthetic
cggcgcattggcaaaaggtcgctttatcaggcgatggagg

SEQ ID NO: 2576 - DNA, 42 bp, Artificial Sequence
  Synthetic
cggcgtttcaaggtggttacgagtatcggcatcgttaccagt

SEQ ID NO: 2577 - DNA, 39 bp, Artificial Sequence
  Synthetic
cgcacgaccggttcttcgttaagattgtctgtcgcggcg

SEQ ID NO: 2578 - DNA, 37 bp, Artificial Sequence
  Synthetic
ggcgggaatggcggcaaatatcatcggcttctgcgtg

SEQ ID NO: 2579 - DNA, 39 bp, Artificial Sequence
  Synthetic
ccagaccgatatgccgtcgccgccatatccgacgcttac

SEQ ID NO: 2580 - DNA, 36 bp, Artificial Sequence
  Synthetic
ggtttgcgcccgcatgtgggcgtttaccggttcgac

SEQ ID NO: 2581 - DNA, 36 bp, Artificial Sequence
  Synthetic
aaccaccccgacccctgtgcgtttcaaacggcgcgg

SEQ ID NO: 2582 - DNA, 38 bp, Artificial Sequence
  Synthetic
gcagcgaacacgatacccgtatgagcagggcgcatcga

SEQ ID NO: 2583 - DNA, 38 bp, Artificial Sequence
  Synthetic
ggcaaagcaaccttagccgcgcacgatggaagcaggaa

SEQ ID NO: 2584 - DNA, 33 bp, Artificial Sequence
  Synthetic
atcaccgcgccgctgcaattggcggcctgcagt

SEQ ID NO: 2585 - DNA, 44 bp, Artificial Sequence
  Synthetic
accgcctttaaacaattgaaagaaatccgtatctggttaaacgg

SEQ ID NO: 2586 - DNA, 41 bp, Artificial Sequence
  Synthetic
tcgacattaccgaacaccgcaaagggtcagtccgatttcgt

SEQ ID NO: 2587 - DNA, 41 bp, Artificial Sequence
  Synthetic
ccagcttcgccgacatcttctttcttcggtcaacacgatgg

SEQ ID NO: 2588 - DNA, 41 bp, Artificial Sequence
  Synthetic
aatcccgccgaagaaaccgatatatattcgagtgcgcgctc

SEQ ID NO: 2589 - DNA, 36 bp, Artificial Sequence
  Synthetic
tccacccacggcgcattcgtcgccatcgtgtgttcg

SEQ ID NO: 2590 - DNA, 38 bp, Artificial Sequence
  Synthetic
agcgcgccaaatcgaccgtttggcaatccttttacgcg

SEQ ID NO: 2591 - DNA, 39 bp, Artificial Sequence
  Synthetic
cggatagacaagttcgcccgccggcaggcgttttctacc

SEQ ID NO: 2592 - DNA, 41 bp, Artificial Sequence
  Synthetic
gcgtgccattatgggtttccacgaccaaatccgcctgtacg

SEQ ID NO: 2593 - DNA, 38 bp, Artificial Sequence
  Synthetic
aaatgccggcgatgaaggtcaccgggtcggtatggaca

SEQ ID NO: 2594 - DNA, 35 bp, Artificial Sequence
  Synthetic
ttgtcttgcccacgcccggcggtggaaggcgggaa

SEQ ID NO: 2595 - DNA, 37 bp, Artificial Sequence
  Synthetic
ggatttgcgcgcccaagctcgcgccgtctgaaaatcc

SEQ ID NO: 2596 - DNA, 37 bp, Artificial Sequence
  Synthetic
tctttgacgaagcggcgcattgccgccgccaaatcca

SEQ ID NO: 2597 - DNA, 38 bp, Artificial Sequence
  Synthetic
ccaaagcccttgatcgcgtccggtgtggtgcaggagga

SEQ ID NO: 2598 - DNA, 34 bp, Artificial Sequence
  Synthetic
gattcccgccgccgtcatgcatacgcgccatcgt

SEQ ID NO: 2599 - DNA, 40 bp, Artificial Sequence
  Synthetic
tgcctgaaacggctaaatcctatcgattcaaaacactggc

SEQ ID NO: 2600 - DNA, 41 bp, Artificial Sequence
  Synthetic
cctgcactcatcaatcctgatttaacccaaactcaaagcca

SEQ ID NO: 2601 - DNA, 38 bp, Artificial Sequence
  Synthetic
gccatttgccgatgattggggcccccggcaggagcatt

SEQ ID NO: 2602 - DNA, 37 bp, Artificial Sequence
  Synthetic
tgttgtcgttgtgggcgggcggctttgtgcagattgc

SEQ ID NO: 2603 - DNA, 38 bp, Artificial Sequence
  Synthetic
ccgggtttcacatcgccgtatgagcgacgctttaccga

SEQ ID NO: 2604 - DNA, 41 bp, Artificial Sequence
  Synthetic
ggaacacggcatcgacacactcagagggctttgagcatcgc

SEQ ID NO: 2605 - DNA, 35 bp, Artificial Sequence
  Synthetic
gcgcatcgatttgggcgcggaagccggcgaagagt

SEQ ID NO: 2606 - DNA, 36 bp, Artificial Sequence
  Synthetic
cgtatgtccggcgcgtcaggtcagggcttcgggcgt

SEQ ID NO: 2607 - DNA, 38 bp, Artificial Sequence
  Synthetic
cagcgcgaagtgttggcggcgacgcagataaaatcgcg

SEQ ID NO: 2608 - DNA, 40 bp, Artificial Sequence
  Synthetic
cgtgccacttgttgccgtcgcactcttggggtcctgaagc

SEQ ID NO: 2609 - DNA, 38 bp, Artificial Sequence
  Synthetic
gagccgtccacgttggagacgcgctcaaacctttcggt

SEQ ID NO: 2610 - DNA, 38 bp, Artificial Sequence
  Synthetic
atttcgtggtgtccgggcagcacccccatcgacctgat

SEQ ID NO: 2611 - DNA, 41 bp, Artificial Sequence
  Synthetic
cactcttcgccattcccgcgatttccgatagattcctgccg

SEQ ID NO: 2612 - DNA, 37 bp, Artificial Sequence
  Synthetic
caacgtcggcgcactggaccggtcggctttttcctgc

SEQ ID NO: 2613 - DNA, 39 bp, Artificial Sequence
  Synthetic
acggacgcgggcaagacactgaacaggatgttgcggatg

SEQ ID NO: 2614 - DNA, 36 bp, Artificial Sequence
  Synthetic
acgagtgcggctacggaatccgacacgctcgtccgt

SEQ ID NO: 2615 - DNA, 38 bp, Artificial Sequence
  Synthetic
cgcgggaatccggtaaccgaaacggcgggggtttctgt

SEQ ID NO: 2616 - DNA, 36 bp, Artificial Sequence
  Synthetic
acgcctacctgctgaccggcaaggatgcgggcgatg

SEQ ID NO: 2617 - DNA, 40 bp, Artificial Sequence
  Synthetic
gttccacacgctcaacaaagccttgctgacgctttcggtc

SEQ ID NO: 2618 - DNA, 39 bp, Artificial Sequence
  Synthetic
aagtcatgctccatgccgtcaaggtgtcagtgcgttgtg

SEQ ID NO: 2619 - DNA, 39 bp, Artificial Sequence
  Synthetic
tggctgcggtacacaatgccgcagcccgcatgtttttcc

SEQ ID NO: 2620 - DNA, 39 bp, Artificial Sequence
  Synthetic
gcatcgccaaccgcctgttgacgccgttgtttttcacgt

SEQ ID NO: 2621 - DNA, 42 bp, Artificial Sequence
  Synthetic
gcgcaccttatcgccgaacaaacgaaacgttttttgcagcgg

SEQ ID NO: 2622 - DNA, 37 bp, Artificial Sequence
  Synthetic
agctgatgcggcagatggtgcagacgcgttcggcaac

SEQ ID NO: 2623 - DNA, 37 bp, Artificial Sequence
  Synthetic
ccttcatcgcccgatacggcgcttcggcgacaacagc

SEQ ID NO: 2624 - DNA, 45 bp, Artificial Sequence
  Synthetic
cgaatgctgcaaatttgtttgatgagccgtattgtttcatcatct

SEQ ID NO: 2625 - DNA, 40 bp, Artificial Sequence
  Synthetic
ccaagccaaaccggtaacctgtcgcttcgattacggcgtt

SEQ ID NO: 2626 - DNA, 39 bp, Artificial Sequence
  Synthetic
gcgtgggtcattttggcgttgttggacatcgcgcattgg

SEQ ID NO: 2627 - DNA, 41 bp, Artificial Sequence
  Synthetic
atgaccaaggacaaaatggacttgtaggggaggttgttctg

SEQ ID NO: 2628 - DNA, 43 bp, Artificial Sequence
  Synthetic
cgccaagcgtaaaccattcattatcggataacatctccttcaa

SEQ ID NO: 2629 - DNA, 47 bp, Artificial Sequence
  Synthetic
gctttggttccttcacatgtcagaagtaatcattaaattcggatccg

SEQ ID NO: 2630 - DNA, 42 bp, Artificial Sequence
  Synthetic
acacggtgcttgatacctttcaacaaatgtgggtgacaatcg

SEQ ID NO: 2631 - DNA, 40 bp, Artificial Sequence
  Synthetic
ggactactgtggctaccgtaaattgggtatctaggccact

SEQ ID NO: 2632 - DNA, 47 bp, Artificial Sequence
  Synthetic
ctgaatttttcagttgcctcacctttgaaaccacttctgatttacct

SEQ ID NO: 2633 - DNA, 45 bp, Artificial Sequence
  Synthetic
ttgtctgtttgggtgtatgaatcatcctgattcatttttctctgg

SEQ ID NO: 2634 - DNA, 44 bp, Artificial Sequence
  Synthetic
gccaaagtaaatggtactaaagctgctccaaagtaatcggttcg

SEQ ID NO: 2635 - DNA, 40 bp, Artificial Sequence
  Synthetic
accgcccggacagcttttgatacacgccaaatcgcaaggt

SEQ ID NO: 2636 - DNA, 38 bp, Artificial Sequence
  Synthetic
cgtggaagaaggcggcaaggtacctccgcgctgatgca

SEQ ID NO: 2637 - DNA, 39 bp, Artificial Sequence
  Synthetic
ctttggcagtggcgatgttgccgtgcgttgggtcaaaga

SEQ ID NO: 2638 - DNA, 39 bp, Artificial Sequence
  Synthetic
ccgtcggcaatcagcggaacctgaccgccattcacaacg

SEQ ID NO: 2639 - DNA, 38 bp, Artificial Sequence
  Synthetic
cttggctcatcgcgcccaagtaccaaggccgctcgtac

SEQ ID NO: 2640 - DNA, 35 bp, Artificial Sequence
  Synthetic
cgttcgatgcgcccctgatcgtccgccaagatgcc

SEQ ID NO: 2641 - DNA, 36 bp, Artificial Sequence
  Synthetic
acgggtttgacgatgcccgggacgcgataccgacga

SEQ ID NO: 2642 - DNA, 38 bp, Artificial Sequence
  Synthetic
ccgatgaccttgcccgcttcgcctgaacatccccacca

SEQ ID NO: 2643 - DNA, 36 bp, Artificial Sequence
  Synthetic
cgcttcggtcaggcagttcagacctgcggctcgtgt

SEQ ID NO: 2644 - DNA, 38 bp, Artificial Sequence
  Synthetic
tcgtccacgcctgcggttgtcttattcggcaacatcgc

SEQ ID NO: 2645 - DNA, 37 bp, Artificial Sequence
  Synthetic
atcctcgccgtcctcgagccgggcggacttcatcgtg

SEQ ID NO: 2646 - DNA, 39 bp, Artificial Sequence
  Synthetic
atatgccggactcgcgccgggaaacgccgaaattttccg

SEQ ID NO: 2647 - DNA, 40 bp, Artificial Sequence
  Synthetic
acacggtgagggacgaagcctccgaaccgtctttctgtgc

SEQ ID NO: 2648 - DNA, 39 bp, Artificial Sequence
  Synthetic
ttgtgcggacgcgtggtcgatgtccaacaagaaatgcgc

SEQ ID NO: 2649 - DNA, 41 bp, Artificial Sequence
  Synthetic
ccggacagatattgccggtgtacatcggatgctcttccaga

SEQ ID NO: 2650 - DNA, 35 bp, Artificial Sequence
  Synthetic
agccgtggtcgaagccgatgtccaactcgagggcg

SEQ ID NO: 2651 - DNA, 41 bp, Artificial Sequence
  Synthetic
gcaattccaccatccccaccgggtctgaccgtctttgaagg

SEQ ID NO: 2652 - DNA, 36 bp, Artificial Sequence
  Synthetic
acctaccgccgccgcaatcgacaaacgtgccttccg

SEQ ID NO: 2653 - DNA, 38 bp, Artificial Sequence
  Synthetic
tatcggcatcaggcagcagctccaaatcaaacgcgccc

SEQ ID NO: 2654 - DNA, 37 bp, Artificial Sequence
  Synthetic
ggcggcatcgaaggcttcgcgtctgaacaccctcccg

SEQ ID NO: 2655 - DNA, 37 bp, Artificial Sequence
  Synthetic
gctgcgtgaggactcggtcgcatcgcttttgccgccg

SEQ ID NO: 2656 - DNA, 37 bp, Artificial Sequence
  Synthetic
caaaccgcaaaccgtccgcagcacggacagggatcgt

SEQ ID NO: 2657 - DNA, 38 bp, Artificial Sequence
  Synthetic
aggacggggtgctgaaacaccgaccaaccgaccgattc

SEQ ID NO: 2658 - DNA, 36 bp, Artificial Sequence
  Synthetic
tctgttcattgtcccgcgccggcgcaacggccttac

SEQ ID NO: 2659 - DNA, 41 bp, Artificial Sequence
  Synthetic
gcgtgcggattgaaatgcatctgctttggcactgaaaagcg

SEQ ID NO: 2660 - DNA, 39 bp, Artificial Sequence
  Synthetic
ggtatccgaacacctgccgactcgcctcgggattgaaca

SEQ ID NO: 2661 - DNA, 41 bp, Artificial Sequence
  Synthetic
tggttttgtctgcctatgccgtctatctgaagtccgagcgc

SEQ ID NO: 2662 - DNA, 40 bp, Artificial Sequence
  Synthetic
tgcgagaattggcggaggaaaaaaactgtacagcaggcgc

SEQ ID NO: 2663 - DNA, 39 bp, Artificial Sequence
  Synthetic
gcgcatcgtcatccggcatttttcgtcatccgttaccgc

SEQ ID NO: 2664 - DNA, 40 bp, Artificial Sequence
  Synthetic
gcctcgctgccttcgagattcctactggtacatcgacacg

SEQ ID NO: 2665 - DNA, 38 bp, Artificial Sequence
  Synthetic
acgacggacagcaaaacgcccccgaacacctgcaacaa

SEQ ID NO: 2666 - DNA, 40 bp, Artificial Sequence
  Synthetic
aaagccgcgagtggtcatggaaaaccgttcgttacctccg

SEQ ID NO: 2667 - DNA, 41 bp, Artificial Sequence
  Synthetic
gttcagacggcattttgtatggagcgacaaataccccgttt

SEQ ID NO: 2668 - DNA, 39 bp, Artificial Sequence
  Synthetic
tcttcgaggcgttcgcgggtcgtttatgctgatccctcg

SEQ ID NO: 2669 - DNA, 42 bp, Artificial Sequence
  Synthetic
cgggtaatctttccgaaaccgtttcaatatagccaaggggat

SEQ ID NO: 2670 - DNA, 39 bp, Artificial Sequence
  Synthetic
agcctgctttgcgtatccacggcgactgcgtgtccattg

SEQ ID NO: 2671 - DNA, 40 bp, Artificial Sequence
  Synthetic
aggtattcgagataggcgcgggtcgtcaacagcgtcgtcg

SEQ ID NO: 2672 - DNA, 36 bp, Artificial Sequence
  Synthetic
acgaatcgccgtcttgcgccacgcgctgaaggaggt

SEQ ID NO: 2673 - DNA, 35 bp, Artificial Sequence
  Synthetic
acccccaagccgcattggattgccgggaaacacgc

SEQ ID NO: 2674 - DNA, 38 bp, Artificial Sequence
  Synthetic
tttgccgtcttcgatgcccaactgcccaaaagcgtacc

SEQ ID NO: 2675 - DNA, 38 bp, Artificial Sequence
  Synthetic
ttgccgaagccagatcgcacgttctttggcggcttcgt

SEQ ID NO: 2676 - DNA, 39 bp, Artificial Sequence
  Synthetic
tcgaccaaatcgccgatggggcggcgattatcatctgca

SEQ ID NO: 2677 - DNA, 37 bp, Artificial Sequence
  Synthetic
tcctttcgggcgcgagactaaaatcggtgcggacgtg

SEQ ID NO: 2678 - DNA, 37 bp, Artificial Sequence
  Synthetic
tccgcatcagccacatcggatgagtccgaggctgtgg

SEQ ID NO: 2679 - DNA, 38 bp, Artificial Sequence
  Synthetic
ccgataccacacccgaatacgcgccattgcaggcggtt

SEQ ID NO: 2680 - DNA, 34 bp, Artificial Sequence
  Synthetic
tgggcaagccattccgccttgccgatgttgccgc

SEQ ID NO: 2681 - DNA, 34 bp, Artificial Sequence
  Synthetic
cctcaaccgccgcatgcacgagtatggtggcgcg

SEQ ID NO: 2682 - DNA, 40 bp, Artificial Sequence
  Synthetic
ccgctgattgcaccgctcattggtgttccaaagcagtacc

SEQ ID NO: 2683 - DNA, 41 bp, Artificial Sequence
  Synthetic
caccgtaagcgagcgtcaacttgtattcctgatttccggcc

SEQ ID NO: 2684 - DNA, 43 bp, Artificial Sequence
  Synthetic
ggtactgcttcctttgccggctttgttatcgacttcaatttgg

SEQ ID NO: 2685 - DNA, 38 bp, Artificial Sequence
  Synthetic
ccttcggcgtgcatttggacagcgccgcataacctctt

SEQ ID NO: 2686 - DNA, 41 bp, Artificial Sequence
  Synthetic
cgatgtttgggcaaagtggctgagcagtagggtcatcaggc

SEQ ID NO: 2687 - DNA, 35 bp, Artificial Sequence
  Synthetic
tcaggtgcgcgctcatcgggacagccagcgcatcg

SEQ ID NO: 2688 - DNA, 37 bp, Artificial Sequence
  Synthetic
acatcaatgccaagccgggctcgccctgatagccgtc

SEQ ID NO: 2689 - DNA, 37 bp, Artificial Sequence
  Synthetic
tcacccacgccgtgctgtcgatatgggcggcgagtcc

SEQ ID NO: 2690 - DNA, 34 bp, Artificial Sequence
  Synthetic
tccgcgccggctttttcgggggcgaacaacaccg

SEQ ID NO: 2691 - DNA, 36 bp, Artificial Sequence
  Synthetic
gcaaagagtttcggggcggctgctctgcggcggaca

SEQ ID NO: 2692 - DNA, 39 bp, Artificial Sequence
  Synthetic
cggatatttctgcctgcccgttgaacccgtataccaacc

SEQ ID NO: 2693 - DNA, 39 bp, Artificial Sequence
  Synthetic
ccgtctggttgcgttggcgcggtagctaagacgacgtcc

SEQ ID NO: 2694 - DNA, 37 bp, Artificial Sequence
  Synthetic
cgggaactgggtgtgggaaatcatttcgcgcgcaccc

SEQ ID NO: 2695 - DNA, 38 bp, Artificial Sequence
  Synthetic
aaagtgcgtcaaggcagagtctacctcttcgcgacgct

SEQ ID NO: 2696 - DNA, 39 bp, Artificial Sequence
  Synthetic
aaatcccgtcccgcacgcgacgagcaaatgaaactggcg

SEQ ID NO: 2697 - DNA, 40 bp, Artificial Sequence
  Synthetic
tgcgccccctcatgattgagcggaatcgtacaggaagacg

SEQ ID NO: 2698 - DNA, 34 bp, Artificial Sequence
  Synthetic
tgccgcgcacgatgcttgcgcgtggcaggaacac

SEQ ID NO: 2699 - DNA, 34 bp, Artificial Sequence
  Synthetic
acgtcggtcagggcaacgcaaaaggccgcgctcg

SEQ ID NO: 2700 - DNA, 40 bp, Artificial Sequence
  Synthetic
atggttttgcccggcgagtcgaaactggtcgaatgcaacg

SEQ ID NO: 2701 - DNA, 40 bp, Artificial Sequence
  Synthetic
gggcgaggaatagtcgatgacggatgcgcgtttcggcata

SEQ ID NO: 2702 - DNA, 41 bp, Artificial Sequence
  Synthetic
cgtagaagcggctgaacagggtcgtatccgcactacctcgc

SEQ ID NO: 2703 - DNA, 38 bp, Artificial Sequence
  Synthetic
ggtcagcagtgccaaaacccaaggctgctgctgtccct

SEQ ID NO: 2704 - DNA, 38 bp, Artificial Sequence
  Synthetic
aaacggcatattcgcccgcgtttcgcaccctcttccgt

SEQ ID NO: 2705 - DNA, 41 bp, Artificial Sequence
  Synthetic
cgtacccgaaaacgaatacatcgccaaggcttcgatgaaga

SEQ ID NO: 2706 - DNA, 35 bp, Artificial Sequence
  Synthetic
ggtttggcggcggaaaccgtcagacggcaggcagc

SEQ ID NO: 2707 - DNA, 43 bp, Artificial Sequence
  Synthetic
gcatcgtattgactgcctttcaaccgatttgcacaaattaacc

SEQ ID NO: 2708 - DNA, 41 bp, Artificial Sequence
  Synthetic
ccaattcgtgcgtgtcttcaatttcggatttaattgacccg

SEQ ID NO: 2709 - DNA, 38 bp, Artificial Sequence
  Synthetic
aaccgaagtcaaaccgccgggcgatgaagcgtgggatt

SEQ ID NO: 2710 - DNA, 45 bp, Artificial Sequence
  Synthetic
cacagggtcaaaatacagttcagtctaccattgatattgtgtgct

SEQ ID NO: 2711 - DNA, 41 bp, Artificial Sequence
  Synthetic
ggacagtttggcagacggtgtgaatttgggcaaagaccccg

SEQ ID NO: 2712 - DNA, 45 bp, Artificial Sequence
  Synthetic
gtgccaccgtcttttttgtgatctttgattgataatggtgaaacg

SEQ ID NO: 2713 - DNA, 41 bp, Artificial Sequence
  Synthetic
tcgggcttttggtcattttcagaaacaattactggcgtgtc

SEQ ID NO: 2714 - DNA, 39 bp, Artificial Sequence
  Synthetic
ccgtcttggttttccagtgcaaaagggatacgcaaccat

SEQ ID NO: 2715 - DNA, 38 bp, Artificial Sequence
  Synthetic
tcgaattgcagcgtgaatgcgccgccgtactgctggct

SEQ ID NO: 2716 - DNA, 35 bp, Artificial Sequence
  Synthetic
tcggtggtccgctcggaagacaccgacgctgacct

SEQ ID NO: 2717 - DNA, 39 bp, Artificial Sequence
  Synthetic
atccattccctctcccgtggaatatttccgttgccgtcc

SEQ ID NO: 2718 - DNA, 43 bp, Artificial Sequence
  Synthetic
ctcaaaaaataccagcccgagagtatctgccagttttccttgt

SEQ ID NO: 2719 - DNA, 39 bp, Artificial Sequence
  Synthetic
gcgcgttgagatagacggcgagccgaaatgcgtaccggc

SEQ ID NO: 2720 - DNA, 37 bp, Artificial Sequence
  Synthetic
gcggagaactgtttgaccgcgggctcgcccgaatcca

SEQ ID NO: 2721 - DNA, 42 bp, Artificial Sequence
  Synthetic
acgccgtctgaaaaaacctttttgttttgcagtaaatcgaga

SEQ ID NO: 2722 - DNA, 39 bp, Artificial Sequence
  Synthetic
gccatgcgcccaaacagatgttgtcctttgtaagcggcg

SEQ ID NO: 2723 - DNA, 42 bp, Artificial Sequence
  Synthetic
gcgcctgctgcttaagatatgcaagcagtcgaaaatcaggcg

SEQ ID NO: 2724 - DNA, 39 bp, Artificial Sequence
  Synthetic
tttccagtcgccgccgtctaaggtcgaaatcgccaaacg

SEQ ID NO: 2725 - DNA, 40 bp, Artificial Sequence
  Synthetic
aaacacccgcttcaaaacccactcggggaatcagaagcgg

SEQ ID NO: 2726 - DNA, 37 bp, Artificial Sequence
  Synthetic
tttgaccgcgccgacacgtgacgaaagaggcggaaca

SEQ ID NO: 2727 - DNA, 38 bp, Artificial Sequence
  Synthetic
aaacggcggtcgattttgtcgccgtgtcaagatggaaa

SEQ ID NO: 2728 - DNA, 34 bp, Artificial Sequence
  Synthetic
tgccgcccgtgcaaactgtgcagacggcggaaca

SEQ ID NO: 2729 - DNA, 40 bp, Artificial Sequence
  Synthetic
acgaaccgttgggctacatcaagtcgagaccgcctgtttc

SEQ ID NO: 2730 - DNA, 42 bp, Artificial Sequence
  Synthetic
tcttcgccgtaaattaccgccaaatcggcgagatttccatcg

SEQ ID NO: 2731 - DNA, 38 bp, Artificial Sequence
  Synthetic
ccgaacttgctgtccactccgcgtaccacgctgctgac

SEQ ID NO: 2732 - DNA, 39 bp, Artificial Sequence
  Synthetic
ggaatgtgccgctgccgaaccgtcctattatgtccgtcg

SEQ ID NO: 2733 - DNA, 39 bp, Artificial Sequence
  Synthetic
cctgttgggtttgcgcgatgacgtatcggacgggttgga

SEQ ID NO: 2734 - DNA, 38 bp, Artificial Sequence
  Synthetic
tcttgatgggcgtcttgcgtatgtgctcctggcgcaga

SEQ ID NO: 2735 - DNA, 38 bp, Artificial Sequence
  Synthetic
atcagaagcggtagcgcacgacgcttggaaaacacccg

SEQ ID NO: 2736 - DNA, 42 bp, Artificial Sequence
  Synthetic
ccgataagtttccgtgcggacaatctcgaaacccgtcattcc

SEQ ID NO: 2737 - DNA, 37 bp, Artificial Sequence
  Synthetic
ctcttgtcgtgcggacggtttgcccgcctgagcaaca

SEQ ID NO: 2738 - DNA, 39 bp, Artificial Sequence
  Synthetic
aaacgatacggcaagcgcgacgaagaaaaccacctgcgt

SEQ ID NO: 2739 - DNA, 36 bp, Artificial Sequence
  Synthetic
cctgtcaagcccgtgtgcagggaagctgcccgaagc

SEQ ID NO: 2740 - DNA, 38 bp, Artificial Sequence
  Synthetic
ggcggatgatacggaggctttggccgccgtttcccgtt

SEQ ID NO: 2741 - DNA, 39 bp, Artificial Sequence
  Synthetic
gcgggggtgcgaaggaaataaggaaccaccgtatccaca

SEQ ID NO: 2742 - DNA, 36 bp, Artificial Sequence
  Synthetic
gcgcgtttccccgttgacggcgcgataatcggcagg

SEQ ID NO: 2743 - DNA, 36 bp, Artificial Sequence
  Synthetic
tcggggataaggcgggcgagacgtccagcggcgtca

SEQ ID NO: 2744 - DNA, 39 bp, Artificial Sequence
  Synthetic
gcgacgcggctttcgaacaggccgcatagtcaaaatgcc

SEQ ID NO: 2745 - DNA, 36 bp, Artificial Sequence
  Synthetic
ggcttatccggtgatggcggccgcagcaattcccgc

SEQ ID NO: 2746 - DNA, 41 bp, Artificial Sequence
  Synthetic
cccgtgatgaagtcccgggattccctcataaaaccgctgcc

SEQ ID NO: 2747 - DNA, 38 bp, Artificial Sequence
  Synthetic
acgagctgggcggtgtgtaaccaccaccagataatcgc

SEQ ID NO: 2748 - DNA, 39 bp, Artificial Sequence
  Synthetic
gcggttacggaggcggacaatcgcatcctcctccttcaa

SEQ ID NO: 2749 - DNA, 40 bp, Artificial Sequence
  Synthetic
ctgttgtcgcagcgtgtggaggccaccagcgtgattttgc

SEQ ID NO: 2750 - DNA, 34 bp, Artificial Sequence
  Synthetic
ttgcggaatcggcgggcagaatccgccgccgcat

SEQ ID NO: 2751 - DNA, 39 bp, Artificial Sequence
  Synthetic
gggctgtacgcgcttaccgtaagcctgtccaacacatcc

SEQ ID NO: 2752 - DNA, 38 bp, Artificial Sequence
  Synthetic
acgagaagggggcggctttcaaaccccaccgcagaatg

SEQ ID NO: 2753 - DNA, 37 bp, Artificial Sequence
  Synthetic
accaactcctaccgcagccagcggcagggatttgacc

SEQ ID NO: 2754 - DNA, 38 bp, Artificial Sequence
  Synthetic
gcggaagtatggtacaggcggtcaccgtgcgccctgtt

SEQ ID NO: 2755 - DNA, 39 bp, Artificial Sequence
  Synthetic
gggcaatgcacgccgaacacaacacggttgtttcagggt

SEQ ID NO: 2756 - DNA, 39 bp, Artificial Sequence
  Synthetic
gccgcctgcccgatattggggtatcacgcgcattcccct

SEQ ID NO: 2757 - DNA, 38 bp, Artificial Sequence
  Synthetic
atcgggcgttcgggcatcacggcgtagttttcaatccg

SEQ ID NO: 2758 - DNA, 39 bp, Artificial Sequence
  Synthetic
cggcctgtaaattccgcgtacgtcaacggcgcggattcg

SEQ ID NO: 2759 - DNA, 35 bp, Artificial Sequence
  Synthetic
ttacggcccggaccaacgccgccggccgatgatga

SEQ ID NO: 2760 - DNA, 39 bp, Artificial Sequence
  Synthetic
gcggtccgcagtcgcattttccactccgaatgtctgacg

SEQ ID NO: 2761 - DNA, 36 bp, Artificial Sequence
  Synthetic
cgaagtatcgcccgccgaaacgtgccggggttctca

SEQ ID NO: 2762 - DNA, 46 bp, Artificial Sequence
  Synthetic
aggttatccaaaaggtttacagcctatactggaatttctgcgtttg

SEQ ID NO: 2763 - DNA, 37 bp, Artificial Sequence
  Synthetic
aacagcctgctgtcgcccgtttggtggcggaggaaac

SEQ ID NO: 2764 - DNA, 39 bp, Artificial Sequence
  Synthetic
atacgcggcggcaaagaacatggtcaggaacaatgcctg

SEQ ID NO: 2765 - DNA, 41 bp, Artificial Sequence
  Synthetic
cggctgttgaccaaaatctgcgataaggcgtggcagaagga

SEQ ID NO: 2766 - DNA, 38 bp, Artificial Sequence
  Synthetic
cgcgcagggtgttgccttagagatggttaacgaaggcg

SEQ ID NO: 2767 - DNA, 38 bp, Artificial Sequence
  Synthetic
tggtggacaattccgcgccgccacatcgacatccaaga

SEQ ID NO: 2768 - DNA, 40 bp, Artificial Sequence
  Synthetic
acgtaaaacctgcaatgcgccagctcgttaccgaacagct

SEQ ID NO: 2769 - DNA, 40 bp, Artificial Sequence
  Synthetic
gtcgccttcgatgatgacggttgccgtttaccgcaacaac

SEQ ID NO: 2770 - DNA, 39 bp, Artificial Sequence
  Synthetic
cgatggttggcaaccgtgcggtatccatcccgattcggc

SEQ ID NO: 2771 - DNA, 40 bp, Artificial Sequence
  Synthetic
attaatacgccccagccgcccttacctctacacggacggc

SEQ ID NO: 2772 - DNA, 43 bp, Artificial Sequence
  Synthetic
ataggcagaatgaccgcagcgatgtttcaaatttcgaagatgt

SEQ ID NO: 2773 - DNA, 39 bp, Artificial Sequence
  Synthetic
accggagtggacgaacctcttagctacccggctatgcaa

SEQ ID NO: 2774 - DNA, 34 bp, Artificial Sequence
  Synthetic
cgcaagctgtttcggcggcttttcctgccgcgcc

SEQ ID NO: 2775 - DNA, 36 bp, Artificial Sequence
  Synthetic
cggtcgaggaggcaatccgtaacgctcaaaccgccg

SEQ ID NO: 2776 - DNA, 36 bp, Artificial Sequence
  Synthetic
gcaccttcgtcgcggatttcggccatcgcgccgttt

SEQ ID NO: 2777 - DNA, 37 bp, Artificial Sequence
  Synthetic
ttggtcgccgagctgccagccctgaaatcgaacgccg

SEQ ID NO: 2778 - DNA, 39 bp, Artificial Sequence
  Synthetic
accatttggtcgcggtgggcttcctgattaccatcggcg

SEQ ID NO: 2779 - DNA, 40 bp, Artificial Sequence
  Synthetic
cgatttgcccgtttacgccctgtcaacagtggcgcgaaac

SEQ ID NO: 2780 - DNA, 38 bp, Artificial Sequence
  Synthetic
acaggatggatttcgcccagccgcggcggcttcagcta

SEQ ID NO: 2781 - DNA, 35 bp, Artificial Sequence
  Synthetic
ggacgacttcgcgttccgcggcagcgttacgggca

SEQ ID NO: 2782 - DNA, 40 bp, Artificial Sequence
  Synthetic
acgagggcatgacgaccgtgggtctggtcggacagattgc

SEQ ID NO: 2783 - DNA, 39 bp, Artificial Sequence
  Synthetic
gctacggcaatcagtgtcaggttctacaccgcccaagca

SEQ ID NO: 2784 - DNA, 37 bp, Artificial Sequence
  Synthetic
atgccgtgcagggcttgggggcacgttctaccaaggc

SEQ ID NO: 2785 - DNA, 38 bp, Artificial Sequence
  Synthetic
cggcccattcgtcttggttgatcagctcgcccaagcca

SEQ ID NO: 2786 - DNA, 35 bp, Artificial Sequence
  Synthetic
cgttgcgcggcagcttgtcctcacccaagccgtct

SEQ ID NO: 2787 - DNA, 38 bp, Artificial Sequence
  Synthetic
ccgggtgcaagcagggtttcggcaaacacccattgacc

SEQ ID NO: 2788 - DNA, 43 bp, Artificial Sequence
  Synthetic
gaggcaaccggcaattattatgacgtaaacgctgtaatactgc

SEQ ID NO: 2789 - DNA, 42 bp, Artificial Sequence
  Synthetic
cgggcgttgtgtgttttgttgtcaatgactaccaccacgacg

SEQ ID NO: 2790 - DNA, 40 bp, Artificial Sequence
  Synthetic
gcaggttgtcggctttgacgtaaactaccgccgcaatacg

SEQ ID NO: 2791 - DNA, 36 bp, Artificial Sequence
  Synthetic
cgtacatcacgccggtcaggcgaagcccagcgcatc

SEQ ID NO: 2792 - DNA, 36 bp, Artificial Sequence
  Synthetic
cttggcaggcttcgcagcgacgcggctacaacgtcg

SEQ ID NO: 2793 - DNA, 35 bp, Artificial Sequence
  Synthetic
aaaggcagacgcggtcgccccgttgcgtttcggaa

SEQ ID NO: 2794 - DNA, 38 bp, Artificial Sequence
  Synthetic
tgggcgcgcaagaagtcggctgccgtagattttgacgg

SEQ ID NO: 2795 - DNA, 38 bp, Artificial Sequence
  Synthetic
acgtgcagcaggcggatttgttcgggtttttgacggcg

SEQ ID NO: 2796 - DNA, 38 bp, Artificial Sequence
  Synthetic
gcggtgtggcgcaggaattgtcgggagccagagtctct

SEQ ID NO: 2797 - DNA, 39 bp, Artificial Sequence
  Synthetic
acatcggcagcatcctcgaaagcgttgcgccataatggt

SEQ ID NO: 2798 - DNA, 35 bp, Artificial Sequence
  Synthetic
acggtttgcaggcagtcgcgcggcggctttgttca

SEQ ID NO: 2799 - DNA, 36 bp, Artificial Sequence
  Synthetic
ccgatgacccagaagccgaccagctgacgggcgtgt

SEQ ID NO: 2800 - DNA, 35 bp, Artificial Sequence
  Synthetic
aactcgccttcgcctgcggcgcagcaaaccgccga

SEQ ID NO: 2801 - DNA, 42 bp, Artificial Sequence
  Synthetic
cggggaaggaaataccgatgggtgcctgatacagtcggtaca

SEQ ID NO: 2802 - DNA, 38 bp, Artificial Sequence
  Synthetic
tccattttggtcggcggcgtttggaaggcaagagcgac

SEQ ID NO: 2803 - DNA, 39 bp, Artificial Sequence
  Synthetic
ggcgcggatgcacttgaagaagtgccgcctgcaaacctc

SEQ ID NO: 2804 - DNA, 37 bp, Artificial Sequence
  Synthetic
ccagtatttcagacggccccgcccaaacgccgcgtgt

SEQ ID NO: 2805 - DNA, 38 bp, Artificial Sequence
  Synthetic
tttggcaaaaccgggcggaacgcaacgacatcctcgcc

SEQ ID NO: 2806 - DNA, 38 bp, Artificial Sequence
  Synthetic
cgggcaggttgagggtgaaatcccgcgctgtacggcat

SEQ ID NO: 2807 - DNA, 38 bp, Artificial Sequence
  Synthetic
cctgccggattgcttgtccgatcgacgaccaccacacc

SEQ ID NO: 2808 - DNA, 38 bp, Artificial Sequence
  Synthetic
cgacttcgatgccgccgtcttagggcaaatgggtctgc

SEQ ID NO: 2809 - DNA, 38 bp, Artificial Sequence
  Synthetic
tgccttggaacatccccatcatcagtacgggaatgagc

SEQ ID NO: 2810 - DNA, 41 bp, Artificial Sequence
  Synthetic
ggaaaggtaaaacacgacgcgcttgaaagtgcgcgaactgt

SEQ ID NO: 2811 - DNA, 38 bp, Artificial Sequence
  Synthetic
cccaggtcttttgcgtcgtccgccaaagccgaactcgc

SEQ ID NO: 2812 - DNA, 42 bp, Artificial Sequence
  Synthetic
ggcgtattcgagataggcgcgtcccataccgattccaacacg

SEQ ID NO: 2813 - DNA, 41 bp, Artificial Sequence
  Synthetic
gcgggttgagggtggaaaagaagcgtgggcgttttacttgt

SEQ ID NO: 2814 - DNA, 42 bp, Artificial Sequence
  Synthetic
gcacggtcgatgtatctgaccgcgtagccggcttctatttcg

SEQ ID NO: 2815 - DNA, 39 bp, Artificial Sequence
  Synthetic
cggcaaggtgttcgccgaggccaaacggcaaaaaaacgc

SEQ ID NO: 2816 - DNA, 46 bp, Artificial Sequence
  Synthetic
cgggttcttgccatcaaatttaactaaacttttggtgctttttccg

SEQ ID NO: 2817 - DNA, 45 bp, Artificial Sequence
  Synthetic
agttcaaaggctacacgtcaaataaaagaaggttcaatatgtcgg

SEQ ID NO: 2818 - DNA, 36 bp, Artificial Sequence
  Synthetic
acaagtaatcccgcgtcccgcggctgtgcgtgaggt

SEQ ID NO: 2819 - DNA, 44 bp, Artificial Sequence
  Synthetic
ccgtccgttctaaaatttgaccaatcctgttttttgacgctgaa

SEQ ID NO: 2820 - DNA, 38 bp, Artificial Sequence
  Synthetic
ggttcgggctttcacaacggagcacatccgccacatcc

SEQ ID NO: 2821 - DNA, 38 bp, Artificial Sequence
  Synthetic
gacttggggcttctggctgccagcaggctgatggcaat

SEQ ID NO: 2822 - DNA, 35 bp, Artificial Sequence
  Synthetic
tatggcaatcggcgcctgccggcccagcaacacca

SEQ ID NO: 2823 - DNA, 39 bp, Artificial Sequence
  Synthetic
cggctcagggattcgacaatgtctcccgcaacaatgggc

SEQ ID NO: 2824 - DNA, 39 bp, Artificial Sequence
  Synthetic
ctcgccggacaattcattgctgggcacctgtatcggcgt

SEQ ID NO: 2825 - DNA, 36 bp, Artificial Sequence
  Synthetic
gctcgggcttttaccgcgtcaaacccaagccgcacc

SEQ ID NO: 2826 - DNA, 40 bp, Artificial Sequence
  Synthetic
acggctttttctttgggctcggaaaagccgaaaccgcacc

SEQ ID NO: 2827 - DNA, 38 bp, Artificial Sequence
  Synthetic
cggatatcgagctgcacagccgtgagttcgggcgggag

SEQ ID NO: 2828 - DNA, 40 bp, Artificial Sequence
  Synthetic
ccaccacacgccatgtcgaaaggaaaaccaacatgtccgc

SEQ ID NO: 2829 - DNA, 37 bp, Artificial Sequence
  Synthetic
tggttcgagggcaggctggacctgttcccgattggcg

SEQ ID NO: 2830 - DNA, 35 bp, Artificial Sequence
  Synthetic
tggcggcaaccttcggtaccagcgtgcagagccac

SEQ ID NO: 2831 - DNA, 39 bp, Artificial Sequence
  Synthetic
caatccctgcgtgcttcggggcgaagaaagccttgccaa

SEQ ID NO: 2832 - DNA, 40 bp, Artificial Sequence
  Synthetic
tccactgcttgccctcaacaagatggcggacggtataggc

SEQ ID NO: 2833 - DNA, 38 bp, Artificial Sequence
  Synthetic
tcgccagcttgcctgtccgcggagcatccaaatggcag

SEQ ID NO: 2834 - DNA, 38 bp, Artificial Sequence
  Synthetic
cccgttgcgtttcggaatgcccgtaaaggcagacgcgg

SEQ ID NO: 2835 - DNA, 40 bp, Artificial Sequence
  Synthetic
gttggaagtttgacgggggctcaccagaggttcgtccact

SEQ ID NO: 2836 - DNA, 43 bp, Artificial Sequence
  Synthetic
tccgttcaattgcttatttgttcaaaaagatgaagcggcaatg

SEQ ID NO: 2837 - DNA, 40 bp, Artificial Sequence
  Synthetic
ctgcctgcgggaatgtcgaaccaaacccaatgcttcaacc

SEQ ID NO: 2838 - DNA, 41 bp, Artificial Sequence
  Synthetic
acggacagatggatcggcatttgcggatccgggtttgatta

SEQ ID NO: 2839 - DNA, 39 bp, Artificial Sequence
  Synthetic
tatgcggcggcagggcttctttgccgaaaatatccccca

SEQ ID NO: 2840 - DNA, 36 bp, Artificial Sequence
  Synthetic
tacagttccgcgccgcactgcctgtatttccgcgac

SEQ ID NO: 2841 - DNA, 41 bp, Artificial Sequence
  Synthetic
cggcttgaccacccagaactgaactcaatgcggacgtatcc

SEQ ID NO: 2842 - DNA, 40 bp, Artificial Sequence
  Synthetic
attgctcaacgccgcttcgacgcacaaaaccatgtttggg

SEQ ID NO: 2843 - DNA, 37 bp, Artificial Sequence
  Synthetic
tgctcttctcgccgacagcgcgcgccatttgagtttc

SEQ ID NO: 2844 - DNA, 38 bp, Artificial Sequence
  Synthetic
ggcggtcgcttcgtccaactgcatcgatttgaccggtt

SEQ ID NO: 2845 - DNA, 37 bp, Artificial Sequence
  Synthetic
cgctgtgggtgtcggtcaggcttgaaagcccacctcg

SEQ ID NO: 2846 - DNA, 38 bp, Artificial Sequence
  Synthetic
ggttcgatcatcagcgtgccggactacggcttccacgc

SEQ ID NO: 2847 - DNA, 34 bp, Artificial Sequence
  Synthetic
cgcgagagtacggatgcgctcaacgcgccgcaca

SEQ ID NO: 2848 - DNA, 39 bp, Artificial Sequence
  Synthetic
agacaagggtgcggcagcccctgacaggttgcttcgaag

SEQ ID NO: 2849 - DNA, 35 bp, Artificial Sequence
  Synthetic
gcgcagggacgcatcgttacccgactttgagcgcg

SEQ ID NO: 2850 - DNA, 39 bp, Artificial Sequence
  Synthetic
ccacacaagccatcctgcccgtcggggtggacttcaaag

SEQ ID NO: 2851 - DNA, 39 bp, Artificial Sequence
  Synthetic
agcgcacacccaaacctggatcaggtcggtcagatagct

SEQ ID NO: 2852 - DNA, 40 bp, Artificial Sequence
  Synthetic
aagtcatcgacaacgcggcgttgcacgtcgatttcagtgg

SEQ ID NO: 2853 - DNA, 38 bp, Artificial Sequence
  Synthetic
tgggcttgaaagtcgtgcgcaccgtatgttccgcaacc

SEQ ID NO: 2854 - DNA, 39 bp, Artificial Sequence
  Synthetic
gcctgtaccgttgccgtcatggcggggttcagttcgatg

SEQ ID NO: 2855 - DNA, 39 bp, Artificial Sequence
  Synthetic
gcccaagcccttatcctgcaaagcggatgaagccttcgc

SEQ ID NO: 2856 - DNA, 37 bp, Artificial Sequence
  Synthetic
tgggacgaaacccggggcttgaaacatctgccgcgtc

SEQ ID NO: 2857 - DNA, 39 bp, Artificial Sequence
  Synthetic
ggcggacgcgttgaaggtggcaaaaaccaccgtttaccg

SEQ ID NO: 2858 - DNA, 38 bp, Artificial Sequence
  Synthetic
aaggcgtggctttcggcgccatactgacggttctgcag

SEQ ID NO: 2859 - DNA, 35 bp, Artificial Sequence
  Synthetic
agccgtgcgctatacccgccggcaagcgtcccgtt

SEQ ID NO: 2860 - DNA, 38 bp, Artificial Sequence
  Synthetic
tgaatggttgtggcagcccggttgacggtgcggacatt

SEQ ID NO: 2861 - DNA, 36 bp, Artificial Sequence
  Synthetic
cggcttgggacattgcctccccgtcgtgcgaggcat

SEQ ID NO: 2862 - DNA, 39 bp, Artificial Sequence
  Synthetic
gcggtcggacacgtcaaactggaagaaatccgcgctttg

SEQ ID NO: 2863 - DNA, 34 bp, Artificial Sequence
  Synthetic
cccggtgccgtgcagattcattgcagcacgccgg

SEQ ID NO: 2864 - DNA, 35 bp, Artificial Sequence
  Synthetic
agccggggcggaagtttcccgttcgcgtggggcat

SEQ ID NO: 2865 - DNA, 41 bp, Artificial Sequence
  Synthetic
gcgcagacgttttctgacggcttcggcaaaaaagaaaccgc

SEQ ID NO: 2866 - DNA, 36 bp, Artificial Sequence
  Synthetic
gccaatatcggtgcggcgcgtaccgacgcttccggt

SEQ ID NO: 2867 - DNA, 38 bp, Artificial Sequence
  Synthetic
agcagcagctacaatgtcggaccacgcgcccgaacaga

SEQ ID NO: 2868 - DNA, 40 bp, Artificial Sequence
  Synthetic
cctcgaatggggcggacagtcaaaatcagggtttgcgagc

SEQ ID NO: 2869 - DNA, 38 bp, Artificial Sequence
  Synthetic
cgacatccgcaccgcattgggttcgggaagtcgctgac

SEQ ID NO: 2870 - DNA, 40 bp, Artificial Sequence
  Synthetic
gaccgaagaccaaggcttcgttcatcggtgcgctctttgg

SEQ ID NO: 2871 - DNA, 37 bp, Artificial Sequence
  Synthetic
ccgaaacctatatcggggcgcgatacgggcggcggtt

SEQ ID NO: 2872 - DNA, 39 bp, Artificial Sequence
  Synthetic
ccaaacatcccgccaaaggcctgatgagggcttcgagga

SEQ ID NO: 2873 - DNA, 41 bp, Artificial Sequence
  Synthetic
ccgcttcctcgacagcgaaagtactgcaaaaggtgatgccg

SEQ ID NO: 2874 - DNA, 41 bp, Artificial Sequence
  Synthetic
cgacggtcggagaatgggtggtccggcttcgaacaatctgt

SEQ ID NO: 2875 - DNA, 38 bp, Artificial Sequence
  Synthetic
cctggaagcaggcggtagacctgccacatcgggttgcc

SEQ ID NO: 2876 - DNA, 38 bp, Artificial Sequence
  Synthetic
gggcaacgtcatcgaagcggcctgcgtcagatcgggat

SEQ ID NO: 2877 - DNA, 38 bp, Artificial Sequence
  Synthetic
tttggggcggcaagttcgtgcggttcgacaccccattt

SEQ ID NO: 2878 - DNA, 39 bp, Artificial Sequence
  Synthetic
gccgctattccgacgaatggcctcaggcacgacatcacg

SEQ ID NO: 2879 - DNA, 38 bp, Artificial Sequence
  Synthetic
atgcggcaggtttgatggatggacttttctcccacgaa

SEQ ID NO: 2880 - DNA, 39 bp, Artificial Sequence
  Synthetic
gcgttttgctggcggatgtagaggctgggtcaaatccgg

SEQ ID NO: 2881 - DNA, 34 bp, Artificial Sequence
  Synthetic
tcgcgcaaaagcccggaggggcaagtgttcgccg

SEQ ID NO: 2882 - DNA, 37 bp, Artificial Sequence
  Synthetic
ccgaatacgccgacaccgacgtacggctgcggacggt

SEQ ID NO: 2883 - DNA, 36 bp, Artificial Sequence
  Synthetic
gggcaacataagcggcggacgttgtggtagccgccg

SEQ ID NO: 2884 - DNA, 40 bp, Artificial Sequence
  Synthetic
cgccgtctttgcctacacccatatcacgaagacggctcgg

SEQ ID NO: 2885 - DNA, 39 bp, Artificial Sequence
  Synthetic
accacggcaggttacggattgatgtcgaaaccgccgttg

SEQ ID NO: 2886 - DNA, 42 bp, Artificial Sequence
  Synthetic
gttccgctgattaaggccttgcattttccaacacctgcttgc

SEQ ID NO: 2887 - DNA, 38 bp, Artificial Sequence
  Synthetic
ccgaaccgtgcctgctgtaaccaccacgtcgtaatcgt

SEQ ID NO: 2888 - DNA, 35 bp, Artificial Sequence
  Synthetic
cgccgaagaacagtccggtggcgcatacacgtcgg

SEQ ID NO: 2889 - DNA, 40 bp, Artificial Sequence
  Synthetic
tggcaatgctgtcttcgcggaactacaccaaccgttctcc

SEQ ID NO: 2890 - DNA, 35 bp, Artificial Sequence
  Synthetic
ttgtccgcacgaaccgccgcgcgcttgccagccaa

SEQ ID NO: 2891 - DNA, 38 bp, Artificial Sequence
  Synthetic
gcgcgctttggcaaacgatatcggcaatttcctgctgg

SEQ ID NO: 2892 - DNA, 38 bp, Artificial Sequence
  Synthetic
tgcccgcgccgattttgggcaaacgcctcgatattggg

SEQ ID NO: 2893 - DNA, 42 bp, Artificial Sequence
  Synthetic
acagataacctgcggcggcaaatacgcaaacactacgtctgc

SEQ ID NO: 2894 - DNA, 36 bp, Artificial Sequence
  Synthetic
gccttgccgaacgcgaacggcgcggtgcaaatcttg

SEQ ID NO: 2895 - DNA, 36 bp, Artificial Sequence
  Synthetic
cgtgttgcacagccggatggcccaacatcgcgcgca

SEQ ID NO: 2896 - DNA, 35 bp, Artificial Sequence
  Synthetic
agcagcgcgtctccatcgcggctcgtcggcgaaga

SEQ ID NO: 2897 - DNA, 41 bp, Artificial Sequence
  Synthetic
cgtcgtcgccgtagacatcaagatacgcctttcaaacggct

SEQ ID NO: 2898 - DNA, 40 bp, Artificial Sequence
  Synthetic
cccttctgccttctggacgaagagcttgcagaaacgcgag

SEQ ID NO: 2899 - DNA, 38 bp, Artificial Sequence
  Synthetic
ccctgatcaacgccaaacgctacttcgagcgcgtccag

SEQ ID NO: 2900 - DNA, 39 bp, Artificial Sequence
  Synthetic
tggcggaagagcagaccgttagcgatgtcgtctgaaagc

SEQ ID NO: 2901 - DNA, 40 bp, Artificial Sequence
  Synthetic
gcaggcggcatggctttcagacctgtacgggcagggattt

SEQ ID NO: 2902 - DNA, 36 bp, Artificial Sequence
  Synthetic
agcaggaagccgccgacttttgccacagttgcggcg

SEQ ID NO: 2903 - DNA, 35 bp, Artificial Sequence
  Synthetic
cgaggcaaaccgcatccgctcggcatgggcaagct

SEQ ID NO: 2904 - DNA, 40 bp, Artificial Sequence
  Synthetic
ggcaaaactgcccgccacataatgggggcggtgtttaagc

SEQ ID NO: 2905 - DNA, 40 bp, Artificial Sequence
  Synthetic
ggcgatttgctgctgaatcggatcggtgcgttcttctccg

SEQ ID NO: 2906 - DNA, 38 bp, Artificial Sequence
  Synthetic
gccttcttcgacttggctgtcgtgcctgtccgacgacc

SEQ ID NO: 2907 - DNA, 38 bp, Artificial Sequence
  Synthetic
tgctctacctggccgggttttatgccaaaagccccgtc

SEQ ID NO: 2908 - DNA, 38 bp, Artificial Sequence
  Synthetic
cacttgcccgcttttttgcagctgggaacaagccgcca

SEQ ID NO: 2909 - DNA, 40 bp, Artificial Sequence
  Synthetic
gatgttttcggggaacacggctcgacaacacgctcgttct

SEQ ID NO: 2910 - DNA, 39 bp, Artificial Sequence
  Synthetic
cggtcatcagggcggtgtcttgaaaccctgaccctctgc

SEQ ID NO: 2911 - DNA, 37 bp, Artificial Sequence
  Synthetic
gtaggtctcggtgtcatcgccgcgtccagggtcagct

SEQ ID NO: 2912 - DNA, 38 bp, Artificial Sequence
  Synthetic
acgtgattgccgaacagggcacttcctgatcgcgcatc

SEQ ID NO: 2913 - DNA, 40 bp, Artificial Sequence
  Synthetic
aaagcaggtgccaaccgcttgggtttgtaccaacagtccg

SEQ ID NO: 2914 - DNA, 38 bp, Artificial Sequence
  Synthetic
acgccaccgacaccaccagtctacttcgcggttgaagg

SEQ ID NO: 2915 - DNA, 38 bp, Artificial Sequence
  Synthetic
ccgccgcgaaaaactggaaacaatggcggggaagtcgg

SEQ ID NO: 2916 - DNA, 38 bp, Artificial Sequence
  Synthetic
cggcgtatcgctcaaaatgccgcgcgtaggtcagttcc

SEQ ID NO: 2917 - DNA, 34 bp, Artificial Sequence
  Synthetic
tgccgccgcattgctgaccgcctaagccgatgcg

SEQ ID NO: 2918 - DNA, 37 bp, Artificial Sequence
  Synthetic
caaaccgaaagcgcgggcccgtacacgctccaaaccg

SEQ ID NO: 2919 - DNA, 43 bp, Artificial Sequence
  Synthetic
ggcacaccaaaaatcatggcttaacacagagtatgcaacttac

SEQ ID NO: 2920 - DNA, 43 bp, Artificial Sequence
  Synthetic
gctgctgattatctgccgtaaacagtatgacaatttgctgaac

SEQ ID NO: 2921 - DNA, 39 bp, Artificial Sequence
  Synthetic
cggtgtgccattggtagattttgctgattaccaccaaca

SEQ ID NO: 2922 - DNA, 41 bp, Artificial Sequence
  Synthetic
gtcccacaattcaaaaccgtcttttgggtcaaaatgggtgc

SEQ ID NO: 2923 - DNA, 44 bp, Artificial Sequence
  Synthetic
ggctgtttttcaggttgcttaattttgaaatgttcaacggcatt

SEQ ID NO: 2924 - DNA, 40 bp, Artificial Sequence
  Synthetic
tttgagcttgtcagcagccgactgaaaatgcgcctgctca

SEQ ID NO: 2925 - DNA, 44 bp, Artificial Sequence
  Synthetic
tgccaaacaccgacataatcatcttcttgttttgatgttggcag

SEQ ID NO: 2926 - DNA, 43 bp, Artificial Sequence
  Synthetic
cgcttgtttacgagttttcaaacaaactttagcgcgaaaccat

SEQ ID NO: 2927 - DNA, 38 bp, Artificial Sequence
  Synthetic
gccctgccacaaacagatttcctgcatttcccaaaagc

SEQ ID NO: 2928 - DNA, 42 bp, Artificial Sequence
  Synthetic
gtggcaatgaatggaatattgtcccaaccgcttgaaacactt

SEQ ID NO: 2929 - DNA, 42 bp, Artificial Sequence
  Synthetic
agactgttcccgataactcgccatacaggacataatgcctac

SEQ ID NO: 2930 - DNA, 47 bp, Artificial Sequence
  Synthetic
gccttaatccaacaaaaaatgacgagcatatccggcaaataatcttg

SEQ ID NO: 2931 - DNA, 39 bp, Artificial Sequence
  Synthetic
agcgcgttattgttcaacagcgtcgtcaaagcaggcaaa

SEQ ID NO: 2932 - DNA, 41 bp, Artificial Sequence
  Synthetic
gtcggtgtgattgccgccattacggcaataatcgacagcgc

SEQ ID NO: 2933 - DNA, 36 bp, Artificial Sequence
  Synthetic
tatcgacctgcgccgccctgcccgtagcgacttggt

SEQ ID NO: 2934 - DNA, 49 bp, Artificial Sequence
  Synthetic
cagaaatcggttattgacgaagtgagatagggagagaaataaatatcgt

SEQ ID NO: 2935 - DNA, 35 bp, Artificial Sequence
  Synthetic
tgcggtgatgtcggcagggcctgatcgaatggccg

SEQ ID NO: 2936 - DNA, 35 bp, Artificial Sequence
  Synthetic
ggcgcgtaccgttttggcagccggcacactgttcg

SEQ ID NO: 2937 - DNA, 35 bp, Artificial Sequence
  Synthetic
gcgtcggcgtggatggagagcgtgtcgccaaaggg

SEQ ID NO: 2938 - DNA, 41 bp, Artificial Sequence
  Synthetic
gcttctcttcggcaggattggagcacccgatatgccgtcta

SEQ ID NO: 2939 - DNA, 39 bp, Artificial Sequence
  Synthetic
aggtcgaggcgggcgaaacgccgagttcttctccaaact

SEQ ID NO: 2940 - DNA, 39 bp, Artificial Sequence
  Synthetic
cgacgcattgggcaagcccgatgccttgttcttccagcc

SEQ ID NO: 2941 - DNA, 40 bp, Artificial Sequence
  Synthetic
acgccgaacaaatcaggcagttcgaccaagcccaaatcgc

SEQ ID NO: 2942 - DNA, 38 bp, Artificial Sequence
  Synthetic
atggatgggcggatggcggcaacaccagctcgttcaca

SEQ ID NO: 2943 - DNA, 42 bp, Artificial Sequence
  Synthetic
gcggcaatcaagcatttcggacgaagcagtcgtctatggtcg

SEQ ID NO: 2944 - DNA, 35 bp, Artificial Sequence
  Synthetic
tgcccccgttttggctgccgaccaggccctgcgta

SEQ ID NO: 2945 - DNA, 40 bp, Artificial Sequence
  Synthetic
cgcaccggcattcacatctgttaagcaagcgaaaacggca

SEQ ID NO: 2946 - DNA, 38 bp, Artificial Sequence; identical to SEQ ID NO: 2734
  Synthetic

SEQ ID NO: 2947 - DNA, 41 bp, Artificial Sequence
  Synthetic
cggggaatcagaagcggtagcaaacacccgcttcaaaaccc

SEQ ID NO: 2948 - DNA, 36 bp, Artificial Sequence
  Synthetic
acgcggggtttgggcaacgggaatccggacctgtcc

SEQ ID NO: 2949 - DNA, 37 bp, Artificial Sequence
  Synthetic
cccaaagccgttcccgttgccaaccatacggacggcg

SEQ ID NO: 2950 - DNA, 42 bp, Artificial Sequence
  Synthetic
acacgccgtcgatttggtgatttgtcgatgacggtagtcgga

SEQ ID NO: 2951 - DNA, 35 bp, Artificial Sequence
  Synthetic
tttcccggcctgcccaacgccgctccggcatggtt

SEQ ID NO: 2952 - DNA, 36 bp, Artificial Sequence
  Synthetic
gaagtgcgcttcgggcatcccctgacattcggcggc

SEQ ID NO: 2953 - DNA, 35 bp, Artificial Sequence
  Synthetic
ccgattacaccgcctccagcgcgcgtaccggcaaa

SEQ ID NO: 2954 - DNA, 38 bp, Artificial Sequence
  Synthetic
tgcgtccgccggcgatttcattggatggcgagatgtgg

SEQ ID NO: 2955 - DNA, 42 bp, Artificial Sequence
  Synthetic
ccaaatgcctgacggtgcagtgcgcgggttggaagtattggt

SEQ ID NO: 2956 - DNA, 38 bp, Artificial Sequence
  Synthetic
tcgaatttttcggcgagggcgccggcgtcatgttggaa

SEQ ID NO: 2957 - DNA, 36 bp, Artificial Sequence
  Synthetic
gcggtttggaagcggaaaccatatcgggcaggcgca

SEQ ID NO: 2958 - DNA, 38 bp, Artificial Sequence
  Synthetic
cccgatacggttgaggtcgtccggcatggtcgccccaa

SEQ ID NO: 2959 - DNA, 38 bp, Artificial Sequence
  Synthetic
gcgacatcaagttgccaaacggcggggtggtgtccgta

SEQ ID NO: 2960 - DNA, 36 bp, Artificial Sequence
  Synthetic
tcgggcgcggagagtggttcagaaagccgcgtttgc

SEQ ID NO: 2961 - DNA, 34 bp, Artificial Sequence
  Synthetic
gatgcgccgcaaatccgcacgcagtcggtcaggt

SEQ ID NO: 2962 - DNA, 33 bp, Artificial Sequence
  Synthetic
aaaacggcgggcgcgtgcggcggttcacaatgt

SEQ ID NO: 2963 - DNA, 40 bp, Artificial Sequence
  Synthetic
ccgcaaacccacctcgtcaaaaatggcggtcagaatcagc

SEQ ID NO: 2964 - DNA, 40 bp, Artificial Sequence
  Synthetic
tgagtttgaacgatgtggcggacgttcagacggcctttga

SEQ ID NO: 2965 - DNA, 41 bp, Artificial Sequence
  Synthetic
gggcgcggataaagtcgtcgtacgttgatgatgtcgtgcgg

SEQ ID NO: 2966 - DNA, 37 bp, Artificial Sequence
  Synthetic
ccgtcaacaaggcgcaacagcgactggtcaaggccgt

SEQ ID NO: 2967 - DNA, 38 bp, Artificial Sequence
  Synthetic
agcgaacagcggcgcaacgtttgattgccgaaccaggt

SEQ ID NO: 2968 - DNA, 39 bp, Artificial Sequence
  Synthetic
gcacacgtcatcggatttaccagcgaaagttccaaacct

SEQ ID NO: 2969 - DNA, 41 bp, Artificial Sequence
  Synthetic
gcgcacacgaattaagcatcgaatgtcgcggaatttggcag

SEQ ID NO: 2970 - DNA, 40 bp, Artificial Sequence
  Synthetic
tgaagaaaaggcgggcgagccgtgctttcttgcgcactgc

SEQ ID NO: 2971 - DNA, 41 bp, Artificial Sequence
  Synthetic
tgccgtctgaaacacattaaggacagaccttttccggattg

SEQ ID NO: 2972 - DNA, 39 bp, Artificial Sequence
  Synthetic
ccgttttggaacgcgtcatcgcggcgttgactttgccct

SEQ ID NO: 2973 - DNA, 37 bp, Artificial Sequence
  Synthetic
cggaaatgccgttgccttcgtcatccacgccatcggc

SEQ ID NO: 2974 - DNA, 35 bp, Artificial Sequence
  Synthetic
tcgcgcacttcggcaatgggatgcttgccgtgcgc

SEQ ID NO: 2975 - DNA, 37 bp, Artificial Sequence
  Synthetic
ggtttgttcggcaggtttggcggcgaagtcgtgtccg

SEQ ID NO: 2976 - DNA, 35 bp, Artificial Sequence
  Synthetic
gttgatcaggcgcgccactgatgccagcatcggcg

SEQ ID NO: 2977 - DNA, 36 bp, Artificial Sequence
  Synthetic
ccgagtaggaagccagcggggaccgaacttgccgcc

SEQ ID NO: 2978 - DNA, 39 bp, Artificial Sequence
  Synthetic
tccccagttgtggtagcggtatcggtttcgacatcacgc

SEQ ID NO: 2979 - DNA, 37 bp, Artificial Sequence
  Synthetic
tgccgctgtgggtcagtgcgccatgtacggtttgggt

SEQ ID NO: 2980 - DNA, 38 bp, Artificial Sequence
  Synthetic
gctgccggtggcgaaggtaaaacgccaaggcaaccaaa

SEQ ID NO: 2981 - DNA, 38 bp, Artificial Sequence
  Synthetic
cctcgcctttcagacgatggatggcttgcccgtcttgg

SEQ ID NO: 2982 - DNA, 39 bp, Artificial Sequence
  Synthetic
ggcggcttcgtcgcacaaaccatcggaaaacacgtcgcc

SEQ ID NO: 2983 - DNA, 39 bp, Artificial Sequence
  Synthetic
tgccgacggacgaacgctgacaaacgcaagacttcgtct

SEQ ID NO: 2984 - DNA, 39 bp, Artificial Sequence
  Synthetic
cgcacgcgaacagggcttgtcgatgcccgtaaacgttac

SEQ ID NO: 2985 - DNA, 34 bp, Artificial Sequence
  Synthetic
attgccgccgcccaacaatttccggcggcgaacg

SEQ ID NO: 2986 - DNA, 41 bp, Artificial Sequence
  Synthetic
tgtttgtgctggcgtttgtgcgacggaacagaacaaatgcc

SEQ ID NO: 2987 - DNA, 39 bp, Artificial Sequence
  Synthetic
gaacaaaagctgctccgtcccggggcaaacggcaacagc

SEQ ID NO: 2988 - DNA, 43 bp, Artificial Sequence
  Synthetic
tctcaatctgcaggtgctgaaatcgtacaggttaatcaaatgg

SEQ ID NO: 2989 - DNA, 38 bp, Artificial Sequence
  Synthetic
gtctgtgcctgtgtcctgcataccccctaccctgaccg

SEQ ID NO: 2990 - DNA, 36 bp, Artificial Sequence
  Synthetic
ggcaatcccgccgatgttcacgaagccctgttccgc

SEQ ID NO: 2991 - DNA, 37 bp, Artificial Sequence
  Synthetic
cggagagcgcgtcggatttcccgatacagctaccccg

SEQ ID NO: 2992 - DNA, 40 bp, Artificial Sequence
  Synthetic
cacagtttcggcaaggctttccgacagggcggttgtcatc

SEQ ID NO: 2993 - DNA, 40 bp, Artificial Sequence
  Synthetic
cgtattgaccgcaccggcagacaggaagcgtttcatctgg

SEQ ID NO: 2994 - DNA, 39 bp, Artificial Sequence
  Synthetic
ctgggtgtcggctacctgcttgttcgacggtcattttgc

SEQ ID NO: 2995 - DNA, 35 bp, Artificial Sequence
  Synthetic
gcaaccatggcctcgaccggtgtgccgcttccgca

SEQ ID NO: 2996 - DNA, 41 bp, Artificial Sequence
  Synthetic
ggcaggcactttaatcatggcgaggcacggtagaagaagcc

SEQ ID NO: 2997 - DNA, 37 bp, Artificial Sequence
  Synthetic
ggcgacaacttggatatgggcatacgcgcgcggcatt

SEQ ID NO: 2998 - DNA, 39 bp, Artificial Sequence
  Synthetic
aaaagctgcacgcggtttgcaatatttcaccgcccccga

SEQ ID NO: 2999 - DNA, 38 bp, Artificial Sequence
  Synthetic
cgggcgaggttttgggtgtaactccccgaccgcgacat

SEQ ID NO: 3000 - DNA, 36 bp, Artificial Sequence
  Synthetic
cgcccaaacactgctgcaaacgcggacaagacctgc

SEQ ID NO: 3001 - DNA, 38 bp, Artificial Sequence
  Synthetic
ttggtgcaacgcctctacacatcgcaggattgtgccgc

SEQ ID NO: 3002 - DNA, 39 bp, Artificial Sequence
  Synthetic
acggctacaacgaggtcaacctccgaacgcgcctttctg

SEQ ID NO: 3003 - DNA, 36 bp, Artificial Sequence
  Synthetic
ccgacggataagcgacgtgcgccgcctttgtccgca

SEQ ID NO: 3004 - DNA, 39 bp, Artificial Sequence
  Synthetic
tatgcgggctttttccacgccttaaggcggctttgtcgg

SEQ ID NO: 3005 - DNA, 39 bp, Artificial Sequence
  Synthetic
tggacgcttggcaaccggcgtaccgcttcaggaaatcgc

SEQ ID NO: 3006 - DNA, 39 bp, Artificial Sequence
  Synthetic
gcgaatgtctgccatgttcgggcccagttgaacagggga

SEQ ID NO: 3007 - DNA, 39 bp, Artificial Sequence
  Synthetic
cgctcctgaccgccctgttcttaccccgtatcggcaaac

SEQ ID NO: 3008 - DNA, 38 bp, Artificial Sequence
  Synthetic
gtacaagtaatcccgcgtcccgcggctgtgcgtgaggt

SEQ ID NO: 3009 - DNA, 35 bp, Artificial Sequence
  Synthetic
ccgacaaacaggccgcacccggcgcggcaaagtct

SEQ ID NO: 3010 - DNA, 35 bp, Artificial Sequence
  Synthetic
agggccgcaccaaatcggcgcgaactcaacgccgc

SEQ ID NO: 3011 - DNA, 44 bp, Artificial Sequence
  Synthetic
gccattaaaagaccagggcattcgaaaagtaattcttggttgcc

SEQ ID NO: 3012 - DNA, 42 bp, Artificial Sequence
  Synthetic
tgctgattgtcgtattcggcggttccacataatgaagcggct

SEQ ID NO: 3013 - DNA, 40 bp, Artificial Sequence
  Synthetic
agtcgcgcatgtgcctgaaaaaatcaaactgattgccgcc

SEQ ID NO: 3014 - DNA, 41 bp, Artificial Sequence
  Synthetic
ggaagaaacggcaatgacggcttccgaaaaaggcctgaccg

SEQ ID NO: 3015 - DNA, 38 bp, Artificial Sequence
  Synthetic
gtggacgatgcctacgaagcctcgcggacgacgtttcc

SEQ ID NO: 3016 - DNA, 39 bp, Artificial Sequence
  Synthetic
tgccgcaactgccacttcaaacatttgttgcaggcggga

SEQ ID NO: 3017 - DNA, 39 bp, Artificial Sequence
  Synthetic
caggttcggtcgtcgtgtccgacggcacagtaaaggctg

SEQ ID NO: 3018 - DNA, 41 bp, Artificial Sequence
  Synthetic
gccgcacccaccatcattgaaggccttcgacgatttcggaa

SEQ ID NO: 3019 - DNA, 35 bp, Artificial Sequence
  Synthetic
ggtgggcggacgctattcccgccaaccgcaaccat

SEQ ID NO: 3020 - DNA, 36 bp, Artificial Sequence
  Synthetic
cgctgcatacggctttgcgctccctgccgtccgcat

SEQ ID NO: 3021 - DNA, 36 bp, Artificial Sequence
  Synthetic
ccgattccgccggtcagtcactggtggctgacccat

SEQ ID NO: 3022 - DNA, 42 bp, Artificial Sequence
  Synthetic
ccgcgtacatactcaactccataacccaatttcgcacaatgg

SEQ ID NO: 3023 - DNA, 36 bp, Artificial Sequence
  Synthetic
cccgaggttgaagccgtgtggctgatcggcgatgcg

SEQ ID NO: 3024 - DNA, 35 bp, Artificial Sequence
  Synthetic
gcacacatggcggctgcacctgaccggcgttccct

SEQ ID NO: 3025 - DNA, 41 bp, Artificial Sequence
  Synthetic
cgaaaagcgtgccgccttgtgcgaattgaacggcttatggc

SEQ ID NO: 3026 - DNA, 37 bp, Artificial Sequence
  Synthetic
gcgttcttcccactgctgcaatgaccgccctgacagg

SEQ ID NO: 3027 - DNA, 43 bp, Artificial Sequence
  Synthetic
gcttgaaaaaacgtgttttaagggaaaccgaaaatgccgtctt

SEQ ID NO: 3028 - DNA, 40 bp, Artificial Sequence
  Synthetic
cggaaaaaatgtcggggatggctcctcctcaaacccgacc

SEQ ID NO: 3029 - DNA, 36 bp, Artificial Sequence
  Synthetic
cctgtccggcatccagacaggccgcatccgcctaca

SEQ ID NO: 3030 - DNA, 42 bp, Artificial Sequence
  Synthetic
cgcatcatcagcgtgttgtcggcggacggcaagaaataccgg

SEQ ID NO: 3031 - DNA, 41 bp, Artificial Sequence
  Synthetic
ggcagaaaaaatccgcgctcaagatgcgctgtttgcacaaa

SEQ ID NO: 3032 - DNA, 34 bp, Artificial Sequence
  Synthetic
cgaagtcagcaccgcgcctagcgcgtcccacctt

SEQ ID NO: 3033 - DNA, 38 bp, Artificial Sequence
  Synthetic
gccattcgatgacggcggccctccatatacgccagccc

SEQ ID NO: 3034 - DNA, 36 bp, Artificial Sequence
  Synthetic
ttgccgccgcgttgttctacatgcccgacaacccca

SEQ ID NO: 3035 - DNA, 41 bp, Artificial Sequence
  Synthetic
tttgagtgccgacgagaaccaggtaatactgttcctctacc

SEQ ID NO: 3036 - DNA, 40 bp, Artificial Sequence
  Synthetic
gccgccgatttggatgtcacttccgtaacggcgcattacg

SEQ ID NO: 3037 - DNA, 38 bp, Artificial Sequence
  Synthetic
cgtcatcctgcccaaacttgccgcaaggtcgtgcgcca

SEQ ID NO: 3038 - DNA, 41 bp, Artificial Sequence
  Synthetic
tcggtagggctgaacattgcccaaggcgatgtcctgatacg

SEQ ID NO: 3039 - DNA, 41 bp, Artificial Sequence
  Synthetic
gctcaaacccggacaggtcggatttgatgatgtgccagccg

SEQ ID NO: 3040 - DNA, 36 bp, Artificial Sequence
  Synthetic
cggcgcggaaagtaccatcctgcgaaatccgtgccg

SEQ ID NO: 3041 - DNA, 41 bp, Artificial Sequence
  Synthetic
cattgccgaaaaagtccgccagatttcagcttcgctcacgc

SEQ ID NO: 3042 - DNA, 36 bp, Artificial Sequence
  Synthetic
gtcaaagctgccgccacggggataccgccctgctgt

SEQ ID NO: 3043 - DNA, 35 bp, Artificial Sequence
  Synthetic
accgaacaaggcggacggtcgcccaacatttcggc

SEQ ID NO: 3044 - DNA, 36 bp, Artificial Sequence
  Synthetic
accctcggttcgacctgccttcggttctctcggggc

SEQ ID NO: 3045 - DNA, 40 bp, Artificial Sequence
  Synthetic
tttgcaccctgcggcaaatggcacactgatacccaaagca

SEQ ID NO: 3046 - DNA, 38 bp, Artificial Sequence
  Synthetic
cggtgtttgccgcgtatcgaatcgcacttgccgcagaa

SEQ ID NO: 3047 - DNA, 40 bp, Artificial Sequence
  Synthetic
gctttcgtcggagaggacggtactggcggtatgaacaggc

SEQ ID NO: 3048 - DNA, 37 bp, Artificial Sequence
  Synthetic
gctccctgcttagcggaacggagaatccgcccgaccg

SEQ ID NO: 3049 - DNA, 35 bp, Artificial Sequence
  Synthetic
gcgtttccggcccgaacagcgcgccccgatgaaac

SEQ ID NO: 3050 - DNA, 38 bp, Artificial Sequence
  Synthetic
gggcggcggtaaaggcgttttcacgggcgcaaaacttc

SEQ ID NO: 3051 - DNA, 39 bp, Artificial Sequence
  Synthetic
tcttctgcaaccgcccgcgacggctttgggcattttgtc

SEQ ID NO: 3052 - DNA, 35 bp, Artificial Sequence
  Synthetic
ccattgccgccagttcccatcggcaaatacgcgcc

SEQ ID NO: 3053 - DNA, 37 bp, Artificial Sequence
  Synthetic
tttgggcgcgcaccgtaacgaagccgtctatgccaag

SEQ ID NO: 3054 - DNA, 39 bp, Artificial Sequence
  Synthetic
ctgccactcgacgtgttcgctttacgccaaactctgggc

SEQ ID NO: 3055 - DNA, 38 bp, Artificial Sequence
  Synthetic
cgttttttgcgggtgctggcttgccgccgctacatcgt

SEQ ID NO: 3056 - DNA, 35 bp, Artificial Sequence
  Synthetic
agctggcggcaggtttcgcgcacgggattcgagga

SEQ ID NO: 3057 - DNA, 40 bp, Artificial Sequence
  Synthetic
cgccattacctacgcgctgatgccgtccgacaacaccatc

SEQ ID NO: 3058 - DNA, 35 bp, Artificial Sequence
  Synthetic
gcattacggcgcgttggcatcccacacggcaagct

SEQ ID NO: 3059 - DNA, 38 bp, Artificial Sequence
  Synthetic
atcggcacaattcccgctgccagaaatcggagtcgggc

SEQ ID NO: 3060 - DNA, 38 bp, Artificial Sequence
  Synthetic
gacggaaggggagggcaaagggagagcgcccaatacca

SEQ ID NO: 3061 - DNA, 41 bp, Artificial Sequence
  Synthetic
agcgcgatgatttggatgctgacgacgtaaaccaccaccag

SEQ ID NO: 3062 - DNA, 40 bp, Artificial Sequence
  Synthetic
aggggagggcgttcagacggatgataaataccgacgccgc

SEQ ID NO: 3063 - DNA, 35 bp, Artificial Sequence
  Synthetic
tttccgcacacgcccagccccgccgcctgtacgaa

SEQ ID NO: 3064 - DNA, 40 bp, Artificial Sequence
  Synthetic
ccgtgcgcgaaaaaagcaacccaatgcgccgtctatgtgt

SEQ ID NO: 3065 - DNA, 39 bp, Artificial Sequence
  Synthetic
agtccggatgccaagccgctcattatgggacaggtcgcc

SEQ ID NO: 3066 - DNA, 35 bp, Artificial Sequence
  Synthetic
gtgtgggcggcgttgttggccctgctgattctgcc

SEQ ID NO: 3067 - DNA, 41 bp, Artificial Sequence
  Synthetic
tgtgtaatcacgatgccgccgagtgatgctcacccaccaaa

SEQ ID NO: 3068 - DNA, 40 bp, Artificial Sequence
  Synthetic
gcgggattggtttcggtggggagcttcagatgtgtagggc

SEQ ID NO: 3069 - DNA, 37 bp, Artificial Sequence
  Synthetic
gcatattggtgcgcggatcgcgacccgcgcaaattcc

SEQ ID NO: 3070 - DNA, 36 bp, Artificial Sequence
  Synthetic
gcttcggtctcggaagcaggcatgcggcggtcagga

SEQ ID NO: 3071 - DNA, 36 bp, Artificial Sequence
  Synthetic
gtcccaaaactggctgcccacagttcggcggacgca

SEQ ID NO: 3072 - DNA, 37 bp, Artificial Sequence
  Synthetic
caagaaatcctcgccgtcggccgtccgcggaaggctt

SEQ ID NO: 3073 - DNA, 34 bp, Artificial Sequence
  Synthetic
tccacgaaaccggccacgccggacacgcccagtt

SEQ ID NO: 3074 - DNA, 38 bp, Artificial Sequence
  Synthetic
ggcatcaccgaacgcgtcgcgacgacggagttgagatg

SEQ ID NO: 3075 - DNA, 42 bp, Artificial Sequence
  Synthetic
ccgccggagattttgtagctgtcatcatgaccgtcttgcacg

SEQ ID NO: 3076 - DNA, 38 bp, Artificial Sequence
  Synthetic
cgttggtcggggcggtaacggatggtgtacgccatggc

SEQ ID NO: 3077 - DNA, 39 bp, Artificial Sequence
  Synthetic
acgccgacttcgccctgacctacaaaaccaacgcctcca

SEQ ID NO: 3078 - DNA, 34 bp, Artificial Sequence
  Synthetic
gggctttttcggcggcgacggcgggttggtgcaa

SEQ ID NO: 3079 - DNA, 39 bp, Artificial Sequence
  Synthetic
gcttccgatggcggcttacggttttcaatccggccggtg

SEQ ID NO: 3080 - DNA, 35 bp, Artificial Sequence
  Synthetic
agacggagttggggcagccgacggcgatgtcctgc

SEQ ID NO: 3081 - DNA, 38 bp, Artificial Sequence
  Synthetic
tgcgttcgttgcgtttgaggtcgacagccgttttgccg

SEQ ID NO: 3082 - DNA, 40 bp, Artificial Sequence
  Synthetic
cggaagttgtcgcgcattgtgcgcaatccaagtcccatcc

SEQ ID NO: 3083 - DNA, 37 bp, Artificial Sequence
  Synthetic
ggtcatccgatggcacagcttcgacatccgcgcccaa

SEQ ID NO: 3084 - DNA, 39 bp, Artificial Sequence
  Synthetic
cgcgtgcgtttgaggtggtcggaaggcttattgaccacc

SEQ ID NO: 3085 - DNA, 39 bp, Artificial Sequence
  Synthetic
ccaaagcgggtttcaggcgttgggcaaactctcccgttt

SEQ ID NO: 3086 - DNA, 41 bp, Artificial Sequence
  Synthetic
caggaaggtggcgacatcgacaagcgatgaaggacaacacc

SEQ ID NO: 3087 - DNA, 33 bp, Artificial Sequence
  Synthetic
tcgttgcggctgccgttcaccgcccgaaaccga

SEQ ID NO: 3088 - DNA, 36 bp, Artificial Sequence
  Synthetic
agcggatcggcaatgctgacccgcgcacgttttcgg

SEQ ID NO: 3089 - DNA, 37 bp, Artificial Sequence
  Synthetic
ttcccgtgcctgttccgccgcacaggaaatgccgtct

SEQ ID NO: 3090 - DNA, 38 bp, Artificial Sequence
  Synthetic
accgcgctcgatttggcggcacggcagttatcaggctg

SEQ ID NO: 3091 - DNA, 41 bp, Artificial Sequence
  Synthetic
ccgatgtggattttgccggacacgcggagtttaaagcacgc

SEQ ID NO: 3092 - DNA, 41 bp, Artificial Sequence
  Synthetic
cggcgtaacaaatcgtgcaggtgaacaaatccgcgtgttcg

SEQ ID NO: 3093 - DNA, 35 bp, Artificial Sequence
  Synthetic
acgctgtgctgggtgcgattcctgcaccagctcga

SEQ ID NO: 3094 - DNA, 38 bp, Artificial Sequence
  Synthetic
gacggtaaatttggcggcttcgtgccctgcggatccaa

SEQ ID NO: 3095 - DNA, 37 bp, Artificial Sequence
  Synthetic
gcgccgatgaggacgttcatacaacggcagcgaatgg

SEQ ID NO: 3096 - DNA, 40 bp, Artificial Sequence
  Synthetic
gaccatgcgtgcgttgatttggatgacgcgcgaacgtttg

SEQ ID NO: 3097 - DNA, 35 bp, Artificial Sequence
  Synthetic
gccggatttcgctgccgtttgctcctgaccaccgc

SEQ ID NO: 3098 - DNA, 38 bp, Artificial Sequence
  Synthetic
cgcatattggtgctgagccagatggaagccctcgccga

SEQ ID NO: 3099 - DNA, 39 bp, Artificial Sequence
  Synthetic
cgcggatggctttctcgacttcaccatcggcgtgaaacc

SEQ ID NO: 3100 - DNA, 35 bp, Artificial Sequence
  Synthetic
tgccgctgaaatacgcgcacgctgctcgccgtgat

SEQ ID NO: 3101 - DNA, 40 bp, Artificial Sequence
  Synthetic
cgactttgacgggcaggtagttcgtgtcgaaggcttgcag

SEQ ID NO: 3102 - DNA, 39 bp, Artificial Sequence
  Synthetic
cgatgtgtccgaccgtaccgagcgtaaccataggcagct

SEQ ID NO: 3103 - DNA, 36 bp, Artificial Sequence
  Synthetic
accactgcagtcgccacgctgatgaccgcgctgtcc

SEQ ID NO: 3104 - DNA, 40 bp, Artificial Sequence
  Synthetic
tcgtgaaatactcgcgcgtccgattacccagcaaatgcgc

SEQ ID NO: 3105 - DNA, 35 bp, Artificial Sequence
  Synthetic
gtttcggggaaacgggcgacgcccccatgtgcgat

SEQ ID NO: 3106 - DNA, 49 bp, Artificial Sequence
  Synthetic
gctactcgtgctaaattgatttgtgccaaatcttttgctttagtatcag

SEQ ID NO: 3107 - DNA, 43 bp, Artificial Sequence
  Synthetic
ggagttaaccatggctgaacaaatcaattgtaccaatcaggct

SEQ ID NO: 3108 - DNA, 42 bp, Artificial Sequence
  Synthetic
agctgctgttcggtgttcaattagttttgcctttagtggtaa

SEQ ID NO: 3109 - DNA, 44 bp, Artificial Sequence
  Synthetic
gcaaacagatttaaggcaaaacaacggcacaaaataagccgatt

SEQ ID NO: 3110 - DNA, 36 bp, Artificial Sequence
  Synthetic
aaagcctcgccctcctgccgacggcattgcatcgcg

SEQ ID NO: 3111 - DNA, 40 bp, Artificial Sequence
  Synthetic
cggttacctgacccgtcgtcatcgtcttcaacaacgacca

SEQ ID NO: 3112 - DNA, 40 bp, Artificial Sequence
  Synthetic
caacctctgggcggtaaagctgcccaaacctccatctcac

SEQ ID NO: 3113 - DNA, 38 bp, Artificial Sequence
  Synthetic
cgataccgatgccgtctgaacccccgcgcctgtaaacg

SEQ ID NO: 3114 - DNA, 37 bp, Artificial Sequence
  Synthetic
ggcagaaatggggcgcgaattgctgtgggggttgtct

SEQ ID NO: 3115 - DNA, 40 bp, Artificial Sequence
  Synthetic
cgtgcgggttcgactttaacctcgaaataacgccgctcca

SEQ ID NO: 3116 - DNA, 38 bp, Artificial Sequence
  Synthetic
gcaaaaagaagccgcgtggggcggattgcggatttcgt

SEQ ID NO: 3117 - DNA, 38 bp, Artificial Sequence
  Synthetic
ccagcggctgtatcgaacggtactacacccgcacccat

SEQ ID NO: 3118 - DNA, 38 bp, Artificial Sequence
  Synthetic
tgtgggagtgggcgaacgcccccgtattgaccacgtcc

SEQ ID NO: 3119 - DNA, 38 bp, Artificial Sequence
  Synthetic
ggcggtttcggcggaacacatgcgatgtggcaaacgcg

SEQ ID NO: 3120 - DNA, 37 bp, Artificial Sequence
  Synthetic
gtcgtggtcggtgctggttcgtatggcgatgtaccgg

SEQ ID NO: 3121 - DNA, 34 bp, Artificial Sequence
  Synthetic
gcgcgcggtcgttgatgtcagcgattggggcgtc

SEQ ID NO: 3122 - DNA, 43 bp, Artificial Sequence
  Synthetic
gctttctgttgaaatggagtctgataattgatgacgggggaag

SEQ ID NO: 3123 - DNA, 34 bp, Artificial Sequence
  Synthetic
acgtggtgaaagccggcggcgtgcggcatcgact

SEQ ID NO: 3124 - DNA, 36 bp, Artificial Sequence
  Synthetic
atccatcggcgtggggcagagcgatttggcgagccg

SEQ ID NO: 3125 - DNA, 38 bp, Artificial Sequence
  Synthetic
ggaatgcccgaaagcagcctaataaatcgacgcgccgg

SEQ ID NO: 3126 - DNA, 36 bp, Artificial Sequence
  Synthetic
ggctggacgatacgcagctgtccaactcgcgcaggt

SEQ ID NO: 3127 - DNA, 40 bp, Artificial Sequence
  Synthetic
tgcgatgaagctgtggaaggaaaccgccgcgatacctatg

SEQ ID NO: 3128 - DNA, 39 bp, Artificial Sequence
  Synthetic
cgaccttggacggcaaagtcacatcctcctgccggtttg

SEQ ID NO: 3129 - DNA, 38 bp, Artificial Sequence
  Synthetic
aaagcccttccttcgacagcgaggtatttggggcgaaa

SEQ ID NO: 3130 - DNA, 38 bp, Artificial Sequence
  Synthetic
cagccgttacctcgggggatttccgggtgtattcggca

SEQ ID NO: 3131 - DNA, 41 bp, Artificial Sequence
  Synthetic
tccacgatacggtcgacggtttccggacacttggttttcgg

SEQ ID NO: 3132 - DNA, 38 bp, Artificial Sequence
  Synthetic
ccatactttccctgctgcggacgctatgcgccaatccc

SEQ ID NO: 3133 - DNA, 37 bp, Artificial Sequence
  Synthetic
gggttcgcctagctgccagcttcccgttttcgccagt

SEQ ID NO: 3134 - DNA, 39 bp, Artificial Sequence
  Synthetic
aggatgatggcggtgctgtacctggctgaccaacccctt

SEQ ID NO: 3135 - DNA, 35 bp, Artificial Sequence
  Synthetic
ggtggcggatgtcgggactgctgccgccaatcgct

SEQ ID NO: 3136 - DNA, 41 bp, Artificial Sequence
  Synthetic
acgcctgattcgaggttcagcaccggcagcttcaaaaacac

SEQ ID NO: 3137 - DNA, 37 bp, Artificial Sequence
  Synthetic
agtacggtgccggcgatgcgccaacccaactacaccg

SEQ ID NO: 3138 - DNA, 37 bp, Artificial Sequence
  Synthetic
ggagatgtagccggtcagggccgacagcctgcaaccc

SEQ ID NO: 3139 - DNA, 36 bp, Artificial Sequence
  Synthetic
tgcggagggtgccgagttcacatgggacccgacgac

SEQ ID NO: 3140 - DNA, 38 bp, Artificial Sequence
  Synthetic
ttccctttgagccggggcgctaccctatagcccgcctt

SEQ ID NO: 3141 - DNA, 40 bp, Artificial Sequence
  Synthetic
cgcgctgttctttgaacgacgacgctgacgctgatttccg

SEQ ID NO: 3142 - DNA, 36 bp, Artificial Sequence
  Synthetic
atcaatacgccggcgcaggcgcgcccaagcttcgac

SEQ ID NO: 3143 - DNA, 40 bp, Artificial Sequence
  Synthetic
ggcaacgtcggcgatgtctttgtcgttgccaaagcctttg

SEQ ID NO: 3144 - DNA, 39 bp, Artificial Sequence
  Synthetic
cttcggcacactgcttaccctacataaacagcggcaggg

SEQ ID NO: 3145 - DNA, 40 bp, Artificial Sequence
  Synthetic
ggcttcgttggggatggagattctttggacggcgttacca

SEQ ID NO: 3146 - DNA, 38 bp, Artificial Sequence
  Synthetic
tttccccgaaaccctgccagggaaggttcgggcatcac

SEQ ID NO: 3147 - DNA, 36 bp, Artificial Sequence
  Synthetic
aagtcggcgcgggcaaaggtagcgtgccgggcgtta

SEQ ID NO: 3148 - DNA, 38 bp, Artificial Sequence
  Synthetic
tccacaggtttgttcaagccaactcgtccgtactttgg

SEQ ID NO: 3149 - DNA, 40 bp, Artificial Sequence
  Synthetic
tctgcaatctgttccgcacgaatgcaatgtttatctgcct

SEQ ID NO: 3150 - DNA, 41 bp, Artificial Sequence
  Synthetic
gcctgttttaatcggatcggtcaaatgccttggaaaaacct

SEQ ID NO: 3151 - DNA, 43 bp, Artificial Sequence
  Synthetic
cctttttttcaaatgcgccaacttattgttatggcttggggtg

SEQ ID NO: 3152 - DNA, 38 bp, Artificial Sequence
  Synthetic
ccgtcggcatcaccctcatcaggttgacaagcccggtt

SEQ ID NO: 3153 - DNA, 38 bp, Artificial Sequence
  Synthetic
gcgcggtgttcgacaaataccgttgccggaaaccgtca

SEQ ID NO: 3154 - DNA, 39 bp, Artificial Sequence
  Synthetic
agcctcccttcccgacttggctgccggtaatgttttgcg

SEQ ID NO: 3155 - DNA, 41 bp, Artificial Sequence
  Synthetic
cgggcaggctttgggtttgaacgatgcggtcgttttgaaag

SEQ ID NO: 3156 - DNA, 35 bp, Artificial Sequence
  Synthetic
tcaagggcggccgcctttcgtcaggccggcggtat

SEQ ID NO: 3157 - DNA, 38 bp, Artificial Sequence
  Synthetic
agctgtttaaagaccgcctgcttcgatgcgcgaagggt

SEQ ID NO: 3158 - DNA, 38 bp, Artificial Sequence
  Synthetic
aaatcccgtcctggttcggcgtcgagcagtgtgccttt

SEQ ID NO: 3159 - DNA, 42 bp, Artificial Sequence
  Synthetic
cgcgcaggttatttcttcacgcttgtccgcgtatgatgaacg

SEQ ID NO: 3160 - DNA, 39 bp, Artificial Sequence
  Synthetic
cccggctcggatgtcgatttgcgtttccaagaggcggtc

SEQ ID NO: 3161 - DNA, 35 bp, Artificial Sequence
  Synthetic
tttcggcagcaccccttccccgtcaaaaccggccg

SEQ ID NO: 3162 - DNA, 41 bp, Artificial Sequence
  Synthetic
tgatggagcacctactagtatggttttacccctgcttcacg

SEQ ID NO: 3163 - DNA, 35 bp, Artificial Sequence
  Synthetic
caaaccgcctcgcgcaaaccggcgtacggctcgaa

SEQ ID NO: 3164 - DNA, 37 bp, Artificial Sequence
  Synthetic
ccagcaggttgccgaaaatgccgatgccgtgtccgca

SEQ ID NO: 3165 - DNA, 37 bp, Artificial Sequence
  Synthetic
cccaacccgaacaccaccactcttctgtgccgtccgg

SEQ ID NO: 3166 - DNA, 39 bp, Artificial Sequence
  Synthetic
tgcgccaaaacaaccaaaccaacaggtggcggttgtagc

SEQ ID NO: 3167 - DNA, 38 bp, Artificial Sequence
  Synthetic
gcaccgcccgcattcaggacgatacagtcgcacatggc

SEQ ID NO: 3168 - DNA, 37 bp, Artificial Sequence
  Synthetic
ctttggcgaggcagacgcgcgacctcgacaccgacga

SEQ ID NO: 3169 - DNA, 38 bp, Artificial Sequence
  Synthetic
gggtggatttgccggcgttaactcaaagtcctcgccga

SEQ ID NO: 3170 - DNA, 40 bp, Artificial Sequence
  Synthetic
gtgtttgaggaagcggtggcctccccggtctgattgaagg

SEQ ID NO: 3171 - DNA, 39 bp, Artificial Sequence
  Synthetic
cgcggttgctccaccatgtatgggctggacggacatgtg

SEQ ID NO: 3172 - DNA, 35 bp, Artificial Sequence
  Synthetic
gcggcgaatacatcagcgcgttcggctgcacccca

SEQ ID NO: 3173 - DNA, 38 bp, Artificial Sequence
  Synthetic
gcgggcgcgaaaaatatgcgccacttgggcgtgaatcg

SEQ ID NO: 3174 - DNA, 38 bp, Artificial Sequence
  Synthetic
aagttgccgccgccgatatcgcctttgacaaagttcgg

SEQ ID NO: 3175 - DNA, 38 bp, Artificial Sequence
  Synthetic
cgttgagctgctgcggcttcttgccgcaacacgtatcg

SEQ ID NO: 3176 - DNA, 41 bp, Artificial Sequence
  Synthetic
agcgaacccaactcatactgcgcgagtgcctgatgttcagt

SEQ ID NO: 3177 - DNA, 37 bp, Artificial Sequence
  Synthetic
cacggaaaccgacctgtcgtcagggcgaacagacggt

SEQ ID NO: 3178 - DNA, 36 bp, Artificial Sequence
  Synthetic
tatgcgccccgccgaatccgggaaaacgcccaagcc

SEQ ID NO: 3179 - DNA, 38 bp, Artificial Sequence
  Synthetic
caaacacggcaggcttctttccaatcggggtcggcagg

SEQ ID NO: 3180 - DNA, 36 bp, Artificial Sequence
  Synthetic
acaccgccgtctcacgcagattcgacggccagtgcg

SEQ ID NO: 3181 - DNA, 38 bp, Artificial Sequence
  Synthetic
accccggctacatcgccagggcggtgggcatttgtttg

SEQ ID NO: 3182 - DNA, 36 bp, Artificial Sequence
  Synthetic
atcccccgagcacaccagcgtgtaaacccgcgccac

SEQ ID NO: 3183 - DNA, 39 bp, Artificial Sequence
  Synthetic
tgcaggaaaacggcagcctactcgctggataatggcttg

SEQ ID NO: 3184 - DNA, 35 bp, Artificial Sequence
  Synthetic
tttcctggctgccgctggcagcgttgccgtcaggg

SEQ ID NO: 3185 - DNA, 33 bp, Artificial Sequence
  Synthetic
cagcacgggtacgctgctaaagcagggccgcca

SEQ ID NO: 3186 - DNA, 38 bp, Artificial Sequence
  Synthetic
ccagacgggcgaggtaaaccatccgatccgcgcatcgt

SEQ ID NO: 3187 - DNA, 36 bp, Artificial Sequence
  Synthetic
cgcggataggcgtttttgcgcgcaagccggcaaact

SEQ ID NO: 3188 - DNA, 40 bp, Artificial Sequence
  Synthetic
ctgccgagcaggtctttggcggcaaaaaccaaggctttga

SEQ ID NO: 3189 - DNA, 40 bp, Artificial Sequence
  Synthetic
gccatacctttgctgttgccgacgaccgggcatattcagc

SEQ ID NO: 3190 - DNA, 34 bp, Artificial Sequence
  Synthetic
aaccggcatcgcccaacggcttttcgccgcttgc

SEQ ID NO: 3191 - DNA, 35 bp, Artificial Sequence
  Synthetic
ggcaggctggcggtttaccgcgcggcaggtcgaaa

SEQ ID NO: 3192 - DNA, 42 bp, Artificial Sequence
  Synthetic
tgccattacgtcgtcgttgactaaactttaccgcgaactgcc

SEQ ID NO: 3193 - DNA, 39 bp, Artificial Sequence
  Synthetic
ttccaagttgcgttgggcgtgcaaggcgaagtcatcacc

SEQ ID NO: 3194 - DNA, 37 bp, Artificial Sequence
  Synthetic
ggtcaggtgcaccatcagcagtgctcaaacgcctgcg

SEQ ID NO: 3195 - DNA, 40 bp, Artificial Sequence
  Synthetic
tccgcacacacttccaaggttcgtgaaaacaaacgcggac

SEQ ID NO: 3196 - DNA, 39 bp, Artificial Sequence
  Synthetic
gccccatcatggttttgggctactggccgaaatcacccg

SEQ ID NO: 3197 - DNA, 38 bp, Artificial Sequence
  Synthetic
gccgctgttcgaacgcaaatcccgcagcagcctttcgc

SEQ ID NO: 3198 - DNA, 36 bp, Artificial Sequence
  Synthetic
agtctgcgcccaaatcggcccatttgggctgctcgc

SEQ ID NO: 3199 - DNA, 40 bp, Artificial Sequence
  Synthetic
ttgccgcatcgaagttcggcttgttctttgcccctgaagg

SEQ ID NO: 3200 - DNA, 43 bp, Artificial Sequence
  Synthetic
tgacatttttagaatgatgccgtcttgaaaagcctgaatccgt

SEQ ID NO: 3201 - DNA, 39 bp, Artificial Sequence
  Synthetic
gcggacgtgatggcgaaaatggccgcctttaccgaatgc

SEQ ID NO: 3202 - DNA, 39 bp, Artificial Sequence
  Synthetic
gccctcgccgaagtagtcgttgttggacgaagccgcagc

SEQ ID NO: 3203 - DNA, 35 bp, Artificial Sequence
  Synthetic
cggacgcttgcagcacctgccatccgtgaagcagc

SEQ ID NO: 3204 - DNA, 38 bp, Artificial Sequence
  Synthetic
aattgcgcgtccggccagtcatcacctacaaactcgcc

SEQ ID NO: 3205 - DNA, 36 bp, Artificial Sequence
  Synthetic
cgtcaacgccgccaacgaccaggttgacggcaggtg

SEQ ID NO: 3206 - DNA, 38 bp, Artificial Sequence
  Synthetic
ccccgtgttgccgcaaactaatcgcgtccagattgagg

SEQ ID NO: 3207 - DNA, 38 bp, Artificial Sequence
  Synthetic
gcaaaatcaaacgcgtgcgcccctttttcgcgtgccgc

SEQ ID NO: 3208 - DNA, 38 bp, Artificial Sequence
  Synthetic
acgcataccgccgacctttctgcccttgattgccgttg

SEQ ID NO: 3209 - DNA, 35 bp, Artificial Sequence
  Synthetic
cctcggctgcgccaatttgaaggcttgggcgcaca

SEQ ID NO: 3210 - DNA, 41 bp, Artificial Sequence
  Synthetic
cggcaagcaggaaaaaaacgctatggccttggtcggtatgg

SEQ ID NO: 3211 - DNA, 35 bp, Artificial Sequence
  Synthetic
ctgccgcatctgtgcccacgaacatcggcggtctg

SEQ ID NO: 3212 - DNA, 39 bp, Artificial Sequence
  Synthetic
gtacgttccacgccgtttctgaaccggtatcgaaatcgt

SEQ ID NO: 3213 - DNA, 39 bp, Artificial Sequence
  Synthetic
acaagccccgattccccggttcctttctttgcgatgcct

SEQ ID NO: 3214 - DNA, 37 bp, Artificial Sequence
  Synthetic
catcgttgccgggtattgccccgccggcagaagcgtt

SEQ ID NO: 3215 - DNA, 42 bp, Artificial Sequence
  Synthetic
ccaaatccgccaactctaccgagacaaaaccaaattcccgcc

SEQ ID NO: 3216 - DNA, 35 bp, Artificial Sequence
  Synthetic
tcgccttgggctgacgcagcgtgcctgttccggca

SEQ ID NO: 3217 - DNA, 37 bp, Artificial Sequence
  Synthetic
gcgcccgaaaaacagcttgcggtaactgtgcgcctgc

SEQ ID NO: 3218 - DNA, 35 bp, Artificial Sequence
  Synthetic
acattccggaccgcccctcgcgagcgtttcccagc

SEQ ID NO: 3219 - DNA, 39 bp, Artificial Sequence
  Synthetic
gcataccgcccgccaaaaagagcactaccgctggacgta

SEQ ID NO: 3220 - DNA, 37 bp, Artificial Sequence
  Synthetic
gtccagccacgtctttaccgccggcgttcgtgtcggt

SEQ ID NO: 3221 - DNA, 39 bp, Artificial Sequence
  Synthetic
ggcttccaaaccagccgccgatttcctcgaccttgcctt

SEQ ID NO: 3222 - DNA, 41 bp, Artificial Sequence
  Synthetic
tgcaccgatatgcccgaactctagggttcgtacagggatgc

SEQ ID NO: 3223 - DNA, 38 bp, Artificial Sequence
  Synthetic
gcaaccgcagcaactacgcccgccgcatcatatgggaa

SEQ ID NO: 3224 - DNA, 38 bp, Artificial Sequence
  Synthetic
ccgtcggacaactcgtcttcttccaagcgtgcggatgc

SEQ ID NO: 3225 - DNA, 34 bp, Artificial Sequence
  Synthetic
aaccaggcaggccggcttgccggttgcgcgcaaa

SEQ ID NO: 3226 - DNA, 39 bp, Artificial Sequence
  Synthetic
ttgcgacaggacgggcagcttggaaatggaaaacccgcg

SEQ ID NO: 3227 - DNA, 37 bp, Artificial Sequence
  Synthetic
cgcgacattctgcgcggagaggttgatgtcttgcggc

SEQ ID NO: 3228 - DNA, 40 bp, Artificial Sequence
  Synthetic
cgagttccacacccaagccaacttcatcggtcagcggaat

SEQ ID NO: 3229 - DNA, 36 bp, Artificial Sequence
  Synthetic
cggtatgttcggcggcgttatgctgtcggcgagtgc

SEQ ID NO: 3230 - DNA, 35 bp, Artificial Sequence
  Synthetic
ggcgcgccatccatgttccggtcgctgtctcgcgt

SEQ ID NO: 3231 - DNA, 34 bp, Artificial Sequence
  Synthetic
gcctccgtcggcgcatttaatcgggcccggatgg

SEQ ID NO: 3232 - DNA, 37 bp, Artificial Sequence
  Synthetic
gccgtctgaaagccgtttgcggcactgccgccggatt

SEQ ID NO: 3233 - DNA, 36 bp, Artificial Sequence
  Synthetic
cgtccgaagcgtttggcgtagcaccaaaatgccgcg

SEQ ID NO: 3234 - DNA, 45 bp, Artificial Sequence
  Synthetic
tccggctacaagtgataaggtgggctttaattgacgattatcttg

SEQ ID NO: 3235 - DNA, 38 bp, Artificial Sequence
  Synthetic
ccggctgacgattttggggctccgtccggttcaaaccc

SEQ ID NO: 3236 - DNA, 37 bp, Artificial Sequence
  Synthetic
tcgccgcaaaattccgacccattgtgcggcggaaacc

SEQ ID NO: 3237 - DNA, 37 bp, Artificial Sequence
  Synthetic
cgctgcaaacccacggcaaacgttcggctttggtgcc

SEQ ID NO: 3238 - DNA, 39 bp, Artificial Sequence
  Synthetic
cgggttactttggcagggtcgaaggctccggcgaatacg

SEQ ID NO: 3239 - DNA, 40 bp, Artificial Sequence
  Synthetic
tggcataatcgagcagcagcacctgccctatctggtagcg

SEQ ID NO: 3240 - DNA, 40 bp, Artificial Sequence
  Synthetic
gcctgcgtaattccggcaaccgccggctttgtttatgttg

SEQ ID NO: 3241 - DNA, 36 bp, Artificial Sequence
  Synthetic
ccatacagccggccgccttccgtttgaggcgcgggt

SEQ ID NO: 3242 - DNA, 40 bp, Artificial Sequence
  Synthetic
gagggttttgtcaccggagaggttccgccgactattccca

SEQ ID NO: 3243 - DNA, 37 bp, Artificial Sequence
  Synthetic
acatcggcatcagcgcggggcggcggattttgcctct

SEQ ID NO: 3244 - DNA, 37 bp, Artificial Sequence
  Synthetic
cgacctgcgccaaatcggtaaaacaggatgccgacgc

SEQ ID NO: 3245 - DNA, 39 bp, Artificial Sequence
  Synthetic
acgcgggcttcagctacggaacaagtgcagatgcttggt

SEQ ID NO: 3246 - DNA, 38 bp, Artificial Sequence
  Synthetic
gtcatcgacagcgaccccgttcgttgaggaatcgggct

SEQ ID NO: 3247 - DNA, 40 bp, Artificial Sequence
  Synthetic
cgttcaacgtcgtcatccgcactgcctgaaacaatgccgt

SEQ ID NO: 3248 - DNA, 35 bp, Artificial Sequence
  Synthetic
cagacccgaaaaaccgcgccgaggtcgttgcgcag

SEQ ID NO: 3249 - DNA, 38 bp, Artificial Sequence
  Synthetic
cggcatttccacgccgcaatctttggcggatgcggtcg

SEQ ID NO: 3250 - DNA, 39 bp, Artificial Sequence
  Synthetic
ccgtcaaagccgttgccgaaacgccgcaaaccaatttcg

SEQ ID NO: 3251 - DNA, 41 bp, Artificial Sequence
  Synthetic
ggggttttcaggcggcatgaaacatccgatacagccgtccc

SEQ ID NO: 3252 - DNA, 36 bp, Artificial Sequence
  Synthetic
cagccaggcaaacgccatcacccgcctgccaaaacc

SEQ ID NO: 3253 - DNA, 39 bp, Artificial Sequence
  Synthetic
tcagggtaacgcctgccgctacccggaaaaacatacgcg

SEQ ID NO: 3254 - DNA, 34 bp, Artificial Sequence
  Synthetic
ccgcgttcgaccacggtttttgcggtcggtgcgt

SEQ ID NO: 3255 - DNA, 36 bp, Artificial Sequence
  Synthetic
ttgccgccgcattgggcaaacagggcatattcgcgc

SEQ ID NO: 3256 - DNA, 38 bp, Artificial Sequence
  Synthetic
gcggtagtagccgtagcggatcggcaggcatgataggc

SEQ ID NO: 3257 - DNA, 38 bp, Artificial Sequence
  Synthetic
gctgatggtgcgcgaaacgccatttccgttacccgctt

SEQ ID NO: 3258 - DNA, 37 bp, Artificial Sequence
  Synthetic
tgcctgcccttccaatgccgtcgtcgcttcgtttgcc

SEQ ID NO: 3259 - DNA, 37 bp, Artificial Sequence
  Synthetic
ccccaaatgccgaccagggtgcaaaattgccgccgcc

SEQ ID NO: 3260 - DNA, 37 bp, Artificial Sequence
  Synthetic
acgcgtttgttggcggcggccgtcgccgtattcaaac

SEQ ID NO: 3261 - DNA, 38 bp, Artificial Sequence
  Synthetic
gggcatcgccgtattggtacgatggcgaacgggtttgc

SEQ ID NO: 3262 - DNA, 37 bp, Artificial Sequence
  Synthetic
ggcaaatgccgtctgcgcgcgcaaggaagacggttcg

SEQ ID NO: 3263 - DNA, 40 bp, Artificial Sequence
  Synthetic
ggcgcgtatgtgctgcaccttagaatgtttgttgcgccgg

SEQ ID NO: 3264 - DNA, 35 bp, Artificial Sequence
  Synthetic
gcccgaagaaacccgccaagcgtcgccgaatctgc

SEQ ID NO: 3265 - DNA, 39 bp, Artificial Sequence
  Synthetic
cgcgccattttgaaagacgcgttgtccaatgcgctggtg

SEQ ID NO: 3266 - DNA, 34 bp, Artificial Sequence
  Synthetic
gccgacggcgtatgtgcatcgcgagcgtgccttt

SEQ ID NO: 3267 - DNA, 39 bp, Artificial Sequence
  Synthetic
cccctgatcaaccacggctttggtggaaaggatgtcggc

SEQ ID NO: 3268 - DNA, 40 bp, Artificial Sequence
  Synthetic
gccaaagaagccggagccaaactgcaatgggaaggaacgg

SEQ ID NO: 3269 - DNA, 37 bp, Artificial Sequence
  Synthetic
ttcggcaaccccgcaaccgcttgcgtgcagagtaccg

SEQ ID NO: 3270 - DNA, 47 bp, Artificial Sequence
  Synthetic
gtgctaaatctaccaagttgcaaatttgtagctactttgatattccg

SEQ ID NO: 3271 - DNA, 40 bp, Artificial Sequence
  Synthetic
tggtaaggtgtcacttgctccttatgcaacgaaagcttgt

SEQ ID NO: 3272 - DNA, 43 bp, Artificial Sequence
  Synthetic
tgcttagtctttctttttctggagaaaaaggaccgtctgttgc

SEQ ID NO: 3273 - DNA, 43 bp, Artificial Sequence
  Synthetic
gtaacccagctaggcaatttgttatagaagtgttcctgcagct

SEQ ID NO: 3274 - DNA, 43 bp, Artificial Sequence
  Synthetic
cgatgcccatttgtattgcaacatcatataccagcaacaaggg

SEQ ID NO: 3275 - DNA, 46 bp, Artificial Sequence
  Synthetic
tcctggcatcttcaaaaaacaatagtgggaaagttgattatgatgg

SEQ ID NO: 3276 - DNA, 42 bp, Artificial Sequence
  Synthetic
tccatctatacctccagcactttactagggatccggccatag

SEQ ID NO: 3277 - DNA, 45 bp, Artificial Sequence
  Synthetic
gaacaatagatgaagcaccaggctattccactagaacctataggc

SEQ ID NO: 3278 - DNA, 45 bp, Artificial Sequence
  Synthetic
tggaacctgtgttgtgtatctagtagccacctgtacaaagtactc

SEQ ID NO: 3279 - DNA, 46 bp, Artificial Sequence
  Synthetic
ccctgtgtgtctgtagtggtaacttttctgacgaatctttattgga

SEQ ID NO: 3280 - DNA, 46 bp, Artificial Sequence
  Synthetic
caaactaaccgttctctttgaggatgttttgcgtttacagttacct

SEQ ID NO: 3281 - DNA, 43 bp, Artificial Sequence
  Synthetic
tgacgagcataaagttgttctcttttggccagattttgtgcag

SEQ ID NO: 3282 - DNA, 48 bp, Artificial Sequence
  Synthetic
gggatccattgcattaatatgagctttggaagtagaaatagtaatgca

SEQ ID NO: 3283 - DNA, 47 bp, Artificial Sequence
  Synthetic
aagcagtcaggatattcaagtacaacaatgttaagctgtgaaacttg

SEQ ID NO: 3284 - DNA, 42 bp, Artificial Sequence
  Synthetic
tcttctccatactctttcattgcccgacaatgcttcaatccg

SEQ ID NO: 3285 - DNA, 45 bp, Artificial Sequence
  Synthetic
tccttgtaatcatacaaatctggcagcctggacagtagtaaacag

SEQ ID NO: 3286 - DNA, 44 bp, Artificial Sequence
  Synthetic
ctgaaaacaaggaggcccatcattgaaccttttctgaaaacaac

SEQ ID NO: 3287 - DNA, 42 bp, Artificial Sequence
  Synthetic
agctgactcgttttcttcatgtttaagcaagtactggcggaa

SEQ ID NO: 3288 - DNA, 42 bp, Artificial Sequence
  Synthetic
tctcatgcttgcaatgtgttcaactggatagagctcgatgag

SEQ ID NO: 3289 - DNA, 44 bp, Artificial Sequence
  Synthetic
tcacaaagtttaccacgtcggatggtttcatcataaaaggaaga

SEQ ID NO: 3290 - DNA, 45 bp, Artificial Sequence
  Synthetic
gtctttctctttgacagaggactcgctccttcagtcactacaaca

SEQ ID NO: 3291 - DNA, 38 bp, Artificial Sequence
  Synthetic
tctgttcgctgaaggggtcctggaggaagccacacgga

SEQ ID NO: 3292 - DNA, 39 bp, Artificial Sequence
  Synthetic
tggctccactggtccccaatcggaccccctttcaaagtg

SEQ ID NO: 3293 - DNA, 40 bp, Artificial Sequence
  Synthetic
gacgcacgtccactcggatgtagcttcccagagagaagcg

SEQ ID NO: 3294 - DNA, 41 bp, Artificial Sequence
  Synthetic
catgcaaggagtcccggagtcttccccttatgtccagtccc

SEQ ID NO: 3295 - DNA, 40 bp, Artificial Sequence
  Synthetic
ccaggggaggattcaccgacagttctcgagggccttcctt

SEQ ID NO: 3296 - DNA, 45 bp, Artificial Sequence
  Synthetic
aggatcctcgaacatagctgtttcgaaaccggtacatataaaagt

SEQ ID NO: 3297 - DNA, 45 bp, Artificial Sequence
  Synthetic
ggcatttgacatctatgacaccttatatggtgcaacattagaagc

SEQ ID NO: 3298 - DNA, 45 bp, Artificial Sequence
  Synthetic
gttcgtagcagcgtaggtcaattgaagatgtaatactagatctgg

SEQ ID NO: 3299 - DNA, 42 bp, Artificial Sequence
  Synthetic
ctcctcatttgtaccttcacagtccttggtgtgccatcagtg

SEQ ID NO: 3300 - DNA, 41 bp, Artificial Sequence
  Synthetic
ttaaattgcgcactgcctttgttaacccaggcattgtttca

SEQ ID NO: 3301 - DNA, 45 bp, Artificial Sequence
  Synthetic
ccaaatctaatctggaccaggtggcaatgggaatcctgtatatgc

SEQ ID NO: 3302 - DNA, 43 bp, Artificial Sequence
  Synthetic
cgtgtttattaacgactgcaatgctgtggtgccctctactgtt

SEQ ID NO: 3303 - DNA, 46 bp, Artificial Sequence
  Synthetic
cgtaatactgcttatatgccccttgtaaaggtactggagatgttga

SEQ ID NO: 3304 - DNA, 39 bp, Artificial Sequence
  Synthetic
cggtggtgtcaggtccactgaggcaccaaggaaaccgag

SEQ ID NO: 3305 - DNA, 42 bp, Artificial Sequence
  Synthetic
aggggctccagattgtataatactctgtgggtcctacagaac

SEQ ID NO: 3306 - DNA, 40 bp, Artificial Sequence
  Synthetic
agatgtaagggccggacgatcagtagtactgtagcacctg

SEQ ID NO: 3307 - DNA, 45 bp, Artificial Sequence
  Synthetic
atgttgtaggggaatatgacatgcatatgcagaccctgatacagt

SEQ ID NO: 3308 - DNA, 48 bp, Artificial Sequence
  Synthetic
gcatacgtttacggcgtttatggcatggggataattattatttatggc

SEQ ID NO: 3309 - DNA, 41 bp, Artificial Sequence
  Synthetic
aggatcaggtaggtgcactccgaaattcctaaggtatctgc

SEQ ID NO: 3310 - DNA, 50 bp, Artificial Sequence
  Synthetic
cacgttgtgtctgtgtatttttacacagttatgtattataggttgtacac

SEQ ID NO: 3311 - DNA, 47 bp, Artificial Sequence
  Synthetic
cccccgccttattataaaaatgtctacagcatgtttttttttcttcg

SEQ ID NO: 3312 - DNA, 47 bp, Artificial Sequence
  Synthetic
acacaccttacataacataccacaaaacgcaaaaaacgtaaacttac

SEQ ID NO: 3313 - DNA, 36 bp, Artificial Sequence
  Synthetic
ctccacccttctgcagacggtggagcacccccccta

SEQ ID NO: 3314 - DNA, 42 bp, Artificial Sequence
  Synthetic
ggaccctatcaggcagtacggtgcaagcccacctatatgtgt

SEQ ID NO: 3315 - DNA, 40 bp, Artificial Sequence
  Synthetic
ccagcaagcgtactatctggcatctagtaggcccgctggt

SEQ ID NO: 3316 - DNA, 40 bp, Artificial Sequence
  Synthetic
tgtacggattggcgggaaccttgttctccttccacttgcc

SEQ ID NO: 3317 - DNA, 43 bp, Artificial Sequence
  Synthetic
caccagggattgtataggggtactttgttacagtccaaagtgg

SEQ ID NO: 3318 - DNA, 46 bp, Artificial Sequence
  Synthetic
gtggaattcacagggtcataaaagttcaggccatttgtattttgag

SEQ ID NO: 3319 - DNA, 40 bp, Artificial Sequence
  Synthetic
agctgaagcaggcgtaaccaaagtcaccgcatagctctgc

SEQ ID NO: 3320 - DNA, 39 bp, Artificial Sequence
  Synthetic
cgatgctgcactggatgttaacgctggtgactttctgtg

SEQ ID NO: 3321 - DNA, 41 bp, Artificial Sequence
  Synthetic
gcatagccaaccctgcgaaaaccacggttgatggtttgccc

SEQ ID NO: 3322 - DNA, 42 bp, Artificial Sequence
  Synthetic
ccagctccacatggtggttgatacacccaataaccgttgacg

SEQ ID NO: 3323 - DNA, 43 bp, Artificial Sequence
  Synthetic
tgggggcaattaaaatttgcactgccactcttgatacaaaacc

SEQ ID NO: 3324 - DNA, 39 bp, Artificial Sequence
  Synthetic
ggtgtagggattactccaggggtcctaaccgaagctcca

SEQ ID NO: 3325 - DNA, 43 bp, Artificial Sequence
  Synthetic
agtttgagcttctgttgatgacaaacattgttgaagccttcga

SEQ ID NO: 3326 - DNA, 46 bp, Artificial Sequence
  Synthetic
cccaagaaaggtgttaagtttttcagagtacaatcaccacaactag

SEQ ID NO: 3327 - DNA, 40 bp, Artificial Sequence
  Synthetic
ggccactcacccatcaagcattttgacatgctaggcggct

SEQ ID NO: 3328 - DNA, 42 bp, Artificial Sequence
  Synthetic
tcagttgggtccggtctagcacttgttcaaattactggagag

SEQ ID NO: 3329 - DNA, 41 bp, Artificial Sequence
  Synthetic
ggtggtgaaggagggaggtttgtcatgtcctgaaagcctgc

SEQ ID NO: 3330 - DNA, 44 bp, Artificial Sequence
  Synthetic
cagttttgaagctaatcacgtcggtgggaaagagtgagttttcg

SEQ ID NO: 3331 - DNA, 40 bp, Artificial Sequence
  Synthetic
gtccagaacagccttgcggggctaagtcccacatcactgg

SEQ ID NO: 3332 - DNA, 41 bp, Artificial Sequence
  Synthetic
cctcgggtgtgatggtactgtctgttgtcgatgtggtcacc

SEQ ID NO: 3333 - DNA, 40 bp, Artificial Sequence
  Synthetic
gcgctcttccaaattacggtgccgaacaggctggcatgaa

SEQ ID NO: 3334 - DNA, 42 bp, Artificial Sequence
  Synthetic
gcagatcttctacaggcaccgtttgaggacaaacttcccgag

SEQ ID NO: 3335 - DNA, 38 bp, Artificial Sequence
  Synthetic
aaagtggtgtaccgagccaccttctctggcatgctaca

SEQ ID NO: 3336 - DNA, 40 bp, Artificial Sequence
  Synthetic
ggcttcacccgaaacggttctggggagaccccgggcttaa

SEQ ID NO: 3337 - DNA, 44 bp, Artificial Sequence
  Synthetic
cagtggttatcaggatggcaatttctgtttctctcaccatttcc

SEQ ID NO: 3338 - DNA, 45 bp, Artificial Sequence
  Synthetic
ggaaagcctaatcgaattgtccttatacagaaattggtcaaagcc

SEQ ID NO: 3339 - DNA, 38 bp, Artificial Sequence
  Synthetic
acacaaacatgcagccatgccaagtgtgcatagcatgg

SEQ ID NO: 3340 - DNA, 43 bp, Artificial Sequence
  Synthetic
gaggatagcaggagcactccggaaaatcattcatactagcaca

SEQ ID NO: 3341 - DNA, 42 bp, Artificial Sequence
  Synthetic
tccatcatcaaaggcccagccattgcttggatcctaacaatg

SEQ ID NO: 3342 - DNA, 48 bp, Artificial Sequence
  Synthetic
atcgtacttttcagcagtatccaatttgaattgtcttattgttcgttg

SEQ ID NO: 3343 - DNA, 47 bp, Artificial Sequence
  Synthetic
tgaagtagcaaaaacacacactcttattatattgggttgacacctgt

SEQ ID NO: 3344 - DNA, 50 bp, Artificial Sequence
  Synthetic
tgtgaagcattatccacatcatcaaatatatttgaagagagtacagatgg

SEQ ID NO: 3345 - DNA, 46 bp, Artificial Sequence
  Synthetic
tgtacctgagaaacatttgcagttaaaagacgattatttcaggaca

SEQ ID NO: 3346 - DNA, 50 bp, Artificial Sequence
  Synthetic
tcgtctaacaagccaattttaccataggtaaagtcatttctttcatgaac

SEQ ID NO: 3347 - DNA, 39 bp, Artificial Sequence
  Synthetic
gcgatggggtcttggagtacctcgcagactccagccaag

SEQ ID NO: 3348 - DNA, 38 bp, Artificial Sequence
  Synthetic
cttgtcgcgcaagtagtcgagaatctgctgtcccgtct

SEQ ID NO: 3349 - DNA, 43 bp, Artificial Sequence
  Synthetic
ggaagtgcttcaggaattggttttatggattgggaattggcac

SEQ ID NO: 3350 - DNA, 41 bp, Artificial Sequence
  Synthetic
gaaagtaggatccggtgcagccttttccgatgatgtcactt

SEQ ID NO: 3351 - DNA, 43 bp, Artificial Sequence
  Synthetic
gcattaggattttctgtgtcaagcaaccgttaggggttggaac

SEQ ID NO: 3352 - DNA, 48 bp, Artificial Sequence
  Synthetic
cctgatttgtcctgttgtaatcgtcaatacaagatggtgatatgtgtg

SEQ ID NO: 3353 - DNA, 39 bp, Artificial Sequence
  Synthetic
cagaaccggtatgcaatagcccagagctgtcaaccgttt

SEQ ID NO: 3354 - DNA, 42 bp, Artificial Sequence
  Synthetic
ctgatgatctttcgacgatgtaggcaacccttcttgtgacct

SEQ ID NO: 3355 - DNA, 43 bp, Artificial Sequence
  Synthetic
cgaaaagaatgctctttcccctgcaaaagagcggtttttaccc

SEQ ID NO: 3356 - DNA, 42 bp, Artificial Sequence
  Synthetic
tgaaagaacgtgtccataccatggggccaaacattgcgagta

SEQ ID NO: 3357 - DNA, 39 bp, Artificial Sequence
  Synthetic
taccagccagcgactagtccagaggactatttggagcca

SEQ ID NO: 3358 - DNA, 48 bp, Artificial Sequence
  Synthetic
atgctcatcgagtgttttttgatttagattgatgaccaaatacaagac

SEQ ID NO: 3359 - DNA, 42 bp, Artificial Sequence
  Synthetic
cggttccgcagaccactatggcatgagtgtcgaacagcctcc

SEQ ID NO: 3360 - DNA, 39 bp, Artificial Sequence
  Synthetic
gcggcaacaagtaaactccaccgcccacaggacgtcaag

SEQ ID NO: 3361 - DNA, 38 bp, Artificial Sequence
  Synthetic
tgacagcgtgggggtgatttgtgccctgtgtcctggaa

SEQ ID NO: 3362 - DNA, 41 bp, Artificial Sequence
  Synthetic
acagtatgggtgcggccatcactgggccaaggttatactgg

SEQ ID NO: 3363 - DNA, 40 bp, Artificial Sequence
  Synthetic
ttggtcgaatgcggcaagggtcaactcttctgggtgtcca

SEQ ID NO: 3364 - DNA, 40 bp, Artificial Sequence
  Synthetic
acaaaccccgtggagttcatcctaacattaggccccccgc

SEQ ID NO: 3365 - DNA, 40 bp, Artificial Sequence
  Synthetic
gtgtggtggtgtgcaggagcaattggacctatggtgagcg

SEQ ID NO: 3366 - DNA, 39 bp, Artificial Sequence
  Synthetic
cccatgattccctgcggccgaagcaacctgcaagaacgt

SEQ ID NO: 3367 - DNA, 41 bp, Artificial Sequence
  Synthetic
ccacccttaacctgcaacgggtttcatagcccgagtggagg

SEQ ID NO: 3368 - DNA, 40 bp, Artificial Sequence
  Synthetic
cgcggagaatacgatgggttcttgaaggattgggcagcgt

SEQ ID NO: 3369 - DNA, 41 bp, Artificial Sequence
  Synthetic
gccccatggaagagtgtccacaggtgcagttcttatccacg

SEQ ID NO: 3370 - DNA, 40 bp, Artificial Sequence
  Synthetic
aacacctaccacatgcccggttacctcaagggttcctcgg

SEQ ID NO: 3371 - DNA, 37 bp, Artificial Sequence
  Synthetic
ctccggtcctgatgttggggtgttcgggttcggggca

SEQ ID NO: 3372 - DNA, 41 bp, Artificial Sequence
  Synthetic
acgcccagactggtcaattgtttaaagggcggtaggcatct

SEQ ID NO: 3373 - DNA, 40 bp, Artificial Sequence
  Synthetic
tctccctgtacggcccctacgagactactacagtgcccca

SEQ ID NO: 3374 - DNA, 42 bp, Artificial Sequence
  Synthetic
gagtggggccagttaaagtcggccagctgggatacaatgtgg

SEQ ID NO: 3375 - DNA, 38 bp, Artificial Sequence
  Synthetic
aagaggggaggtcaccgcggaccttgccgggtaatccc

SEQ ID NO: 3376 - DNA, 38 bp, Artificial Sequence
  Synthetic
atgtggcgccgcagaacgtcaatactctgccctggagc

SEQ ID NO: 3377 - DNA, 39 bp, Artificial Sequence
  Synthetic
aagggcactccggggagttgcggcactgacagacttcaa

SEQ ID NO: 3378 - DNA, 40 bp, Artificial Sequence
  Synthetic
acgccatccagctccgtgaaacaatctgaagtgtccctgc

SEQ ID NO: 3379 - DNA, 38 bp, Artificial Sequence
  Synthetic
gcaggtggccttgagagaggtctccaccctctctggca

SEQ ID NO: 3380 - DNA, 36 bp, Artificial Sequence
  Synthetic
gcaggtggtatcgggcagcgacttggaagcgaccgg

SEQ ID NO: 3381 - DNA, 40 bp, Artificial Sequence
  Synthetic
gccccagtccaggtgtatgacacagggtcatggtcaaccg

SEQ ID NO: 3382 - DNA, 41 bp, Artificial Sequence
  Synthetic
cgccgtatccgtacttggaacgccctagaggaagcctgtgg

SEQ ID NO: 3383 - DNA, 42 bp, Artificial Sequence
  Synthetic
gtcgtcaccacataccaggagcgctttagcctcctgtagagc

SEQ ID NO: 3384 - DNA, 41 bp, Artificial Sequence
  Synthetic
gcactatccgagcccacaaggcggttaattcctggctaggg

SEQ ID NO: 3385 - DNA, 38 bp, Artificial Sequence
  Synthetic
atggcggccctacctccctgttggagacatcgggctcg

SEQ ID NO: 3386 - DNA, 43 bp, Artificial Sequence
  Synthetic
tactgcgtaggtgcactaggcttgtagatctgttctctaaacg

SEQ ID NO: 3387 - DNA, 42 bp, Artificial Sequence
  Synthetic
ggtgttcacgtgcctccgatagggttagagacgtgctagtgc

SEQ ID NO: 3388 - DNA, 45 bp, Artificial Sequence
  Synthetic
gtggttgaatgactttgacttttgagagtgccaagaaatttgaca

SEQ ID NO: 3389 - DNA, 43 bp, Artificial Sequence
  Synthetic
cgcttattatagcagccaacatagggcaagggaggtaggacta

SEQ ID NO: 3390 - DNA, 38 bp, Artificial Sequence
  Synthetic
tccaagcaccttttacgggcattgttgagtcctgcggt

SEQ ID NO: 3391 - DNA, 46 bp, Artificial Sequence
  Synthetic
gaccaccagttacatatgccataatgacgccatggtttatacttca

SEQ ID NO: 3392 - DNA, 41 bp, Artificial Sequence
  Synthetic
acctaagttgagtgatcgcaacttgttaacaaggcactcga

SEQ ID NO: 3393 - DNA, 40 bp, Artificial Sequence
  Synthetic
caggagacaatgcgcagtattaccagtctgtgtaaatggc

SEQ ID NO: 3394 - DNA, 46 bp, Artificial Sequence
  Synthetic
tgcatcgtcctcttcttcctcacttttcatcacgtatgtattgttc

SEQ ID NO: 3395 - DNA, 46 bp, Artificial Sequence
  Synthetic
aggtgtatgttagcagcatttacaatgtgttgacatcgttaaggag

SEQ ID NO: 3396 - DNA, 42 bp, Artificial Sequence
  Synthetic
aagactgaagtggtttagcacctcacaggacatcttacttgc

SEQ ID NO: 3397 - DNA, 42 bp, Artificial Sequence
  Synthetic
tcacctaccatgtaaggtgcatgaacatgcttagaggtgaag

SEQ ID NO: 3398 - DNA, 47 bp, Artificial Sequence
  Synthetic
gctctaacatccatgcatataggcaaactgtatcctggaatttgaga

SEQ ID NO: 3399 - DNA, 44 bp, Artificial Sequence
  Synthetic
tgatgacgaagtgaggtatccattccgtagtgtcagtatcatca

SEQ ID NO: 3400 - DNA, 47 bp, Artificial Sequence
  Synthetic
agcttcactacgtagtgtgtcatcatgtaaatcatgagggtaagact

SEQ ID NO: 3401 - DNA, 46 bp, Artificial Sequence
  Synthetic
ggtagtagttttctgaccacaatgtcatgctaatttggaatctgca

SEQ ID NO: 3402 - DNA, 44 bp, Artificial Sequence
  Synthetic
tggtcctttgtactctgacatcttaaggagaccctctatcgtat

SEQ ID NO: 3403 - DNA, 40 bp, Artificial Sequence
  Synthetic
ccactacatcgccattcaagtccaaagccagcttcacgag

SEQ ID NO: 3404 - DNA, 47 bp, Artificial Sequence
  Synthetic
tggtttaagtatgacattgcctacaaccatacagaaggaagtcatag

SEQ ID NO: 3405 - DNA, 46 bp, Artificial Sequence
  Synthetic
ggaaaagaaccttcacagaaatccagctccttcttattgtaatggc

SEQ ID NO: 3406 - DNA, 39 bp, Artificial Sequence
  Synthetic
ctaaccattgcagaaacgggttcttggctcatgtggttt

SEQ ID NO: 3407 - DNA, 44 bp, Artificial Sequence
  Synthetic
gtcagtagggttgattggtcttttcattagtgatgaagttgctc

SEQ ID NO: 3408 - DNA, 47 bp, Artificial Sequence
  Synthetic
gcaacaagtgccttaagtttttccagtttccgttaagatgtttgatg

SEQ ID NO: 3409 - DNA, 45 bp, Artificial Sequence
  Synthetic
gcagctgttcagataaagacatgtacatatcaatgcccaagtagc

SEQ ID NO: 3410 - DNA, 46 bp, Artificial Sequence
  Synthetic
accagcatgtttatttgcaaaacaaaaatcattggttacaaagcca

SEQ ID NO: 3411 - DNA, 43 bp, Artificial Sequence
  Synthetic
tctggacgaagctcactataagaaagctatgggcaaacctgtg

SEQ ID NO: 3412 - DNA, 39 bp, Artificial Sequence
  Synthetic
ccaccagccactactgaagcttactcctcttgtgcaacc

SEQ ID NO: 3413 - DNA, 47 bp, Artificial Sequence
  Synthetic
cgctacgcaattttaggtacatttcgttacatttagtaccttcgagg

SEQ ID NO: 3414 - DNA, 40 bp, Artificial Sequence
  Synthetic
aaccactctgcagaacagcagctgatgttctctaccaacc

SEQ ID NO: 3415 - DNA, 46 bp, Artificial Sequence
  Synthetic
cggacaaatttatacttgggtgtctaaaattgtctgcttaggctta

SEQ ID NO: 3416 - DNA, 47 bp, Artificial Sequence
  Synthetic
acatgatcttgtgtcaaaggttcatagattcaccactactttgaatg

SEQ ID NO: 3417 - DNA, 48 bp, Artificial Sequence
  Synthetic
gaccactgtgtactttgaacaagacatcattggatgcttttaactttc

SEQ ID NO: 3418 - DNA, 50 bp, Artificial Sequence
  Synthetic
cgacaccagaatagttagaggttactctactatggtaatgctttagatca

SEQ ID NO: 3419 - DNA, 43 bp, Artificial Sequence
  Synthetic
cctccaatacccaacaacttaatgtatatgaactcccaggggc

SEQ ID NO: 3420 - DNA, 47 bp, Artificial Sequence
  Synthetic
acaacctattaatgtctacagcaccagaagatggtttctcttttgtc

SEQ ID NO: 3421 - DNA, 43 bp, Artificial Sequence
  Synthetic
gcactagttacttttgccctcttgcaggctatgacccaaatgt

SEQ ID NO: 3422 - DNA, 43 bp, Artificial Sequence
  Synthetic
gtcgtagtgctactggactcagttggcctcttattgttacagc

SEQ ID NO: 3423 - DNA, 42 bp, Artificial Sequence
  Synthetic
gcaggtacttctgtagcatttccatatggtgctgggcagttt

SEQ ID NO: 3424 - DNA, 45 bp, Artificial Sequence
  Synthetic
gggtcattagcacaagtggtagtaaaggattctgtgacttgaaag

SEQ ID NO: 3425 - DNA, 48 bp, Artificial Sequence
  Synthetic
ccatgtcaccatctactctaaacttataacttggttaaagattgtcca

SEQ ID NO: 3426 - DNA, 44 bp, Artificial Sequence
  Synthetic
cctacaatgcctgcatcacgtgtacgccaatcattattaaagac

SEQ ID NO: 3427 - DNA, 48 bp, Artificial Sequence
  Synthetic
ggatacacctatcatccaaacagtttctcttcgaccgttattttaaat

SEQ ID NO: 3428 - DNA, 47 bp, Artificial Sequence
  Synthetic
tgacagtttgaaaagcaacattgtttattgctagataaacgcactac

SEQ ID NO: 3429 - DNA, 48 bp, Artificial Sequence
  Synthetic
acagatagagacaccagctacggaactcaaatgaatcttaagtatgcc

SEQ ID NO: 3430 - DNA, 43 bp, Artificial Sequence
  Synthetic
cgttagctaacctgtagaaacgggttcttgctcgcaaacataa

SEQ ID NO: 3431 - DNA, 46 bp, Artificial Sequence
  Synthetic
cggcatcatcagaaagaatcatcatatcatgaattcgtggatgagt

SEQ ID NO: 3432 - DNA, 47 bp, Artificial Sequence
  Synthetic
agacatcagcatactcctgattaggacttatgattgaaaggttcgtg

SEQ ID NO: 3433 - DNA, 45 bp, Artificial Sequence
  Synthetic
gcaaacatagggattaacagacaacgaccattcctatgttgcaag

SEQ ID NO: 3434 - DNA, 40 bp, Artificial Sequence
  Synthetic
ttcctcagtggctttgagcgccaacacttgtactgagaga

SEQ ID NO: 3435 - DNA, 43 bp, Artificial Sequence
  Synthetic
gtgttgggtacaagccagtaatcttagtgcacctactctagtg

SEQ ID NO: 3436 - DNA, 44 bp, Artificial Sequence
  Synthetic
agcattgacaacactcaagtcataaatgcattgccagaaacaac

SEQ ID NO: 3437 - DNA, 47 bp, Artificial Sequence
  Synthetic
tgattgcagatgaaacatcatgtgtaaaagcacacaaggataagtca

SEQ ID NO: 3438 - DNA, 47 bp, Artificial Sequence
  Synthetic
cgacgtggtatttctagacttgtaacattttgtgcataatgtctgat

SEQ ID NO: 3439 - DNA, 44 bp, Artificial Sequence
  Synthetic
aaagccaatccacgcacgaaggttaccctaatatgtttatcacc

SEQ ID NO: 3440 - DNA, 42 bp, Artificial Sequence
  Synthetic
gtaagctcaaagccatgcgcagtgatacactgaaaggattgt

SEQ ID NO: 3441 - DNA, 45 bp, Artificial Sequence
  Synthetic
caatgcagacttcacaaccatgtattataggagatgaactgaggg

SEQ ID NO: 3442 - DNA, 44 bp, Artificial Sequence
  Synthetic
catcacagcctggtaagttcaagaatgcaattgtgtgtaggttt

SEQ ID NO: 3443 - DNA, 45 bp, Artificial Sequence
  Synthetic
cctggtaaatgtattccacaggttaatttctgctggatttagcct

SEQ ID NO: 3444 - DNA, 43 bp, Artificial Sequence
  Synthetic
acaagacagtaagtgaagaacaagctctgcacaatgactgaca

SEQ ID NO: 3445 - DNA, 45 bp, Artificial Sequence
  Synthetic
cctcgagcttatatcgctgtatgaataagcccagatcacaaatgg

SEQ ID NO: 3446 - DNA, 50 bp, Artificial Sequence
  Synthetic
ccaaagcatgaatgaaatttcagcaaataaagtcacaagatttgtcagtg

SEQ ID NO: 3447 - DNA, 44 bp, Artificial Sequence
  Synthetic
ccaattaaagtagaatctgcgtcggctcagacaatggttgccaa

SEQ ID NO: 3448 - DNA, 45 bp, Artificial Sequence
  Synthetic
tgccaagatagttagccccaattggacagcttttgttacaaatgt

SEQ ID NO: 3449 - DNA, 43 bp, Artificial Sequence
  Synthetic
tgtctgtgtacccatgggtttgtaactttgaattgtgtgacaa

SEQ ID NO: 3450 - DNA, 44 bp, Artificial Sequence
  Synthetic
acttgagcataaatgtagttggcttttttcacctgctcaagaca

SEQ ID NO: 3451 - DNA, 50 bp, Artificial Sequence
  Synthetic
gcaaagatcattcaacttagtggcactacaactcaacatttttttcaacc

SEQ ID NO: 3452 - DNA, 43 bp, Artificial Sequence
  Synthetic
gccaataacaattaagagcaggtggtaggccctttgagagaga

SEQ ID NO: 3453 - DNA, 50 bp, Artificial Sequence
  Synthetic
agcatttgttccaggtgtaattacacatctgaaatattagacatttcacc

SEQ ID NO: 3454 - DNA, 47 bp, Artificial Sequence
  Synthetic
agcaatggtgttattagagtaagcaactagccaaaaatctattgtgg

SEQ ID NO: 3455 - DNA, 46 bp, Artificial Sequence
  Synthetic
gcattcgccatattgcttcatgaaaggtcttttattgaggacttgc

SEQ ID NO: 3456 - DNA, 49 bp, Artificial Sequence
  Synthetic
tgcagttgatgttgttgtaagtgattctatgagaaccaaaaacaaatcg

SEQ ID NO: 3457 - DNA, 42 bp, Artificial Sequence
  Synthetic
ggacataaggtggtagccctttctgagtgtgttcttggacaa

SEQ ID NO: 3458 - DNA, 48 bp, Artificial Sequence
  Synthetic
gctcttctttgaatgagtcaagctctcgttattggcatcattaacaac

SEQ ID NO: 3459 - DNA, 42 bp, Artificial Sequence
  Synthetic
aagagcatgcacccttgaggcatcgtcatggttacaatcttg

SEQ ID NO: 3460 - DNA, 42 bp, Artificial Sequence
  Synthetic
gcaaatgaactggaagcccttatgctgtttttcagagcgcta

SEQ ID NO: 3461 - DNA, 46 bp, Artificial Sequence
  Synthetic
gtgaaatagccatgtacaacgacataattggtggttattctgagga

SEQ ID NO: 3462 - DNA, 43 bp, Artificial Sequence
  Synthetic
gcaagaataccacgaaagcaagaaatcggaagaaacaggtacg

SEQ ID NO: 3463 - DNA, 43 bp, Artificial Sequence
  Synthetic
cctgttccgattagaataggcaaattcctggaacaatggaacc

SEQ ID NO: 3464 - DNA, 40 bp, Artificial Sequence
  Synthetic
acagcgccctagggagtgtcacttgtcattggtgctgtga

SEQ ID NO: 3465 - DNA, 48 bp, Artificial Sequence
  Synthetic
cctgatagtgatatagctcgcaagcatgaaaattattctcttcctgac

SEQ ID NO: 3466 - DNA, 47 bp, Artificial Sequence
  Synthetic
acatgaggtttattagatgcacagcttgtatttctctatgcagttgc

SEQ ID NO: 3467 - DNA, 41 bp, Artificial Sequence
  Synthetic
ccattgcgtcctccattctggtccccccgcattacatttgg

SEQ ID NO: 3468 - DNA, 40 bp, Artificial Sequence
  Synthetic
tgccaatgtggtctttgggtgtacttccctacggcgctaa

SEQ ID NO: 3469 - DNA, 45 bp, Artificial Sequence
  Synthetic
agcagatttcttagtgacagtttggcttgagagcaaagtttctgg

SEQ ID NO: 3470 - DNA, 43 bp, Artificial Sequence
  Synthetic
gttcagcagtatgacgttgtctttcatggagccattaaattgg

SEQ ID NO: 3471 - DNA, 49 bp, Artificial Sequence
  Synthetic
cctacttgtgctgtttagttacgagttccgtttacgatacatagtctac

SEQ ID NO: 3472 - DNA, 39 bp, Artificial Sequence
  Synthetic
gggaagggtgggaaaaactggccatgcggtgttgtactc

SEQ ID NO: 3473 - DNA, 41 bp, Artificial Sequence
  Synthetic
caagaagggtgagcaggcagcagtagacctggcagatgagg

SEQ ID NO: 3474 - DNA, 43 bp, Artificial Sequence
  Synthetic
gcacccatgatgacaatctatacacgtgtccgtgtttcctgtt

SEQ ID NO: 3475 - DNA, 46 bp, Artificial Sequence
  Synthetic
cacaagcttcaactgttggtgactgttaaagatgtgttagaaaagg

SEQ ID NO: 3476 - DNA, 38 bp, Artificial Sequence
  Synthetic
agggcatcaggcaatttccatggacagtcgttcttgga

SEQ ID NO: 3477 - DNA, 44 bp, Artificial Sequence
  Synthetic
ccaactgtcatcactaggtcttttaaggtgagcaaggtagagaa

SEQ ID NO: 3478 - DNA, 47 bp, Artificial Sequence
  Synthetic
ctgagtggtactaaacacaaccttatcaattagccctatgttttcag

SEQ ID NO: 3479 - DNA, 50 bp, Artificial Sequence
  Synthetic
ggttgtgaggcaatatctactggtatgaatatgtacactgttgatttacg

SEQ ID NO: 3480 - DNA, 40 bp, Artificial Sequence
  Synthetic
ccccacatcccacactaaatgttcctggtgttggaaaacc

SEQ ID NO: 3481 - DNA, 48 bp, Artificial Sequence
  Synthetic
tgtgagtactccttcttgtgtgtcaaagatttttgcttaagattagcc

SEQ ID NO: 3482 - DNA, 45 bp, Artificial Sequence
  Synthetic
ttcctgattgccatgtgtaatcatcttatgtatgtacccccagga

SEQ ID NO: 3483 - DNA, 45 bp, Artificial Sequence
  Synthetic
cgaggacaccatgcttttatatgtcacgattcaaatattgtgtgc

SEQ ID NO: 3484 - DNA, 50 bp, Artificial Sequence
  Synthetic
tcacatcattaccttcagtgtttgttgattctattcttgtatcatactcc

SEQ ID NO: 3485 - DNA, 49 bp, Artificial Sequence
  Synthetic
cacactggaattttctcaggtcaattggtgttataggtatgattacagc

SEQ ID NO: 3486 - DNA, 45 bp, Artificial Sequence
  Synthetic
acgcacagagtttctctttaagaaacacaaactgtaattgccact

SEQ ID NO: 3487 - DNA, 43 bp, Artificial Sequence
  Synthetic
tttaggatctgggggcaaagaatactggaaaatctcttgccac

SEQ ID NO: 3488 - DNA, 46 bp, Artificial Sequence
  Synthetic
tgaagatactgttggtggtgttagtaccatttacatccaagtttgt

SEQ ID NO: 3489 - DNA, 49 bp, Artificial Sequence
  Synthetic
accctgaagtgtacagaacaatttctataggtataatagctaatgtggt

SEQ ID NO: 3490 - DNA, 45 bp, Artificial Sequence
  Synthetic
gcaaatcataggaatcagagacctttggtacttccaacacattct

SEQ ID NO: 3491 - DNA, 42 bp, Artificial Sequence
  Synthetic
ccttgtacaaaacacccccacatactgcacgaatgatcaagt

SEQ ID NO: 3492 - DNA, 49 bp, Artificial Sequence
  Synthetic
gtgactatacctgggtttttgtggatgtgttattcagaagtgtatttgg

SEQ ID NO: 3493 - DNA, 43 bp, Artificial Sequence
  Synthetic
ctcatcagctctgaatcctcttttaacccctgctgataagtct

SEQ ID NO: 3494 - DNA, 43 bp, Artificial Sequence
  Synthetic
ggtagaagcactaacacacagtctaaagaggtggagttgtcac

SEQ ID NO: 3495 - DNA, 49 bp, Artificial Sequence
  Synthetic
cttcacaagctacctgtacattagatctaaaaggagattgtttacagac

SEQ ID NO: 3496 - DNA, 47 bp, Artificial Sequence
  Synthetic
ccatcaaatgcatttctcatatgcagggtaaagtaggctttctagat

SEQ ID NO: 3497 - DNA, 43 bp, Artificial Sequence
  Synthetic
tgtgatgtgatctctaaggtctgtactgagcgtacgttttgct

SEQ ID NO: 3498 - DNA, 48 bp, Artificial Sequence
  Synthetic
tgacaggagcaagaatagttttgttcaacctgatgtgttaaagtatgg

SEQ ID NO: 3499 - DNA, 44 bp, Artificial Sequence
  Synthetic
ttcacagtcatgccccaacccagaaatatgggcatttatacctg

SEQ ID NO: 3500 - DNA, 41 bp, Artificial Sequence
  Synthetic
ggaagatgctccaggttctactggcccattacaaggcctaa

SEQ ID NO: 3501 - DNA, 42 bp, Artificial Sequence
  Synthetic
ctctgtgattggtacctgctctatcacacctgtcactgcatt

SEQ ID NO: 3502 - DNA, 50 bp, Artificial Sequence
  Synthetic
tcggggacaaatacctttaaaactgagaaggggaaacattaaatattcct

SEQ ID NO: 3503 - DNA, 46 bp, Artificial Sequence
  Synthetic
gacgttccctgtctgaattgtatgtattcagatgtaagttaccaga

SEQ ID NO: 3504 - DNA, 43 bp, Artificial Sequence
  Synthetic
gctgttctcgctttccaaaaaagaacaattgctttgtggcctg

SEQ ID NO: 3505 - DNA, 48 bp, Artificial Sequence
  Synthetic
gccattcttccaatattctgggattatgtaaaataactttggatgctg

SEQ ID NO: 3506 - DNA, 48 bp, Artificial Sequence
  Synthetic
tgaccccatgagtcagataaaacagcttgaataaattgtttactgtgc

SEQ ID NO: 3507 - DNA, 47 bp, Artificial Sequence
  Synthetic
gaaggtaacaccaactcttccaaataaagtatgaaggggactattgc

SEQ ID NO: 3508 - DNA, 43 bp, Artificial Sequence
  Synthetic
ccaatctgcagtttgtaattcaagaccaggacctgctttcaag

SEQ ID NO: 3509 - DNA, 43 bp, Artificial Sequence
  Synthetic
agtctcggactcaaatctacaagatccgagctttagtggacct

SEQ ID NO: 3510 - DNA, 42 bp, Artificial Sequence
  Synthetic
tgatcctgcagtacatcgaaaccagtgtgacgaagaagatga

SEQ ID NO: 3511 - DNA, 48 bp, Artificial Sequence
  Synthetic
tggaactagtaacgacagaggaaattattcaaatactggacaatggac

SEQ ID NO: 3512 - DNA, 41 bp, Artificial Sequence
  Synthetic
ggctcttggttctctggtggttcgacaagagaacgacgacg

SEQ ID NO: 3513 - DNA, 45 bp, Artificial Sequence
  Synthetic
cctctggatttatcacatccaaaggtacaaaaccaagcataccac

SEQ ID NO: 3514 - DNA, 49 bp, Artificial Sequence
  Synthetic
ggtttgaacctgttgtacaaaacgcttttaatagggttatcaatcaagg

SEQ ID NO: 3515 - DNA, 43 bp, Artificial Sequence
  Synthetic
gttgaaaaaggtccagttggctatcgcgcaggtgttaagacaa

SEQ ID NO: 3516 - DNA, 41 bp, Artificial Sequence
  Synthetic
tgctttgccttctccatcttctaatgtcgctgtttggagac

SEQ ID NO: 3517 - DNA, 43 bp, Artificial Sequence
  Synthetic
acatcttctcatttttctctcagctcctgtcaggaatgggaac

SEQ ID NO: 3518 - DNA, 41 bp, Artificial Sequence
  Synthetic
tgtctttgctgtgttcatagctggtcttcggtacctggagt

SEQ ID NO: 3519 - DNA, 45 bp, Artificial Sequence
  Synthetic
agtttccatctgttcataagatcgtactcactgagtgacatcaac

SEQ ID NO: 3520 - DNA, 44 bp, Artificial Sequence
  Synthetic
tcctctttgtcatacagaatcagctaggtccaatctaccgaaga

SEQ ID NO: 3521 - DNA, 40 bp, Artificial Sequence; identical to SEQ ID NO: 2016
  Synthetic

SEQ ID NO: 3522 - DNA, 43 bp, Artificial Sequence
  Synthetic
ctgatgaagcttgagactctcagacaattggtgtggatggcat

SEQ ID NO: 3523 - DNA, 44 bp, Artificial Sequence
  Synthetic
cccaaaagagctctttcatttgatctttttgttcatgatgcccg

SEQ ID NO: 3524 - DNA, 43 bp, Artificial Sequence
  Synthetic
gccaccccaaataaacaaaggattaggctgttgctgcttcaat

SEQ ID NO: 3525 - DNA, 42 bp, Artificial Sequence
  Synthetic
tccatcttgctttctggcgcaaattgacacgattactgttga

SEQ ID NO: 3526 - DNA, 46 bp, Artificial Sequence
  Synthetic
gaggcgtgtataaaaagaaatgtgtccgttgaggtatttttctcac

SEQ ID NO: 3527 - DNA, 48 bp, Artificial Sequence
  Synthetic
cagtaccttccattgattagcctttgttgaaatgaaaaaacctcatgc

SEQ ID NO: 3528 - DNA, 50 bp, Artificial Sequence
  Synthetic
gcaaaaggataattagcagcttctggttggtaaatcaaccttatttaacg

SEQ ID NO: 3529 - DNA, 43 bp, Artificial Sequence
  Synthetic
tgcaaaacattaaactctgctactgtaaacgttatgcgcgtgt

SEQ ID NO: 3530 - DNA, 47 bp, Artificial Sequence
  Synthetic
ttcagtaagaccgatagcttccaaacgtgcagaagaagaaatttcag

SEQ ID NO: 3531 - DNA, 48 bp, Artificial Sequence
  Synthetic
agccataaaaccaatattgtgctttatggtaaaaatgattgttggtct

SEQ ID NO: 3532 - DNA, 45 bp, Artificial Sequence
  Synthetic
ccaactttgattcggttaaattcctaggaggacataatggcatta

SEQ ID NO: 3533 - DNA, 42 bp, Artificial Sequence
  Synthetic
caaagaagcaagcctaagcctaaagtgggcttgtctggtcta

SEQ ID NO: 3534 - DNA, 45 bp, Artificial Sequence
  Synthetic
gcctgcaaaatcttacctaagtcatggaggctcaaaatttgtgat

SEQ ID NO: 3535 - DNA, 40 bp, Artificial Sequence
  Synthetic
agcacaacaaaacaagccatttcagcaattagaagcgctg

SEQ ID NO: 3536 - DNA, 48 bp, Artificial Sequence
  Synthetic
cacaaaacctttcaagagacgtttgaagttactaagttttgacgatgt

SEQ ID NO: 3537 - DNA, 46 bp, Artificial Sequence
  Synthetic
gcaattaatggctgatttgcggagaataccgattgaaatttctcct

SEQ ID NO: 3538 - DNA, 44 bp, Artificial Sequence
  Synthetic
cccaaatctacggctgataaagattgtggtgatcacatctgctt

SEQ ID NO: 3539 - DNA, 39 bp, Artificial Sequence
  Synthetic
tacgagatccccaacgttggtggtaccgaaaacatgagt

SEQ ID NO: 3540 - DNA, 45 bp, Artificial Sequence
  Synthetic
gcagggcgtaactttgctaaatcaagatgaataccctaaatttgg

SEQ ID NO: 3541 - DNA, 42 bp, Artificial Sequence
  Synthetic
gcaatagctcctccattgacattacttttgctgctcaggctt

SEQ ID NO: 3542 - DNA, 40 bp, Artificial Sequence
  Synthetic
accagtgcatcaattaacgcttcacgattatggtcggtgg

SEQ ID NO: 3543 - DNA, 47 bp, Artificial Sequence
  Synthetic
tgaggttaatcgaccaaaatcttcttcttgccaaagaatatctgaac

SEQ ID NO: 3544 - DNA, 50 bp, Artificial Sequence
  Synthetic
gagcaacccttcaagataaacatcttttgaaggataagattgatagaagg

SEQ ID NO: 3545 - DNA, 50 bp, Artificial Sequence
  Synthetic
gcttcttttgtagctactagtgtcgctttgatcagcatttaaaactactg

SEQ ID NO: 3546 - DNA, 44 bp, Artificial Sequence
  Synthetic
acaatggggcatttccgatgctaaaaaatggttagttaagccag

SEQ ID NO: 3547 - DNA, 44 bp, Artificial Sequence
  Synthetic
gaccttgaaagtggcaaagttttagttgtcaagagcttactgac

SEQ ID NO: 3548 - DNA, 44 bp, Artificial Sequence
  Synthetic
gcatttttattaccacaagctgccaaaagtaaatggttggcagc

SEQ ID NO: 3549 - DNA, 44 bp, Artificial Sequence
  Synthetic
ccagtcacaaaatcttctgctgttatgtctcttggtatacggct

SEQ ID NO: 3550 - DNA, 44 bp, Artificial Sequence
  Synthetic
caacattcttagcatcccagtagtttggtgcttacttcttgagc

SEQ ID NO: 3551 - DNA, 50 bp, Artificial Sequence
  Synthetic
acgaaaatccttgttgttaagagcttctttcaaaaacactaagaaagacc

SEQ ID NO: 3552 - DNA, 45 bp, Artificial Sequence
  Synthetic
ctaattgaactgggaaggttacaccaaagctgagtttgcaaaagc

SEQ ID NO: 3553 - DNA, 44 bp, Artificial Sequence
  Synthetic
tgtgtcatcagccagctgtacatcagtttttagaggagaattgg

SEQ ID NO: 3554 - DNA, 45 bp, Artificial Sequence
  Synthetic
ggtgtccactcttgtgcctgctaaaaagagcttatttgtgacaag

SEQ ID NO: 3555 - DNA, 41 bp, Artificial Sequence
  Synthetic
tgcttggggtaatggctcactggcacctgcttctagtccag

SEQ ID NO: 3556 - DNA, 41 bp, Artificial Sequence
  Synthetic
cattggattgtaggcatggtttgcaccacaagtgttgcaac

SEQ ID NO: 3557 - DNA, 42 bp, Artificial Sequence
  Synthetic
tctgtaatactgccgcgatctggccatttgcaagtatttacg

SEQ ID NO: 3558 - DNA, 45 bp, Artificial Sequence
  Synthetic
caggttttcgaggtgttgcaggtcttgaaatgtattatactagtg

SEQ ID NO: 3559 - DNA, 43 bp, Artificial Sequence
  Synthetic
cagttggatgagttaggatcatccttccctcactggaaattcc

SEQ ID NO: 3560 - DNA, 47 bp, Artificial Sequence
  Synthetic
ggtttgaccatagagtcatattggtaggtttatccaccatattgatg

SEQ ID NO: 3561 - DNA, 43 bp, Artificial Sequence
  Synthetic
ccaaaatcatctgattgagcagctactaagccaaccaaagcgt

SEQ ID NO: 3562 - DNA, 44 bp, Artificial Sequence
  Synthetic
ggacgtaattgccctcactattgaaagaaaatgagaccactgtc

SEQ ID NO: 3563 - DNA, 43 bp, Artificial Sequence
  Synthetic
gctgctggtgttttagcaatgataaccaaacagctccgttgag

SEQ ID NO: 3564 - DNA, 47 bp, Artificial Sequence
  Synthetic
cttctgtgccatacataccatagtttatcatttacgatgcccttacc

SEQ ID NO: 3565 - DNA, 45 bp, Artificial Sequence
  Synthetic
aggaatagctcgctctttagggtaagcagagttgaatttgacctt

SEQ ID NO: 3566 - DNA, 46 bp, Artificial Sequence
  Synthetic
tgaaactgattggggctaacgcacatgtctaagttattattggttg

SEQ ID NO: 3567 - DNA, 41 bp, Artificial Sequence
  Synthetic
tgccttcaaaaatggcagctaaatgtggctctagcttttcg

SEQ ID NO: 3568 - DNA, 47 bp, Artificial Sequence
  Synthetic
gctccgtatggtaaatagcttgtaaagatactacgacgattagagaa

SEQ ID NO: 3569 - DNA, 47 bp, Artificial Sequence
  Synthetic
gccgattagccttaagtttggttaagaagcagtcttagctaatcaac

SEQ ID NO: 3570 - DNA, 49 bp, Artificial Sequence
  Synthetic
cgtcatacaacctggtaaataaggttattgttggtcctaatttcaatcg

SEQ ID NO: 3571 - DNA, 45 bp, Artificial Sequence
  Synthetic
ggcttatgcgcttgtttgtaagtaaaaatagggatgatgctatcg

SEQ ID NO: 3572 - DNA, 43 bp, Artificial Sequence
  Synthetic
ccgatttttacacacagttgtcctagccattaccgactaccga

SEQ ID NO: 3573 - DNA, 44 bp, Artificial Sequence
  Synthetic
agctaattgaacatctgctccaacataagccctgattatgctcc

SEQ ID NO: 3574 - DNA, 46 bp, Artificial Sequence
  Synthetic
aatcagattggcctttggtaattgttaaacggtaagaaagtagccg

SEQ ID NO: 3575 - DNA, 44 bp, Artificial Sequence
  Synthetic
gtgattcttgaagagtaccagctttctcttgacgatgctcttcg

SEQ ID NO: 3576 - DNA, 43 bp, Artificial Sequence
  Synthetic
cggtaccagtcttttctttgttgtagctgcagcttctttttcc

SEQ ID NO: 3577 - DNA, 45 bp, Artificial Sequence
  Synthetic
cacctccccataaaaatcccattttacaaaaaagagtttcggtgg

SEQ ID NO: 3578 - DNA, 46 bp, Artificial Sequence
  Synthetic
cggtatattaagcgacataccagtccaagtccccttcttagaaagt

SEQ ID NO: 3579 - DNA, 44 bp, Artificial Sequence
  Synthetic
gcgtcgtaaatggtattggattgataggaaggtcaattggttgc

SEQ ID NO: 3580 - DNA, 44 bp, Artificial Sequence
  Synthetic
ggtgattgacatgttcttgagtcaagttccggctatgaaaatgc

SEQ ID NO: 3581 - DNA, 45 bp, Artificial Sequence
  Synthetic
ggcaacaaatcagcaatcttgttaaaaaatggcaccattgattgc

SEQ ID NO: 3582 - DNA, 44 bp, Artificial Sequence
  Synthetic
gatcgcctttgttactagattctctttatccaaacgtgccaaac

SEQ ID NO: 3583 - DNA, 45 bp, Artificial Sequence
  Synthetic
ccacatatttgctttcttctagggtggctttattcaagacttgcc

SEQ ID NO: 3584 - DNA, 50 bp, Artificial Sequence
  Synthetic
ggtctaaaagagcaactcgattcaacagtttgttccttttagaatcaaag

SEQ ID NO: 3585 - DNA, 43 bp, Artificial Sequence
  Synthetic
gccccaaagccttagaaagattcctactttgctgaaatctacc

SEQ ID NO: 3586 - DNA, 43 bp, Artificial Sequence
  Synthetic
cccttaagcatggtgataccgttttacacctgatgacacactc

SEQ ID NO: 3587 - DNA, 44 bp, Artificial Sequence
  Synthetic
ggtctccatgcaaatgagtaatgaagaaggaacgcaaagacaaa

SEQ ID NO: 3588 - DNA, 43 bp, Artificial Sequence
  Synthetic
cgtctagggttccttctaagtctttgtctggcgcataccattt

SEQ ID NO: 3589 - DNA, 39 bp, Artificial Sequence
  Synthetic
gcttcatgagcgatttgtgctcggattgcgagaaatcac

SEQ ID NO: 3590 - DNA, 41 bp, Artificial Sequence
  Synthetic
tccaactcgaggcattctttgaacaaagaacgcctagaaca

SEQ ID NO: 3591 - DNA, 39 bp, Artificial Sequence
  Synthetic
tccgataagggcaaacttggtcaggcttgattgcgtcag

SEQ ID NO: 3592 - DNA, 46 bp, Artificial Sequence
  Synthetic
ccgctgttaaaaactcatctaaggcccgctcagttgatttatgatc

SEQ ID NO: 3593 - DNA, 47 bp, Artificial Sequence
  Synthetic
ttaggcgtgtcaagaagaccttttatcagtttttagaggctattggt

SEQ ID NO: 3594 - DNA, 41 bp, Artificial Sequence
  Synthetic
tgagggcttcaactaaagcatccaaacgacctcaactccaa

SEQ ID NO: 3595 - DNA, 40 bp, Artificial Sequence
  Synthetic
agccccatcagcaatcatttgtctttttcagatggggggt

SEQ ID NO: 3596 - DNA, 43 bp, Artificial Sequence
  Synthetic
caaacgtcttgtgttacctcttgatcttagcagccgagtacga

SEQ ID NO: 3597 - DNA, 39 bp, Artificial Sequence
  Synthetic
tgacatcgtgtacgcgtacaaagcagccttgtctgctta

SEQ ID NO: 3598 - DNA, 41 bp, Artificial Sequence
  Synthetic
gttcacaaatcgcacctgctaaacgtcagttagtggaaggg

SEQ ID NO: 3599 - DNA, 48 bp, Artificial Sequence
  Synthetic
aagagattgctcaatagcttgtgtttatggcctgtcaattagatacac

SEQ ID NO: 3600 - DNA, 46 bp, Artificial Sequence
  Synthetic
ggaaaagccaagaaatctgctggatgaacccctaaaacattacact

SEQ ID NO: 3601 - DNA, 42 bp, Artificial Sequence
  Synthetic
agcacccgcattcataaaaacaggtttgaatttgcatgtggc

SEQ ID NO: 3602 - DNA, 45 bp, Artificial Sequence
  Synthetic
gccctttaagatttgcttccatgatttgtggatctgtgtttaagc

SEQ ID NO: 3603 - DNA, 42 bp, Artificial Sequence
  Synthetic
ggttacttgattttcgttgtgcagaaagcaagagcccctgaa

SEQ ID NO: 3604 - DNA, 44 bp, Artificial Sequence
  Synthetic
ggccttcaattcccttgtcaaattccagttgctactttatcgac

SEQ ID NO: 3605 - DNA, 42 bp, Artificial Sequence
  Synthetic
agcaacacgttggcaaaccattgcggtaaaaattcctggacg

SEQ ID NO: 3606 - DNA, 43 bp, Artificial Sequence
  Synthetic
tattgccaccccatttgccattcaggctgtaataatttagcgc

SEQ ID NO: 3607 - DNA, 44 bp, Artificial Sequence
  Synthetic
tggaggaattatggaaaatcaggaaccaaaggtttcaagccttg

SEQ ID NO: 3608 - DNA, 45 bp, Artificial Sequence
  Synthetic
ttacctttcctttgcctacgttgtgccttaaacccatttaattgc

SEQ ID NO: 3609 - DNA, 43 bp, Artificial Sequence
  Synthetic
cggaagaaaaagatggtattgatgccaagtcctgcaacagcta

SEQ ID NO: 3610 - DNA, 48 bp, Artificial Sequence
  Synthetic
acaggctggtaccaattactcattatatttttgatggtcttgtcaacg

SEQ ID NO: 3611 - DNA, 47 bp, Artificial Sequence
  Synthetic
ccagttacgtctttggaaaatgtttgtaatcaccaaaggtttgtagt

SEQ ID NO: 3612 - DNA, 47 bp, Artificial Sequence
  Synthetic
gaatgtgccaagttgcaaaaatctcaggtggagtatatcaattctcc

SEQ ID NO: 3613 - DNA, 45 bp, Artificial Sequence
  Synthetic
cttagtgactacacgcccaaaagagcttcaacgattttttcaatg

SEQ ID NO: 3614 - DNA, 39 bp, Artificial Sequence
  Synthetic
tgacgtgacagtcgaaagcaagccttatttcggtaagct

SEQ ID NO: 3615 - DNA, 47 bp, Artificial Sequence
  Synthetic
aggtctgcgctaagatatggtatataaccattgctcaaaaaagaaga

SEQ ID NO: 3616 - DNA, 41 bp, Artificial Sequence
  Synthetic
gaaggagatttcggacgaaccttgatttgggacataacagc

SEQ ID NO: 3617 - DNA, 43 bp, Artificial Sequence
  Synthetic
tgcatttaatcttggagagcaagaaatgttttaaggcccgtcg

SEQ ID NO: 3618 - DNA, 48 bp, Artificial Sequence
  Synthetic
tgctcttcctagatctcaaaaaaggtaagccaagaatgttaaaaaacc

SEQ ID NO: 3619 - DNA, 43 bp, Artificial Sequence
  Synthetic
ggtggcggtgtagtggttttattatgctggtgattttttctca

SEQ ID NO: 3620 - DNA, 45 bp, Artificial Sequence
  Synthetic
tgcagccttgcttgttaaacaatttgaaaaacgttggataagacg

SEQ ID NO: 3621 - DNA, 44 bp, Artificial Sequence
  Synthetic
aggaactatcatatcaggaggtcttcaagaagtgcaatgatggg

SEQ ID NO: 3622 - DNA, 43 bp, Artificial Sequence
  Synthetic
actcgaaaccatacagaagaaatgatcccaccaaagtaatgcg

SEQ ID NO: 3623 - DNA, 45 bp, Artificial Sequence
  Synthetic
cgcgaaatgctaagattatcggtaatttcacttcttcactagcgt

SEQ ID NO: 3624 - DNA, 43 bp, Artificial Sequence
  Synthetic
tcagccttctatcttgattttgctacgacgacgttctaagcta

SEQ ID NO: 3625 - DNA, 43 bp, Artificial Sequence
  Synthetic
gcagatattcttcgactttgggtccatagaaacacggacatca

SEQ ID NO: 3626 - DNA, 45 bp, Artificial Sequence
  Synthetic
ccaaatggcgagtttacaaaagaacaagaagaaccagagtcaaac

SEQ ID NO: 3627 - DNA, 43 bp, Artificial Sequence
  Synthetic
tctgtttctgatttccgtcaagatcccatgatggatgaaaggt

SEQ ID NO: 3628 - DNA, 41 bp, Artificial Sequence
  Synthetic
gttacccttgagtcagggacatagtcatcctcaccaaaacc

SEQ ID NO: 3629 - DNA, 50 bp, Artificial Sequence
  Synthetic
cgattcaacctctttatactacgcccgatatacgtattagtatcaaggat

SEQ ID NO: 3630 - DNA, 46 bp, Artificial Sequence
  Synthetic
cgtaaggagatggatttagcagaattatcaacctgacttaaagcgt

SEQ ID NO: 3631 - DNA, 38 bp, Artificial Sequence
  Synthetic
aaacagcctttccaatgcgcttgttcccaagctgcttg

SEQ ID NO: 3632 - DNA, 50 bp, Artificial Sequence
  Synthetic
agaggtaaatctcagtgaaacacaactgtgattataagcaaatcatcttg

SEQ ID NO: 3633 - DNA, 48 bp, Artificial Sequence
  Synthetic
aggattaaaccgagtataagcgtagaaacgattaatgtctattctcgt

SEQ ID NO: 3634 - DNA, 45 bp, Artificial Sequence
  Synthetic
ccttttcacggcggtaacacaaagttactaaatagctatagtccg

SEQ ID NO: 3635 - DNA, 41 bp, Artificial Sequence
  Synthetic
gccccctgtgagataaggtagtagctgagctaaactcccat

SEQ ID NO: 3636 - DNA, 42 bp, Artificial Sequence
  Synthetic
tggacttaccgctggtgtaccaatgctttcagcgcttatccc

SEQ ID NO: 3637 - DNA, 42 bp, Artificial Sequence
  Synthetic
gggcttagtgatccggtggtactgttatccccagggtagctt

SEQ ID NO: 3638 - DNA, 41 bp, Artificial Sequence
  Synthetic
cgcagtgaataggcccaagcaaggcgtcaccccctatacat

SEQ ID NO: 3639 - DNA, 45 bp, Artificial Sequence
  Synthetic
gagtccggctaagcagtgagcagctcaatgttataaagataagca

SEQ ID NO: 3640 - DNA, 42 bp, Artificial Sequence
  Synthetic
tgtaccggggctaaaacagtttctctcctaccatgacacttt

SEQ ID NO: 3641 - DNA, 41 bp, Artificial Sequence
  Synthetic
cctacaacaagttcgagcccgtatcgtaactcgccggttca

SEQ ID NO: 3642 - DNA, 38 bp, Artificial Sequence
  Synthetic
tgagaggtcttgtggggcctgacctcctgcgtgcaaag

SEQ ID NO: 3643 - DNA, 48 bp, Artificial Sequence
  Synthetic
cgaaacgtaaagaagaagttgaccttctttgattgttttttcagtagc

SEQ ID NO: 3644 - DNA, 40 bp, Artificial Sequence
  Synthetic
gcagacaaccaaccagctgtcttgttatctgctgccattg

SEQ ID NO: 3645 - DNA, 43 bp, Artificial Sequence
  Synthetic
tgcaggattgtcattgtcagaaatctgggatacgagttgatcc

SEQ ID NO: 3646 - DNA, 45 bp, Artificial Sequence
  Synthetic
tccttgaattaggtgatggtgtctaccaccaagtttgttatcacc

SEQ ID NO: 3647 - DNA, 43 bp, Artificial Sequence
  Synthetic
tcgtacaactccttcagtagtatcacactgcttgacgttttgc

SEQ ID NO: 3648 - DNA, 50 bp, Artificial Sequence
  Synthetic
ccagcgatggtagttgtttataactgcttctaacttgctatctagtttac

SEQ ID NO: 3649 - DNA, 39 bp, Artificial Sequence
  Synthetic
tcgttctcaggatctggcaaaccaaggcacgttctagat

SEQ ID NO: 3650 - DNA, 50 bp, Artificial Sequence
  Synthetic
cgtaggtctgttagtttggtaaacacgataataatcacctaatttagcag

SEQ ID NO: 3651 - DNA, 43 bp, Artificial Sequence
  Synthetic
gcagtttgctattccaagaaactttagcgctcctctacgatag

SEQ ID NO: 3652 - DNA, 41 bp, Artificial Sequence
  Synthetic
tggcaaaactagagaagttgggacttggcatccgtccacta

SEQ ID NO: 3653 - DNA, 41 bp, Artificial Sequence
  Synthetic
gtcacatcacctcgtctatcacggctggtggaacttctgtt

SEQ ID NO: 3654 - DNA, 42 bp, Artificial Sequence
  Synthetic
atttggtgagcacgagggatcacaaaaagatctctttgcctt

SEQ ID NO: 3655 - DNA, 48 bp, Artificial Sequence
  Synthetic
acgatcgctggattctaaatttttgctatgcgcaaaatgatatctttg

SEQ ID NO: 3656 - DNA, 39 bp, Artificial Sequence
  Synthetic
ttgccgtattgctgttccgttggaaaataagcgtgctca

SEQ ID NO: 3657 - DNA, 49 bp, Artificial Sequence
  Synthetic
tctggtagtttttctttgaccttctaagcctattatgatctgatgaaga

SEQ ID NO: 3658 - DNA, 43 bp, Artificial Sequence
  Synthetic
cataggctggcgatcaataaagatctcgtgattgtggttgacc

SEQ ID NO: 3659 - DNA, 43 bp, Artificial Sequence
  Synthetic
gagtttatcaaacgcttgaaaggctctattgagagcgcacaga

SEQ ID NO: 3660 - DNA, 44 bp, Artificial Sequence
  Synthetic
agggtttgattttgccaaatcttgcgatcaagaacaagaagctc

SEQ ID NO: 3661 - DNA, 49 bp, Artificial Sequence
  Synthetic
cccgttcaaattggctcttgtatttaccaagcctataaagaaaaacaag

SEQ ID NO: 3662 - DNA, 44 bp, Artificial Sequence
  Synthetic
ggcttcttgttcagggagggtagctctagtgatatcaaatatgc

SEQ ID NO: 3663 - DNA, 39 bp, Artificial Sequence
  Synthetic
acatgatgcgctcagaagggggtcagaatcaccacttcc

SEQ ID NO: 3664 - DNA, 43 bp, Artificial Sequence
  Synthetic
cagaaaaagcagctgaattggtacacaaaagggcacaggttga

SEQ ID NO: 3665 - DNA, 48 bp, Artificial Sequence
  Synthetic
aggaccgtcatgaatactaaaatgtgaaaggaattcacacttatgact

SEQ ID NO: 3666 - DNA, 40 bp, Artificial Sequence
  Synthetic
attgcggtgtgaagacctgcctcagtttgactttgcctta

SEQ ID NO: 3667 - DNA, 49 bp, Artificial Sequence
  Synthetic
tccctacctagaagtttgtacttgtctctttaatcagcttgagattgac

SEQ ID NO: 3668 - DNA, 47 bp, Artificial Sequence
  Synthetic
gccaaatcgtaaacaacgttggaaatcaaagatgtagataatcaccg

SEQ ID NO: 3669 - DNA, 42 bp, Artificial Sequence
  Synthetic
agaagcttcgcaatcactatcaaagattgggctttatcacgt

SEQ ID NO: 3670 - DNA, 48 bp, Artificial Sequence
  Synthetic
cgatcagtgggttattggttatacggtctgattaaatcctacccattg

SEQ ID NO: 3671 - DNA, 44 bp, Artificial Sequence
  Synthetic
agcgtgacaaccaatccattggattactccattattggcaaagg

SEQ ID NO: 3672 - DNA, 44 bp, Artificial Sequence
  Synthetic
agtgaaaatccgactttcagaagttccacgagtggtttgattgt

SEQ ID NO: 3673 - DNA, 40 bp, Artificial Sequence
  Synthetic
gcattagcaaaggcggtagccgcatcagtatgtcgccgcc

SEQ ID NO: 3674 - DNA, 38 bp, Artificial Sequence
  Synthetic
atgcaacggcggatgttgttggatatgcagcgctggcg

SEQ ID NO: 3675 - DNA, 40 bp, Artificial Sequence
  Synthetic
gtccggcaacaacgcctcagcaatgcgtgctcatggtatg

SEQ ID NO: 3676 - DNA, 40 bp, Artificial Sequence
  Synthetic
gggcatggggcaaggatttgcgcgcgttagggctattggg

SEQ ID NO: 3677 - DNA, 40 bp, Artificial Sequence
  Synthetic
gtgagggcgtactcatcggtgaaagtcaccgttggcacag

SEQ ID NO: 3678 - DNA, 42 bp, Artificial Sequence
  Synthetic
tgacacccaatcccgacactgtaaagagacatttgtccccgg

SEQ ID NO: 3679 - DNA, 42 bp, Artificial Sequence
  Synthetic
gcgcggatggtccaattatccactgacagccgacttttaccc

SEQ ID NO: 3680 - DNA, 38 bp, Artificial Sequence
  Synthetic
ccaagatgcaggcgggggaggccaccgtctacaccgga

SEQ ID NO: 3681 - DNA, 38 bp, Artificial Sequence
  Synthetic
cctcataaactgccgccccatcgagtccagccggtcca

SEQ ID NO: 3682 - DNA, 40 bp, Artificial Sequence
  Synthetic
actcctgataggccacctgcatgtggcgcctgactatagg

SEQ ID NO: 3683 - DNA, 38 bp, Artificial Sequence
  Synthetic
gccctccattgcgccttaagttggggaagtccgtcggt

SEQ ID NO: 3684 - DNA, 42 bp, Artificial Sequence
  Synthetic
actgtagccgccattctgttggtgattttgagagcaagggcc

SEQ ID NO: 3685 - DNA, 40 bp, Artificial Sequence
  Synthetic
gcctgtggccgaatgcttcgtgcaggacatagacgcagtg

SEQ ID NO: 3686 - DNA, 39 bp, Artificial Sequence
  Synthetic
aacagacggagcgactcccgcaggtacggcaaggagaca

SEQ ID NO: 3687 - DNA, 41 bp, Artificial Sequence
  Synthetic
cgaacggagcaggtggtacaatattgatgaaggaggccggg

SEQ ID NO: 3688 - DNA, 38 bp, Artificial Sequence
  Synthetic
ctgcgtacgagccaacatcactgccctcatcaccggct

SEQ ID NO: 3689 - DNA, 36 bp, Artificial Sequence
  Synthetic
ttgagggccagaccaggctctgctctgtcgtgcctg

SEQ ID NO: 3690 - DNA, 35 bp, Artificial Sequence
  Synthetic
attggtccgttggggcgggcgacgcggcacacgat

SEQ ID NO: 3691 - DNA, 38 bp, Artificial Sequence
  Synthetic
ccaccgacgtggggactgttggtgggtatgcggtgtca

SEQ ID NO: 3692 - DNA, 41 bp, Artificial Sequence
  Synthetic
gcgatattcaacctggagggcgaccaattcagcctacaccg

SEQ ID NO: 3693 - DNA, 38 bp, Artificial Sequence
  Synthetic
ctctgcagagggcaaggtcaccgctcgccccatcacca

SEQ ID NO: 3694 - DNA, 44 bp, Artificial Sequence
  Synthetic
ctatcagagtcagtggtgttgtaatgggcaagatcagtttttgg

SEQ ID NO: 3695 - DNA, 48 bp, Artificial Sequence
  Synthetic
cctaaccagtttacaaacttgacgaactaaacgaaatttttctagtgc

SEQ ID NO: 3696 - DNA, 39 bp, Artificial Sequence
  Synthetic
ccaaaagcaacaaaacggcatgttcgcacctatagcgaa

SEQ ID NO: 3697 - DNA, 48 bp, Artificial Sequence
  Synthetic
ccacaattgcatttaacaaaagcatattacaaatggtatgtcattgct

SEQ ID NO: 3698 - DNA, 50 bp, Artificial Sequence
  Synthetic
gctagcagcaaatttaacatcttcttactttctaatcaattacgtctagc

SEQ ID NO: 3699 - DNA, 47 bp, Artificial Sequence
  Synthetic
caacaatcttacctttagggcaaactgaacttgccactgttaatttg

SEQ ID NO: 3700 - DNA, 44 bp, Artificial Sequence
  Synthetic
gctcccaaacattataacagtccttggttgatggctgtagtgtc

SEQ ID NO: 3701 - DNA, 50 bp, Artificial Sequence
  Synthetic
caagcaattttaccaaaacacgtctcacttacttctaatggtcttttagg

SEQ ID NO: 3702 - DNA, 49 bp, Artificial Sequence
  Synthetic
gcaacttaatatgttgcccaatgacgtccattatttatacaggtgattg

SEQ ID NO: 3703 - DNA, 47 bp, Artificial Sequence
  Synthetic
acaacactcacctttttgaaaaagtggtaaaaagtttgatgatcagg

SEQ ID NO: 3704 - DNA, 45 bp, Artificial Sequence
  Synthetic
agaaacacagtttacaaggtgtgaaaagctggtgaagttaaacct

SEQ ID NO: 3705 - DNA, 46 bp, Artificial Sequence
  Synthetic
cacacaacgaccaagatttttatcatttttgttgagagttgtacca

SEQ ID NO: 3706 - DNA, 44 bp, Artificial Sequence
  Synthetic
tggagctacagataagacagtatcaaacaattgggtgttgtgag

SEQ ID NO: 3707 - DNA, 46 bp, Artificial Sequence
  Synthetic
aaccatctttaagcacactagcatgtaaaagtactgtagttgaagt

SEQ ID NO: 3708 - DNA, 46 bp, Artificial Sequence
  Synthetic
caaacttagcctcatgccattgatttgtttgaagcacctttacact

SEQ ID NO: 3709 - DNA, 46 bp, Artificial Sequence
  Synthetic
acacgtccatcattaacataccatttattgtagagttggtgaatgc

SEQ ID NO: 3710 - DNA, 45 bp, Artificial Sequence
  Synthetic
gcataatctaacatagccttggctatagtggtagtgctagtgagg

SEQ ID NO: 3711 - DNA, 49 bp, Artificial Sequence
  Synthetic
gacactgaaaaattatgcaaacgcaccactgttcttattgattatgatc

SEQ ID NO: 3712 - DNA, 48 bp, Artificial Sequence
  Synthetic
actaggttggtcatcaaaattaccatacaccaaattgagttaggtagt

SEQ ID NO: 3713 - DNA, 50 bp, Artificial Sequence
  Synthetic
tgaagtccattagcaaccatgtattaggttttttaaatgtactatgggtg

SEQ ID NO: 3714 - DNA, 48 bp, Artificial Sequence
  Synthetic
ggcacgcttcaattgtttaataagtttgcttatgaaaatgctagacaa

SEQ ID NO: 3715 - DNA, 45 bp, Artificial Sequence
  Synthetic
gaacaggtctaccatcattgtcttttctgttcattatgctggagt

SEQ ID NO: 3716 - DNA, 46 bp, Artificial Sequence
  Synthetic
tccagaattaacagccaattcagttcgttcttggttttataggtgc

SEQ ID NO: 3717 - DNA, 45 bp, Artificial Sequence
  Synthetic
caacaaccacaaacattacacacatggtaaatgtgttcaggttcc

SEQ ID NO: 3718 - DNA, 49 bp, Artificial Sequence
  Synthetic
gccaaagcaccagaaaagttaagttgttataaagaggtgtactaagtcg

SEQ ID NO: 3719 - DNA, 48 bp, Artificial Sequence
  Synthetic
acgcatttaagcatagctctagccccagttgaaaatgaagatatacat

SEQ ID NO: 3720 - DNA, 45 bp, Artificial Sequence
  Synthetic
cctaactgagtgtgtgttaacatctgtgttccacttgttacaact

SEQ ID NO: 3721 - DNA, 46 bp, Artificial Sequence
  Synthetic
gcacgttctttaccactaatagcatctttgacaaagcgtaatgtcc

SEQ ID NO: 3722 - DNA, 47 bp, Artificial Sequence
  Synthetic
gcctataaaacctatctgttgcagtgcctaacatgatacgtatgatt

SEQ ID NO: 3723 - DNA, 48 bp, Artificial Sequence
  Synthetic
ggtaccatctttgtcaactatttgcgttgggttgaagaagatttaact

SEQ ID NO: 3724 - DNA, 49 bp, Artificial Sequence
  Synthetic
ccagcagcttgcaatattgtagaaaatcaagaagataagttttggtgtg

SEQ ID NO: 3725 - DNA, 48 bp, Artificial Sequence
  Synthetic
gctagaatacttctcttggtttgcattttgtcttaacatctcacaatg

SEQ ID NO: 3726 - DNA, 42 bp, Artificial Sequence
  Synthetic
gccacaaacatgagcactttcatttgctattcgtaatgtgcg

SEQ ID NO: 3727 - DNA, 44 bp, Artificial Sequence
  Synthetic
ggaaccaacataaccccactggttgtgattatgtttacaatccg

SEQ ID NO: 3728 - DNA, 44 bp, Artificial Sequence
  Synthetic
tgggttgcataatcataatccaacagctgttactgatgccaaat

SEQ ID NO: 3729 - DNA, 46 bp, Artificial Sequence
  Synthetic
gcaacattagtaggcaatgttgtttcaaagtttttgttcgctatgg

SEQ ID NO: 3730 - DNA, 47 bp, Artificial Sequence
  Synthetic
caccacaacatccacctataaggactaaagagtttagatcttggtgt

SEQ ID NO: 3731 - DNA, 39 bp, Artificial Sequence
  Synthetic
acacctttgtcagaaccagcaacaatgtgcgtacctcat

SEQ ID NO: 3732 - DNA, 44 bp, Artificial Sequence
  Synthetic
gttgaagaattgtcaggaacacctatggcctcttgctttttcac

SEQ ID NO: 3733 - DNA, 47 bp, Artificial Sequence
  Synthetic
tggcacataaaaagtacgagttacaggcataactatatctggtgaaa

SEQ ID NO: 3734 - DNA, 38 bp, Artificial Sequence
  Synthetic
agaccccgtccactagtgtggccgcattcctaatggtt

SEQ ID NO: 3735 - DNA, 46 bp, Artificial Sequence
  Synthetic
atgagtagtgttgatagtgctgtttttcttgacaccacaatacctt

SEQ ID NO: 3736 - DNA, 43 bp, Artificial Sequence
  Synthetic
agtctcaggcaaaacattatcatcagtgtgagcacttgcagtt

SEQ ID NO: 3737 - DNA, 45 bp, Artificial Sequence
  Synthetic
gtctggttggttacatggtgtccttggttttaaaaatgtttccac

SEQ ID NO: 3738 - DNA, 46 bp, Artificial Sequence
  Synthetic
gctaaacaacaaatcttccaaagcattacctcagagaaacattcgt

SEQ ID NO: 3739 - DNA, 46 bp, Artificial Sequence
  Synthetic
gcctgaattgaattagaaatggccttgttaatcaacagggtagtgc

SEQ ID NO: 3740 - DNA, 38 bp, Artificial Sequence
  Synthetic
ggttgacgcagaacatagccatgtaaaggcgtggtctg

SEQ ID NO: 3741 - DNA, 49 bp, Artificial Sequence
  Synthetic
caacaaaacacaagaagactcaacagaaaattatatcaaatggccttgg

SEQ ID NO: 3742 - DNA, 47 bp, Artificial Sequence
  Synthetic
ggcacactactattagacatcgttttgcttaccaagattatatgcaa

SEQ ID NO: 3743 - DNA, 47 bp, Artificial Sequence
  Synthetic
gcagccatcaccggtaagtaataagcttttaatcctgaaactaatgc

SEQ ID NO: 3744 - DNA, 49 bp, Artificial Sequence
  Synthetic
ggaaatttcttcctagcagctctgtctaaactaaacaaaatggctagtg

SEQ ID NO: 3745 - DNA, 41 bp, Artificial Sequence
  Synthetic
cgtttgcgattaccaagactggcaacgttctgatggtgttg

SEQ ID NO: 3746 - DNA, 47 bp, Artificial Sequence
  Synthetic
ggtgacttcgactggttatcaaaacgattctaaccagtcttcttcag

SEQ ID NO: 3747 - DNA, 43 bp, Artificial Sequence
  Synthetic
cagtgctaacctcactatcaaagaaaggttttccacagcttgc

SEQ ID NO: 3748 - DNA, 44 bp, Artificial Sequence
  Synthetic
cggtacctcataagactcctgataatcaagggtgtgctagaact

SEQ ID NO: 3749 - DNA, 43 bp, Artificial Sequence
  Synthetic
tcaccaagtgaggtttcctctaacaacgattggtttttggtgg

SEQ ID NO: 3750 - DNA, 41 bp, Artificial Sequence
  Synthetic
acaggttttgttgctcttgtacgtaaagatacggctggcgt

SEQ ID NO: 3751 - DNA, 45 bp, Artificial Sequence
  Synthetic
ccccatgtaaaaacagttgaagacactgagcctccaaaatcaaga

SEQ ID NO: 3752 - DNA, 50 bp, Artificial Sequence
  Synthetic
gcgaaatggaaaagaacttgttcttaacaggacagtaaattgatagaaga

SEQ ID NO: 3753 - DNA, 38 bp, Artificial Sequence
  Synthetic
aacctcaagtgtgctgccacgagagctgtttttggcac

SEQ ID NO: 3754 - DNA, 36 bp, Artificial Sequence
  Synthetic
tgctgggcggtgtcactctcctggggctcctgcagt

SEQ ID NO: 3755 - DNA, 44 bp, Artificial Sequence
  Synthetic
caagaaacttctctcgttgagccaggataggtagtgctagaatg

SEQ ID NO: 3756 - DNA, 47 bp, Artificial Sequence
  Synthetic
tcagcaattgttgtatgctcaatttctcatgcaaaatatcaaacacc

SEQ ID NO: 3757 - DNA, 47 bp, Artificial Sequence
  Synthetic
gttggtattgggaagtctctacctagaaattttccccatagatgttg

SEQ ID NO: 3758 - DNA, 41 bp, Artificial Sequence
  Synthetic
ctaccaaggggatatcctcgcggagaagcatcaacatcaga

SEQ ID NO: 3759 - DNA, 42 bp, Artificial Sequence
  Synthetic
cactggtgtctgagcaagagcaaatccagcatttgagccaga

SEQ ID NO: 3760 - DNA, 45 bp, Artificial Sequence
  Synthetic
tggaactaatgactgttgtttgacttattgctccagaagactcaa

SEQ ID NO: 3761 - DNA, 43 bp, Artificial Sequence
  Synthetic
gttgcatggtagaagagattggtccatcactagaatcctgtcc

SEQ ID NO: 3762 - DNA, 44 bp, Artificial Sequence
  Synthetic
ttgtctagaatctccatttgcatgagggccaccctcttttaaat

SEQ ID NO: 3763 - DNA, 44 bp, Artificial Sequence
  Synthetic
gcttgaacaacatctaaagggacatttggggctatggattttgc

SEQ ID NO: 3764 - DNA, 43 bp, Artificial Sequence
  Synthetic
tcgctgaagccagtaagatctacaacaaattatgtaggcacac

SEQ ID NO: 3765 - DNA, 49 bp, Artificial Sequence
  Synthetic
gggattaacaaaaagaaaggacagcctgattgattgtgtgttattttcc

SEQ ID NO: 3766 - DNA, 43 bp, Artificial Sequence
  Synthetic
gttggcaaaccgtctttgggtcttcattgtttatggtttaccg

SEQ ID NO: 3767 - DNA, 40 bp, Artificial Sequence
  Synthetic
cagttctctgatggagagcagagcgcagtgtttgaatgtg

SEQ ID NO: 3768 - DNA, 47 bp, Artificial Sequence
  Synthetic
ggaatttccctgactttgtggtttggaaactaacagtgatatatcag

SEQ ID NO: 3769 - DNA, 44 bp, Artificial Sequence
  Synthetic
tgtcaacttcatttggcaacgatcgaaggcgattatttaatgtg

SEQ ID NO: 3770 - DNA, 43 bp, Artificial Sequence
  Synthetic
gcaatatccattcaggtgtttttcccctgctgcaatgttttgg

SEQ ID NO: 3771 - DNA, 44 bp, Artificial Sequence
  Synthetic
gctgcaaccaaaaatgacttttacttttgtatgagcctgttgca

SEQ ID NO: 3772 - DNA, 47 bp, Artificial Sequence
  Synthetic
gcacttgctcttgttttattaaggtctgttgagtctttatgaacagg

SEQ ID NO: 3773 - DNA, 49 bp, Artificial Sequence
  Synthetic
cctctaccagttccaataccaagaaagattcttcaatatggaagtttgg

SEQ ID NO: 3774 - DNA, 46 bp, Artificial Sequence
  Synthetic
ggaagatcagaagcagggtgaatttctatctaacattcccactaca

SEQ ID NO: 3775 - DNA, 41 bp, Artificial Sequence
  Synthetic
gtgtcaaagctggatgcacggtcaatctgtaggtgaagaca

SEQ ID NO: 3776 - DNA, 43 bp, Artificial Sequence
  Synthetic
ctcctgctttgtcatgatcactatttgttaccgggcatcctag

SEQ ID NO: 3777 - DNA, 47 bp, Artificial Sequence
  Synthetic
gggcacatcagataaatttccttgttagaagatggtgatatgatgga

SEQ ID NO: 3778 - DNA, 47 bp, Artificial Sequence
  Synthetic
tgggaacagcaaaataattgtctgtaatacatttgtagccaatggag

SEQ ID NO: 3779 - DNA, 48 bp, Artificial Sequence
  Synthetic
cataccgtacttaaggagtcacatcgacaccaaatcctaataaaatgc

SEQ ID NO: 3780 - DNA, 41 bp, Artificial Sequence
  Synthetic
gacccacctcaatttgtgttgttttagtcactggcaaacgg

SEQ ID NO: 3781 - DNA, 44 bp, Artificial Sequence
  Synthetic
gctcaaacccttcaattccagcggggtaaaaatgatgaaagtgc

SEQ ID NO: 3782 - DNA, 43 bp, Artificial Sequence
  Synthetic
gggtgcttgaggaaggttccaaaaagggatatacgtaatgtgt

SEQ ID NO: 3783 - DNA, 39 bp, Artificial Sequence
  Synthetic
gactcccaccgcagtttcagtcttcgagcgttttgatga

SEQ ID NO: 3784 - DNA, 43 bp, Artificial Sequence
  Synthetic
gggaaaatttagcctatagcctaggtggaagtccatggtgagg

SEQ ID NO: 3785 - DNA, 38 bp, Artificial Sequence
  Synthetic
acactgcaaggtgacgttccgcatggagctgtaggagt

SEQ ID NO: 3786 - DNA, 43 bp, Artificial Sequence
  Synthetic
gcagtcctatcaactgattgaatcatggtcttgaccacatcct

SEQ ID NO: 3787 - DNA, 50 bp, Artificial Sequence
  Synthetic
atgccaaatcttgcatatgtatggtgtggtgaaattattatacaatgagc

SEQ ID NO: 3788 - DNA, 50 bp, Artificial Sequence
  Synthetic
accaaactctaattgtcaattcccaaaggttccatttatttacacaagag

SEQ ID NO: 3789 - DNA, 45 bp, Artificial Sequence
  Synthetic
atgagtaattttgatcccaccacccagcaaagatgtcttttgctt

SEQ ID NO: 3790 - DNA, 49 bp, Artificial Sequence
  Synthetic
gccaggaacaaaacaaaacagtaatgagatcttgtctttgattttcaag

SEQ ID NO: 3791 - DNA, 45 bp, Artificial Sequence
  Synthetic
cgttagaaggagaggtcaatctgttaagtcagcacatcagaaagg

SEQ ID NO: 3792 - DNA, 42 bp, Artificial Sequence
  Synthetic
tgttgtgatagctcccacaggaagctaacagagggaaaatgg

SEQ ID NO: 3793 - DNA, 46 bp, Artificial Sequence
  Synthetic
tgaaacaagttgaaaaaccacctcagtcttcaacctctaatcctcc

SEQ ID NO: 3794 - DNA, 43 bp, Artificial Sequence
  Synthetic
gcttcctgcattctatatgactctccagctggagacttggagt

SEQ ID NO: 3795 - DNA, 48 bp, Artificial Sequence
  Synthetic
aatccaaacctccttaaagctctagtgaaataatgaagttttcctgga

SEQ ID NO: 3796 - DNA, 47 bp, Artificial Sequence
  Synthetic
cctcatctgttgtgttttggccatggatatagtggacaattagtttg

SEQ ID NO: 3797 - DNA, 47 bp, Artificial Sequence
  Synthetic
caacccacttgtgattagtaacagagtttttccagtcttttccatct

SEQ ID NO: 3798 - DNA, 45 bp, Artificial Sequence
  Synthetic
caactccaaactgaaccaagttctagaatctcagtcaactttgga

SEQ ID NO: 3799 - DNA, 41 bp, Artificial Sequence
  Synthetic
tgcccaagattgcattctgtatcgaaggtcttcctggaatg

SEQ ID NO: 3800 - DNA, 48 bp, Artificial Sequence
  Synthetic
gccattggatcaatttcagctttagatcatcacattgataaaaccatg

SEQ ID NO: 3801 - DNA, 46 bp, Artificial Sequence
  Synthetic
gcaataaaccattttcatccaaccactcctggatttccttatgtcc

SEQ ID NO: 3802 - DNA, 45 bp, Artificial Sequence
  Synthetic
cctgtatggaaacctggattcaaattactcaattttgtgccgaat

SEQ ID NO: 3803 - DNA, 41 bp, Artificial Sequence
  Synthetic
ttgccgtgctgttgtcatttagctacattctatgtctggtt

SEQ ID NO: 3804 - DNA, 40 bp, Artificial Sequence
  Synthetic
tttgctgcgttcaacaaaaaggggagaccctcagtgtgat

SEQ ID NO: 3805 - DNA, 49 bp, Artificial Sequence
  Synthetic
cccccaaatgtacagtttgtcaaatgacccacttaaaattcaaataccc

SEQ ID NO: 3806 - DNA, 48 bp, Artificial Sequence
  Synthetic
cgtattttgaagtaaccccgaggaggagacatacttttgattaacagc

SEQ ID NO: 3807 - DNA, 43 bp, Artificial Sequence
  Synthetic
ccattttctatgaaacccgcgattggcaacagggatgcgaaat

SEQ ID NO: 3808 - DNA, 45 bp, Artificial Sequence
  Synthetic
cgcgttgtatgaccagagatctagaagtagaagggagaattcagg

SEQ ID NO: 3809 - DNA, 50 bp, Artificial Sequence
  Synthetic
aggatccaatctttgtatcctgactatacagagatgaagcattaaacaac

SEQ ID NO: 3810 - DNA, 44 bp, Artificial Sequence
  Synthetic
tccatctcaacaatgaacagagatccctgccactcataaacaag

SEQ ID NO: 3811 - DNA, 46 bp, Artificial Sequence
  Synthetic
tcgtcccttgactgttttttcataatgttgtttcaattgtgctaga

SEQ ID NO: 3812 - DNA, 41 bp, Artificial Sequence
  Synthetic
caggtcaatgggcaggacaaagaagcaactataccagacat

SEQ ID NO: 3813 - DNA, 43 bp, Artificial Sequence
  Synthetic
acacccttctttaggatcaatacctaccttctttgctgtgtcc

SEQ ID NO: 3814 - DNA, 41 bp, Artificial Sequence
  Synthetic
gctaagctgctgcaactctttcgagcagcaaatacaggact

SEQ ID NO: 3815 - DNA, 48 bp, Artificial Sequence
  Synthetic
cccgacaacaagtcttattgctattatgctcagcaaatttaaaaacag

SEQ ID NO: 3816 - DNA, 41 bp, Artificial Sequence
  Synthetic
tgaagccacccatgaccatggaaagacaaacttagaggctc

SEQ ID NO: 3817 - DNA, 38 bp, Artificial Sequence
  Synthetic
atgtgccagctgccttacaggcgcacgtagagtaaagc

SEQ ID NO: 3818 - DNA, 44 bp, Artificial Sequence
  Synthetic
actgaaggtgcaacagggtcgtcctactgatataatacctttgg

SEQ ID NO: 3819 - DNA, 43 bp, Artificial Sequence
  Synthetic
ttgagtgccaacctgtgctcaggttacattagagtcagtagac

SEQ ID NO: 3820 - DNA, 44 bp, Artificial Sequence
  Synthetic
accacaatgatgacatctgcaaatttacatccaagtttgagacg

SEQ ID NO: 3821 - DNA, 43 bp, Artificial Sequence
  Synthetic
cggtaagtgtaccctaaaggcccatgaagtgttagttcccaag

SEQ ID NO: 3822 - DNA, 41 bp, Artificial Sequence
  Synthetic
ccaatgttcccccaagcaggggtgaatacatcctttgatcc

SEQ ID NO: 3823 - DNA, 46 bp, Artificial Sequence
  Synthetic
cctctacaaaacatatgtctggcattaatgatgtgtatggcaatgc

SEQ ID NO: 3824 - DNA, 43 bp, Artificial Sequence
  Synthetic
caatgtcacagtagttaccaggatgtctctcaccattgcaaca

SEQ ID NO: 3825 - DNA, 43 bp, Artificial Sequence
  Synthetic
cagcagaaagccggattgaatgcaatgtcaaattacaggattt

SEQ ID NO: 3826 - DNA, 40 bp, Artificial Sequence
  Synthetic
tgacacaaacatgcaaccatgcgtgtgtgtagcatggtcc

SEQ ID NO: 3827 - DNA, 44 bp, Artificial Sequence
  Synthetic
tcgaggataacaggaacactccggaaaattgtccatattagccc

SEQ ID NO: 3828 - DNA, 38 bp, Artificial Sequence
  Synthetic
tcccatccacacgtcatctcgagagggaatccaggagt

SEQ ID NO: 3829 - DNA, 37 bp, Artificial Sequence
  Synthetic
gctgctccagcgtgtcgtgcctaattacgctgtccgc

SEQ ID NO: 3830 - DNA, 40 bp, Artificial Sequence
  Synthetic
gctctcccactccaacacgggccctgtggagactgcatct

SEQ ID NO: 3831 - DNA, 39 bp, Artificial Sequence
  Synthetic
tgcggagatgtggagagaaacggctggacgaactgtgcg

SEQ ID NO: 3832 - DNA, 38 bp, Artificial Sequence
  Synthetic
acgtatacgaagggtggctcgtgggcggtctcccttgt

SEQ ID NO: 3833 - DNA, 38 bp, Artificial Sequence
  Synthetic
tccgttgtgctcgacgccgtgtacgtccaccacatgag

SEQ ID NO: 3834 - DNA, 40 bp, Artificial Sequence
  Synthetic
gcgtatcctcgtctgccctctggccggcgagagaaagaga

SEQ ID NO: 3835 - DNA, 38 bp, Artificial Sequence
  Synthetic
gcggggctttctttgagttcgccgggtatgagccgcca

SEQ ID NO: 3836 - DNA, 37 bp, Artificial Sequence
  Synthetic
tctcgccgaggacgcgttccgtagacgggctcgaagc

SEQ ID NO: 3837 - DNA, 40 bp, Artificial Sequence
  Synthetic
ataccattcccaaccatccctaacatcaagttccctggaa

SEQ ID NO: 3838 - DNA, 39 bp, Artificial Sequence
  Synthetic
tggttaagctgggcgattgtgcaaaaagtctggcaaacc

SEQ ID NO: 3839 - DNA, 39 bp, Artificial Sequence
  Synthetic
tgtgagtcaaaacggaggcttgcaaaaaaacagagtggt

SEQ ID NO: 3840 - DNA, 43 bp, Artificial Sequence
  Synthetic
ccatttcccacaaagtctgccgacacgaaacactgatacttac

SEQ ID NO: 3841 - DNA, 40 bp, Artificial Sequence
  Synthetic
tgcaagtttgtaaggcgtgtttctcccgaagaactgacag

SEQ ID NO: 3842 - DNA, 46 bp, Artificial Sequence
  Synthetic
cctctatgttgcgaaagtatgctttcctttgccatagtaaacatga

SEQ ID NO: 3843 - DNA, 44 bp, Artificial Sequence
  Synthetic
tctgcggtaaacctgtactagatgtttgttgttgtacttcaagc

SEQ ID NO: 3844 - DNA, 40 bp, Artificial Sequence
  Synthetic
cagtgcgacacaactaacgaattgtttgatttcggttgga

SEQ ID NO: 3845 - DNA, 42 bp, Artificial Sequence
  Synthetic
cgccccggctttataacatttagggacttgatatatccgagt

SEQ ID NO: 3846 - DNA, 43 bp, Artificial Sequence
  Synthetic
gttgctgtccggttgtaacatttgtgtttttttaccgaaagac

SEQ ID NO: 3847 - DNA, 42 bp, Artificial Sequence
  Synthetic
ttttccccccctgatcggagtctgcgcagattttaaaatacg

SEQ ID NO: 3848 - DNA, 39 bp, Artificial Sequence
  Synthetic
accctcgggaaggttctcttttacgtcgtttcctgtagc

SEQ ID NO: 3849 - DNA, 38 bp, Artificial Sequence
  Synthetic
atcgcgcaatcgaaccattctctgacggctaaggtgaa

SEQ ID NO: 3850 - DNA, 44 bp, Artificial Sequence
  Synthetic
gcaatgtgatcaacgacgttttatgtatcggaaaaactcgaatt

SEQ ID NO: 3851 - DNA, 48 bp, Artificial Sequence
  Synthetic
caaagcaattcctctatcgcagaagaaagtttcggaaaatgtaaacac

SEQ ID NO: 3852 - DNA, 45 bp, Artificial Sequence
  Synthetic
cctgtaaactggtctgcttgcatgtgttataacagacatatgcaa

SEQ ID NO: 3853 - DNA, 44 bp, Artificial Sequence
  Synthetic
aatctctaacccgtcatctccaaggacactttcaaaatttttcg

SEQ ID NO: 3854 - DNA, 43 bp, Artificial Sequence
  Synthetic
cacaaatcatcgtcgaacaataaggcggtgagcaagttctctt

SEQ ID NO: 3855 - DNA, 40 bp, Artificial Sequence
  Synthetic
gattccgccgtactgaaaaaacaacgctgtttaaaagggc

SEQ ID NO: 3856 - DNA, 40 bp, Artificial Sequence
  Synthetic
ggcagaacagagaccccccctgctgacaggatcgtcccct

SEQ ID NO: 3857 - DNA, 35 bp, Artificial Sequence
  Synthetic
cgcgaagtgttccgcgacgtggagacgcgggcgaa

SEQ ID NO: 3858 - DNA, 40 bp, Artificial Sequence
  Synthetic
gggcgttcgttccgcacatagccgtgacgtatgaagaaga

SEQ ID NO: 3859 - DNA, 38 bp, Artificial Sequence
  Synthetic
gcgatctccacctcgcgtggcctccgatacgtacgact

SEQ ID NO: 3860 - DNA, 41 bp, Artificial Sequence
  Synthetic
aggaaaacgagtacgcgcaccaatcatgcattgtgtggggt

SEQ ID NO: 3861 - DNA, 42 bp, Artificial Sequence
  Synthetic
ccgacttcgataaacctcttggttccttagcccaagagcatg

SEQ ID NO: 3862 - DNA, 43 bp, Artificial Sequence
  Synthetic
tcctttttcaatttcttcttcccctctcacagaacttcaggct

SEQ ID NO: 3863 - DNA, 40 bp, Artificial Sequence
  Synthetic
tggaacttctggtagctcatggaaatgggaggacctgaga

SEQ ID NO: 3864 - DNA, 43 bp, Artificial Sequence
  Synthetic
catctcctgtggcccacttgaatacaataagcaatgaggaaac

SEQ ID NO: 3865 - DNA, 48 bp, Artificial Sequence
  Synthetic
agggagccaattttaaagacagtatgactttcgagtttagtagtacag

SEQ ID NO: 3866 - DNA, 48 bp, Artificial Sequence
  Synthetic
tgagtcccaatactgaaagttttggcgatacaagggtatgatatgacc

SEQ ID NO: 3867 - DNA, 47 bp, Artificial Sequence
  Synthetic
gaaggttaacagagtgtgttactgtgttatcatgcgaacaattcaac

SEQ ID NO: 3868 - DNA, 40 bp, Artificial Sequence
  Synthetic
tcctgggtaacacgttccataagctcatggtcctacattg

SEQ ID NO: 3869 - DNA, 42 bp, Artificial Sequence
  Synthetic
agagactttgttggtcagcactaaaagaagtcctcgtgctat

SEQ ID NO: 3870 - DNA, 44 bp, Artificial Sequence
  Synthetic
cgtggactggtgtatctgaaatgattggaaatctagtggtaccg

SEQ ID NO: 3871 - DNA, 43 bp, Artificial Sequence
  Synthetic
tctaccatccctgtccacccattcaatctagaggcctatttgg

SEQ ID NO: 3872 - DNA, 36 bp, Artificial Sequence
  Synthetic
agcacgagccaaggggacgcttccacgcggcagatc

SEQ ID NO: 3873 - DNA, 39 bp, Artificial Sequence
  Synthetic
aggtgcgtacacggccaccttggagtgggagagaacaga

SEQ ID NO: 3874 - DNA, 38 bp, Artificial Sequence
  Synthetic
tcgttcaggtcaagcgccagctccgcacgtctgtctga

SEQ ID NO: 3875 - DNA, 37 bp, Artificial Sequence
  Synthetic
gcaggagtcggtcgatcgtctagtctatgcgcgcgcc

SEQ ID NO: 3876 - DNA, 39 bp, Artificial Sequence
  Synthetic
gccggcgagcgtttgcttgttcacacagatgcaaccgat

SEQ ID NO: 3877 - DNA, 36 bp, Artificial Sequence
  Synthetic
ctcatacgccacggggtcccccgtctggcgtcgaac

SEQ ID NO: 3878 - DNA, 37 bp, Artificial Sequence
  Synthetic
gcctccgctgcctatcggacgccgttctgtctcgaga

SEQ ID NO: 3879 - DNA, 40 bp, Artificial Sequence
  Synthetic
ggagaagaggtggcggctcagaagaatctgccgatcacca

SEQ ID NO: 3880 - DNA, 35 bp, Artificial Sequence
  Synthetic
ttgcgtcgcttcgagcccgagaaagaggcgccggt

SEQ ID NO: 3881 - DNA, 41 bp, Artificial Sequence
  Synthetic
gccaagctgtctcgcggatacctgcgaagatagtgaccccg

SEQ ID NO: 3882 - DNA, 44 bp, Artificial Sequence
  Synthetic
gtatgacggccccagattcgactccttaacacatcattattcct

SEQ ID NO: 3883 - DNA, 40 bp, Artificial Sequence
  Synthetic
atgagaacagctgctctctgttagcgattttgtgctcatg

SEQ ID NO: 3884 - DNA, 44 bp, Artificial Sequence
  Synthetic
cgtctgactgtttgcgattctggtttccaatgtccattttttcc

SEQ ID NO: 3885 - DNA, 44 bp, Artificial Sequence
  Synthetic
cgtgcctgctttttagcgtgtagctctgttttctttgttttgtc

SEQ ID NO: 3886 - DNA, 44 bp, Artificial Sequence
  Synthetic
tctcggattgcgtcgttatgatttttgttaaaaagcgaatgtcc

SEQ ID NO: 3887 - DNA, 41 bp, Artificial Sequence
  Synthetic
gcccagagagattgcaactacttcacacatcacgagtctcc

SEQ ID NO: 3888 - DNA, 43 bp, Artificial Sequence
  Synthetic
cggcccattggaacgaacattatgatcatctgaaactgtttgg

SEQ ID NO: 3889 - DNA, 45 bp, Artificial Sequence
  Synthetic
cggtatacgcgtttagtagaatgctgatgacgcatacgatctact

SEQ ID NO: 3890 - DNA, 38 bp, Artificial Sequence
  Synthetic
gcgtgtttagtgggtgcagtccgtcattacatctcccg

SEQ ID NO: 3891 - DNA, 42 bp, Artificial Sequence
  Synthetic
tcagacctctcatcgttcacataatttcgacgcaaactttgg

SEQ ID NO: 3892 - DNA, 42 bp, Artificial Sequence
  Synthetic
tggaagtccgacagatgcaatagttcgttgagagaattaggc

SEQ ID NO: 3893 - DNA, 49 bp, Artificial Sequence
  Synthetic
agtcttagtgaggactgactttgaagaaacatactgatttgtacagaag

SEQ ID NO: 3894 - DNA, 42 bp, Artificial Sequence
  Synthetic
tcagacatgggaagcaagatacaagtgttggtaaacgcgtgt

SEQ ID NO: 3895 - DNA, 39 bp, Artificial Sequence
  Synthetic
acacaaggcaattttagcccttttttcaaacgtctgggc

SEQ ID NO: 3896 - DNA, 39 bp, Artificial Sequence
  Synthetic
cgcccatatgctaaacgaacggtttgtggagtcggtagc

SEQ ID NO: 3897 - DNA, 45 bp, Artificial Sequence
  Synthetic
ggactagtgttcgcattagagaatcgagcctagcgattagtttgt

SEQ ID NO: 3898 - DNA, 39 bp, Artificial Sequence
  Synthetic
cggcctggaatacaagaccattgatgccaatgaagcctt

SEQ ID NO: 3899 - DNA, 41 bp, Artificial Sequence
  Synthetic
accatgacctcgagaatctctctgaatgggagcctttgaac

SEQ ID NO: 3900 - DNA, 43 bp, Artificial Sequence
  Synthetic
agacgttcgagacctgttcaaaatctgtgtttgtatctgctcc

SEQ ID NO: 3901 - DNA, 46 bp, Artificial Sequence
  Synthetic
acaaccattgagtgagaatacgctgaattttttctggaatcttgag

SEQ ID NO: 3902 - DNA, 35 bp, Artificial Sequence
  Synthetic
cgagccaaggggacgatccgccgacacactgcagc

SEQ ID NO: 3903 - DNA, 39 bp, Artificial Sequence
  Synthetic
cgtctccgatccgtcaggaccgagctctctcaccccgtg

SEQ ID NO: 3904 - DNA, 38 bp, Artificial Sequence
  Synthetic
tctcgctccgcttggttttccggccgccgagattaacg

SEQ ID NO: 3905 - DNA, 38 bp, Artificial Sequence
  Synthetic
gtctgcggaccccgatgtaaaccggtgattcccggaga

SEQ ID NO: 3906 - DNA, 36 bp, Artificial Sequence
  Synthetic
cctcgccttgcaaactccgtacatgagggcggccag

SEQ ID NO: 3907 - DNA, 43 bp, Artificial Sequence
  Synthetic
ccctcttgagcttcctatacagtttccttaatgggaacgggga

SEQ ID NO: 3908 - DNA, 44 bp, Artificial Sequence
  Synthetic
agcgacggtaaatgcatttgaaactattgccgcaaatatcattg

SEQ ID NO: 3909 - DNA, 42 bp, Artificial Sequence
  Synthetic
ccgatcaaggaatggggcatcagtttcctttggcatatccgc

SEQ ID NO: 3910 - DNA, 43 bp, Artificial Sequence
  Synthetic
ggcctattatcttttgcctaggcattttctgacatgaccctcg

SEQ ID NO: 3911 - DNA, 45 bp, Artificial Sequence
  Synthetic
agtttctccaagcgaatctctgtatctcatcggaggacttgaatg

SEQ ID NO: 3912 - DNA, 41 bp, Artificial Sequence
  Synthetic
ccagatcaggttttttgggttgggtaaccgaaaacggtccg

SEQ ID NO: 3913 - DNA, 49 bp, Artificial Sequence
  Synthetic
tcttcttccactgttggtgcatatttatggaaaagtgaatcagtatagg

SEQ ID NO: 3914 - DNA, 41 bp, Artificial Sequence
  Synthetic
ggttgctcacgctgtctattgtcagaagatgaccatgaaca

SEQ ID NO: 3915 - DNA, 40 bp, Artificial Sequence
  Synthetic
tctgtacctgaatcgtctgcctatagtgtgccccaactgt

SEQ ID NO: 3916 - DNA, 43 bp, Artificial Sequence
  Synthetic
cggactaagttgctgtataacatcagcgacagttgaaacggaa

SEQ ID NO: 3917 - DNA, 40 bp, Artificial Sequence
  Synthetic
tgccgcactactgtttctctattggacaacgtgtagatgg

SEQ ID NO: 3918 - DNA, 43 bp, Artificial Sequence
  Synthetic
cccattatcatatgcccactgcgttggaacatagttttgctga

SEQ ID NO: 3919 - DNA, 39 bp, Artificial Sequence
  Synthetic
tcctggcacaaatctaggcgcagtttagagctgcagaca

SEQ ID NO: 3920 - DNA, 44 bp, Artificial Sequence
  Synthetic
cgtccatggctctaagttatattcacatgcagcaattgaaatgc

SEQ ID NO: 3921 - DNA, 42 bp, Artificial Sequence
  Synthetic
tgtttccagtgtccacgtattttccggagacttgtccatcag

SEQ ID NO: 3922 - DNA, 45 bp, Artificial Sequence
  Synthetic
ggtgtgtggtagatgtaacatgtaccatcaggtacagatgtccct

SEQ ID NO: 3923 - DNA, 42 bp, Artificial Sequence
  Synthetic
cacaggcaaatatggtgtacctttaacatctggtcctgacat

SEQ ID NO: 3924 - DNA, 48 bp, Artificial Sequence
  Synthetic
ctctgtattgatgtccagacactttccatattttgaattgaaaaagcc

SEQ ID NO: 3925 - DNA, 50 bp, Artificial Sequence
  Synthetic
acccataccccaatattctccaatagttgctatggattataaacaaactc

SEQ ID NO: 3926 - DNA, 43 bp, Artificial Sequence
  Synthetic
cacacatacacaatcatcgttttgtgcccctacctcttcttcc

SEQ ID NO: 3927 - DNA, 43 bp, Artificial Sequence
  Synthetic
agtgtaattaaaggtgtggcaacctgttccctgccaaaaatgc

SEQ ID NO: 3928 - DNA, 48 bp, Artificial Sequence
  Synthetic
tggtcgctcttctgtattttcaaatacatataaaagcactgtgtacaa

SEQ ID NO: 3929 - DNA, 46 bp, Artificial Sequence
  Synthetic
gccccgtacactgaacaattgctgtttgctattttatagtaaggtc

SEQ ID NO: 3930 - DNA, 46 bp, Artificial Sequence
  Synthetic
caggtcaatctcagtttgtggtataatcagcagtataatcatgcac

SEQ ID NO: 3931 - DNA, 42 bp, Artificial Sequence
  Synthetic
cgttttaatttctgcagcgtctgtgacagctcagcagttgtt

SEQ ID NO: 3932 - DNA, 42 bp, Artificial Sequence
  Synthetic
cacatccatatcacttcctgaccaggctcacaacatagtgtg

SEQ ID NO: 3933 - DNA, 47 bp, Artificial Sequence
  Synthetic
ccactgcaccattttagatagttcaacaccagaatggatagaaagac

SEQ ID NO: 3934 - DNA, 45 bp, Artificial Sequence
  Synthetic
tgtactattggcttccagtccctatgaaacaatggataaagcatg

SEQ ID NO: 3935 - DNA, 48 bp, Artificial Sequence
  Synthetic
ggaccatgtcctttcaaaaaaacataatggaaatcctgtataccaatt

SEQ ID NO: 3936 - DNA, 41 bp, Artificial Sequence
  Synthetic
acgttttatggccgtcatgtatggatgggtggtgtaaagtg

SEQ ID NO: 3937 - DNA, 38 bp, Artificial Sequence
  Synthetic
cgggctctgtggttctgggaggcacctacgaagcctca

SEQ ID NO: 3938 - DNA, 48 bp, Artificial Sequence
  Synthetic
gcacagtttacatttgtccaatgataggtatcggtttcaaaaacataa

SEQ ID NO: 3939 - DNA, 44 bp, Artificial Sequence
  Synthetic
gcaaaaacacaaaactaacacacaacgccatatatgctgctagg

SEQ ID NO: 3940 - DNA, 45 bp, Artificial Sequence
  Synthetic
tacctcaccagtttgggggaagttctactacatatactaatccca

SEQ ID NO: 3941 - DNA, 45 bp, Artificial Sequence
  Synthetic
atcaggatcaggtgccacacgataatcccatatttcaaaatgctg

SEQ ID NO: 3942 - DNA, 43 bp, Artificial Sequence
  Synthetic
gccataacgcaaatgtggagctcaatctccttttgataccacc

SEQ ID NO: 3943 - DNA, 47 bp, Artificial Sequence
  Synthetic
tgtcctctaagctagtggcaaccatactatgaattctaccttactgg

SEQ ID NO: 3944 - DNA, 48 bp, Artificial Sequence
  Synthetic
gtaaaagcatagttggcagcctatttgttttatacactatgccttacc

SEQ ID NO: 3945 - DNA, 38 bp, Artificial Sequence
  Synthetic
gaggggagggaaaaactggccccaatgggtgttgtact

SEQ ID NO: 3946 - DNA, 42 bp, Artificial Sequence
  Synthetic
aggctggaccactgttaccagttgcatacccagcagtagacc

SEQ ID NO: 3947 - DNA, 42 bp, Artificial Sequence
  Synthetic
gcctcaacagatggtgattgtatgacccagttaaagatgtct

SEQ ID NO: 3948 - DNA, 47 bp, Artificial Sequence
  Synthetic
caccagaaaattcagcacacatgacatcttctaatatagtgccaatc

SEQ ID NO: 3949 - DNA, 46 bp, Artificial Sequence
  Synthetic
caaaggctgtgatgtaatgtctacttgtacactgtacaactaggga

SEQ ID NO: 3950 - DNA, 42 bp, Artificial Sequence
  Synthetic
tccaacatcccacacaacatgctggtattgatgaaccaacaa

SEQ ID NO: 3951 - DNA, 48 bp, Artificial Sequence
  Synthetic
tgtcctgtccattatagtcagtgttagaaagtttccttggtagatctg

SEQ ID NO: 3952 - DNA, 43 bp, Artificial Sequence
  Synthetic
ccagaatattgacatattggtgcctcaggagctccaattcctt

SEQ ID NO: 3953 - DNA, 43 bp, Artificial Sequence
  Synthetic
cagcacagtgaaattgtctaagatcacatggtgtcattggcat

SEQ ID NO: 3954 - DNA, 40 bp, Artificial Sequence
  Synthetic
tggtgaaccattgcaaccaattaaactcctctgaccctca

SEQ ID NO: 3955 - DNA, 46 bp, Artificial Sequence
  Synthetic
tgtctccttcttttgtcttcttccattgctcaacatacaccttagc

SEQ ID NO: 3956 - DNA, 45 bp, Artificial Sequence
  Synthetic
cctcagcttgtacttacctggataaccaaaggctgttttagtacc

SEQ ID NO: 3957 - DNA, 48 bp, Artificial Sequence
  Synthetic
agcaacgaatagtaatgctctgtaatgaaaattattgtgtgtgtgttg

SEQ ID NO: 3958 - DNA, 45 bp, Artificial Sequence
  Synthetic
tgaaccatctgtactttcatcgaaaaaagttggtttgttgtggat

SEQ ID NO: 3959 - DNA, 49 bp, Artificial Sequence
  Synthetic
tgcctcaattacttcttctaaagcaagaagctacaaaagtaataagtcc

SEQ ID NO: 3960 - DNA, 46 bp, Artificial Sequence
  Synthetic
accatttgactgcaatctctaacattatacgcagatgaagatagca

SEQ ID NO: 3961 - DNA, 47 bp, Artificial Sequence
  Synthetic
ggtagtttaatttgttgtgggactctatgaggaatgcattagatggt

SEQ ID NO: 3962 - DNA, 47 bp, Artificial Sequence
  Synthetic
ctcagaggcatactgtgatttacttttcaagtttcagaagctaaagc

SEQ ID NO: 3963 - DNA, 40 bp, Artificial Sequence
  Synthetic
ggcctcctctcaggggaattgaggcctcctccaactccat

SEQ ID NO: 3964 - DNA, 45 bp, Artificial Sequence
  Synthetic
cacgtttatttctacctgctctgtaactgtaaacctcccaaaagg

SEQ ID NO: 3965 - DNA, 44 bp, Artificial Sequence
  Synthetic
tggattaccccctacaccaccaggggaaatcgatattgtatcag

SEQ ID NO: 3966 - DNA, 45 bp, Artificial Sequence
  Synthetic
agtctgcatcaggagcagctgatgtttcatttacatttgaaaggg

SEQ ID NO: 3967 - DNA, 47 bp, Artificial Sequence
  Synthetic
gctctgtttgtgatggtataatggttggattggtagtgtttaatccc

SEQ ID NO: 3968 - DNA, 46 bp, Artificial Sequence
  Synthetic
tgggtatgtgttaggattttcaacagaagaggaaatccattaggtg

SEQ ID NO: 3969 - DNA, 43 bp, Artificial Sequence
  Synthetic
gggaagcaagtttattatcctgcttggctggaaaggttggaga

SEQ ID NO: 3970 - DNA, 49 bp, Artificial Sequence
  Synthetic
gcgtaagggtcagttttttccttattacaagtatattacttcatgggcc

SEQ ID NO: 3971 - DNA, 37 bp, Artificial Sequence
  Synthetic
actgtcgccagtggggtgcgctcagccactaacccgt

SEQ ID NO: 3972 - DNA, 43 bp, Artificial Sequence
  Synthetic
acactatttgtcaccataagcaagtctgtgggatggaaccaac

SEQ ID NO: 3973 - DNA, 43 bp, Artificial Sequence
  Synthetic
tgcttcaacagttggtgacattaaaattcacacaacctctagc

SEQ ID NO: 3974 - DNA, 40 bp, Artificial Sequence
  Synthetic
acagattttgcccgaagatgctaaaggttggtggtggaag

SEQ ID NO: 3975 - DNA, 50 bp, Artificial Sequence
  Synthetic
agggtcccattacaattaaagaaggttcaaatgttaggagagataacaag

SEQ ID NO: 3976 - DNA, 41 bp, Artificial Sequence
  Synthetic
cttggcagccgtgttggtaagataagtcagagttctcaggg

SEQ ID NO: 3977 - DNA, 45 bp, Artificial Sequence
  Synthetic
gtggtagaaaagagagtgttgctaacaagaaaacagcagacaagc

SEQ ID NO: 3978 - DNA, 44 bp, Artificial Sequence
  Synthetic
accttgtctatgtagtcctcaactacaccaatgatgaaacagga

SEQ ID NO: 3979 - DNA, 43 bp, Artificial Sequence
  Synthetic
catgctcttggaagtttatatcccactctttgggccaagatcc

SEQ ID NO: 3980 - DNA, 49 bp, Artificial Sequence
  Synthetic
tctggggacatcataaccatcataaggttttcctaggtttactattcca

SEQ ID NO: 3981 - DNA, 45 bp, Artificial Sequence
  Synthetic
tcagtcctgtggttaataaagtgttattcagcacaaactaccatg

SEQ ID NO: 3982 - DNA, 45 bp, Artificial Sequence
  Synthetic
gtcgtgtgcttctaatttaactggtttggagggctgctactatag

SEQ ID NO: 3983 - DNA, 43 bp, Artificial Sequence
  Synthetic
gctaccaaaggcactccctaattgtttagacactcaccaaggt

SEQ ID NO: 3984 - DNA, 44 bp, Artificial Sequence
  Synthetic
ggtctagtgatgtttaaccactgacctgtcacaagtcaccatgg

SEQ ID NO: 3985 - DNA, 45 bp, Artificial Sequence
  Synthetic
acttcttgttgatcatacccatcaagtttaaccaaaccaggtgac

SEQ ID NO: 3986 - DNA, 43 bp, Artificial Sequence
  Synthetic
ggtacccttgcaagatcttaagatcacccacagtaacagtccc

SEQ ID NO: 3987 - DNA, 43 bp, Artificial Sequence
  Synthetic
ccaagccctgaaatatagctgttatagaggagagcaaatccag

SEQ ID NO: 3988 - DNA, 43 bp, Artificial Sequence
  Synthetic
actcaggtttcttcttgggtgtattgatgtgtattgcccaagg

SEQ ID NO: 3989 - DNA, 45 bp, Artificial Sequence
  Synthetic
cctatgatattacctgtgttggccatatgactatccaacccaacc

SEQ ID NO: 3990 - DNA, 41 bp, Artificial Sequence
  Synthetic
gtgaggtctacttccaatcgtgtcctggtgttaaggaacca

SEQ ID NO: 3991 - DNA, 45 bp, Artificial Sequence
  Synthetic
ccttgtgtctttagtagcgttgtttttcccttatgtgtctttggg

SEQ ID NO: 3992 - DNA, 43 bp, Artificial Sequence
  Synthetic
gcatgcatttgtgaccaaaacaccaggtatcttaacaggctca

SEQ ID NO: 3993 - DNA, 45 bp, Artificial Sequence
  Synthetic
tgcattgagtaaacaggatgtatcaaatgtgaccttccttaaacg

SEQ ID NO: 3994 - DNA, 46 bp, Artificial Sequence
  Synthetic
cttctcttgtcttcctgatgtgtatcgcgagatactaacaaaaacc

SEQ ID NO: 3995 - DNA, 38 bp, Artificial Sequence
  Synthetic
ttgtcggcccattcctgttcgtcggacagagtgatggt

SEQ ID NO: 3996 - DNA, 45 bp, Artificial Sequence
  Synthetic
ggagctcttctttcttctcttttgtgtcgttttcccaaatgaagt

SEQ ID NO: 3997 - DNA, 44 bp, Artificial Sequence
  Synthetic
tgtgaattcttcatacccctcatgtcatccgtcaagaaggaaga

SEQ ID NO: 3998 - DNA, 39 bp, Artificial Sequence
  Synthetic
cctcaggagttgatgcatgggggcgatctgaatttcgtg

SEQ ID NO: 3999 - DNA, 44 bp, Artificial Sequence
  Synthetic
tgtttcactaacctcttcaggagatattgaccgtttcttgaggg

SEQ ID NO: 4000 - DNA, 40 bp, Artificial Sequence
  Synthetic
gacttgcttccgggctaggcacaagcggtaatgcagttga

SEQ ID NO: 4001 - DNA, 39 bp, Artificial Sequence
  Synthetic
ggatttaacacggacgcggaaaccgattacgtggggttt

SEQ ID NO: 4002 - DNA, 38 bp, Artificial Sequence
  Synthetic
cttcgtttgggtcgttctcccccacacttcaggaccta

SEQ ID NO: 4003 - DNA, 40 bp, Artificial Sequence
  Synthetic
ggtctgttcccggtgatattgattggacaatcctgaggtg

SEQ ID NO: 4004 - DNA, 40 bp, Artificial Sequence
  Synthetic
cccacgtcctgcaacaaatcctggttagaccgagtggcga

SEQ ID NO: 4005 - DNA, 40 bp, Artificial Sequence
  Synthetic
gtctccaaaacccggagcacgggaatttaacaagacacgc

SEQ ID NO: 4006 - DNA, 39 bp, Artificial Sequence
  Synthetic
tctgtccccgctgcctcatcgcaggggctacattctgga

SEQ ID NO: 4007 - DNA, 38 bp, Artificial Sequence
  Synthetic
cttgcaatctgggcgcagggacgaggattgggaggagg

SEQ ID NO: 4008 - DNA, 40 bp, Artificial Sequence
  Synthetic
cggtacagactcccaggtagcatggaagacccaagagcga

SEQ ID NO: 4009 - DNA, 41 bp, Artificial Sequence
  Synthetic
gatgccgttcaggttcaccctgtgcaactttagccagacca

SEQ ID NO: 4010 - DNA, 35 bp, Artificial Sequence
  Synthetic
tgctggaagcactgggcgcgggatgggccggagtt

SEQ ID NO: 4011 - DNA, 38 bp, Artificial Sequence
  Synthetic
cacctctaccgggtcctggatggtccacctctcccgat

SEQ ID NO: 4012 - DNA, 40 bp, Artificial Sequence
  Synthetic
tgcacaacatgaacccccggggcctggatcttaaggttgg

SEQ ID NO: 4013 - DNA, 36 bp, Artificial Sequence
  Synthetic
aaccgggtgcggcaagtccggggtgatgagctgcga

SEQ ID NO: 4014 - DNA, 38 bp, Artificial Sequence
  Synthetic
ccccgaaacgaggaagtctgcttccaggcggtcccaga

SEQ ID NO: 4015 - DNA, 38 bp, Artificial Sequence
  Synthetic
ctgtacgccctgcaatccctccggagcttgcccttgga

SEQ ID NO: 4016 - DNA, 38 bp, Artificial Sequence
  Synthetic
gccttcgtctcagagtggtccgtgtcctgcaggggcgt

SEQ ID NO: 4017 - DNA, 39 bp, Artificial Sequence
  Synthetic
tgacaacctgagtgccgaggtccagctgttggggtaggt

SEQ ID NO: 4018 - DNA, 37 bp, Artificial Sequence
  Synthetic
cgcgtcaggattgtgcccgcgcaacgcacttccattc

SEQ ID NO: 4019 - DNA, 39 bp, Artificial Sequence
  Synthetic
tacgtgcgcgccagcatcctacacatagatgggctccga

SEQ ID NO: 4020 - DNA, 40 bp, Artificial Sequence
  Synthetic
cgctcaagcttacgccctccatggttaacggccttgtagg

SEQ ID NO: 4021 - DNA, 40 bp, Artificial Sequence
  Synthetic
cgcccgcgattcatggaactatctgggcggctaggacaat

SEQ ID NO: 4022 - DNA, 35 bp, Artificial Sequence
  Synthetic
ccccaagctggtcgccctttcccagcgatcccagc

SEQ ID NO: 4023 - DNA, 38 bp, Artificial Sequence
  Synthetic
cgccactcctgaagttcctcctcgctgcacgggctgta

SEQ ID NO: 4024 - DNA, 36 bp, Artificial Sequence
  Synthetic
gttcaaagtcacggggcccggacgcggcggttgaca

SEQ ID NO: 4025 - DNA, 35 bp, Artificial Sequence
  Synthetic
cgccgtctttacgcggcactccccgtcaacgtcgc

SEQ ID NO: 4026 - DNA, 38 bp, Artificial Sequence
  Synthetic
ccaccgcccccagaggaaattcgcgctcaaaatccccg

SEQ ID NO: 4027 - DNA, 39 bp, Artificial Sequence
  Synthetic
cggtcgatcttgacgcgcttaggcgctaacgatgcatct

SEQ ID NO: 4028 - DNA, 38 bp, Artificial Sequence
  Synthetic
gctcaggggcgttggggttatgtcatcatttgcggcgg

SEQ ID NO: 4029 - DNA, 36 bp, Artificial Sequence
  Synthetic
atgctcgaggacctggcccactaggaagtgcggcgg

SEQ ID NO: 4030 - DNA, 37 bp, Artificial Sequence
  Synthetic
ctcgaaccggggtacacgccttcctccgtagcctggc

SEQ ID NO: 4031 - DNA, 37 bp, Artificial Sequence
  Synthetic
aaaagggggctcgctcgccagcattgccagggttacg

SEQ ID NO: 4032 - DNA, 40 bp, Artificial Sequence
  Synthetic
ggtgcgcacgtggttgttgaaaggcctacgagcagacggt

SEQ ID NO: 4033 - DNA, 42 bp, Artificial Sequence
  Synthetic
gggcacgtacggcgtcttgtaagcgatcaactactcagtgct

SEQ ID NO: 4034 - DNA, 38 bp, Artificial Sequence
  Synthetic
gggcttgctgctgggacatctaaggatgcacccgctgc

SEQ ID NO: 4035 - DNA, 35 bp, Artificial Sequence
  Synthetic
gctgttgtagcggcccacgaggccatccgtcccga

SEQ ID NO: 4036 - DNA, 42 bp, Artificial Sequence
  Synthetic
cccgcgtaggttcttgaaagcctttttccagacaagccggca

SEQ ID NO: 4037 - DNA, 41 bp, Artificial Sequence
  Synthetic
cgtactgcggcggaattttctgacgacaccgacagtttgag

SEQ ID NO: 4038 - DNA, 37 bp, Artificial Sequence
  Synthetic
cgggagccaatgcgggttcaagcgcggcgtccatgaa

SEQ ID NO: 4039 - DNA, 42 bp, Artificial Sequence
  Synthetic
agcgtaggtcttccagcggtttgaacgccatggccaataacg

SEQ ID NO: 4040 - DNA, 41 bp, Artificial Sequence
  Synthetic
catcacgctctcgtacgagggccttgttagagatgaggcgc

SEQ ID NO: 4041 - DNA, 41 bp, Artificial Sequence
  Synthetic
ggtcccagcccagcttgaaattaagtggggcgtcaaaatgg

SEQ ID NO: 4042 - DNA, 45 bp, Artificial Sequence
  Synthetic
aggagcattaactttagcagcatttcaagtacttggaaagcaaga

SEQ ID NO: 4043 - DNA, 41 bp, Artificial Sequence
  Synthetic
gctgggtggagcgaaaggtgagcaagtttactggtcgctgc

SEQ ID NO: 4044 - DNA, 40 bp, Artificial Sequence
  Synthetic
tgcccagggccttgtagacgcgagtgaccgttactgacgc

SEQ ID NO: 4045 - DNA, 38 bp, Artificial Sequence
  Synthetic
gcgtcagcgactacggagtcaagcttacaagcgcgggc

SEQ ID NO: 4046 - DNA, 35 bp, Artificial Sequence
  Synthetic
tttccgcgcctgggtctggcagacgagcggccgtt

SEQ ID NO: 4047 - DNA, 36 bp, Artificial Sequence
  Synthetic
caacacgcgctgcaccctgtgtgcgcgagtttgctc

SEQ ID NO: 4048 - DNA, 38 bp, Artificial Sequence
  Synthetic
ggtgtccagcacgtcctcctacccgaccatgcagatca

SEQ ID NO: 4049 - DNA, 35 bp, Artificial Sequence
  Synthetic
aggctcggtggccgtggatgtgcagaccgacccct

SEQ ID NO: 4050 - DNA, 41 bp, Artificial Sequence
  Synthetic
cggcgggatcttcctcggtaatactgttgcagagagatggc

SEQ ID NO: 4051 - DNA, 41 bp, Artificial Sequence
  Synthetic
cgttccaggtgcccatgaacgcatcaattttgcgtccctgg

SEQ ID NO: 4052 - DNA, 38 bp, Artificial Sequence
  Synthetic
gcatcttccatctccaccaccgccgtgcagcgcgagat

SEQ ID NO: 4053 - DNA, 35 bp, Artificial Sequence
  Synthetic
tgccagttctgggcctggccagctccggtcgtgca

SEQ ID NO: 4054 - DNA, 38 bp, Artificial Sequence
  Synthetic
ggagccaccgtggggtttctaaccgggtctggtgcagt

SEQ ID NO: 4055 - DNA, 44 bp, Artificial Sequence
  Synthetic
aattgttatgtcagcgcctccccaaaacaaactaatgctggaaa

SEQ ID NO: 4056 - DNA, 43 bp, Artificial Sequence
  Synthetic
acccagagaatctagcaaaagcttgtggttgacttacaagaca

SEQ ID NO: 4057 - DNA, 38 bp, Artificial Sequence
  Synthetic
tggtgttggtgggcagtgtgttgtacctgcccgactcc

SEQ ID NO: 4058 - DNA, 40 bp, Artificial Sequence
  Synthetic
gttgcccagggaactctgcacacctacgagtggaacttcc

SEQ ID NO: 4059 - DNA, 41 bp, Artificial Sequence
  Synthetic
acgctgcgcttaatctcgaactgttcgactcctcggttagc

SEQ ID NO: 4060 - DNA, 35 bp, Artificial Sequence
  Synthetic
cctggcgcatggtaggtgcccctgcccttccagca

SEQ ID NO: 4061 - DNA, 40 bp, Artificial Sequence
  Synthetic
gtagacggcctcgatgacgctgaagttttcgacgtggtca

SEQ ID NO: 4062 - DNA, 35 bp, Artificial Sequence
  Synthetic
tctgcttaagccggcggtcgctcgcgcacctgcta

SEQ ID NO: 4063 - DNA, 40 bp, Artificial Sequence
  Synthetic
gcacctgtggcgattgtagcatgggaaccccaccatgaac

SEQ ID NO: 4064 - DNA, 41 bp, Artificial Sequence
  Synthetic
ccccgagattgctgttcccaaatgcggtactggtacttggg

SEQ ID NO: 4065 - DNA, 39 bp, Artificial Sequence
  Synthetic
tacccgaatatgcagcgcggctgtggggcttgtggttac

SEQ ID NO: 4066 - DNA, 37 bp, Artificial Sequence
  Synthetic
gctcaagtgtctgcacgggacgcgctgaccgttctcg

SEQ ID NO: 4067 - DNA, 40 bp, Artificial Sequence
  Synthetic
tgctgatggaacgctaccgctttggaagatctcggtctgc

SEQ ID NO: 4068 - DNA, 42 bp, Artificial Sequence
  Synthetic
cgaggaggacgtggttccactgtgtttggtctttctgggctg

SEQ ID NO: 4069 - DNA, 42 bp, Artificial Sequence
  Synthetic
tcctgtgggggttctagacgaggcaacccaaaatcaagcagg

SEQ ID NO: 4070 - DNA, 39 bp, Artificial Sequence
  Synthetic
tcgacgctgcgcttaagcacgttacactagcgccctggt

SEQ ID NO: 4071 - DNA, 40 bp, Artificial Sequence
  Synthetic
tgtagtgcagggtctcctcgacttggaatgtatgcgccgc

SEQ ID NO: 4072 - DNA, 41 bp, Artificial Sequence
  Synthetic
gcccgtccacaacgttttaagggacgagaacctgaaggagc

SEQ ID NO: 4073 - DNA, 38 bp, Artificial Sequence
  Synthetic
actcaagcagcccctcgccagctggccaactacattgc

SEQ ID NO: 4074 - DNA, 41 bp, Artificial Sequence
  Synthetic
gatcgtgccctgggtgatgactctttgaggaccaattgcgc

SEQ ID NO: 4075 - DNA, 37 bp, Artificial Sequence
  Synthetic
acgaggaggcttgaccggaggcaggcaacagagcagc

SEQ ID NO: 4076 - DNA, 40 bp, Artificial Sequence
  Synthetic
gctgacctcgactctgctgaaacttgaccaccagggagct

SEQ ID NO: 4077 - DNA, 42 bp, Artificial Sequence
  Synthetic
gccagctggacacctgagttagactaccgtactacttccgcg

SEQ ID NO: 4078 - DNA, 40 bp, Artificial Sequence
  Synthetic
ggcctggggagcctgaaaagcagttcgtggaggagtttgt

SEQ ID NO: 4079 - DNA, 43 bp, Artificial Sequence
  Synthetic
tccagagtagagtcttatttcagctcccgaagttgcatgagaa

SEQ ID NO: 4080 - DNA, 47 bp, Artificial Sequence
  Synthetic
caccagggaaaggataattagcaaatatctgctgggttagatattgc

SEQ ID NO: 4081 - DNA, 43 bp, Artificial Sequence
  Synthetic
acctgacataaagcaggccataatctaccaaggagaacatggt

SEQ ID NO: 4082 - DNA, 44 bp, Artificial Sequence
  Synthetic
agctatgcttgatttgtgggtttccagttacatggtatgatgga

SEQ ID NO: 4083 - DNA, 45 bp, Artificial Sequence
  Synthetic
ctttgagcagtattaccttgtccaagtgtcagtcaaaaccttgtt

SEQ ID NO: 4084 - DNA, 47 bp, Artificial Sequence
  Synthetic
gaggttctttggtatgtggcttaatgataaggcaaatcgttacagaa

SEQ ID NO: 4085 - DNA, 49 bp, Artificial Sequence
  Synthetic
acaaagtacaaaagaaccacgagaactcaggtttgcatattcaaattac

SEQ ID NO: 4086 - DNA, 39 bp, Artificial Sequence
  Synthetic
gcagacaatgctgcagacgcagccattccccacctacct

SEQ ID NO: 4087 - DNA, 48 bp, Artificial Sequence
  Synthetic
cgagatcaaaacaggggtagatcatttcctattacttggtaattgtgg

SEQ ID NO: 4088 - DNA, 41 bp, Artificial Sequence
  Synthetic
cccgtctgctgggtgatgactaccccagcagaagcaaaagt

SEQ ID NO: 4089 - DNA, 38 bp, Artificial Sequence
  Synthetic
tgagtgacagaaccccagggcttccttactcccccctt

SEQ ID NO: 4090 - DNA, 49 bp, Artificial Sequence
  Synthetic
aaatgctaccaagtctccattatcaggtggaaatatatgtgttagagtt

SEQ ID NO: 4091 - DNA, 46 bp, Artificial Sequence
  Synthetic
gccaaggtagatgtttccataaacttttggtagcctatccaaaacc

SEQ ID NO: 4092 - DNA, 40 bp, Artificial Sequence
  Synthetic
aaggccacccgtactgagagacacattctcccaccaccag

SEQ ID NO: 4093 - DNA, 44 bp, Artificial Sequence
  Synthetic
tgggctgctgaataacataatgattgcaccgcattctaatttcg

SEQ ID NO: 4094 - DNA, 43 bp, Artificial Sequence
  Synthetic
cctgggatatgatcctgaccacaaggcacactgacatacatct

SEQ ID NO: 4095 - DNA, 41 bp, Artificial Sequence
  Synthetic
ggcagcattaactggatggggatgcgaattcccctcaacac

SEQ ID NO: 4096 - DNA, 45 bp, Artificial Sequence
  Synthetic
tggacttacaccaacaatttgtagacatcatgttacattcctgca

SEQ ID NO: 4097 - DNA, 44 bp, Artificial Sequence
  Synthetic
cctggctttatcacttacattttggctgcatgctggaataagct

SEQ ID NO: 4098 - DNA, 40 bp, Artificial Sequence
  Synthetic
ccgatgtgatttttgccggaagtccgtgtgattaaagagc

SEQ ID NO: 4099 - DNA, 42 bp, Artificial Sequence
  Synthetic
cgtcagtgtaagttgcctttaagtcagtacaagcgccaacag

SEQ ID NO: 4100 - DNA, 39 bp, Artificial Sequence
  Synthetic
gatgctctcacttctcctggattataatggccgggctac

SEQ ID NO: 4101 - DNA, 43 bp, Artificial Sequence
  Synthetic
caggatatccatatgtctgaagcaaccattgttccaagggcaa

SEQ ID NO: 4102 - DNA, 40 bp, Artificial Sequence
  Synthetic
agctccacagtgctggatagatactcagagacccagttca

SEQ ID NO: 4103 - DNA, 46 bp, Artificial Sequence
  Synthetic
ccagttcttgttgtcccgatcttgatcatacagacataacatttgg

SEQ ID NO: 4104 - DNA, 42 bp, Artificial Sequence
  Synthetic
cattctcatagtcagcatcactgcggccgacagaaaacagag

SEQ ID NO: 4105 - DNA, 41 bp, Artificial Sequence
  Synthetic
cttctccaatttctgtgggctttctcagatgtcatcggact

SEQ ID NO: 4106 - DNA, 45 bp, Artificial Sequence
  Synthetic
gttgatcaaggattctagcatgtgtggagtggaatctctaggaga

SEQ ID NO: 4107 - DNA, 49 bp, Artificial Sequence
  Synthetic
cttgggttggtaatgacatcagttagagggtagaacaaataataatgga

SEQ ID NO: 4108 - DNA, 41 bp, Artificial Sequence
  Synthetic
gctgctgactcttcgttctttgatcgaagaccacaacacca

SEQ ID NO: 4109 - DNA, 42 bp, Artificial Sequence
  Synthetic
tgtctttcccttttgtgaagactgcgggaaaacgggaaatcc

SEQ ID NO: 4110 - DNA, 44 bp, Artificial Sequence
  Synthetic
gagaggttctactgtcccattttcaaatggctgaaacatacagg

SEQ ID NO: 4111 - DNA, 45 bp, Artificial Sequence
  Synthetic
ggagcatggatcgaatctaccatgcattgacctcaaaataactgt

SEQ ID NO: 4112 - DNA, 48 bp, Artificial Sequence
  Synthetic
ttgagttcggtaatgcaagatctgtggaacatcactaggtacaattac

SEQ ID NO: 4113 - DNA, 46 bp, Artificial Sequence
  Synthetic
tccattaaaggatagcaaactgcttcaggcacattatccaaaactc

SEQ ID NO: 4114 - DNA, 49 bp, Artificial Sequence
  Synthetic
gctgagctttttgagactcttgtctcagttcaaataagaaaaacgtagg

SEQ ID NO: 4115 - DNA, 50 bp, Artificial Sequence
  Synthetic
gcaccaaagaatctagtttgtggatatccctgataacaataactaatgac

SEQ ID NO: 4116 - DNA, 50 bp, Artificial Sequence
  Synthetic
acctgttcagtgtaaatgatgtcatctctactctgctaatataacagaaa

SEQ ID NO: 4117 - DNA, 43 bp, Artificial Sequence
  Synthetic
gaatgtaactcctcttgagcgatctcatccacatgtacatgcg

SEQ ID NO: 4118 - DNA, 49 bp, Artificial Sequence
  Synthetic
gactggattgtctttaaccctaagtcatacaacaatcaaatctatccac

SEQ ID NO: 4119 - DNA, 42 bp, Artificial Sequence
  Synthetic
cagaaatcgtgtgggtccagagaaaacaccattgctattcac

SEQ ID NO: 4120 - DNA, 46 bp, Artificial Sequence
  Synthetic
tcctgcagctattacagaacatgggtaatttctcatacctatgaca

SEQ ID NO: 4121 - DNA, 47 bp, Artificial Sequence
  Synthetic
cgtaccctaggaaaatgagtgtattacttttgaccatcctttttctg

SEQ ID NO: 4122 - DNA, 46 bp, Artificial Sequence
  Synthetic
agtgccaacctgaagatctagtagaaggtaggctacttaaactagg

SEQ ID NO: 4123 - DNA, 41 bp, Artificial Sequence
  Synthetic
tggtgggattaacacgtgatgtccactatctcctgatgcag

SEQ ID NO: 4124 - DNA, 44 bp, Artificial Sequence
  Synthetic
cggataaggttcaaaagtgtaacgacccggcagatcaaaatcag

SEQ ID NO: 4125 - DNA, 45 bp, Artificial Sequence
  Synthetic
cgagtcgtccagctgaagacgtattaatgtattgtgatgttgtcg

SEQ ID NO: 4126 - DNA, 44 bp, Artificial Sequence
  Synthetic
cccattttcactgaataactcacctaagatgagagcagtccagg

SEQ ID NO: 4127 - DNA, 45 bp, Artificial Sequence
  Synthetic
tgctatagcttgattgtctccttgttcttgcagctgttaaagttg

SEQ ID NO: 4128 - DNA, 48 bp, Artificial Sequence
  Synthetic
gctgtagacatatagttgaaccctcaagggaaaaattggttaagatgt

SEQ ID NO: 4129 - DNA, 50 bp, Artificial Sequence
  Synthetic
gtggattggtcttccataagttagagagtatatgtgttcagtagaattgg

SEQ ID NO: 4130 - DNA, 44 bp, Artificial Sequence
  Synthetic
ttctctaaacttaagttagccctgggggcttatggaactgatga

SEQ ID NO: 4131 - DNA, 41 bp, Artificial Sequence
  Synthetic
tccctctgacgtttaacccgttcgggggtattctaatcaat

SEQ ID NO: 4132 - DNA, 44 bp, Artificial Sequence
  Synthetic
agcatactatcggcatcaggatctgagagtaagaggtataggga

SEQ ID NO: 4133 - DNA, 47 bp, Artificial Sequence
  Synthetic
ggtaagttccaatgctttcaaacaattatcacaccaattgagacttt

SEQ ID NO: 4134 - DNA, 42 bp, Artificial Sequence
  Synthetic
aggatctccagtataagggaatgtggatgtcaatccgacctt

SEQ ID NO: 4135 - DNA, 45 bp, Artificial Sequence
  Synthetic
gtttgtccactcttgtttgttgaatatcacacccaggaatctttg

SEQ ID NO: 4136 - DNA, 47 bp, Artificial Sequence
  Synthetic
tggtcatgttgtctcttactcttctggatgtgatagaatcaatggat

SEQ ID NO: 4137 - DNA, 46 bp, Artificial Sequence
  Synthetic
ccttcttttcattacctccaaccgacactagcgagaaatatttgtg

SEQ ID NO: 4138 - DNA, 42 bp, Artificial Sequence
  Synthetic
tcgaacatgtaacctttccctagtctgagcattgcacccata

SEQ ID NO: 4139 - DNA, 41 bp, Artificial Sequence
  Synthetic
agtccgtcccaccagtatgttcttaggagtctcaatcctga

SEQ ID NO: 4140 - DNA, 46 bp, Artificial Sequence
  Synthetic
agccgattcattaattccagacacgatttgtagccaattttagcat

SEQ ID NO: 4141 - DNA, 40 bp, Artificial Sequence
  Synthetic
gcctcccctgatagtcttcattctccacattccagaagtc

SEQ ID NO: 4142 - DNA, 46 bp, Artificial Sequence
  Synthetic
actgctagggaagaatttctcaaatgggaattcttgaagatgaaca

SEQ ID NO: 4143 - DNA, 43 bp, Artificial Sequence
  Synthetic
tgcagagcaggaaaatattagttgggtagggtcagcaaagcac

SEQ ID NO: 4144 - DNA, 40 bp, Artificial Sequence
  Synthetic
ccgtcctgttgtctgttccacaaaaagtgagggagctgcg

SEQ ID NO: 4145 - DNA, 42 bp, Artificial Sequence
  Synthetic
acgcacactatcctcctcctctggtggttgacctacattgca

SEQ ID NO: 4146 - DNA, 49 bp, Artificial Sequence
  Synthetic
gctagtccaaataggtccttgaattagacatattagaggtgtttaaggt

SEQ ID NO: 4147 - DNA, 44 bp, Artificial Sequence
  Synthetic
ggtatgtttaacagttttcccatgctgtgcgatacaaatgtggg

SEQ ID NO: 4148 - DNA, 42 bp, Artificial Sequence
  Synthetic
cctcatttcccagcaatgcatattgggcatatgacaatgaca

SEQ ID NO: 4149 - DNA, 42 bp, Artificial Sequence
  Synthetic
gcaaaatagcgacttccctgtgggtaccaaaaaaaagctgca

SEQ ID NO: 4150 - DNA, 42 bp, Artificial Sequence
  Synthetic
ggtctagtaatttctcctggcacgaggaggaggaggatgagg

SEQ ID NO: 4151 - DNA, 40 bp, Artificial Sequence
  Synthetic
tttccaaagaggtggtttgcaaagggttacaaacaagtgc

SEQ ID NO: 4152 - DNA, 46 bp, Artificial Sequence
  Synthetic
gcacaacaatcctacatatatggcagctttcctatctttcctcact

SEQ ID NO: 4153 - DNA, 39 bp, Artificial Sequence
  Synthetic
tacagtaggaggccgggtgcgggggattgggtataggca

SEQ ID NO: 4154 - DNA, 40 bp, Artificial Sequence
  Synthetic
cccctgcctgaggaggttcaatgggtctgtgcaggttagc

SEQ ID NO: 4155 - DNA, 41 bp, Artificial Sequence
  Synthetic
ggcaccaaaggctgtaactccagcgctcgggtacactttta

SEQ ID NO: 4156 - DNA, 45 bp, Artificial Sequence
  Synthetic
gcaacaaataaaaatcagagccctggtaccagctgtaccatatgt

SEQ ID NO: 4157 - DNA, 39 bp, Artificial Sequence
  Synthetic
gtgtttttcttgccctgcagccagttcccgtctgcttac

SEQ ID NO: 4158 - DNA, 47 bp, Artificial Sequence
  Synthetic
agcagccatttgtaaataatcaggaaataaatctgaagtgccattgg

SEQ ID NO: 4159 - DNA, 46 bp, Artificial Sequence
  Synthetic
ataccattgttgtggccctggctgattcccaattatttaataagcc

SEQ ID NO: 4160 - DNA, 44 bp, Artificial Sequence
  Synthetic
ggactgcaaaaacctatatgtgtctttgttggatgactggaact

SEQ ID NO: 4161 - DNA, 43 bp, Artificial Sequence
  Synthetic
acatgcacaacaacagcatacagtgctacaaaacgcaaaaagc

SEQ ID NO: 4162 - DNA, 42 bp, Artificial Sequence
  Synthetic
acagaaatggggaagctgcacatgcaccctgtgagtaagtgt

SEQ ID NO: 4163 - DNA, 43 bp, Artificial Sequence
  Synthetic
cacagtaattgcacaacatgtcaaagggtgtgtttgacaggtt

SEQ ID NO: 4164 - DNA, 44 bp, Artificial Sequence
  Synthetic
gctgttatattgcgggcataagtttggagaaacagtggaattac

SEQ ID NO: 4165 - DNA, 43 bp, Artificial Sequence
  Synthetic
tctgtatagtttgagcgttgaaagagacgtttgcatccaacac

SEQ ID NO: 4166 - DNA, 38 bp, Artificial Sequence
  Synthetic
ggacatgggctgccagaccgggacggtccagtacttcc

SEQ ID NO: 4167 - DNA, 37 bp, Artificial Sequence
  Synthetic
acgggattggtcggccgaaccggcccgtcaatcaaag

SEQ ID NO: 4168 - DNA, 41 bp, Artificial Sequence
  Synthetic
taagcaaaggggggatgggttttaccgagtaaaaggttcca

SEQ ID NO: 4169 - DNA, 39 bp, Artificial Sequence
  Synthetic
tatcccgcatgtaagctggctgattctggtctcacctgt

SEQ ID NO: 4170 - DNA, 36 bp, Artificial Sequence
  Synthetic
tacaccatgcgcggcggtcgcggttcgatgtagggt

SEQ ID NO: 4171 - DNA, 39 bp, Artificial Sequence
  Synthetic
tacgtgcaggcgccacacgcatgtggctgagcaaaaagg

SEQ ID NO: 4172 - DNA, 38 bp, Artificial Sequence
  Synthetic
gctggacacgcccatctcctcaggttcctgcggaggtg

SEQ ID NO: 4173 - DNA, 38 bp, Artificial Sequence
  Synthetic
gcagcacgcaaaagagcaggttacttgaggagccggcg

SEQ ID NO: 4174 - DNA, 35 bp, Artificial Sequence
  Synthetic
ccccattgacgcgtctgccccccttccgcctccaa

SEQ ID NO: 4175 - DNA, 39 bp, Artificial Sequence
  Synthetic
ccgaacagaagatgggacgccgtcgtcacgctccacaac

SEQ ID NO: 4176 - DNA, 40 bp, Artificial Sequence
  Synthetic
accgcatctcttggcgtttaccgtcctcgaattcgtggcc

SEQ ID NO: 4177 - DNA, 40 bp, Artificial Sequence
  Synthetic
acaggcaaaacacgccgtggcggtgcgaaatgaagagtgt

SEQ ID NO: 4178 - DNA, 38 bp, Artificial Sequence
  Synthetic
cgcgcttcagtgcaccgttgagaagcagtttcaggacg

SEQ ID NO: 4179 - DNA, 42 bp, Artificial Sequence
  Synthetic
cactgataacatgtaactccgccttatcaggtacgtgctgtt

SEQ ID NO: 4180 - DNA, 38 bp, Artificial Sequence
  Synthetic
ggtcacgggcgtgttcagtaatcgatggagcgcatgcc

SEQ ID NO: 4181 - DNA, 38 bp, Artificial Sequence
  Synthetic
cctgccgttgttctttgcggcccgttgcagtgattcgg

SEQ ID NO: 4182 - DNA, 36 bp, Artificial Sequence
  Synthetic
tttgtgggagcgtccggccgtcccgttgtgcgttgt

SEQ ID NO: 4183 - DNA, 38 bp, Artificial Sequence
  Synthetic
cggcaccgttgtcgcagtacagacggtgtcagtcaagg

SEQ ID NO: 4184 - DNA, 39 bp, Artificial Sequence
  Synthetic
ggcttctggttgggcgagcccaacagtagtccctctgcc

SEQ ID NO: 4185 - DNA, 41 bp, Artificial Sequence
  Synthetic
ccccgtgttgttctgccgtattcgtcctccccctgaaaagc

SEQ ID NO: 4186 - DNA, 37 bp, Artificial Sequence
  Synthetic
gcccgggtatgcgaaaccatcgtagctggcggttctg

SEQ ID NO: 4187 - DNA, 35 bp, Artificial Sequence
  Synthetic
tgcacctctggcgccacagagccacgcgctagcac

SEQ ID NO: 4188 - DNA, 39 bp, Artificial Sequence
  Synthetic
tcagggcgcgtctggtctcaaaggggatcaaattggccc

SEQ ID NO: 4189 - DNA, 40 bp, Artificial Sequence
  Synthetic
gtgaatgagggcgcatctacctcgaggcctgcgtaacttg

SEQ ID NO: 4190 - DNA, 38 bp, Artificial Sequence
  Synthetic
acgcctctgaggacgctgcctgtccttagttggcgccg

SEQ ID NO: 4191 - DNA, 39 bp, Artificial Sequence
  Synthetic
ggccaccgcgtccttcatttccggcggtaacaaaggacg

SEQ ID NO: 4192 - DNA, 40 bp, Artificial Sequence
  Synthetic
cctgttggacgatctcgcacatgacgcaaagacgctcctg

SEQ ID NO: 4193 - DNA, 41 bp, Artificial Sequence
  Synthetic
ggcgatgtgctgggggtgatacagagagcctagaatcacgc

SEQ ID NO: 4194 - DNA, 40 bp, Artificial Sequence
  Synthetic
cgcgtgaggtgaggtggacatccccacacgccatagacat

SEQ ID NO: 4195 - DNA, 39 bp, Artificial Sequence
  Synthetic
ttggggtaacggcgggcacctttccacacgcaatgaagc

SEQ ID NO: 4196 - DNA, 38 bp, Artificial Sequence
  Synthetic
tgcgagcaggagggacctttgtatgccagaagcctcct

SEQ ID NO: 4197 - DNA, 36 bp, Artificial Sequence
  Synthetic
tccctgggcaggcggaatagcgctgtgcgccctcaa

SEQ ID NO: 4198 - DNA, 38 bp, Artificial Sequence
  Synthetic
gcagcagcaggatgagcagcatgctgctcctgctcctc

SEQ ID NO: 4199 - DNA, 40 bp, Artificial Sequence
  Synthetic
gcactcttaccccccgtaaccacggagacacaggatggga

SEQ ID NO: 4200 - DNA, 35 bp, Artificial Sequence
  Synthetic
tgtcagaggtgctgcgggcacggtgcccagtgggt

SEQ ID NO: 4201 - DNA, 41 bp, Artificial Sequence
  Synthetic
ccccggacgtaaaggtcgaaggagacagctctgattcacgg

SEQ ID NO: 4202 - DNA, 36 bp, Artificial Sequence
  Synthetic
ttctgccgggagctgggagaagcgtcggagagctgg

SEQ ID NO: 4203 - DNA, 37 bp, Artificial Sequence
  Synthetic
catgctggccgagagggtggggacggagtgatggcct

SEQ ID NO: 4204 - DNA, 41 bp, Artificial Sequence
  Synthetic
gcgcatcttggagaccctgaagagtccggagaagatagggc

SEQ ID NO: 4205 - DNA, 43 bp, Artificial Sequence
  Synthetic
ccaaaccatactctttgcaaagcaagcagggatgtctgaggag

SEQ ID NO: 4206 - DNA, 38 bp, Artificial Sequence
  Synthetic
ccgcactcaaccaccagcccggggtggtaactacctgc

SEQ ID NO: 4207 - DNA, 40 bp, Artificial Sequence
  Synthetic
tcccccgttacctcctctggcagacagtgggtatggcaat

SEQ ID NO: 4208 - DNA, 41 bp, Artificial Sequence
  Synthetic
catggccgtcttgtaccagtcatagaaccaccaaaactgag

SEQ ID NO: 4209 - DNA, 47 bp, Artificial Sequence
  Synthetic
cgccttttaggaacaatttaaaggctcaggtttctaagacatcaagg

SEQ ID NO: 4210 - DNA, 45 bp, Artificial Sequence
  Synthetic
gttgttatcattaggggtggacactagtgagcatagacagaaagc

SEQ ID NO: 4211 - DNA, 39 bp, Artificial Sequence
  Synthetic
gagggcaggcacagctgtactgctgtttaaggcccgaga

SEQ ID NO: 4212 - DNA, 39 bp, Artificial Sequence
  Synthetic
ttcgtcgtccgaggcgctgtggctgggactgttattcac

SEQ ID NO: 4213 - DNA, 43 bp, Artificial Sequence
  Synthetic
cccttaggtatactgactcttgtcagcctttgtaacactgtgg

SEQ ID NO: 4214 - DNA, 44 bp, Artificial Sequence
  Synthetic
acaaacggacataaaacatcaacaatggggtcatgatgatgttc

SEQ ID NO: 4215 - DNA, 40 bp, Artificial Sequence
  Synthetic
gggtctgtaacggtggaggttgcaggagcgtcacatccca

SEQ ID NO: 4216 - DNA, 41 bp, Artificial Sequence
  Synthetic
gcaatggctgaaggacatccgagttgcccccagcttctact

SEQ ID NO: 4217 - DNA, 42 bp, Artificial Sequence
  Synthetic
ccgtactgatcacctttgaaacaggtggcggcctaatgaaag

SEQ ID NO: 4218 - DNA, 41 bp, Artificial Sequence
  Synthetic
gacttatttgactgcagagtggcgaggacggggatatggtt

SEQ ID NO: 4219 - DNA, 45 bp, Artificial Sequence
  Synthetic
gggttatcttgcacagttggaagggaatatctcaggcatatggag

SEQ ID NO: 4220 - DNA, 47 bp, Artificial Sequence
  Synthetic
acagttacagaacacacaacacatgacatgtatggtatgtatcccct

SEQ ID NO: 4221 - DNA, 43 bp, Artificial Sequence
  Synthetic
ttgctttcttgcagcagctgaaacttactagatgatagcgatg

SEQ ID NO: 4222 - DNA, 44 bp, Artificial Sequence
  Synthetic
ggcaatctggagagacagactcacagtggaatagaaaatgaagc

SEQ ID NO: 4223 - DNA, 50 bp, Artificial Sequence
  Synthetic
tctgtagcatcatctataagcccaaggtttctcatatgaattcaaaaagc

SEQ ID NO: 4224 - DNA, 44 bp, Artificial Sequence
  Synthetic
ggaacatgctgcaggcctagtcatgagaaaagaaggaatactgt

SEQ ID NO: 4225 - DNA, 42 bp, Artificial Sequence
  Synthetic
ggtttctccggtttgtgcaaccatcagctcttcctaccccac

SEQ ID NO: 4226 - DNA, 48 bp, Artificial Sequence
  Synthetic
ggccaccaaagtatactaaactactaataaagtagaggaaacaacact

SEQ ID NO: 4227 - DNA, 44 bp, Artificial Sequence
  Synthetic
gttctgtagttatgtcaaagcctgtggtcactcctgaagtagtg

SEQ ID NO: 4228 - DNA, 39 bp, Artificial Sequence
  Synthetic
aggatctggagcagcagttggaaaatcccgcctttacca

SEQ ID NO: 4229 - DNA, 41 bp, Artificial Sequence
  Synthetic
tgagggtgagacacaaagagtctggtgtggctcttagagtg

SEQ ID NO: 4230 - DNA, 44 bp, Artificial Sequence
  Synthetic
gccgtggaagtatatttctgtttctatcttccaccttccagacc

SEQ ID NO: 4231 - DNA, 46 bp, Artificial Sequence
  Synthetic
cgtttaacttatttagcaaggggtggaaactgaaaggtattgaggt

SEQ ID NO: 4232 - DNA, 44 bp, Artificial Sequence
  Synthetic
cccaaatccaatatcacacatgtctctgcccacctcttgaatta

SEQ ID NO: 4233 - DNA, 43 bp, Artificial Sequence
  Synthetic
gcctgagtaccttgaccagggggttgtaggtgaaaatattcct

SEQ ID NO: 4234 - DNA, 43 bp, Artificial Sequence
  Synthetic
tctgatagatccacatcccaaaagtccacacgttgtcctgatc

SEQ ID NO: 4235 - DNA, 44 bp, Artificial Sequence
  Synthetic
cgtgttgagacagcaccatttactgtgaatttaatgtgaaatgc

SEQ ID NO: 4236 - DNA, 48 bp, Artificial Sequence
  Synthetic
gcttcccttgagcaatcaaatcaaattgcaagaaattgatattcgttg

SEQ ID NO: 4237 - DNA, 47 bp, Artificial Sequence
  Synthetic
ctgaaatgttggacccatcagtacgtgagaatgagcatgatactttg

SEQ ID NO: 4238 - DNA, 48 bp, Artificial Sequence
  Synthetic
cctgttcagaagaatttgcagtttcattgaaaagacgattgttgtttc

SEQ ID NO: 4239 - DNA, 48 bp, Artificial Sequence
  Synthetic
gatgttgcactttggtgattcactaacaaatgcctcttatatgtatgg

SEQ ID NO: 4240 - DNA, 39 bp, Artificial Sequence
  Synthetic
gcgtcacctcctcgctttctcgacgacgacgacgaagag

SEQ ID NO: 4241 - DNA, 50 bp, Artificial Sequence
  Synthetic
ggcaatgtggtagtgactaaaaacagaacataaagaatctagtagcaagc

SEQ ID NO: 4242 - DNA, 50 bp, Artificial Sequence
  Synthetic
ccaaaatagaccacacttccaaacaaataaagtagaaggtaatacatggg

SEQ ID NO: 4243 - DNA, 44 bp, Artificial Sequence
  Synthetic
gggggtctagcactgttactatattgttatagacacaggcacat

SEQ ID NO: 4244 - DNA, 43 bp, Artificial Sequence
  Synthetic
accaaaagactgtgcatctacaaatactgctgtgcaaactcat

SEQ ID NO: 4245 - DNA, 45 bp, Artificial Sequence
  Synthetic
ccatagtgacgtcctcctcaaattgcactttatacatctaggttt

SEQ ID NO: 4246 - DNA, 47 bp, Artificial Sequence
  Synthetic
aggttgcacaggaatataaggtgtaattaatacattaccctgtgcag

SEQ ID NO: 4247 - DNA, 50 bp, Artificial Sequence
  Synthetic
tcaaagaaaggatgtccaactgttaattgttggaactgatttatacttcc

SEQ ID NO: 4248 - DNA, 48 bp, Artificial Sequence
  Synthetic
ggattttctgtatcctgcaatttgtggtattgaaattgatagaggtgg

SEQ ID NO: 4249 - DNA, 47 bp, Artificial Sequence
  Synthetic
cgaaccactcggaattgtaaagtaatattttaatcctaatggccagg

SEQ ID NO: 4250 - DNA, 48 bp, Artificial Sequence
  Synthetic
ccacatgagtcaagtcaacatcatttattttgcatgtgaaatggaaca

SEQ ID NO: 4251 - DNA, 45 bp, Artificial Sequence
  Synthetic
cccctgatgtgagtaatagggttaatgaacaggccaaaaatgaac

SEQ ID NO: 4252 - DNA, 40 bp, Artificial Sequence
  Synthetic
ttcctttgatctctccgaacctagggctcaacctttcaga

SEQ ID NO: 4253 - DNA, 40 bp, Artificial Sequence
  Synthetic
accatcatggcatgcggatccaactgtggaaaactccatt

SEQ ID NO: 4254 - DNA, 46 bp, Artificial Sequence
  Synthetic
gctccactcttcctgttggaatgcagatttcttaaaattagagagg

SEQ ID NO: 4255 - DNA, 39 bp, Artificial Sequence
  Synthetic
tccaagccacttgtctccattccagaccggatgatggaa

SEQ ID NO: 4256 - DNA, 48 bp, Artificial Sequence
  Synthetic
caagtatcttttccaccatcgtgtataaaggacaagaaatgtgatgtc

SEQ ID NO: 4257 - DNA, 39 bp, Artificial Sequence
  Synthetic
cgcccgattgaaacttaccgtcattttggcgccaactct

SEQ ID NO: 4258 - DNA, 43 bp, Artificial Sequence
  Synthetic
ctggccaaactcttcttgtagtattggggtgtgtagacattgc

SEQ ID NO: 4259 - DNA, 43 bp, Artificial Sequence
  Synthetic
tgaggacacaagaattgcagttcctgacgctgctattagaagt

SEQ ID NO: 4260 - DNA, 46 bp, Artificial Sequence
  Synthetic
ctcaaattcctgctggcgaagtcaaatttgttaaatgatgaggagg

SEQ ID NO: 4261 - DNA, 45 bp, Artificial Sequence
  Synthetic
aggtcaaattgcatagcatctgctgattggattgtaaatcagacc

SEQ ID NO: 4262 - DNA, 46 bp, Artificial Sequence
  Synthetic
gtgtccaaagcctttcaaaaaaagaatggtacccctgtatttcaac

SEQ ID NO: 4263 - DNA, 43 bp, Artificial Sequence
  Synthetic
cggaggtacgggttgatacccaagctttattattttttgcacg

SEQ ID NO: 4264 - DNA, 49 bp, Artificial Sequence
  Synthetic
ttccatccttataatatgcacctgctttgtagactcagatgatatgtgg

SEQ ID NO: 4265 - DNA, 37 bp, Artificial Sequence
  Synthetic
ggtgtctcgtcgacggtgtcccacggggctacgagaa

SEQ ID NO: 4266 - DNA, 39 bp, Artificial Sequence
  Synthetic
ggaccctctggatcctctggaagggaagcgagcacctca

SEQ ID NO: 4267 - DNA, 43 bp, Artificial Sequence
  Synthetic
gctagcctcctccagtaaccttagagtacaaacagttagtgga

SEQ ID NO: 4268 - DNA, 44 bp, Artificial Sequence
  Synthetic
tccacctattggttgaccaccgaatctgcattaactgatcatgt

SEQ ID NO: 4269 - DNA, 43 bp, Artificial Sequence
  Synthetic
tgctacgtccctttcaaatatttgtgccctcacgtttagttcg

SEQ ID NO: 4270 - DNA, 50 bp, Artificial Sequence
  Synthetic
accagaatgttcccctaatagtgatagtgcatttttatacagatcttagc

SEQ ID NO: 4271 - DNA, 46 bp, Artificial Sequence
  Synthetic
cacagcataaccttccaaatcttgtgcgttctaccacatttactgt

SEQ ID NO: 4272 - DNA, 39 bp, Artificial Sequence
  Synthetic
tccgtgctttgtacccttgccctgcaactggtaaggtat

SEQ ID NO: 4273 - DNA, 44 bp, Artificial Sequence
  Synthetic
aacacctaaaggctggccacccagaaaaggaaagattagtatgg

SEQ ID NO: 4274 - DNA, 40 bp, Artificial Sequence
  Synthetic
gcagtattgggtatcgcatcccaatgttatgccaggcact

SEQ ID NO: 4275 - DNA, 44 bp, Artificial Sequence
  Synthetic
gctcatatggatctttcctttctggtcttacatcacaggcaaca

SEQ ID NO: 4276 - DNA, 45 bp, Artificial Sequence
  Synthetic
gctttcaatgtgatgtttttgtccaacagaaaataacagggtccc

SEQ ID NO: 4277 - DNA, 42 bp, Artificial Sequence
  Synthetic
gccccaacagtaagaatgcatttcgaaggggtcttgcaagga

SEQ ID NO: 4278 - DNA, 48 bp, Artificial Sequence
  Synthetic
agcttctcttaaaggttgagcaattagacattaaacgaaaaacagatg

SEQ ID NO: 4279 - DNA, 48 bp, Artificial Sequence
  Synthetic
cctctggagtgtcatcaatggataatacaagaaaatgtagaagacctt

SEQ ID NO: 4280 - DNA, 44 bp, Artificial Sequence
  Synthetic
gcaactgtaggttccgtagaactttgcaggtaaacgaggaatgt

SEQ ID NO: 4281 - DNA, 43 bp, Artificial Sequence
  Synthetic
gcatacttggatttagccaaactttaaaaccacgctaaaaccg

SEQ ID NO: 4282 - DNA, 44 bp, Artificial Sequence
  Synthetic
cagtccatgtaccagtttttccatattttaccgaactggatggg

SEQ ID NO: 4283 - DNA, 46 bp, Artificial Sequence
  Synthetic
agtgacgctagtgtcaagcaataagtgttattgatattcaaacgcc

SEQ ID NO: 4284 - DNA, 41 bp, Artificial Sequence
  Synthetic
agggcggagagatagaccaacagggcgcgagatttgtacaa

SEQ ID NO: 4285 - DNA, 43 bp, Artificial Sequence
  Synthetic
tgtgcttagtactttgtcagtgttacagtgacggaagacctag

SEQ ID NO: 4286 - DNA, 38 bp, Artificial Sequence
  Synthetic
cacgtacccttttgacctggccttagggcaacattggg

SEQ ID NO: 4287 - DNA, 41 bp, Artificial Sequence
  Synthetic
cagggatactgtcgccaacaaaaacgtgaacaagtctatgc

SEQ ID NO: 4288 - DNA, 42 bp, Artificial Sequence
  Synthetic
gcgtctttaggacagatagtagcttagcctttgtaccagcac

SEQ ID NO: 4289 - DNA, 41 bp, Artificial Sequence
  Synthetic
ggttacaatggtcacagcatgtggatgagctggaggaggag

SEQ ID NO: 4290 - DNA, 47 bp, Artificial Sequence
  Synthetic
tgaagagtgccagggaatttccgggtcagttatttcaaatctaatag

SEQ ID NO: 4291 - DNA, 48 bp, Artificial Sequence
  Synthetic
gcactcttctacctgtgatagttcatccaaaaaaacgtttatttgagg

SEQ ID NO: 4292 - DNA, 45 bp, Artificial Sequence
  Synthetic
gcactagccatttgatgattaacaaatttgtgtttggtcaaatgc

SEQ ID NO: 4293 - DNA, 40 bp, Artificial Sequence
  Synthetic
ccttcccacttcttcagcagacagcaagaaaacgaagagt

SEQ ID NO: 4294 - DNA, 42 bp, Artificial Sequence
  Synthetic
ccaaatggtctgtagccagtagctattttgggggtttgggaa

SEQ ID NO: 4295 - DNA, 42 bp, Artificial Sequence
  Synthetic
tcttcagcagttattgtaggccccagaaggtgttccagagac

SEQ ID NO: 4296 - DNA, 48 bp, Artificial Sequence
  Synthetic
ggcctactcaggtaattgatatctcttgttattcaatcaagaacttgc

SEQ ID NO: 4297 - DNA, 46 bp, Artificial Sequence
  Synthetic
acaaagggttttctgaatctccataagaattaggtagaggaggtcc

SEQ ID NO: 4298 - DNA, 46 bp, Artificial Sequence
  Synthetic
tgctgatctgtcttgagaaaatgttgcacacaagaattcaagatgg

SEQ ID NO: 4299 - DNA, 46 bp, Artificial Sequence
  Synthetic
tggtactttacaaagacgaaagactaagcgattttaaccagtacac

SEQ ID NO: 4300 - DNA, 45 bp, Artificial Sequence
  Synthetic
acatgagtcagtattttgcaaacacttttgccaaatgtactgtga

SEQ ID NO: 4301 - DNA, 44 bp, Artificial Sequence
  Synthetic
ccgccaaattttgagtcagtcaaacagaggcgattgttataccg

SEQ ID NO: 4302 - DNA, 46 bp, Artificial Sequence
  Synthetic
gcttttctgctgcatccaacaactttacctgaggtgattattaggt

SEQ ID NO: 4303 - DNA, 39 bp, Artificial Sequence
  Synthetic
atcgacgagctccagagtcgacttcttgtgcaaactgtg

SEQ ID NO: 4304 - DNA, 43 bp, Artificial Sequence
  Synthetic
tgagttagtgtctacctgtgtaagaggcaaaacggagactgtt

SEQ ID NO: 4305 - DNA, 49 bp, Artificial Sequence
  Synthetic
gcagctgattgatgttctaccaatataatttcatgatgggagaatttcc

SEQ ID NO: 4306 - DNA, 40 bp, Artificial Sequence
  Synthetic
tcggtgtcggtggtcccaccctagctctacaaggccaacc

SEQ ID NO: 4307 - DNA, 40 bp, Artificial Sequence
  Synthetic
ggatcccgagcttcttcttgtatagaacggttgcgagaac

SEQ ID NO: 4308 - DNA, 43 bp, Artificial Sequence
  Synthetic
ggtgtagatggtgtcaatggtctatgggcataggtactggcaa

SEQ ID NO: 4309 - DNA, 46 bp, Artificial Sequence
  Synthetic
actacagtaggtgtactttctggtaccatcagttgttagtacctct

SEQ ID NO: 4310 - DNA, 46 bp, Artificial Sequence
  Synthetic
cttgtttttggtgggttaatagagctatagggggacaatatgagga

SEQ ID NO: 4311 - DNA, 48 bp, Artificial Sequence
  Synthetic
gtttgtttgggatcaaaagacacattaacaaatacatgagcaaacagt

SEQ ID NO: 4312 - DNA, 47 bp, Artificial Sequence
  Synthetic
ggccatttgcaagtactgtgaatatgtcaattttgtaaagtttcagg

SEQ ID NO: 4313 - DNA, 50 bp, Artificial Sequence
  Synthetic
agcgtttacctaaagaaaactgtgatccttatgccagatataatttttgg

SEQ ID NO: 4314 - DNA, 46 bp, Artificial Sequence
  Synthetic
tcataggtaaacaggggtgcgcaactatatctactgactcatttgg

SEQ ID NO: 4315 - DNA, 45 bp, Artificial Sequence
  Synthetic
cctcttgttaaaacttgacctacctcgccaaaaggaagtaaagac

SEQ ID NO: 4316 - DNA, 46 bp, Artificial Sequence
  Synthetic
cccatcagtttccatctgttcataacgagtgacatcaaaatcatgg

SEQ ID NO: 4317 - DNA, 43 bp, Artificial Sequence
  Synthetic
ccctctcaatatcaatgcagatcttgagagaaagtcggaaccc

SEQ ID NO: 4318 - DNA, 43 bp, Artificial Sequence
  Synthetic
ccctctgatgaagcttaacaatcttgagtcagctggtgtggat

SEQ ID NO: 4319 - DNA, 42 bp, Artificial Sequence
  Synthetic
ccagtgaatgctgccatgatcgttttctgtacaaagaaacct

SEQ ID NO: 4320 - DNA, 39 bp, Artificial Sequence
  Synthetic
aagccatgggtacactgtcctttcaaccgaaaacggtac

SEQ ID NO: 4321 - DNA, 46 bp, Artificial Sequence
  Synthetic
aggtcaatttcagtttgcggtacacggtaaagtaacaactattcca

SEQ ID NO: 4322 - DNA, 41 bp, Artificial Sequence
  Synthetic
gcagcgtctgtgtatctgcatatgacagggagacagctcag

SEQ ID NO: 4323 - DNA, 43 bp, Artificial Sequence
  Synthetic
gcctatatccatatcactgtctgctgatggaggctcacagact

SEQ ID NO: 4324 - DNA, 43 bp, Artificial Sequence
  Synthetic
cgtcattatcaaatgcccattgcaatacagcacagttttcagg

SEQ ID NO: 4325 - DNA, 50 bp, Artificial Sequence
  Synthetic
gaagtcgaccccttgatatcttaaacacacatatgtagtaaagtagatga

SEQ ID NO: 4326 - DNA, 45 bp, Artificial Sequence
  Synthetic
cccatatgcacttcccatgtgattatacagactttaatgacgagg

SEQ ID NO: 4327 - DNA, 43 bp, Artificial Sequence
  Synthetic
gcaaagcaaaaacacaaaactaacatattttgctgctacgcct

SEQ ID NO: 4328 - DNA, 47 bp, Artificial Sequence
  Synthetic
gccctacacaaagcaaaagtgtaatatgctgtgtggttaataaacac

SEQ ID NO: 4329 - DNA, 42 bp, Artificial Sequence
  Synthetic
cctcaataactgggggttcaacaaggctctgtccatgttagt

SEQ ID NO: 4330 - DNA, 42 bp, Artificial Sequence
  Synthetic
gtcaggatcaggtgccacactggataatccagtctttgagga

SEQ ID NO: 4331 - DNA, 47 bp, Artificial Sequence
  Synthetic
gcctacgccttaaaaagtatacaggcacatgatgtggttatacatgg

SEQ ID NO: 4332 - DNA, 43 bp, Artificial Sequence
  Synthetic
catctgttttggaattaccagccttctcacgtttgcttgctgt

SEQ ID NO: 4333 - DNA, 41 bp, Artificial Sequence
  Synthetic
tttgtgttcctagtggtgtccaacagggacacaataatggc

SEQ ID NO: 4334 - DNA, 45 bp, Artificial Sequence
  Synthetic
ctaagcttgtggcagctgggcatactatgaactccactttacttg

SEQ ID NO: 4335 - DNA, 41 bp, Artificial Sequence
  Synthetic
tgcgtttggctgatggtgtaactactactaaaaaacgctcg

SEQ ID NO: 4336 - DNA, 39 bp, Artificial Sequence
  Synthetic
aaaagggtggaggacatagggggttgtgtccctaggcat

SEQ ID NO: 4337 - DNA, 42 bp, Artificial Sequence
  Synthetic
ccaacagcagtaaagtatgctgatgtaagacgcctcgcctta

SEQ ID NO: 4338 - DNA, 47 bp, Artificial Sequence
  Synthetic
cctcaggattgggaaaaaacatttcatatcggtgcatatataagtgc

SEQ ID NO: 4339 - DNA, 42 bp, Artificial Sequence
  Synthetic
actcgtaacatgtaaggtcagtctaagtgtgcaggacattgt

SEQ ID NO: 4340 - DNA, 41 bp, Artificial Sequence
  Synthetic
cccaattacctgaatcagccatcaaaattgtgtgccccaac

SEQ ID NO: 4341 - DNA, 47 bp, Artificial Sequence
  Synthetic
tgagataggtcaaattgacagtcctgtacccgaatggattaaaagac

SEQ ID NO: 4342 - DNA, 40 bp, Artificial Sequence
  Synthetic
tgtccagcatgcaggtgttgagtcatttttggttatcgcc

SEQ ID NO: 4343 - DNA, 48 bp, Artificial Sequence
  Synthetic
tgccttccagttttcattagtaagtaaagtgtttacgttttcaaatcc

SEQ ID NO: 4344 - DNA, 41 bp, Artificial Sequence
  Synthetic
tcgtgatactgcaaggcttggacataaggcacgtgaaatgg

SEQ ID NO: 4345 - DNA, 44 bp, Artificial Sequence
  Synthetic
attgccctcaacctttggaatttacaaaacatgtaagcaaagtg

SEQ ID NO: 4346 - DNA, 45 bp, Artificial Sequence
  Synthetic
ggcactatggaggtaggaccgattcttctatagtttcattagtgg

SEQ ID NO: 4347 - DNA, 45 bp, Artificial Sequence
  Synthetic
aagcaggcctatgtaactttacaatagaatttcagcacagtgact

SEQ ID NO: 4348 - DNA, 47 bp, Artificial Sequence
  Synthetic
gccacatctgcaaaaaaatatgacatatgggtccgattttatattgc

SEQ ID NO: 4349 - DNA, 47 bp, Artificial Sequence
  Synthetic
gtaccccaatgttcccctaagggtcagtagattataaacaaacacag

SEQ ID NO: 4350 - DNA, 43 bp, Artificial Sequence
  Synthetic
gccctgttaaataggtgtctaacaagcagatccctatggcgat

SEQ ID NO: 4351 - DNA, 41 bp, Artificial Sequence
  Synthetic
aagcggtcgcagaataactttataatagccactgtgtctcc

SEQ ID NO: 4352 - DNA, 46 bp, Artificial Sequence
  Synthetic
tccattattgtgtcaacctgctctaaaagtgatcagatttgcattg

SEQ ID NO: 4353 - DNA, 39 bp, Artificial Sequence
  Synthetic
gaggtcattggctggactggacgaattcatcaatgtgcc

SEQ ID NO: 4354 - DNA, 45 bp, Artificial Sequence
  Synthetic
gtgaatcccccacagtactaaaagaacccaacaataaagaggagc

SEQ ID NO: 4355 - DNA, 46 bp, Artificial Sequence
  Synthetic
ccctttcttgacaattttgtatgcagaatgatgccatcaatttcga

SEQ ID NO: 4356 - DNA, 50 bp, Artificial Sequence
  Synthetic
catcctccctctataaaacctgctagagagagagaagaagaaaaaagaga

SEQ ID NO: 4357 - DNA, 50 bp, Artificial Sequence
  Synthetic
aagttcagcattataagtccagacaaaggaggatagagaatttaaacaag

SEQ ID NO: 4358 - DNA, 43 bp, Artificial Sequence
  Synthetic
cccattgattccaattttactccacaacgtatgactacccgca

SEQ ID NO: 4359 - DNA, 47 bp, Artificial Sequence
  Synthetic
catcagtctccatctgttcgtaagactgagtgacatcaaaatcatgg

SEQ ID NO: 4360 - DNA, 48 bp, Artificial Sequence
  Synthetic
ctcttctgtatataggtcctccagtaataaatacctggaagaacatcc

SEQ ID NO: 4361 - DNA, 42 bp, Artificial Sequence
  Synthetic
aattccatcaccattgttccaactctccctaggaggtctgga

SEQ ID NO: 4362 - DNA, 43 bp, Artificial Sequence
  Synthetic
ccctttgatgaagctcaatactcttgagtcaactggtgtggat

SEQ ID NO: 4363 - DNA, 50 bp, Artificial Sequence
  Synthetic
ctcctcggttactaattcatcacatctattggagatgtaaagttagaact

SEQ ID NO: 4364 - DNA, 42 bp, Artificial Sequence
  Synthetic
gttgcagtcttgggctcaaataaagtactttagtcctagccc

SEQ ID NO: 4365 - DNA, 43 bp, Artificial Sequence
  Synthetic
acatcattactgtaacgcccgtcaacattactgcaaccacatt

SEQ ID NO: 4366 - DNA, 48 bp, Artificial Sequence
  Synthetic
cccatctactagtggttgcaaccaataaaatatacccaaggtaaggtg

SEQ ID NO: 4367 - DNA, 44 bp, Artificial Sequence
  Synthetic
ccatctgagctgtcgtctggctttttttagtaaactgtggaagc

SEQ ID NO: 4368 - DNA, 48 bp, Artificial Sequence
  Synthetic
actgcattgtcctcattatttccattcgcatacatttaaaaaacaagg

SEQ ID NO: 4369 - DNA, 42 bp, Artificial Sequence
  Synthetic
gtgtctattaggcagtcgatgtccggggatccgagtctccta

SEQ ID NO: 4370 - DNA, 47 bp, Artificial Sequence
  Synthetic
ggccatataccgatatgtaagaaggacctcctacatctactcctaag

SEQ ID NO: 4371 - DNA, 39 bp, Artificial Sequence
  Synthetic
agccatcaacaatagaggccatggctcagttgaattgca

SEQ ID NO: 4372 - DNA, 42 bp, Artificial Sequence
  Synthetic
accatccacaacaataggaggttacatcctgttattcctggc

SEQ ID NO: 4373 - DNA, 41 bp, Artificial Sequence
  Synthetic
caaccaacaacaaacaactgtgtggtgctaaggacgctaga

SEQ ID NO: 4374 - DNA, 47 bp, Artificial Sequence
  Synthetic
gcaaaatataaagagggagccagcgtttgagggtaatggtaaaaagt

SEQ ID NO: 4375 - DNA, 47 bp, Artificial Sequence
  Synthetic
ccttttccttaggaggctctgccttacagatatattgattctcttgc

SEQ ID NO: 4376 - DNA, 43 bp, Artificial Sequence
  Synthetic
gaacatacctgctggcaaaattggtattgcttttggaggcacc

SEQ ID NO: 4377 - DNA, 41 bp, Artificial Sequence
  Synthetic
gtccgtctctctgttttggcccttgaagcagtagtccttct

SEQ ID NO: 4378 - DNA, 49 bp, Artificial Sequence
  Synthetic
ttagcagaaatggttcaatggtgtcatatctataagcaataattggctc

SEQ ID NO: 4379 - DNA, 41 bp, Artificial Sequence
  Synthetic
cttgttggctgttcatggatacttccaaacatacaggggtg

SEQ ID NO: 4380 - DNA, 43 bp, Artificial Sequence
  Synthetic
ggtttgcaaccccttcctagaaatgtatagcttctttggactt

SEQ ID NO: 4381 - DNA, 37 bp, Artificial Sequence
  Synthetic
ctcccacccaggcggcataccggtggtgctactagcg

SEQ ID NO: 4382 - DNA, 41 bp, Artificial Sequence
  Synthetic
ctgctggagaagtgggaagcggcttcagcttcaagtcttgc

SEQ ID NO: 4383 - DNA, 48 bp, Artificial Sequence
  Synthetic
aaagcagtttctaagtagtgtgtctttataatgagtccaaatgtccat

SEQ ID NO: 4384 - DNA, 42 bp, Artificial Sequence
  Synthetic
aagaatcaggtcctagcactagcataaaattggcgggctctg

SEQ ID NO: 4385 - DNA, 47 bp, Artificial Sequence
  Synthetic
cggacattaagtagaccaacattcatcctagcctacttaatcgaatt

SEQ ID NO: 4386 - DNA, 47 bp, Artificial Sequence
  Synthetic
agatgcattagctgagtctgctgtcaaaagactcattatatggatct

SEQ ID NO: 4387 - DNA, 46 bp, Artificial Sequence
  Synthetic
ttgttcaataaatatgctgacgtggtgtaatcctcatcctgttgag

SEQ ID NO: 4388 - DNA, 46 bp, Artificial Sequence
  Synthetic
ttgctccctacacgtattttccagcagccaatatggtctattaaat

SEQ ID NO: 4389 - DNA, 44 bp, Artificial Sequence
  Synthetic
ctatggatctgtctgaaagactgtcccgtaacataccggtttga

SEQ ID NO: 4390 - DNA, 38 bp, Artificial Sequence
  Synthetic
gctgtggacagtgtggtcagtttggcgcctttttagca

SEQ ID NO: 4391 - DNA, 47 bp, Artificial Sequence
  Synthetic
actgaaaaatgagaggtaatgctccaggcagtactaattcttcaaga

SEQ ID NO: 4392 - DNA, 45 bp, Artificial Sequence
  Synthetic
atcctgtgcaagaaaccgtggctacttgtaccttctaaactatca

SEQ ID NO: 4393 - DNA, 44 bp, Artificial Sequence
  Synthetic
ctaaaagtccagaagttgcagttgagagcttattttcacagcct

SEQ ID NO: 4394 - DNA, 43 bp, Artificial Sequence
  Synthetic
acctaaaacatccagaaggagatggcagttcctgcagtgcatc

SEQ ID NO: 4395 - DNA, 42 bp, Artificial Sequence
  Synthetic
aggagagtcctgctaggagacgtgtctcaggtgatgttgtgg

SEQ ID NO: 4396 - DNA, 43 bp, Artificial Sequence
  Synthetic
gcttgggatccgccaataattccgatatctccagcatttaagc

SEQ ID NO: 4397 - DNA, 41 bp, Artificial Sequence
  Synthetic
gacccacaattcctgttgacactgaatgactgcagagccag

SEQ ID NO: 4398 - DNA, 42 bp, Artificial Sequence
  Synthetic
ttagcaatgcagaagaaggtgtagtgctaaacgtttcggtgg

SEQ ID NO: 4399 - DNA, 43 bp, Artificial Sequence
  Synthetic
ctgaatttgaaattgaagcccctccatctctgaagcgggtgac

SEQ ID NO: 4400 - DNA, 44 bp, Artificial Sequence
  Synthetic
taggacgtcctagatacagtgaaaccgagtttgcattgttccac

SEQ ID NO: 4401 - DNA, 44 bp, Artificial Sequence
  Synthetic
cgcaaacgaaaacgaatagctatcagatacagtttaccagttgg

SEQ ID NO: 4402 - DNA, 40 bp, Artificial Sequence
  Synthetic
agttcctcatgtctcaggaagtgcgattcggatctggtag

SEQ ID NO: 4403 - DNA, 45 bp, Artificial Sequence
  Synthetic
acccaactatttattgtaggctgtgacaaggctttgctatatccc

SEQ ID NO: 4404 - DNA, 42 bp, Artificial Sequence
  Synthetic
tagtggttctctagtttccagtgattgttagtcccctgagca

SEQ ID NO: 4405 - DNA, 41 bp, Artificial Sequence
  Synthetic
tagtggtctgcggaaccggtgcgggcatagagtgggttgat

SEQ ID NO: 4406 - DNA, 38 bp, Artificial Sequence
  Synthetic
ggccctagattgggtgtgcgtttggggatacgttggcg

SEQ ID NO: 4407 - DNA, 39 bp, Artificial Sequence
  Synthetic
ccagggctctggcacatggtccctgttgcatagttgacc

SEQ ID NO: 4408 - DNA, 38 bp, Artificial Sequence
  Synthetic
ccactttggcggtccgctataggtcaatatgcgtccgc

SEQ ID NO: 4409 - DNA, 37 bp, Artificial Sequence
  Synthetic
ttgccgcttacgctgtgagaaacacaccccagtggcc

SEQ ID NO: 4410 - DNA, 40 bp, Artificial Sequence
  Synthetic
cagtgactttgaccaggggtggaatagggtcgctggtccg

SEQ ID NO: 4411 - DNA, 41 bp, Artificial Sequence
  Synthetic
cccagggtgcccagagtaacacggatgtttcctgaagcagt

SEQ ID NO: 4412 - DNA, 42 bp, Artificial Sequence
  Synthetic
tgctccattccactacggagctgtagataaggccggaagcgg

SEQ ID NO: 4413 - DNA, 41 bp, Artificial Sequence
  Synthetic
gggaacccatggtatctggtggctgcctcgtagatgccaag

SEQ ID NO: 4414 - DNA, 38 bp, Artificial Sequence
  Synthetic
tccctcctctcaaccctcggtagcacagcagcacacac

SEQ ID NO: 4415 - DNA, 39 bp, Artificial Sequence
  Synthetic
cgttgcagtcgagcccgtgatatgtcgccacaagcagtg

SEQ ID NO: 4416 - DNA, 38 bp, Artificial Sequence
  Synthetic
tccacctcaacgcagaccttccgtgcccgctccgtgat

SEQ ID NO: 4417 - DNA, 39 bp, Artificial Sequence
  Synthetic
gcccccaaagtcattgcgttgctgctttggctacaccgc

SEQ ID NO: 4418 - DNA, 38 bp, Artificial Sequence
  Synthetic
accacgggggctcccataacacctgaacaacccccgtc

SEQ ID NO: 4419 - DNA, 42 bp, Artificial Sequence
  Synthetic
aaatgtgatgagcttgccgggacccctatagtaagcaacggc

SEQ ID NO: 4420 - DNA, 39 bp, Artificial Sequence
  Synthetic
gctctcagagacgtgggaggacgccactggacacgtatc

SEQ ID NO: 4421 - DNA, 40 bp, Artificial Sequence
  Synthetic
tggaagagtgctccaaagctcctgaacattccgccgatgg

SEQ ID NO: 4422 - DNA, 40 bp, Artificial Sequence
  Synthetic
agtcaacatcctgggtgggtggccgagaccacgaaagtcg

SEQ ID NO: 4423 - DNA, 39 bp, Artificial Sequence
  Synthetic
ggcataccggcactagtgaggatttccacgggaggcgaa

SEQ ID NO: 4424 - DNA, 42 bp, Artificial Sequence
  Synthetic
ggcatcatgaacaccaagtgcccgcatcgatccgttcttgac

SEQ ID NO: 4425 - DNA, 40 bp, Artificial Sequence
  Synthetic
tccttcccccgaattcttcagctgggttcaggggcgaatc

SEQ ID NO: 4426 - DNA, 35 bp, Artificial Sequence
  Synthetic
tccaccacccaggcggaaggtgccgtggaaaccgc

SEQ ID NO: 4427 - DNA, 42 bp, Artificial Sequence
  Synthetic
ctacaggacatgaccaccccgaggcaggatttacgcagaaga

SEQ ID NO: 4428 - DNA, 42 bp, Artificial Sequence
  Synthetic
tatcagtgctgcaacctcgaccccacgtacaacctctcggta

SEQ ID NO: 4429 - DNA, 41 bp, Artificial Sequence
  Synthetic
cgagagcaagggagtcgaacgggagtacctggtcattgccg

SEQ ID NO: 4430 - DNA, 37 bp, Artificial Sequence
  Synthetic
ctggccggctcgatctttcgtgatccacgtccgcctc

SEQ ID NO: 4431 - DNA, 45 bp, Artificial Sequence
  Synthetic
aagaatgaacatcttcccctaatgttaagcacctcataacgatgt

SEQ ID NO: 4432 - DNA, 42 bp, Artificial Sequence
  Synthetic
tcttgggagtggagtcaatgaacttcttcaaccatttccatt

SEQ ID NO: 4433 - DNA, 45 bp, Artificial Sequence
  Synthetic
cgtgattagaacacacgagtactccacatcctgtaacatcagaaa

SEQ ID NO: 4434 - DNA, 42 bp, Artificial Sequence
  Synthetic
gacaaattgactcaggggagacatattgttgtgttcagtgcc

SEQ ID NO: 4435 - DNA, 41 bp, Artificial Sequence
  Synthetic
agaaggccaaactatcaaatgcatactgatccctcctggtg

SEQ ID NO: 4436 - DNA, 43 bp, Artificial Sequence
  Synthetic
gcacaaacagccatacaattattcaatctcccctgtggcattt

SEQ ID NO: 4437 - DNA, 46 bp, Artificial Sequence
  Synthetic
acaacataatggaccctgagtacacaaatgtcctacaaagggattt

SEQ ID NO: 4438 - DNA, 41 bp, Artificial Sequence
  Synthetic
tttgaggcttgctttaacagtgcgtgggccatagcttcaag

SEQ ID NO: 4439 - DNA, 43 bp, Artificial Sequence
  Synthetic
attggataccatgccaataattccacacagtgacattccgctc

SEQ ID NO: 4440 - DNA, 38 bp, Artificial Sequence
  Synthetic
ttgtgttacccaggcagcttatgtttcacgctgctgag

SEQ ID NO: 4441 - DNA, 45 bp, Artificial Sequence
  Synthetic
aaatgctaataatttggggagtgcatctggtacaatgctctttgt

SEQ ID NO: 4442 - DNA, 47 bp, Artificial Sequence
  Synthetic
catgaagacagaaggaacacttgagtgtatttattgctcccaaagga

SEQ ID NO: 4443 - DNA, 41 bp, Artificial Sequence
  Synthetic
aggaatggttgatggttggtatgctgctgcataccctgatc

SEQ ID NO: 4444 - DNA, 46 bp, Artificial Sequence
  Synthetic
gactgatgatcacagacatgagacctgtgtgttatgatgtctctgg

SEQ ID NO: 4445 - DNA, 43 bp, Artificial Sequence
  Synthetic
acactcaacaaagatcaacttctgtactatctcctgtgctccg

SEQ ID NO: 4446 - DNA, 44 bp, Artificial Sequence
  Synthetic
gccaacagcttctatgaagtgttgtgctataccaaaatgaacaa

SEQ ID NO: 4447 - DNA, 43 bp, Artificial Sequence
  Synthetic
acagaggtacaccaaggaatcaattgagttgttcagcatatgc

SEQ ID NO: 4448 - DNA, 45 bp, Artificial Sequence
  Synthetic
atcagaactgaagcattaatgaccattcactttcctcattcctga

SEQ ID NO: 4449 - DNA, 40 bp, Artificial Sequence
  Synthetic
caactcacccatccaaccaaactttttccgggtggctagt

SEQ ID NO: 4450 - DNA, 41 bp, Artificial Sequence
  Synthetic
aaactcaagaagtgcagtgctagaaggacacattggcacat

SEQ ID NO: 4451 - DNA, 50 bp, Artificial Sequence
  Synthetic
tactgttagtcatcacagtgactgactactataaattgactttgtggctt

SEQ ID NO: 4452 - DNA, 48 bp, Artificial Sequence
  Synthetic
atccacatggggcaaataatcatttgtctatgttgacagatattgtga

SEQ ID NO: 4453 - DNA, 46 bp, Artificial Sequence
  Synthetic
gcacaaatcacattatccattctggatgaatatgatggctgcaatt

SEQ ID NO: 4454 - DNA, 43 bp, Artificial Sequence
  Synthetic
agcatatgcagcaacaatccaatccaggttttttgtttggtat

SEQ ID NO: 4455 - DNA, 40 bp, Artificial Sequence
  Synthetic
ccctccactcaacctcctcctgtgataggtactcggatgt

SEQ ID NO: 4456 - DNA, 39 bp, Artificial Sequence
  Synthetic
caatccttgctgcagtcacacgcactgcatgttgtttga

SEQ ID NO: 4457 - DNA, 45 bp, Artificial Sequence
  Synthetic
agtgtcttaaccagcaaagtgtttcacaataggtaacaactgttt

SEQ ID NO: 4458 - DNA, 44 bp, Artificial Sequence
  Synthetic
tcttcccactagctgaaacatgtaactgttcattgtgtcacaaa

SEQ ID NO: 4459 - DNA, 47 bp, Artificial Sequence
  Synthetic
gcacctaatcatgttcttacaatggaaatccaatgatagatgggttg

SEQ ID NO: 4460 - DNA, 40 bp, Artificial Sequence
  Synthetic
gccatgagcaaactcctcactcttcattgtccctcagttt

SEQ ID NO: 4461 - DNA, 46 bp, Artificial Sequence
  Synthetic
tgtaggtagaatgtttgcaatgcacagctatcattttctctgctaa

SEQ ID NO: 4462 - DNA, 45 bp, Artificial Sequence
  Synthetic
gaacctacatatcctcacgggcttctctgctttataaaagggtaa

SEQ ID NO: 4463 - DNA, 49 bp, Artificial Sequence
  Synthetic
tacagtcagtagtagaccatgtgaaggctagtatcaaagtgataatttg

SEQ ID NO: 4464 - DNA, 38 bp, Artificial Sequence
  Synthetic
cctcccgggagagccatagtgtcgtcctggcaattccg

SEQ ID NO: 4465 - DNA, 42 bp, Artificial Sequence
  Synthetic
caggggccctagattgggtgtgtggggataggctgacgtcta

SEQ ID NO: 4466 - DNA, 39 bp, Artificial Sequence
  Synthetic
cgcatggcgtccgggttctagaaagagcaaccaggaagg

SEQ ID NO: 4467 - DNA, 36 bp, Artificial Sequence
  Synthetic
ggtgttgggtggcggtgatgcgttgtggggagtttg

SEQ ID NO: 4468 - DNA, 42 bp, Artificial Sequence
  Synthetic
tcatggacatgatcgctggtgcccaccatggagaaatacgct

SEQ ID NO: 4469 - DNA, 41 bp, Artificial Sequence
  Synthetic
tcagttatgccaacggaagcgggtcttggagggtagtgcca

SEQ ID NO: 4470 - DNA, 39 bp, Artificial Sequence
  Synthetic
gcccccttgtgtcatcggaggaagcaatcagtggggcag

SEQ ID NO: 4471 - DNA, 39 bp, Artificial Sequence
  Synthetic
agcccgttgctgctgtccagcagggtcgtgaaagaacac

SEQ ID NO: 4472 - DNA, 40 bp, Artificial Sequence
  Synthetic
cctcgtgttcttctgctttgcggaggccacatcccgtaga

SEQ ID NO: 4473 - DNA, 39 bp, Artificial Sequence
  Synthetic
aaagtcccctacttcgtgcgccggctatcttccgcgcta

SEQ ID NO: 4474 - DNA, 42 bp, Artificial Sequence
  Synthetic
ggagaccaagctcatcacgtggaagccgttgatgatgtcacc

SEQ ID NO: 4475 - DNA, 41 bp, Artificial Sequence
  Synthetic
ggaacgaggaccatcgcatcacacaaggtcttggtccacat

SEQ ID NO: 4476 - DNA, 41 bp, Artificial Sequence
  Synthetic
tccctgtggagaacctagggacggtggagaggagttgtccg

SEQ ID NO: 4477 - DNA, 39 bp, Artificial Sequence
  Synthetic
cgggtgctcaggaggtgcttaatgtggcatccgtggagt

SEQ ID NO: 4478 - DNA, 39 bp, Artificial Sequence
  Synthetic
gaagctggtcgcattgggcagacagacacgtcaagaccg

SEQ ID NO: 4479 - DNA, 41 bp, Artificial Sequence
  Synthetic
tctgtgagtgctatgacgcgggtaactgtagtctcggcggg

SEQ ID NO: 4480 - DNA, 38 bp, Artificial Sequence
  Synthetic
tgaagtcaccctgacgcacccggtgctcgtgacgacct

SEQ ID NO: 4481 - DNA, 41 bp, Artificial Sequence
  Synthetic
gtcccgccatgcagaggttatagacctcgagtttctgccag

SEQ ID NO: 4482 - DNA, 37 bp, Artificial Sequence
  Synthetic
tgtgggtgctggcctagctcacgaggaccttccccag

SEQ ID NO: 4483 - DNA, 36 bp, Artificial Sequence
  Synthetic
cgcccgcgtcactgccatatgcagtcgcctcaggag

SEQ ID NO: 4484 - DNA, 41 bp, Artificial Sequence
  Synthetic
ctgcaggaacatgtggagtgggcaggaaggggagtacaggg

SEQ ID NO: 4485 - DNA, 41 bp, Artificial Sequence
  Synthetic
gcaattaccttgcgagcccgaagggatcagtgagcatggac

SEQ ID NO: 4486 - DNA, 40 bp, Artificial Sequence
  Synthetic
tgtggcagaggaggatgagcggcgaatctccgagacttcc

SEQ ID NO: 4487 - DNA, 42 bp, Artificial Sequence
  Synthetic
acgacaacatcctctgagcccgggggcatggaagaataggac

SEQ ID NO: 4488 - DNA, 40 bp, Artificial Sequence
  Synthetic
agactgcaagttctggacagccttttgacgccgctgcttt

SEQ ID NO: 4489 - DNA, 38 bp, Artificial Sequence
  Synthetic
gcgtgtgcgagaagatggccaggagcttcccatcacgg

SEQ ID NO: 4490 - DNA, 41 bp, Artificial Sequence
  Synthetic
ttcaaggggggaaaactgcggcagctagttgtcagtacgcc

SEQ ID NO: 4491 - DNA, 40 bp, Artificial Sequence
  Synthetic
cgcgtgggagacagcaagactgtgggggcaaacatgatta

SEQ ID NO: 4492 - DNA, 40 bp, Artificial Sequence
  Synthetic
tgcctcagaaaacttggggtcctggacagaagcctagcgc

SEQ ID NO: 4493 - DNA, 45 bp, Artificial Sequence
  Synthetic
agatccgaaaatcgaaacgaacacatgaaacagacttctaagtgc

SEQ ID NO: 4494 - DNA, 46 bp, Artificial Sequence
  Synthetic
gtatgactacaaggagaaccgattttagtatgtgtgaacttccctc

SEQ ID NO: 4495 - DNA, 43 bp, Artificial Sequence
  Synthetic
aagaacatgaggaaaacaagccactactttctctggtgccata

SEQ ID NO: 4496 - DNA, 47 bp, Artificial Sequence
  Synthetic
atgagaaggaactatttcacagcgcccttcattatgtattcagtagc

SEQ ID NO: 4497 - DNA, 39 bp, Artificial Sequence
  Synthetic
tggagccacacagatgggaagtccgtaagagcatgtctc

SEQ ID NO: 4498 - DNA, 41 bp, Artificial Sequence
  Synthetic
aatcagaaacatggccaattggaaaggttctgcacaccttc

SEQ ID NO: 4499 - DNA, 43 bp, Artificial Sequence
  Synthetic
tttgcatcagaatagaccaggcatcacactgaaattcgctttc

SEQ ID NO: 4500 - DNA, 42 bp, Artificial Sequence
  Synthetic
agaagcagtaatgagaatgggagagttctcgccattttccgt

SEQ ID NO: 4501 - DNA, 38 bp, Artificial Sequence
  Synthetic
agccgcgtactctagctgatgcacaaggaagttgcaaa

SEQ ID NO: 4502 - DNA, 42 bp, Artificial Sequence
  Synthetic
gcagggagcaattagaagactccttgtttgtcaggttgtgtt

SEQ ID NO: 4503 - DNA, 42 bp, Artificial Sequence
  Synthetic
aattgtagaacgtaaaacaggggacactgtcctccacatcct

SEQ ID NO: 4504 - DNA, 42 bp, Artificial Sequence
  Synthetic
ggggctatatccctaggacggcttgggccttatcaaacagcc

SEQ ID NO: 4505 - DNA, 46 bp, Artificial Sequence
  Synthetic
tgtgctttgatagaaaacatcgagcgcatttatgttggaggtcact

SEQ ID NO: 4506 - DNA, 44 bp, Artificial Sequence
  Synthetic
ccaggaaaggcttctagacctccaatgttctatttggtcctcta

SEQ ID NO: 4507 - DNA, 42 bp, Artificial Sequence
  Synthetic
cgtggacattacaggacacatgctactgtttgtccacgtctt

SEQ ID NO: 4508 - DNA, 44 bp, Artificial Sequence
  Synthetic
aaaaggaagcatctaagtatggggagaaaaaatgatgctgctgc

SEQ ID NO: 4509 - DNA, 42 bp, Artificial Sequence
  Synthetic
agatgttaccctacactttgagcatgtccataaaggcgggat

SEQ ID NO: 4510 - DNA, 47 bp, Artificial Sequence
  Synthetic
atttccacaaacacccattgctataagtataactaggatgcaggtaa

SEQ ID NO: 4511 - DNA, 43 bp, Artificial Sequence
  Synthetic
atcctgattaccttaaaatggctgcacatttgttcccgcctta

SEQ ID NO: 4512 - DNA, 43 bp, Artificial Sequence
  Synthetic
cccagggtcaaaacaatggtattgggtggtatctacaactgtt

SEQ ID NO: 4513 - DNA, 40 bp, Artificial Sequence
  Synthetic
ccccagctacaagtagtttggattgacatgcaatggcctg

SEQ ID NO: 4514 - DNA, 36 bp, Artificial Sequence
  Synthetic
actacgtccgccgtctaggtgagcgccggacaaagg

SEQ ID NO: 4515 - DNA, 35 bp, Artificial Sequence
  Synthetic
cgggattcgagcgccccttagggctagcgctacgg

SEQ ID NO: 4516 - DNA, 39 bp, Artificial Sequence
  Synthetic
cgccgtcatcctccacccaaacatagggaggggggattt

SEQ ID NO: 4517 - DNA, 41 bp, Artificial Sequence
  Synthetic
aagacctccaagacctcctgcatgctggtgatggagggaag

SEQ ID NO: 4518 - DNA, 40 bp, Artificial Sequence
  Synthetic
ccttcctgggcctctatcctccgaggcgttctacgaaggc

SEQ ID NO: 4519 - DNA, 38 bp, Artificial Sequence
  Synthetic
cttccggtgcgggaaagcagtgacatagggggcatggc

SEQ ID NO: 4520 - DNA, 39 bp, Artificial Sequence
  Synthetic
tacaggcgccagctgtccttggaactggctgatttcggg

SEQ ID NO: 4521 - DNA, 38 bp, Artificial Sequence
  Synthetic
gacctgcgggccactaactcaggctggacaagtcaggg

SEQ ID NO: 4522 - DNA, 40 bp, Artificial Sequence
  Synthetic
ctggcccatatcctgcagcctgccaggagaatgtcatcca

SEQ ID NO: 4523 - DNA, 42 bp, Artificial Sequence
  Synthetic
aggcatactgatccccgagacccgcagctgcactaatgattg

SEQ ID NO: 4524 - DNA, 40 bp, Artificial Sequence
  Synthetic
ggggcagctacttgcctcagtggtttggcagagtagtcca

SEQ ID NO: 4525 - DNA, 40 bp, Artificial Sequence
  Synthetic
acctgatcccatctccaggcttgcaggacaggggtgatta

SEQ ID NO: 4526 - DNA, 46 bp, Artificial Sequence
  Synthetic
gctattcgccatactacccatgtcatagggttttaagaatgccatt

SEQ ID NO: 4527 - DNA, 37 bp, Artificial Sequence
  Synthetic
agttctgcccagtggatcccgtccgacgggtcttggg

SEQ ID NO: 4528 - DNA, 39 bp, Artificial Sequence
  Synthetic
gttcatggaccctcgacctgcattagggcagggtggctg

SEQ ID NO: 4529 - DNA, 46 bp, Artificial Sequence
  Synthetic
cagcccctactggaaatttcagaatattgaggtgtgaaacttcttg

SEQ ID NO: 4530 - DNA, 35 bp, Artificial Sequence
  Synthetic
gagcagtaccggtggcggttcctgccagccactcc

SEQ ID NO: 4531 - DNA, 40 bp, Artificial Sequence
  Synthetic
atcctccttctcctgcagcaacttggaaggcgaggtggag

SEQ ID NO: 4532 - DNA, 38 bp, Artificial Sequence
  Synthetic
tcgcttcctcttctcctcagcctccaggggggaaagcg

SEQ ID NO: 4533 - DNA, 41 bp, Artificial Sequence
  Synthetic
tatcagcccacttcccagggttccaaacacgtagactgggt

SEQ ID NO: 4534 - DNA, 42 bp, Artificial Sequence
  Synthetic
acccttaaggtccttaccccgcgaggaaggagggtggaatgt

SEQ ID NO: 4535 - DNA, 44 bp, Artificial Sequence
  Synthetic
tcaaaccaaggcctaccaccgagatgcaaattatgaaaggaaga

SEQ ID NO: 4536 - DNA, 41 bp, Artificial Sequence
  Synthetic
taagctcagacctccgggaagcacggcttgacaaacatggg

SEQ ID NO: 4537 - DNA, 37 bp, Artificial Sequence
  Synthetic
acgccggttgagtcgcgtcggacgtagttcaggaggc

SEQ ID NO: 4538 - DNA, 43 bp, Artificial Sequence
  Synthetic
agaagtacacatcagggagacagttcattgccatcatccattt

SEQ ID NO: 4539 - DNA, 45 bp, Artificial Sequence
  Synthetic
aagtcgaaaggttaaaacatggaacggcgtattttgacttggttt

SEQ ID NO: 4540 - DNA, 43 bp, Artificial Sequence
  Synthetic
tggttgcatacatgttagagagagattgttccaccagcaactg

SEQ ID NO: 4541 - DNA, 39 bp, Artificial Sequence
  Synthetic
attggagatgtgccacagcactgcctaagaatgtccacc

SEQ ID NO: 4542 - DNA, 43 bp, Artificial Sequence
  Synthetic
ggaaaagggcaacagctatactcattgactgttcgtctcttcc

SEQ ID NO: 4543 - DNA, 45 bp, Artificial Sequence
  Synthetic
aattggggaattgaacatatcgacacttggagtcatgtctggtaa

SEQ ID NO: 4544 - DNA, 40 bp, Artificial Sequence
  Synthetic
acaggggacagagaaactgactcagggccattaatctccc

SEQ ID NO: 4545 - DNA, 43 bp, Artificial Sequence
  Synthetic
tgtacttgggacatttgataccactctactttgctttggtggg

SEQ ID NO: 4546 - DNA, 39 bp, Artificial Sequence
  Synthetic
gtggagtccgctgttctgagtgatgcttaatgctggtcc

SEQ ID NO: 4547 - DNA, 40 bp, Artificial Sequence
  Synthetic
tatcagaatggaccaggcgattcacactgaagttcgcttt

SEQ ID NO: 4548 - DNA, 44 bp, Artificial Sequence
  Synthetic
aacacagttcgagtctctgaaactcccattctcattactgcttc

SEQ ID NO: 4549 - DNA, 42 bp, Artificial Sequence
  Synthetic
acaggaacaggatacaccatggccactttcccttttctgagt

SEQ ID NO: 4550 - DNA, 39 bp, Artificial Sequence
  Synthetic
ctaactcaaggtcgccagacttatggtgttggccaatgc

SEQ ID NO: 4551 - DNA, 46 bp, Artificial Sequence
  Synthetic
agagcactgacattaaatacgatgacgatagcccttctttttaact

SEQ ID NO: 4552 - DNA, 41 bp, Artificial Sequence
  Synthetic
ctttcacaatcactggggacaaccatcgccaggaacattcg

SEQ ID NO: 4553 - DNA, 42 bp, Artificial Sequence
  Synthetic
gctagcaagcattgacctgaagaagaggccttattttctcaa

SEQ ID NO: 4554 - DNA, 43 bp, Artificial Sequence
  Synthetic
ctcatagtgaatgcaccaaaccaaggtcctgtagaatctgtcc

SEQ ID NO: 4555 - DNA, 42 bp, Artificial Sequence
  Synthetic
cccagatggctcttcaattgttctcccctatggcacctatat

SEQ ID NO: 4556 - DNA, 37 bp, Artificial Sequence
  Synthetic
gacggcctcgctgactggagaatcgtgtgcgcgaaag

SEQ ID NO: 4557 - DNA, 38 bp, Artificial Sequence
  Synthetic
tattgccacgcatccggatcactgggctggggtggttt

SEQ ID NO: 4558 - DNA, 35 bp, Artificial Sequence
  Synthetic
acgccgtccaacttcacgcgttcaccgcgtcgtgc

SEQ ID NO: 4559 - DNA, 42 bp, Artificial Sequence
  Synthetic
tccaataaacccatcccctcgcgacggattcctgaggctaca

SEQ ID NO: 4560 - DNA, 41 bp, Artificial Sequence
  Synthetic
gggacggaggagagacgatgcaggtcggaccatccacccat

SEQ ID NO: 4561 - DNA, 45 bp, Artificial Sequence
  Synthetic
atacaccacatcgttggataatacggacgcgttaatcgaactttc

SEQ ID NO: 4562 - DNA, 41 bp, Artificial Sequence
  Synthetic
cgttatcatctgctcccgctgccggccgctgaaaaaagagt

SEQ ID NO: 4563 - DNA, 40 bp, Artificial Sequence
  Synthetic
cggattccaagtcagagcggcgggtcggtccaggtcaacg

SEQ ID NO: 4564 - DNA, 39 bp, Artificial Sequence
  Synthetic
tcagccacgacgcgagtgacgttatagcgccgtctttcg

SEQ ID NO: 4565 - DNA, 39 bp, Artificial Sequence
  Synthetic
tctcatcaccgagaccgcgggccaggctgtgggtctcgt

SEQ ID NO: 4566 - DNA, 36 bp, Artificial Sequence
  Synthetic
cgcccgatccctccaggtttacgcggtgccgttcac

SEQ ID NO: 4567 - DNA, 38 bp, Artificial Sequence
  Synthetic
catcgggtagacggcgctagcggatccgtcagccagta

SEQ ID NO: 4568 - DNA, 37 bp, Artificial Sequence
  Synthetic
ggaggaaactgccgcgggatcttcctcagagacggcc

SEQ ID NO: 4569 - DNA, 39 bp, Artificial Sequence
  Synthetic
gcacgctgcatggctaaatacccatgacgcgttcgggac

SEQ ID NO: 4570 - DNA, 40 bp, Artificial Sequence
  Synthetic
gcatgaactgcccgtggtggtggagcctcggtttggatac

SEQ ID NO: 4571 - DNA, 36 bp, Artificial Sequence
  Synthetic
tgaggttgcgggccaggttctcggacgagggctatg

SEQ ID NO: 4572 - DNA, 36 bp, Artificial Sequence
  Synthetic
tctgagcgagtcccttgcgcgcagcggctcatcagg

SEQ ID NO: 4573 - DNA, 38 bp, Artificial Sequence
  Synthetic
cgcaagtaatgggtgcgcgatacgtggtgtgcacgttg

SEQ ID NO: 4574 - DNA, 37 bp, Artificial Sequence
  Synthetic
cgagagcccgtcgtgatagtcctacgcggcgacagct

SEQ ID NO: 4575 - DNA, 36 bp, Artificial Sequence
  Synthetic
acatgcgccctgggtctgatcgatgggtccgcttca

SEQ ID NO: 4576 - DNA, 37 bp, Artificial Sequence
  Synthetic
cgtgcgccacgccaagatagtacgactcgtaggccgt

SEQ ID NO: 4577 - DNA, 38 bp, Artificial Sequence
  Synthetic
caggcggtgcagatcggttttcaatgcgggcaggcgtg

SEQ ID NO: 4578 - DNA, 39 bp, Artificial Sequence
  Synthetic
cgggtacgacctgcgatttagcgacagttgagcgcgtcg

SEQ ID NO: 4579 - DNA, 39 bp, Artificial Sequence
  Synthetic
ccgctggtcggtttctgactggcggtgtttccagcattt

SEQ ID NO: 4580 - DNA, 39 bp, Artificial Sequence
  Synthetic
gcgctccacgatctcggcatgtgctagaccgtaccgaat

SEQ ID NO: 4581 - DNA, 38 bp, Artificial Sequence
  Synthetic
accaggacaaggtggtgagctgccgatttttcgccgca

SEQ ID NO: 4582 - DNA, 39 bp, Artificial Sequence
  Synthetic
ggccttggtggacttccaggcggataatctcctgggcca

SEQ ID NO: 4583 - DNA, 40 bp, Artificial Sequence
  Synthetic
agagggctcatccgactctgcccacgctgatgtcctcggg

SEQ ID NO: 4584 - DNA, 39 bp, Artificial Sequence
  Synthetic
caggggcgagtccgtcgtcacgacgccatcaccgagaac

SEQ ID NO: 4585 - DNA, 41 bp, Artificial Sequence
  Synthetic
tcgcgcatagtgtggaagtggtcgcccaccatgaaggattt

SEQ ID NO: 4586 - DNA, 39 bp, Artificial Sequence
  Synthetic
cccctccgtattcttgtcgcgtccaccagctggactacg

SEQ ID NO: 4587 - DNA, 38 bp, Artificial Sequence
  Synthetic
tgctgggcgccaggaaaaacttcatgacgcccaagtgg

SEQ ID NO: 4588 - DNA, 38 bp, Artificial Sequence
  Synthetic
acctgacggtgaaccacccaaatcgcccctcacgtcag

SEQ ID NO: 4589 - DNA, 39 bp, Artificial Sequence
  Synthetic
cggcagcagtacacgtcgagcgcgtacgccgtgtaccac

SEQ ID NO: 4590 - DNA, 38 bp, Artificial Sequence
  Synthetic
cgtcgggcacagacccatggcgaccgggatcacgacga

SEQ ID NO: 4591 - DNA, 37 bp, Artificial Sequence
  Synthetic
gcgtagttgcgcaggccctgtacctggtgtcgcggtc

SEQ ID NO: 4592 - DNA, 41 bp, Artificial Sequence
  Synthetic
cgtaattcaccacgggcacgcccgtgagtgttacttcccca

SEQ ID NO: 4593 - DNA, 37 bp, Artificial Sequence
  Synthetic
actgacagttgcgcaatccgatctccatcgccagcgc

SEQ ID NO: 4594 - DNA, 38 bp, Artificial Sequence
  Synthetic
gcgcgttgccccaaaccactttgatttgagcgtgctgc

SEQ ID NO: 4595 - DNA, 35 bp, Artificial Sequence
  Synthetic
acaagccccagcaaccggtacccaagctggccgag

SEQ ID NO: 4596 - DNA, 36 bp, Artificial Sequence
  Synthetic
aagctacagcgctcgcggcactggcagaccttggtc

SEQ ID NO: 4597 - DNA, 38 bp, Artificial Sequence
  Synthetic
gggccacgctgacggctttttacggtctggatctcgcg

SEQ ID NO: 4598 - DNA, 37 bp, Artificial Sequence
  Synthetic
cggcttgaacgagcgccttgtcgctgctgatctgacg

SEQ ID NO: 4599 - DNA, 34 bp, Artificial Sequence
  Synthetic
gcgctacgaacccgcacagcctggcttacgggga

SEQ ID NO: 4600 - DNA, 35 bp, Artificial Sequence
  Synthetic
tacgcgcacgccaaaccgcgcgccaacgagttgac

SEQ ID NO: 4601 - DNA, 36 bp, Artificial Sequence
  Synthetic
ggcttcggcgtgcagctgtcgccacatccagcatgt

SEQ ID NO: 4602 - DNA, 40 bp, Artificial Sequence
  Synthetic
gttggacgacaacgccaagcgcaactctagcattttggcg

SEQ ID NO: 4603 - DNA, 39 bp, Artificial Sequence
  Synthetic
gtgcagcagcgcctacagagcgtttcctcttcctcttcg

SEQ ID NO: 4604 - DNA, 40 bp, Artificial Sequence
  Synthetic
tcaaccaggacttgctgtcggccgttgatccgcccgtcta

SEQ ID NO: 4605 - DNA, 37 bp, Artificial Sequence
  Synthetic
tgaccacccccgacgccaaacagctcgcgaagtgtct

SEQ ID NO: 4606 - DNA, 37 bp, Artificial Sequence
  Synthetic
cggaagcaggacccactaccgtgcgctagcgtcacgg

SEQ ID NO: 4607 - DNA, 38 bp, Artificial Sequence
  Synthetic
caaacagctgtcgcggtactcgacttcgcacgggcacg

SEQ ID NO: 4608 - DNA, 36 bp, Artificial Sequence
  Synthetic
cgccacagcagagccagcactttgcgactctgggcc

SEQ ID NO: 4609 - DNA, 40 bp, Artificial Sequence
  Synthetic
agctcgatgttgaacaccgacgcggagtgctgacgaagtg

SEQ ID NO: 4610 - DNA, 42 bp, Artificial Sequence
  Synthetic
tcgttttcctcctctccgtcgtgaatgtcctgggctaagcag

SEQ ID NO: 4611 - DNA, 39 bp, Artificial Sequence
  Synthetic
accagtctcagtctcagcagcattgagaaacagcggcgg

SEQ ID NO: 4612 - DNA, 40 bp, Artificial Sequence
  Synthetic
ctgttgctctcctctaccccgcgtcggacgcgattgatgg

SEQ ID NO: 4613 - DNA, 38 bp, Artificial Sequence
  Synthetic
ccactactgccggagccgagctccggcagtaacagtag

SEQ ID NO: 4614 - DNA, 41 bp, Artificial Sequence
  Synthetic
atagcggcgttaggtgacacgtacagcaaaggtacgacggt

SEQ ID NO: 4615 - DNA, 35 bp, Artificial Sequence
  Synthetic
gttgcgcacccgtaagccgagggggaggggcgaat

SEQ ID NO: 4616 - DNA, 39 bp, Artificial Sequence
  Synthetic
gctgctgttgctgctgttgttgagcagcaacagtcgcag

SEQ ID NO: 4617 - DNA, 39 bp, Artificial Sequence
  Synthetic
ggggatctcctcacgcacgcggattgcgaccccgaagtg

SEQ ID NO: 4618 - DNA, 39 bp, Artificial Sequence
  Synthetic
gccacaaagtcgcttttgccgctcatcgaccccgtgacg

SEQ ID NO: 4619 - DNA, 38 bp, Artificial Sequence
  Synthetic
cctcgcacagccgatgcaccatacgcaaggcatcgtgg

SEQ ID NO: 4620 - DNA, 38 bp, Artificial Sequence
  Synthetic
gcgatcaccacgctcgaggaacgcaggagattctggcc

SEQ ID NO: 4621 - DNA, 37 bp, Artificial Sequence
  Synthetic
cagccagaccgctagccgaaagccgtcccgaacatca

SEQ ID NO: 4622 - DNA, 39 bp, Artificial Sequence
  Synthetic
acccggcgtgtcgactcgtagggaaaaaaaggtggggcc

SEQ ID NO: 4623 - DNA, 35 bp, Artificial Sequence
  Synthetic
gcggactgcaccgggatgatctcacggcggcagtc

SEQ ID NO: 4624 - DNA, 36 bp, Artificial Sequence
  Synthetic
cgaccgcgcggctgatgatacgtctggcaccctacc

SEQ ID NO: 4625 - DNA, 41 bp, Artificial Sequence
  Synthetic
tgaagaaatagaccgggtgccgtctggatgaccgtatgggc

SEQ ID NO: 4626 - DNA, 35 bp, Artificial Sequence
  Synthetic
gaggccacggcgcagaagaaccgctgcccgtctac

SEQ ID NO: 4627 - DNA, 37 bp, Artificial Sequence
  Synthetic
cgcgccggtactcgagcaaacgtctacctggcctacc

SEQ ID NO: 4628 - DNA, 35 bp, Artificial Sequence
  Synthetic
agcggctgctggaagagggcgggtgacggcgacat

SEQ ID NO: 4629 - DNA, 38 bp, Artificial Sequence
  Synthetic
cacctggacatctaccgtcgccacaggcggttgagcgc

SEQ ID NO: 4630 - DNA, 35 bp, Artificial Sequence
  Synthetic
tgcctcagctgttaccgcggccttcccaagcggca

SEQ ID NO: 4631 - DNA, 35 bp, Artificial Sequence
  Synthetic
gctggtgcggcttttccacatcgtcccgtagcccg

SEQ ID NO: 4632 - DNA, 35 bp, Artificial Sequence
  Synthetic
ctcggtgagcgggtagcgaagcctgcgactgctgc

SEQ ID NO: 4633 - DNA, 39 bp, Artificial Sequence
  Synthetic
cagggccagggacagccttgtcgtcgtggttgatgttga

SEQ ID NO: 4634 - DNA, 37 bp, Artificial Sequence
  Synthetic
cgcaccctctgagtgctgcctgccacggtagcacctg

SEQ ID NO: 4635 - DNA, 36 bp, Artificial Sequence
  Synthetic
ccgtcttatcccgtgccgcataccgcccggagagtc

SEQ ID NO: 4636 - DNA, 39 bp, Artificial Sequence
  Synthetic
cgtaaggaaaccgcggcgggcctgggaaactcaagtctt

SEQ ID NO: 4637 - DNA, 39 bp, Artificial Sequence
  Synthetic
acagtccggcttgggtgtccatgtttgccggcttcgagg

SEQ ID NO: 4638 - DNA, 37 bp, Artificial Sequence
  Synthetic
cgcggagggtgattcgcactcccgggcgtctccatag

SEQ ID NO: 4639 - DNA, 41 bp, Artificial Sequence
  Synthetic
agttgttgaggtccaccagcagtaaacatcaagggccgctg

SEQ ID NO: 4640 - DNA, 36 bp, Artificial Sequence
  Synthetic
agacgaccggcttccagcgactgccaggtgcttcgg

SEQ ID NO: 4641 - DNA, 34 bp, Artificial Sequence
  Synthetic
gcttgcccgacgcgtgaaggccgagcgcaaacac

SEQ ID NO: 4642 - DNA, 40 bp, Artificial Sequence
  Synthetic
gcacgttgaccgacacgttctacaatcagctgcaggtgca

SEQ ID NO: 4643 - DNA, 39 bp, Artificial Sequence
  Synthetic
gctgttgcgacggcgaatgacgcaccaagtcaaatccac

SEQ ID NO: 4644 - DNA, 36 bp, Artificial Sequence
  Synthetic
ccggagcgtggcggtacaaggtgcgacgacccttct

SEQ ID NO: 4645 - DNA, 38 bp, Artificial Sequence
  Synthetic
cgtgtcgtacgcgcaccgttgataccgcggaatcaacg

SEQ ID NO: 4646 - DNA, 42 bp, Artificial Sequence
  Synthetic
tcagctccgaggctaggttagctgatcgacatgaagaccgcc

SEQ ID NO: 4647 - DNA, 40 bp, Artificial Sequence
  Synthetic
gaggcccatgatgagtagtcgcgccctggatcgtacccat

SEQ ID NO: 4648 - DNA, 38 bp, Artificial Sequence
  Synthetic
gcggccggcatcaggagaaacctcaagacgctgctagt

SEQ ID NO: 4649 - DNA, 39 bp, Artificial Sequence
  Synthetic
ccgatagcggttcctcagccaggtaacgcgcatctcagc

SEQ ID NO: 4650 - DNA, 35 bp, Artificial Sequence
  Synthetic
agggtggtccgcgttccgttgtgccacccggtgct

SEQ ID NO: 4651 - DNA, 37 bp, Artificial Sequence
  Synthetic
ccgaccagttctccatcgcgtgctttccccgagctcc

SEQ ID NO: 4652 - DNA, 39 bp, Artificial Sequence
  Synthetic
cccgtggccgtaccctgttgtaccagatgttcaccgtgg

SEQ ID NO: 4653 - DNA, 40 bp, Artificial Sequence
  Synthetic
cacgcatgtgctacgcggattagaggctcggcaattctcg

SEQ ID NO: 4654 - DNA, 36 bp, Artificial Sequence
  Synthetic
cgacgagcgcgggtcacaaacgtcgaacgcgatcgg

SEQ ID NO: 4655 - DNA, 38 bp, Artificial Sequence
  Synthetic
ctgacgccacgccgccattgtgttcctgataggcccgg

SEQ ID NO: 4656 - DNA, 35 bp, Artificial Sequence
  Synthetic
tgctgctctgcacgctctgacaccaaccaggcggc

SEQ ID NO: 4657 - DNA, 39 bp, Artificial Sequence
  Synthetic
gcgtcgcccttctccgtgatcaacgtggtctcttacgtg

SEQ ID NO: 4658 - DNA, 39 bp, Artificial Sequence
  Synthetic
cgtcgtggagacaagcaacaccagttttgggggcggagg

SEQ ID NO: 4659 - DNA, 37 bp, Artificial Sequence
  Synthetic
gtgctcagcggcgtgtacagcttggatcacgtcggcg

SEQ ID NO: 4660 - DNA, 36 bp, Artificial Sequence
  Synthetic
ggtagcgcttgcggcacaccacctcctgcatctcca

SEQ ID NO: 4661 - DNA, 39 bp, Artificial Sequence
  Synthetic
gcagcggcgagaggagaggattcaggtggatcctccgtc

SEQ ID NO: 4662 - DNA, 38 bp, Artificial Sequence
  Synthetic
tcctctcagtttccccgtctccacgtcgaaaccccggc

SEQ ID NO: 4663 - DNA, 37 bp, Artificial Sequence
  Synthetic
gtggtgccgtccacgtcgtgcaagccgtggtaaccgt

SEQ ID NO: 4664 - DNA, 35 bp, Artificial Sequence
  Synthetic
gcacgcgcgtttccccgtaagcgccgacaactccg

SEQ ID NO: 4665 - DNA, 37 bp, Artificial Sequence
  Synthetic
cggcaagctcacgcactgccgtagctcatttgcgccg

SEQ ID NO: 4666 - DNA, 35 bp, Artificial Sequence
  Synthetic
cggaacgtgacggttgccgttttccccgccggtgg

SEQ ID NO: 4667 - DNA, 37 bp, Artificial Sequence
  Synthetic
tgacgacggggaggatgacgagccactaccgcagagc

SEQ ID NO: 4668 - DNA, 39 bp, Artificial Sequence
  Synthetic
atcggctcgtatcccgaagtgctcagagacgcgttccgc

SEQ ID NO: 4669 - DNA, 36 bp, Artificial Sequence
  Synthetic
ccgtcctggcacgcctcttcagacgcagacaggtgc

SEQ ID NO: 4670 - DNA, 39 bp, Artificial Sequence
  Synthetic
cccggcgtgctgttggtctccgttgccgtagaagaagtt

SEQ ID NO: 4671 - DNA, 38 bp, Artificial Sequence
  Synthetic
agagcctcacctgcgtgacgtttctgggctactccgcc

SEQ ID NO: 4672 - DNA, 40 bp, Artificial Sequence
  Synthetic
gagcacttgcggctccatgagctggaggtccatacggatt

SEQ ID NO: 4673 - DNA, 37 bp, Artificial Sequence
  Synthetic
gcccgtcgtagcgcagaataagctgctgttcaccacg

SEQ ID NO: 4674 - DNA, 40 bp, Artificial Sequence
  Synthetic
caacgccgcgtgtaacttccacgctctttgacaccatcac

SEQ ID NO: 4675 - DNA, 36 bp, Artificial Sequence
  Synthetic
atatgtgggagcgcaaggccagaggtcctcgcaggc

SEQ ID NO: 4676 - DNA, 36 bp, Artificial Sequence
  Synthetic
gcgactttaccgcgaacgccggtctgcgtgggcgaa

SEQ ID NO: 4677 - DNA, 41 bp, Artificial Sequence
  Synthetic
tgcctgtccaaccaccatgacgtgtgatccatgagttcggc

SEQ ID NO: 4678 - DNA, 40 bp, Artificial Sequence
  Synthetic
gctcatgcagcgtctcacggggcgattgtaggtaacgagc

SEQ ID NO: 4679 - DNA, 36 bp, Artificial Sequence
  Synthetic
acaccagcgacaacgtgctctgcaccacctcggggt

SEQ ID NO: 4680 - DNA, 38 bp, Artificial Sequence
  Synthetic
cgtgtgcaccaccgtggagactcttggcgatggtcatg

SEQ ID NO: 4681 - DNA, 36 bp, Artificial Sequence
  Synthetic
cgtgcaccacggtgaacacgttgcctggacgcctgg

SEQ ID NO: 4682 - DNA, 39 bp, Artificial Sequence
  Synthetic
ggcgctgtgtccgagctcacctgctgtacaacaatccgg

SEQ ID NO: 4683 - DNA, 40 bp, Artificial Sequence
  Synthetic
ccaggtgagaaagagaagccgcctctcatcgtgccgcaga

SEQ ID NO: 4684 - DNA, 39 bp, Artificial Sequence
  Synthetic
cggcagcggtggtactggtatgcttactgtgtgaagcgg

SEQ ID NO: 4685 - DNA, 35 bp, Artificial Sequence
  Synthetic
gtccagaacgcggttgggaacgccacaggccgtag

SEQ ID NO: 4686 - DNA, 40 bp, Artificial Sequence
  Synthetic
catgttgccgtgtgacgagacgaggtgacgcgacctcctg

SEQ ID NO: 4687 - DNA, 41 bp, Artificial Sequence
  Synthetic
tgggcgatgcacaactctttctgctacggctgctgatacga

SEQ ID NO: 4688 - DNA, 35 bp, Artificial Sequence
  Synthetic
ggtggtggtgggcatcgtgcgctcggcagctcctt

SEQ ID NO: 4689 - DNA, 40 bp, Artificial Sequence
  Synthetic
gtcgcctcggtagctcagtagtctacggaccgtctgtcga

SEQ ID NO: 4690 - DNA, 48 bp, Artificial Sequence
  Synthetic
cgataggcggctataagatagagattgtctctctttatctttcttgtg

SEQ ID NO: 4691 - DNA, 41 bp, Artificial Sequence
  Synthetic
tatggttcttaggcgcgcatcaagtcatgattcgtaactgc

SEQ ID NO: 4692 - DNA, 38 bp, Artificial Sequence
  Synthetic
ccggcgtgcagcaaggttcgcttcgtaattctgacgca

SEQ ID NO: 4693 - DNA, 38 bp, Artificial Sequence
  Synthetic
tccctcggcgaccaacaccaagatgtgggccgagaact

SEQ ID NO: 4694 - DNA, 37 bp, Artificial Sequence
  Synthetic
gtagcgggagatacggcgttcaagccgccgttcaagc

SEQ ID NO: 4695 - DNA, 39 bp, Artificial Sequence
  Synthetic
gctatcgtcgccggtttcgggtggtggacgagacgagac

SEQ ID NO: 4696 - DNA, 37 bp, Artificial Sequence
  Synthetic
tcggcgttttcgggaagggcaaacccaagccggtcgg

SEQ ID NO: 4697 - DNA, 36 bp, Artificial Sequence
  Synthetic
cgacgcgatcacggtaaccctacgctagcggggctg

SEQ ID NO: 4698 - DNA, 42 bp, Artificial Sequence
  Synthetic
gcgttgtctcgcctatcagcgttaacgtgggtttcaggggaa

SEQ ID NO: 4699 - DNA, 37 bp, Artificial Sequence
  Synthetic
tacgagaccccgaggtacgcactgcagaccgtacggg

SEQ ID NO: 4700 - DNA, 36 bp, Artificial Sequence
  Synthetic
cggaacggcgtttcactgccttctgcaccgccgacg

SEQ ID NO: 4701 - DNA, 37 bp, Artificial Sequence
  Synthetic
gcgtggcagggctggaagaacccagcactccatcgac

SEQ ID NO: 4702 - DNA, 37 bp, Artificial Sequence
  Synthetic
accggtgtggaagccgaggcatacgccacagcatgcg

SEQ ID NO: 4703 - DNA, 35 bp, Artificial Sequence
  Synthetic
acatgggccatgtgtggtggtgtgcactgccgcga

SEQ ID NO: 4704 - DNA, 40 bp, Artificial Sequence
  Synthetic
ctccgggttcctgccttttccaaggccgtggaaaaccacc

SEQ ID NO: 4705 - DNA, 40 bp, Artificial Sequence
  Synthetic
aacaacgcagactgctgaaggccaggcatgggtctgtcga

SEQ ID NO: 4706 - DNA, 37 bp, Artificial Sequence
  Synthetic
agcttctccccgactccgcgagactggcagggacacg

SEQ ID NO: 4707 - DNA, 40 bp, Artificial Sequence
  Synthetic
cgataccaccacattcaggggcctggccgtcctgttcctg

SEQ ID NO: 4708 - DNA, 35 bp, Artificial Sequence
  Synthetic
gggactttccacacggcggaccgttgacgtgggcg

SEQ ID NO: 4709 - DNA, 40 bp, Artificial Sequence
  Synthetic
tcgacgacaggtgcggattagtgcgacagacatccccctg

SEQ ID NO: 4710 - DNA, 41 bp, Artificial Sequence
  Synthetic
caacaataccgccctacgttggttcagtgttggatcagact

SEQ ID NO: 4711 - DNA, 38 bp, Artificial Sequence
  Synthetic
ggacgtaacattcggacacggactcgcgggtttgggga

SEQ ID NO: 4712 - DNA, 35 bp, Artificial Sequence
  Synthetic
ggcgacgacagttccgtgggaaggcaccgcgacag

SEQ ID NO: 4713 - DNA, 35 bp, Artificial Sequence
  Synthetic
ccggcggtggtgaacgagaaccccagcaacggcct

SEQ ID NO: 4714 - DNA, 41 bp, Artificial Sequence
  Synthetic
gtaacccagccaaaccagcgcgattgctgacgctggaaacc

SEQ ID NO: 4715 - DNA, 36 bp, Artificial Sequence
  Synthetic
ccgtgccatcggtgggtaccagagaacgcagcgcac

SEQ ID NO: 4716 - DNA, 40 bp, Artificial Sequence
  Synthetic
gcgagaaccggtcgctcatagctcctcctggtgcctgtgg

SEQ ID NO: 4717 - DNA, 37 bp, Artificial Sequence
  Synthetic
ggaggctatatgaccgcgcggggccgcccaaacatct

SEQ ID NO: 4718 - DNA, 41 bp, Artificial Sequence
  Synthetic
ccttcatcgcgtttgccgtgccccttgagtttgatggtgcc

SEQ ID NO: 4719 - DNA, 39 bp, Artificial Sequence
  Synthetic
aaacgggcgcggttttataggccgggactttgacagccg

SEQ ID NO: 4720 - DNA, 40 bp, Artificial Sequence
  Synthetic
agctgatgcatttccagcgacgtctcctttacggggctgg

SEQ ID NO: 4721 - DNA, 38 bp, Artificial Sequence
  Synthetic
ttctctgtggtcggcgagtctgggcctgaagcgatgga

SEQ ID NO: 4722 - DNA, 37 bp, Artificial Sequence
  Synthetic
gcagtgctacggtggttccctacgatcctccggcgct

SEQ ID NO: 4723 - DNA, 38 bp, Artificial Sequence
  Synthetic
tggtaaagtgaagacgcgccgcaggctggaacgcaacg

SEQ ID NO: 4724 - DNA, 38 bp, Artificial Sequence
  Synthetic
gtgacgcagcagcatcgctccacagacgccgtttgcta

SEQ ID NO: 4725 - DNA, 41 bp, Artificial Sequence
  Synthetic
acacctggtcgacgtggttacgttgagtgccagtacagcgc

SEQ ID NO: 4726 - DNA, 36 bp, Artificial Sequence
  Synthetic
gtcagggccagaacccgcaggtgacgccggttgtcc

SEQ ID NO: 4727 - DNA, 40 bp, Artificial Sequence
  Synthetic
ccctgctgttggctacctctctttcctgtgcaccgtcatc

SEQ ID NO: 4728 - DNA, 39 bp, Artificial Sequence
  Synthetic
cgcatctgctcgccgtagattggatgattttgcgcgaca

SEQ ID NO: 4729 - DNA, 38 bp, Artificial Sequence
  Synthetic
acgagcacgcttccgaggggaagatcgtcctctcgccg

SEQ ID NO: 4730 - DNA, 39 bp, Artificial Sequence
  Synthetic
gaccgagccagagggacctccgacaggtaagatgtggct

SEQ ID NO: 4731 - DNA, 36 bp, Artificial Sequence
  Synthetic
cgtggaaaaccacccggcagtcctccgggttcctgc

SEQ ID NO: 4732 - DNA, 40 bp, Artificial Sequence
  Synthetic
cgggggggtgaaatttggagtgcagcacacgcaactagtc

SEQ ID NO: 4733 - DNA, 47 bp, Artificial Sequence
  Synthetic
aagttcgctgcaatatgcacaccaatgaaatggaagtctgaatacat

SEQ ID NO: 4734 - DNA, 48 bp, Artificial Sequence
  Synthetic
aggaaaaccgattcactgaaattggtcggattttatcttgttagcttt

SEQ ID NO: 4735 - DNA, 39 bp, Artificial Sequence
  Synthetic
aatcacagggaccatgcgtaaaggctggagaagttaggt

SEQ ID NO: 4736 - DNA, 42 bp, Artificial Sequence
  Synthetic
ctgcaaagatattggcgatctgatgctatcgatctgagctct

SEQ ID NO: 4737 - DNA, 39 bp, Artificial Sequence
  Synthetic
cattgcagggccactgagtaccatccatggctgcacaag

SEQ ID NO: 4738 - DNA, 42 bp, Artificial Sequence
  Synthetic
ttctcccttactgacccaaggcctacttcaagaacacagtac

SEQ ID NO: 4739 - DNA, 39 bp, Artificial Sequence
  Synthetic
aaacagatcggagacatggccaaggttctgcacaccttc

SEQ ID NO: 4740 - DNA, 41 bp, Artificial Sequence
  Synthetic
agaatggttagcggcattggggaatcagcctcccttcattg

SEQ ID NO: 4741 - DNA, 40 bp, Artificial Sequence
  Synthetic
gcgacaagcgaacaatggagatgccatatcatcagatggg

SEQ ID NO: 4742 - DNA, 43 bp, Artificial Sequence
  Synthetic
agaaggacaagaattgcatatgagagtgctgctgtttggaatt

SEQ ID NO: 4743 - DNA, 48 bp, Artificial Sequence
  Synthetic
atgagaacatggaagcaatggacttcttatagcccaatatctacttct

SEQ ID NO: 4744 - DNA, 40 bp, Artificial Sequence
  Synthetic
ggaagtgaaaattgatgacggcgaggctcagagttcactc

SEQ ID NO: 4745 - DNA, 46 bp, Artificial Sequence
  Synthetic
tttggtggacaacttttttaacgagtcgtaaagagacggaacataa

SEQ ID NO: 4746 - DNA, 40 bp, Artificial Sequence
  Synthetic
aagacgagcaagacgagaacgggttccctatcagcggcag

SEQ ID NO: 4747 - DNA, 44 bp, Artificial Sequence
  Synthetic
agaggaagaaagagaacaaacagtgcaggtgctcaaagtccatt

SEQ ID NO: 4748 - DNA, 43 bp, Artificial Sequence
  Synthetic
aaacacttcaggtttttggaggttcaccctatttaccaccttg

SEQ ID NO: 4749 - DNA, 40 bp, Artificial Sequence
  Synthetic
ctgccgacgttgcaagaggatttacttctccaccaccgca

SEQ ID NO: 4750 - DNA, 46 bp, Artificial Sequence
  Synthetic
tataggtaacggggcaatagttgagtgcattcgacatctaaaagca

SEQ ID NO: 4751 - DNA, 45 bp, Artificial Sequence
  Synthetic
tgaagggaatggctattttaaagcacaaaacgtcgcatagtttga

SEQ ID NO: 4752 - DNA, 40 bp, Artificial Sequence
  Synthetic
tgatgatactcgacatcgttgctagcacaatgggacgaag

SEQ ID NO: 4753 - DNA, 41 bp, Artificial Sequence
  Synthetic
cgcttctacggctcgcagtatagcattcgaagccaagtgat

SEQ ID NO: 4754 - DNA, 40 bp, Artificial Sequence
  Synthetic
gcattaggccatctttgggatcactaacccggaacatgaa

SEQ ID NO: 4755 - DNA, 40 bp, Artificial Sequence
  Synthetic
cgaaaacggtgtagccagtactttccatgcctttccttct

SEQ ID NO: 4756 - DNA, 39 bp, Artificial Sequence
  Synthetic
ttaacgaggtgcagctgccgcgcgtccgacaaatgatga

SEQ ID NO: 4757 - DNA, 40 bp, Artificial Sequence
  Synthetic
gggtttggctggctgttgctggacaaaaccctcgtccatt

SEQ ID NO: 4758 - DNA, 39 bp, Artificial Sequence
  Synthetic
ggcgtacagttttggagccaagttattgtggcgcagatg

SEQ ID NO: 4759 - DNA, 42 bp, Artificial Sequence
  Synthetic
ctctgacacaaaagctctagtccaaacgatcggtacccttcc

SEQ ID NO: 4760 - DNA, 47 bp, Artificial Sequence
  Synthetic
acgtgtcagtttctataaacgatgatgatcaaatggaagaaagccta

SEQ ID NO: 4761 - DNA, 41 bp, Artificial Sequence
  Synthetic
tgcgctcgtcagatagcaagccggtgaagtagttaccagcg

SEQ ID NO: 4762 - DNA, 40 bp, Artificial Sequence
  Synthetic
agtaggatagcacctgccgccgcgccttcacatgagctat

SEQ ID NO: 4763 - DNA, 44 bp, Artificial Sequence
  Synthetic
agcatataaaactgatttaccgcctttaagaaaggctgcacaag

SEQ ID NO: 4764 - DNA, 47 bp, Artificial Sequence
  Synthetic
aagcggttattgattacctgagcgagttgtatatagtaggacacaat

SEQ ID NO: 4765 - DNA, 43 bp, Artificial Sequence
  Synthetic
agagtctttttcccattggtccctcttgtcaaacatgccttac

SEQ ID NO: 4766 - DNA, 38 bp, Artificial Sequence
  Synthetic
gcatcgttgcacgggctgtactgctttctggtgcgagg

SEQ ID NO: 4767 - DNA, 41 bp, Artificial Sequence
  Synthetic
cggaaacgggaaatcagggcggcggacatgcttttctctct

SEQ ID NO: 4768 - DNA, 35 bp, Artificial Sequence
  Synthetic
ggttcgggtcctgcgggaatcccctgccagagcgt

SEQ ID NO: 4769 - DNA, 44 bp, Artificial Sequence
  Synthetic
gctgcaaggtcattagatatccgggaacgaaattggactaaacg

SEQ ID NO: 4770 - DNA, 40 bp, Artificial Sequence
  Synthetic
gctcgaccgttttcacgtggtgcaacgcctcatttcccat

SEQ ID NO: 4771 - DNA, 42 bp, Artificial Sequence
  Synthetic
ttgaagtaagctgttttaagcccagcctgcgaattcaacaag

SEQ ID NO: 4772 - DNA, 43 bp, Artificial Sequence
  Synthetic
taagctcctgcattaatggtgtagacacagaaactgtacagcc

SEQ ID NO: 4773 - DNA, 42 bp, Artificial Sequence
  Synthetic
tgttgctcgcataaattcgcggcgtggcaactattgaacgct

SEQ ID NO: 4774 - DNA, 42 bp, Artificial Sequence
  Synthetic
gctatgagcacaagtgaggcgcaagactcctctccgtgtctg

SEQ ID NO: 4775 - DNA, 35 bp, Artificial Sequence
  Synthetic
gacaacagcggggaggaagcaaatccgcggcgcag

SEQ ID NO: 4776 - DNA, 48 bp, Artificial Sequence
  Synthetic
tgtacataatccagcaagtaaaccccattgtctctactatgttgaact

SEQ ID NO: 4777 - DNA, 38 bp, Artificial Sequence
  Synthetic
tgctgacgtcactggcgatgacgccggtcgctgcatct

SEQ ID NO: 4778 - DNA, 38 bp, Artificial Sequence
  Synthetic
catccgcaaagatgaggctgctgttatagcgtgccacg

SEQ ID NO: 4779 - DNA, 44 bp, Artificial Sequence
  Synthetic
caaacgtccaggcagggtttcttgcaaatttttaaaagcctgag

SEQ ID NO: 4780 - DNA, 41 bp, Artificial Sequence
  Synthetic
ccccctcctggattttacactgactgtccgtaacatcatcc

SEQ ID NO: 4781 - DNA, 42 bp, Artificial Sequence
  Synthetic
cacatgcgggggatgaaggaagagcaaatgggtttcctgacc

SEQ ID NO: 4782 - DNA, 43 bp, Artificial Sequence
  Synthetic
gtttaccaccaaatttaaggccaggatggtttggccttcgttg

SEQ ID NO: 4783 - DNA, 41 bp, Artificial Sequence
  Synthetic
aactccgggagtgtacactaatgaaaatcaaccccgcaacc

SEQ ID NO: 4784 - DNA, 39 bp, Artificial Sequence
  Synthetic
tatcgcagctggtatttggcagtccatgaccgaactcct

SEQ ID NO: 4785 - DNA, 39 bp, Artificial Sequence
  Synthetic
cgtacgcggacattaccgagccgtctacagtggtgcgac

SEQ ID NO: 4786 - DNA, 38 bp, Artificial Sequence
  Synthetic
gctgcggccgcaacagctatcgcgcacccagtatacat

SEQ ID NO: 4787 - DNA, 41 bp, Artificial Sequence
  Synthetic
cgcccagacgtagggtacagtccgggagaaaaaaccactgt

SEQ ID NO: 4788 - DNA, 46 bp, Artificial Sequence
  Synthetic
acgtactagagcacatgaaggtcttttttatcggacgtacttttac

SEQ ID NO: 4789 - DNA, 39 bp, Artificial Sequence
  Synthetic
cgccgtagacgtcgacgcattgtacaacgcgacgtactg

SEQ ID NO: 4790 - DNA, 42 bp, Artificial Sequence
  Synthetic
ccaaccaaaggagaaaagcggcggttctgttgtgtgcgttac

SEQ ID NO: 4791 - DNA, 38 bp, Artificial Sequence
  Synthetic
cactccctcgatgatgccgcactccgaggcatcctgac

SEQ ID NO: 4792 - DNA, 42 bp, Artificial Sequence
  Synthetic
ttaagccctattccggaaccgcttgtgaagcattaggagcgc

SEQ ID NO: 4793 - DNA, 44 bp, Artificial Sequence
  Synthetic
ctgctcaagttgtgttctataccggcttaaacacaagatgcgtg

SEQ ID NO: 4794 - DNA, 42 bp, Artificial Sequence
  Synthetic
cgttcgcgttattgagaatcacgcctactgcgctaagaggaa

SEQ ID NO: 4795 - DNA, 46 bp, Artificial Sequence
  Synthetic
aacaagaacacctacgagtacatgcgatattgacataggtatccac

SEQ ID NO: 4796 - DNA, 40 bp, Artificial Sequence
  Synthetic
gggaaatgatcttcgggtggatgtgccatgggaaaaaagt

SEQ ID NO: 4797 - DNA, 44 bp, Artificial Sequence
  Synthetic
gtgtcaatcatgtttgactcctccttcatttggggttagcaaac

SEQ ID NO: 4798 - DNA, 39 bp, Artificial Sequence
  Synthetic
ggatacctgggccccactatcacagctgtttggcctata

SEQ ID NO: 4799 - DNA, 40 bp, Artificial Sequence
  Synthetic
tttccgggttttgtgtctcgcggtgtacgcccccagtttc

SEQ ID NO: 4800 - DNA, 45 bp, Artificial Sequence
  Synthetic
atggataaaaatcccactatggacccctgaggactttgtagcata

SEQ ID NO: 4801 - DNA, 40 bp, Artificial Sequence
  Synthetic
ccacagctggcgcacaagttggccctaattgcgacttcaa

SEQ ID NO: 4802 - DNA, 46 bp, Artificial Sequence
  Synthetic
gctatttgagccttcattccttcaggaataattctttctccggaaa

SEQ ID NO: 4803 - DNA, 39 bp, Artificial Sequence
  Synthetic
accggtgggttcccaggaatttcaggagctcatgggacg

SEQ ID NO: 4804 - DNA, 42 bp, Artificial Sequence
  Synthetic
acattcttttcattttcgtcgctgaaatggaaaccaggcagg

SEQ ID NO: 4805 - DNA, 40 bp, Artificial Sequence
  Synthetic
aaaacgctgggctcgaggactgctttgtcgctgtagatgt

SEQ ID NO: 4806 - DNA, 45 bp, Artificial Sequence
  Synthetic
ttcttgctttaagggctggcgacctaaaccttcaaaaattttagg

SEQ ID NO: 4807 - DNA, 42 bp, Artificial Sequence
  Synthetic
atggaaagccggttgtaagcgacgctgttgtagttcgttgga

SEQ ID NO: 4808 - DNA, 43 bp, Artificial Sequence
  Synthetic
aaccttcgagaactaaacaaactgttgtccgttcgtcaaaacc

SEQ ID NO: 4809 - DNA, 42 bp, Artificial Sequence
  Synthetic
ttcacgacgaacctaagacttaccggttcaaatttgcgcagg

SEQ ID NO: 4810 - DNA, 41 bp, Artificial Sequence
  Synthetic
cgcagcaacgctcaaagaaacactgcctgactctcccaaga

SEQ ID NO: 4811 - DNA, 42 bp, Artificial Sequence
  Synthetic
tgtagcctgctttcagcactgcgaatcgccactccatcatgg

SEQ ID NO: 4812 - DNA, 43 bp, Artificial Sequence
  Synthetic
ccgcagctgtctctacctcaagtatttattgaacagagcttct

SEQ ID NO: 4813 - DNA, 42 bp, Artificial Sequence
  Synthetic
ttaaccctccctcttggccagccgaggcaaaagtacagtggt

SEQ ID NO: 4814 - DNA, 43 bp, Artificial Sequence
  Synthetic
tgaagatttctgctgtcatttgtgtcttcttcaggcggtacag

SEQ ID NO: 4815 - DNA, 42 bp, Artificial Sequence
  Synthetic
ttgttgctccagttattgacaaacgaaggagaaactgcctcg

SEQ ID NO: 4816 - DNA, 41 bp, Artificial Sequence
  Synthetic
gtatgctcaaacagccgaaagaagggttacattatggccag

SEQ ID NO: 4817 - DNA, 43 bp, Artificial Sequence
  Synthetic
atacggtaagggcagcccaaagcttttagtaatacctgaaaca

SEQ ID NO: 4818 - DNA, 41 bp, Artificial Sequence
  Synthetic
ttctcatctttttatgcctgccaatcaaggtcactgactgc

SEQ ID NO: 4819 - DNA, 39 bp, Artificial Sequence
  Synthetic
cccccaggatgatttacccctaacaacagaaggaggacg

SEQ ID NO: 4820 - DNA, 38 bp, Artificial Sequence
  Synthetic
tcaactgtgctacacgctgcaataggtaccgagcccac

SEQ ID NO: 4821 - DNA, 43 bp, Artificial Sequence
  Synthetic
aaatggaaggtcagattcttcttcccatactgggttctgctgc

SEQ ID NO: 4822 - DNA, 45 bp, Artificial Sequence
  Synthetic
tcacaaggtcttaaactttcttggatcttgtgttaagtgtgaggg

SEQ ID NO: 4823 - DNA, 42 bp, Artificial Sequence
  Synthetic
aatggtgagctccgatgggttggacaaggctaaggaaccgtt

SEQ ID NO: 4824 - DNA, 43 bp, Artificial Sequence
  Synthetic
ctgtccttaagacggggattggagttgttaagttccagtttgt

SEQ ID NO: 4825 - DNA, 43 bp, Artificial Sequence
  Synthetic
ctggttccccaagcttcgtgtaacagtattggtagacactgat

SEQ ID NO: 4826 - DNA, 42 bp, Artificial Sequence
  Synthetic
tacactatacgcgtggttaaactgtacaaagggggaaaggga

SEQ ID NO: 4827 - DNA, 43 bp, Artificial Sequence
  Synthetic
cgcccaaggattctctcgtttaattatgcatcatcgagcaatt

SEQ ID NO: 4828 - DNA, 41 bp, Artificial Sequence
  Synthetic
ccagctgacatacactgtagtgatacatggtcatgagcggt

SEQ ID NO: 4829 - DNA, 38 bp, Artificial Sequence
  Synthetic
ttcctcacagggcggtagttcagacggtatcgctacag

SEQ ID NO: 4830 - DNA, 43 bp, Artificial Sequence
  Synthetic
ccgctgtgctggtgaaagatttgaacatttggaaaatcgctta

SEQ ID NO: 4831 - DNA, 43 bp, Artificial Sequence
  Synthetic
gcaaagaaagttcacctccaggttgtgcaagttgtatgttctg

SEQ ID NO: 4832 - DNA, 39 bp, Artificial Sequence
  Synthetic
ctggcaaacgggtggaaaaaccgtgttttgcgatgttcg

SEQ ID NO: 4833 - DNA, 39 bp, Artificial Sequence
  Synthetic
catagccccaggtcccgtaatctggtaaggcattatggc

SEQ ID NO: 4834 - DNA, 40 bp, Artificial Sequence
  Synthetic
gcctatggctggtcgctcaaacatctagcctcatctgcca

SEQ ID NO: 4835 - DNA, 41 bp, Artificial Sequence
  Synthetic
gttgaggcttgtgggttttccgcacagcgtcttgggttgtt

SEQ ID NO: 4836 - DNA, 40 bp, Artificial Sequence
  Synthetic
gcctgagcaccagttggcttatgggtgtgctcatagctca

SEQ ID NO: 4837 - DNA, 39 bp, Artificial Sequence
  Synthetic
gaatgcctagtggggctaacctggtggggtgaaatcctg

SEQ ID NO: 4838 - DNA, 41 bp, Artificial Sequence
  Synthetic
acagaaggtggctttatcacattccattatagcccctgtgg

SEQ ID NO: 4839 - DNA, 48 bp, Artificial Sequence
  Synthetic
tcaagagctggaaaataaacttccatcaaatctaacataggtgaacaa

SEQ ID NO: 4840 - DNA, 47 bp, Artificial Sequence
  Synthetic
gtaccaattacaacaagcaaaagcctgttaaggaaatgttttggctc

SEQ ID NO: 4841 - DNA, 41 bp, Artificial Sequence
  Synthetic
gatggtgactgcaggtggagtgagctgtagtttctcaagtc

SEQ ID NO: 4842 - DNA, 40 bp, Artificial Sequence
  Synthetic
atccaagttcattgactggctgtaatgtgtccgacttgcg

SEQ ID NO: 4843 - DNA, 43 bp, Artificial Sequence
  Synthetic
tttgtcagatggtttcaagcactctctgcccttatcttcaaga

SEQ ID NO: 4844 - DNA, 45 bp, Artificial Sequence
  Synthetic
cattgtagatcttcttagtgcctcccatccctctttctcacagaa

SEQ ID NO: 4845 - DNA, 47 bp, Artificial Sequence
  Synthetic
ataacgattttgtggctagatcgaaggtagtctggtatgaatcttct

SEQ ID NO: 4846 - DNA, 39 bp, Artificial Sequence
  Synthetic
cgctgtgttgacccagaaagcttggacaaaacagctgtt

SEQ ID NO: 4847 - DNA, 44 bp, Artificial Sequence
  Synthetic
gtaatctctatgctggcttccatgatcacaccctatagctgaac

SEQ ID NO: 4848 - DNA, 44 bp, Artificial Sequence
  Synthetic
atggattgacaataacacctgctgcattatcccagttgactttc

SEQ ID NO: 4849 - DNA, 43 bp, Artificial Sequence
  Synthetic
ttctgcagacgattcgacatttagatcgacagtatgagaacaa

SEQ ID NO: 4850 - DNA, 48 bp, Artificial Sequence
  Synthetic
tcggtggttccatttagaatagacagcagcatacaatgtaattcttac

SEQ ID NO: 4851 - DNA, 48 bp, Artificial Sequence
  Synthetic
tgcactgacagtatagatacgttgggttagaaatgtttgaatcgtcat

SEQ ID NO: 4852 - DNA, 46 bp, Artificial Sequence
  Synthetic
tgaaagacacagcaaaaggagattgaattttcagcttcatcttcga

SEQ ID NO: 4853 - DNA, 41 bp, Artificial Sequence
  Synthetic
ctgtttttggacaaacaccgggttgctgcttgatgacttac

SEQ ID NO: 4854 - DNA, 49 bp, Artificial Sequence
  Synthetic
ctcatattgagtcacaggagagcagcattttcttttctgatattttccc

SEQ ID NO: 4855 - DNA, 43 bp, Artificial Sequence
  Synthetic
ggactgtgcattttaaaacccaagtgtcgaaggaggaggagta

SEQ ID NO: 4856 - DNA, 39 bp, Artificial Sequence
  Synthetic
gtcaggagaaaccccccgcattcggtctctcctcctcct

SEQ ID NO: 4857 - DNA, 43 bp, Artificial Sequence
  Synthetic
actgtttggaactgggttggagtcagtgctatcaaatgcaata

SEQ ID NO: 4858 - DNA, 45 bp, Artificial Sequence
  Synthetic
gggaagtgtaatatacctaggaggcggattatacccagttgaccc

SEQ ID NO: 4859 - DNA, 48 bp, Artificial Sequence
  Synthetic
ttctgttgtgccattagaggatctctcttgtatctccactatctactg

SEQ ID NO: 4860 - DNA, 44 bp, Artificial Sequence
  Synthetic
gagcctcagcaactccacatacaaatacattcagatcagatgac

SEQ ID NO: 4861 - DNA, 39 bp, Artificial Sequence
  Synthetic
cccagctttactgacacagccgcatcaaaggcgggattt

SEQ ID NO: 4862 - DNA, 44 bp, Artificial Sequence
  Synthetic
aattgggcaggcggttcattgataattcaatagcatcagcagta

SEQ ID NO: 4863 - DNA, 44 bp, Artificial Sequence
  Synthetic
atgattctgatcatgaacgcctaggtagtacctataccaagcgg

SEQ ID NO: 4864 - DNA, 43 bp, Artificial Sequence
  Synthetic
agaagagaacaactatatgccagactggtagagcatctcccat

SEQ ID NO: 4865 - DNA, 44 bp, Artificial Sequence
  Synthetic
tagagctacaagatgccctacactcaacaacccaaaaagacaaa

SEQ ID NO: 4866 - DNA, 47 bp, Artificial Sequence
  Synthetic
gtccgcaccccaataattatttgcggaaatttgaagaggatatgtcc

SEQ ID NO: 4867 - DNA, 37 bp, Artificial Sequence
  Synthetic
acagaccacgatccccacaccactgctgccgtgcgac

SEQ ID NO: 4868 - DNA, 44 bp, Artificial Sequence
  Synthetic
gccttaaccacaaattctttggccttactgaacgacatcgaaat

SEQ ID NO: 4869 - DNA, 42 bp, Artificial Sequence
  Synthetic
tgccagcctattcacatacctgactacattaacggtctccat

SEQ ID NO: 4870 - DNA, 36 bp, Artificial Sequence
  Synthetic
atcacatgagaacggcgcgacgtcgcgcgaattcgg

SEQ ID NO: 4871 - DNA, 48 bp, Artificial Sequence
  Synthetic
atgtcacatggatcatcaaccaaagttcttgagtagtcatatgttctt

SEQ ID NO: 4872 - DNA, 42 bp, Artificial Sequence
  Synthetic
attgtgtaatggaggcagaaacagtcttccttccgtaagtct

SEQ ID NO: 4873 - DNA, 44 bp, Artificial Sequence
  Synthetic
caggatgaacagtgatcagtttgctgttggcattcattccattt

SEQ ID NO: 4874 - DNA, 44 bp, Artificial Sequence
  Synthetic
aacagcttatcaccttctactgctcgctctaaattcttggagac

SEQ ID NO: 4875 - DNA, 39 bp, Artificial Sequence
  Synthetic
aagcgtgtttgaatcagcggtttcttctatggcctctcc

SEQ ID NO: 4876 - DNA, 42 bp, Artificial Sequence
  Synthetic
gaccagttgtgcaagacgttgcaaaacacacaattaatttgc

SEQ ID NO: 4877 - DNA, 44 bp, Artificial Sequence
  Synthetic
aacaagacatcttagacgtgctaattttctacttcacacagcgg

SEQ ID NO: 4878 - DNA, 45 bp, Artificial Sequence
  Synthetic
cagaagatgaggtggacgaagtgggtcactatttggaaatgttgt

SEQ ID NO: 4879 - DNA, 43 bp, Artificial Sequence
  Synthetic
cccaacaggtacacaaatatcagaccatgtcatacccactgtc

SEQ ID NO: 4880 - DNA, 38 bp, Artificial Sequence
  Synthetic
tccacgattggacgccattatggtttgaaacagccgtc

SEQ ID NO: 4881 - DNA, 39 bp, Artificial Sequence
  Synthetic
caggcacagcaggaatattggtaccaagtaatgctgccc

SEQ ID NO: 4882 - DNA, 49 bp, Artificial Sequence
  Synthetic
gcatttgaatatgcacaaaggggagcatattgctatttaaaaatgctcg

SEQ ID NO: 4883 - DNA, 46 bp, Artificial Sequence
  Synthetic
atggaagcaatagccaagcgtcagtactgttttcttcataaagttc

SEQ ID NO: 4884 - DNA, 43 bp, Artificial Sequence
  Synthetic
aacaagttatgaaatgtggcaaacattctacagttttgccccg

SEQ ID NO: 4885 - DNA, 43 bp, Artificial Sequence
  Synthetic
accagcaccaaagacggaacactttaaacaattggattcacct

SEQ ID NO: 4886 - DNA, 47 bp, Artificial Sequence
  Synthetic
ctgggatttatgtcactgcacctaatgtacagttgtattacaccaat

SEQ ID NO: 4887 - DNA, 45 bp, Artificial Sequence
  Synthetic
aactctacttgtgtgttactgtccccatcattgctgtgtggtaac

SEQ ID NO: 4888 - DNA, 41 bp, Artificial Sequence
  Synthetic
ccaggtgcaggttacagacctccccttcatatacagggtta

SEQ ID NO: 4889 - DNA, 40 bp, Artificial Sequence
  Synthetic
tactgcacctatgggaacaccaaacagggcctgtaggtaa

SEQ ID NO: 4890 - DNA, 42 bp, Artificial Sequence
  Synthetic
cagcagttctagacttcttgcagcagttttgttagcccgttt

SEQ ID NO: 4891 - DNA, 45 bp, Artificial Sequence
  Synthetic
tccagattatttacaaatggctgcaacatttgttccttccgtaga

SEQ ID NO: 4892 - DNA, 43 bp, Artificial Sequence
  Synthetic
acaatggtatttgttggggtaatcaatgttggtactgcgtgtg

SEQ ID NO: 4893 - DNA, 47 bp, Artificial Sequence
  Synthetic
cttttatgcactgtagccaactctaacagtaagagcaaaaaaatgtg

SEQ ID NO: 4894 - DNA, 38 bp, Artificial Sequence
  Synthetic
tggattaacccgctcaatgcccaggcctttcgcgaccc

SEQ ID NO: 4895 - DNA, 38 bp, Artificial Sequence
  Synthetic
cccagattgggtgtgcgcgtcttccacgaggttgcgac

SEQ ID NO: 4896 - DNA, 41 bp, Artificial Sequence
  Synthetic
ggctttggaggacgggatcaacgaaagaagtgccaagagga

SEQ ID NO: 4897 - DNA, 39 bp, Artificial Sequence
  Synthetic
tcgcagcgccatacatcggccccaccatcaaatccacat

SEQ ID NO: 4898 - DNA, 40 bp, Artificial Sequence
  Synthetic
cctcgtgggggtggcctattcaacccctgcaaagaggaat

SEQ ID NO: 4899 - DNA, 36 bp, Artificial Sequence
  Synthetic
cccactcggggtcgctaacaatcccgcatggccgag

SEQ ID NO: 4900 - DNA, 39 bp, Artificial Sequence
  Synthetic
gttcaccaaaacctgtggcgccctgaagcaatcggtggg

SEQ ID NO: 4901 - DNA, 39 bp, Artificial Sequence
  Synthetic
ccactacagcgtggcagatccatcaagccggtggagagg

SEQ ID NO: 4902 - DNA, 38 bp, Artificial Sequence
  Synthetic
ttctgatgctgcctgagagggcgacaacgatggcgccg

SEQ ID NO: 4903 - DNA, 42 bp, Artificial Sequence
  Synthetic
tcttgcagtcctggtctgtccagccctaagatggccagaaga

SEQ ID NO: 4904 - DNA, 40 bp, Artificial Sequence
  Synthetic
cctgtttcggccaggttggggtctccacccctttgatgtt

SEQ ID NO: 4905 - DNA, 39 bp, Artificial Sequence
  Synthetic
taacggcgtgatgtggaccggattgacaggtcccttcgg

SEQ ID NO: 4906 - DNA, 38 bp, Artificial Sequence
  Synthetic
cactgacaactcaacacccccaggtgcgtgtaggtgcg

SEQ ID NO: 4907 - DNA, 39 bp, Artificial Sequence
  Synthetic
ggtgcgccaatcacgtactcaatgtcgtatgcccctccg

SEQ ID NO: 4908 - DNA, 42 bp, Artificial Sequence
  Synthetic
aaagtgcgatgaactggccagactctgtagtaggctacggca

SEQ ID NO: 4909 - DNA, 41 bp, Artificial Sequence
  Synthetic
gggaggttgggcacataccgggcagtgtcaaacatgcctga

SEQ ID NO: 4910 - DNA, 39 bp, Artificial Sequence
  Synthetic
ccaagctgggacaccatgtggtctgtagaggaggggcgt

SEQ ID NO: 4911 - DNA, 42 bp, Artificial Sequence
  Synthetic
aacacctcccactagtcgagcacctaaggccttctgcttgaa

SEQ ID NO: 4912 - DNA, 40 bp, Artificial Sequence
  Synthetic
gattcgcgactccgatgcttctttttgccaaggcccacac

SEQ ID NO: 4913 - DNA, 36 bp, Artificial Sequence
  Synthetic
gaaggggccgtgcagtggaacacgtgattgcctcgc

SEQ ID NO: 4914 - DNA, 40 bp, Artificial Sequence
  Synthetic
aggctataagggagagtggcgcacctgccagatctgctcc

SEQ ID NO: 4915 - DNA, 41 bp, Artificial Sequence
  Synthetic
ccacgcccctaagtgcaaaccttgtgatcccactacgaacg

SEQ ID NO: 4916 - DNA, 41 bp, Artificial Sequence
  Synthetic
gtaccgctccccatgactcccagacccccacaagaggttag

SEQ ID NO: 4917 - DNA, 42 bp, Artificial Sequence
  Synthetic
tccctctcccaggaggaaacgggccaaagcggtagaaacaac

SEQ ID NO: 4918 - DNA, 40 bp, Artificial Sequence
  Synthetic
gcttgtaacaccttgcgcggtgaattgctcagggggctaa

SEQ ID NO: 4919 - DNA, 42 bp, Artificial Sequence
  Synthetic
taaccacatcagctccgtgtggtggccatgattgttgttgga

SEQ ID NO: 4920 - DNA, 40 bp, Artificial Sequence
  Synthetic
accgaaaaggacatcagggtcgatgactttgcgggcttcg

SEQ ID NO: 4921 - DNA, 35 bp, Artificial Sequence
  Synthetic
aggaggacaaccgagccctagcgtcacctggggga

SEQ ID NO: 4922 - DNA, 40 bp, Artificial Sequence
  Synthetic
atcgggttggtttacggtaggcggtcgggcatgagacatg

SEQ ID NO: 4923 - DNA, 45 bp, Artificial Sequence
  Synthetic
atacatatactgtgatcatgggcgttgattttcgtgagatccact

SEQ ID NO: 4924 - DNA, 42 bp, Artificial Sequence
  Synthetic
gagtacaacaaatcacactcgggcataacacacaacagcgtt

SEQ ID NO: 4925 - DNA, 42 bp, Artificial Sequence
  Synthetic
tatgggtgtgttcgggcaaatactgtgtaacctgatcttcct

SEQ ID NO: 4926 - DNA, 45 bp, Artificial Sequence
  Synthetic
gatggggtcttcaaaactactcttcgtgatccagaccaatgtgta

SEQ ID NO: 4927 - DNA, 49 bp, Artificial Sequence
  Synthetic
actgatccagatacatacaccagtgaagtataagagaagtttgatacca

SEQ ID NO: 4928 - DNA, 43 bp, Artificial Sequence
  Synthetic
gttgagaaaacgaaacagacggtgggactttttgtgtgtgttt

SEQ ID NO: 4929 - DNA, 43 bp, Artificial Sequence
  Synthetic
aagtgcttcaaaccccagtgttaaggcacactaaaccttgatg

SEQ ID NO: 4930 - DNA, 44 bp, Artificial Sequence
  Synthetic
acatcaatagggcgcacaaatcctttcctcttcttaattactgg

SEQ ID NO: 4931 - DNA, 44 bp, Artificial Sequence
  Synthetic
attaccccataatttgcgaaaagcacttgggtaataagggcttc

SEQ ID NO: 4932 - DNA, 39 bp, Artificial Sequence
  Synthetic
gttggagtgtatcgcagaggaagtgaacccgacaccaaa

SEQ ID NO: 4933 - DNA, 45 bp, Artificial Sequence
  Synthetic
tgtacatttccaaacactttcaggtactttctgaaccatccatca

SEQ ID NO: 4934 - DNA, 44 bp, Artificial Sequence
  Synthetic
tgcaattgcagaacacttcaattccatcaaagtgcttgggatct

SEQ ID NO: 4935 - DNA, 44 bp, Artificial Sequence
  Synthetic
ctaagccccccaacaatcttgtgcaaacatatatctaggtcaaa

SEQ ID NO: 4936 - DNA, 45 bp, Artificial Sequence
  Synthetic
atgattatgcaacaaaaactgggcaccaaagatcttaccagtagc

SEQ ID NO: 4937 - DNA, 49 bp, Artificial Sequence
  Synthetic
aacctgctgtattgagtgacaatgcccttgtacttagagaataatgatt

SEQ ID NO: 4938 - DNA, 43 bp, Artificial Sequence
  Synthetic
acaaagcattccatcaaaatcccgcacatcaggatcacaaccc

SEQ ID NO: 4939 - DNA, 48 bp, Artificial Sequence
  Synthetic
aagagatacttcaagcctgatcaacatgtatatctttcatgggcataa

SEQ ID NO: 4940 - DNA, 42 bp, Artificial Sequence
  Synthetic
tcattggtcgagagaaccacgctcgaccgaaatccacgaaag

SEQ ID NO: 4941 - DNA, 41 bp, Artificial Sequence
  Synthetic
ttgcagatgcagcaagtgtggagcataaaagcgctcgtggt

SEQ ID NO: 4942 - DNA, 40 bp, Artificial Sequence
  Synthetic
agtggaacgtggacgacctcaatcgtcaagcactgcgtac

SEQ ID NO: 4943 - DNA, 39 bp, Artificial Sequence
  Synthetic
ccggggttgagtgtgactgttcactgccaagctggacac

SEQ ID NO: 4944 - DNA, 38 bp, Artificial Sequence
  Synthetic
aagtgaaaacaacgcggcgcgaacgcctgcagatcgac

SEQ ID NO: 4945 - DNA, 46 bp, Artificial Sequence
  Synthetic
aagcaattgagtcttgtatggaagggcttcaaattttgcactaagc

SEQ ID NO: 4946 - DNA, 40 bp, Artificial Sequence
  Synthetic
caggctttgtgtagttgcaacagtcacgaaaaagcagtcg

SEQ ID NO: 4947 - DNA, 42 bp, Artificial Sequence
  Synthetic
agaagatgaagctacaaatgctgcttaaggagctctgcgtcc

SEQ ID NO: 4948 - DNA, 47 bp, Artificial Sequence
  Synthetic
catcagctagcttcacaggcaggagtcttctgttaattgattgtcat

SEQ ID NO: 4949 - DNA, 43 bp, Artificial Sequence
  Synthetic
agtaggatttttggatgatgccactccatctaatgcatttcgc

SEQ ID NO: 4950 - DNA, 38 bp, Artificial Sequence
  Synthetic
acctacaccaagaccccgcaagtgcttgcctcctcctg

SEQ ID NO: 4951 - DNA, 43 bp, Artificial Sequence
  Synthetic
tgaaagacttgaagaggaagctaggtaatggattagcaggccc

SEQ ID NO: 4952 - DNA, 39 bp, Artificial Sequence
  Synthetic
tcgcagacgaataaaacgagcatcaccaccttggacaca

SEQ ID NO: 4953 - DNA, 41 bp, Artificial Sequence
  Synthetic
taggccacgtcctaccatacccgcaacaggaaggacgtctg

SEQ ID NO: 4954 - DNA, 44 bp, Artificial Sequence
  Synthetic
gggacctttaagaagtacaccttttctgatataaatctcgcgcc

SEQ ID NO: 4955 - DNA, 42 bp, Artificial Sequence
  Synthetic
tattgcatttacagaacagccacgtaagcggcttacacgaat

SEQ ID NO: 4956 - DNA, 46 bp, Artificial Sequence
  Synthetic
atcagatgttcattgttggttgtgccacatggtttagctaaatccc

SEQ ID NO: 4957 - DNA, 49 bp, Artificial Sequence
  Synthetic
agatgtttcttttatggcaagagggtactccatctttacaaaacatgtg

SEQ ID NO: 4958 - DNA, 41 bp, Artificial Sequence
  Synthetic
taataggccattttgggtgcacaaagttcgtttccccatgc

SEQ ID NO: 4959 - DNA, 45 bp, Artificial Sequence
  Synthetic
tgtaccaactaggaatgctcacaggagtactggatgtataggtat

SEQ ID NO: 4960 - DNA, 43 bp, Artificial Sequence
  Synthetic
cgaaatcggtcgcttgtatagcacaaagtaaagtgtgccaaat

SEQ ID NO: 4961 - DNA, 41 bp, Artificial Sequence
  Synthetic
aacctaatgcaacctcgccagcgctggatgggatggttcca

SEQ ID NO: 4962 - DNA, 37 bp, Artificial Sequence
  Synthetic
gggccggctgctaattgccgcagtaagtgcggtcagc

SEQ ID NO: 4963 - DNA, 35 bp, Artificial Sequence
  Synthetic
ccccctggcacataccgcaaccacaacgcgcctgc

SEQ ID NO: 4964 - DNA, 42 bp, Artificial Sequence
  Synthetic
tgttccttacccccggtctacctggaaatagggagggggtac

SEQ ID NO: 4965 - DNA, 40 bp, Artificial Sequence
  Synthetic
ttaccatctgccaccagcggtacttctgagcatgctcccg

SEQ ID NO: 4966 - DNA, 41 bp, Artificial Sequence
  Synthetic
ggactgcgattcgtaaggcggggttgtaggaaacaggtgca

SEQ ID NO: 4967 - DNA, 39 bp, Artificial Sequence
  Synthetic
ctgccctccaaccgctttacctttactgtggcggtcagc

SEQ ID NO: 4968 - DNA, 35 bp, Artificial Sequence
  Synthetic
ctgggctggaggtgcgctacgggggcaaaaaccgc

SEQ ID NO: 4969 - DNA, 39 bp, Artificial Sequence
  Synthetic
attcgccggctcgctgttttggtcaacattagacgcgtt

SEQ ID NO: 4970 - DNA, 38 bp, Artificial Sequence
  Synthetic
gacttgctcccgcctcggtagcacctggtatatgccgg

SEQ ID NO: 4971 - DNA, 38 bp, Artificial Sequence
  Synthetic
cttgactcagccacagacgtcgactgcacaacgccggg

SEQ ID NO: 4972 - DNA, 36 bp, Artificial Sequence
  Synthetic
gatgaggccccgtcccttccaaggtggacggtggcg

SEQ ID NO: 4973 - DNA, 38 bp, Artificial Sequence
  Synthetic
ggtcgttgttctggggtgagcgttggcggccttagctg

SEQ ID NO: 4974 - DNA, 40 bp, Artificial Sequence
  Synthetic
tccttgctggtggcgaaattggattggcgtcaggattgcc

SEQ ID NO: 4975 - DNA, 38 bp, Artificial Sequence
  Synthetic
gtaaccgcgacgtgtccagggtctcccccgtggtgaat

SEQ ID NO: 4976 - DNA, 39 bp, Artificial Sequence
  Synthetic
gaagcagctccgcctcgctcatccacacacatctgagct

SEQ ID NO: 4977 - DNA, 35 bp, Artificial Sequence
  Synthetic
gccgctgcctcacgtcgtaagcgaccgcggttagc

SEQ ID NO: 4978 - DNA, 38 bp, Artificial Sequence
  Synthetic
ttactccagcactgcccgtcatggtgagctcggcagtc

SEQ ID NO: 4979 - DNA, 41 bp, Artificial Sequence
  Synthetic
ttggttaatgtagcgaccggcgtgtgaccttggtccagtcg

SEQ ID NO: 4980 - DNA, 39 bp, Artificial Sequence
  Synthetic
ggccccgtctctatttccgctcctcaagcaatgctagcg

SEQ ID NO: 4981 - DNA, 41 bp, Artificial Sequence
  Synthetic
acttgacgttcgtaatgggcttaaaaaatccgttggtcgtc

SEQ ID NO: 4982 - DNA, 47 bp, Artificial Sequence
  Synthetic
tctcgtgtatgtctaacgatgttccaaacatctttgaattgtttcca

SEQ ID NO: 4983 - DNA, 43 bp, Artificial Sequence
  Synthetic
gtattaacgcattgcccagttgaattgaagtttggtttacgcg

SEQ ID NO: 4984 - DNA, 39 bp, Artificial Sequence
  Synthetic
acaaacaatggtagaccgcgcatacgaaactgtgcaagc

SEQ ID NO: 4985 - DNA, 47 bp, Artificial Sequence
  Synthetic
gttgcaaaaacaaagacagtttgaaggaatacgttcaattaaagctc

SEQ ID NO: 4986 - DNA, 39 bp, Artificial Sequence
  Synthetic
ccagctccggattatgtggtcgatgtacggcaaatcaat

SEQ ID NO: 4987 - DNA, 38 bp, Artificial Sequence
  Synthetic
cgatgaacaccgttttgcactaggccaacgttttccac

SEQ ID NO: 4988 - DNA, 38 bp, Artificial Sequence
  Synthetic
ggcaccactggattccgtttagtaaatttgggacgccg

SEQ ID NO: 4989 - DNA, 42 bp, Artificial Sequence
  Synthetic
ctagctcctgcaaactttctggaagccagtttttcattggtg

SEQ ID NO: 4990 - DNA, 41 bp, Artificial Sequence
  Synthetic
gtgtgcacaccgttgcatttaaggctgttatcatctgatcg

SEQ ID NO: 4991 - DNA, 43 bp, Artificial Sequence
  Synthetic
ctgcttcttccggtgaatattcaagccctgaattaaaaaaggc

SEQ ID NO: 4992 - DNA, 42 bp, Artificial Sequence
  Synthetic
caccgttgcctttactgtaagtatgttacaaaatacgcacgc

SEQ ID NO: 4993 - DNA, 38 bp, Artificial Sequence
  Synthetic
actctgggaatcggggggaggtcggtggcgctgtatgc

SEQ ID NO: 4994 - DNA, 37 bp, Artificial Sequence
  Synthetic
ccggtattcacggggcgacaacaccgtgtgtacccgc

SEQ ID NO: 4995 - DNA, 38 bp, Artificial Sequence
  Synthetic
cgatccgggccaagggcttgataattcccccggtgtcg

SEQ ID NO: 4996 - DNA, 36 bp, Artificial Sequence
  Synthetic
tgggcgggtatcatcggtcttcggacagcgttcccg

SEQ ID NO: 4997 - DNA, 46 bp, Artificial Sequence
  Synthetic
agctagaacgattcgcagttaatccagtatttgtctacagccttct

SEQ ID NO: 4998 - DNA, 39 bp, Artificial Sequence
  Synthetic
agcaatcaggtcagccaaaatgcctgatgtaccatttgc

SEQ ID NO: 4999 - DNA, 43 bp, Artificial Sequence
  Synthetic
gagagaaccaaggggaagtgaccatcctatttgttcctgaagg

SEQ ID NO: 5000 - DNA, 39 bp, Artificial Sequence
  Synthetic
ggaccagcggctacactagaagccaaaactcttgcctta

SEQ ID NO: 5001 - DNA, 50 bp, Artificial Sequence
  Synthetic
gtagcatgacaaaaatcttagagcctgtattgatagataactatgtctgg

SEQ ID NO: 5002 - DNA, 47 bp, Artificial Sequence
  Synthetic
gttagtggggaaattgaattgggcaggagtttacataattgccttac

SEQ ID NO: 5003 - DNA, 42 bp, Artificial Sequence
  Synthetic
aaactgcccatacaaaaggaaacaactcaggaatccaggtgg

SEQ ID NO: 5004 - DNA, 43 bp, Artificial Sequence
  Synthetic
ctagtgattttaacctgccacctctgacatttatcacagctgg

SEQ ID NO: 5005 - DNA, 43 bp, Artificial Sequence
  Synthetic
atacatactgacaatggcagcaattattcctgcttgattcccg

SEQ ID NO: 5006 - DNA, 45 bp, Artificial Sequence
  Synthetic
aggggatgctagattggtaataacaaaatgccagtctctttctcc

SEQ ID NO: 5007 - DNA, 43 bp, Artificial Sequence
  Synthetic
aacaccaaaaaagataaagccacctttctggggcttgttccat

SEQ ID NO: 5008 - DNA, 44 bp, Artificial Sequence
  Synthetic
acaactgctgtttatccattttcagtctgtcgagtaacgcctat

SEQ ID NO: 5009 - DNA, 41 bp, Artificial Sequence
  Synthetic
acagaggtacataatgtttgggctacttcttgtgggttggg

SEQ ID NO: 5010 - DNA, 44 bp, Artificial Sequence
  Synthetic
ctgctgttaaatggcagtctagctgtccgtgaaattgacagatc

SEQ ID NO: 5011 - DNA, 45 bp, Artificial Sequence
  Synthetic
tggtggtaatagcaacaatgagtcccacttctccaattgtccctc

SEQ ID NO: 5012 - DNA, 42 bp, Artificial Sequence
  Synthetic
gttgcaactcacagtctggggcggtatctttccacagccagg

SEQ ID NO: 5013 - DNA, 41 bp, Artificial Sequence
  Synthetic
agcagctaccaatgctgcttgtggaaaacccacctcctcct

SEQ ID NO: 5014 - DNA, 38 bp, Artificial Sequence
  Synthetic
agggactttccgctggggactgcaggatctgagggctc

SEQ ID NO: 5015 - DNA, 40 bp, Artificial Sequence
  Synthetic
acgaccttcaccgcgactccgcctcgaacatctccgtgtc

SEQ ID NO: 5016 - DNA, 37 bp, Artificial Sequence
  Synthetic
gagcgcgtgatggtcatcgcccatggccatcaacgcc

SEQ ID NO: 5017 - DNA, 36 bp, Artificial Sequence
  Synthetic
cgctctcaaacacctccccgagggcctttctggggc

SEQ ID NO: 5018 - DNA, 39 bp, Artificial Sequence
  Synthetic
taacgtcaaggtcgtcgtcgggttaagcacctgggcccg

SEQ ID NO: 5019 - DNA, 35 bp, Artificial Sequence
  Synthetic
ggtccgaaacgtcccgtcgaacagccaggtcgcgg

SEQ ID NO: 5020 - DNA, 42 bp, Artificial Sequence
  Synthetic
tccttgtgggacgagaacagccaagttacatcaccaacccgg

SEQ ID NO: 5021 - DNA, 37 bp, Artificial Sequence
  Synthetic
cgttgagggtctgcacgcacggcgtatctcatcaccg

SEQ ID NO: 5022 - DNA, 42 bp, Artificial Sequence
  Synthetic
ggtgcgctgcttcaagattctgccgctagagtacgagatcga

SEQ ID NO: 5023 - DNA, 35 bp, Artificial Sequence
  Synthetic
ccacgccctcgctgttcgtaagggagacgcgtggc

SEQ ID NO: 5024 - DNA, 40 bp, Artificial Sequence
  Synthetic
cactggtacatggcccactaccgcaaaacagggccgagag

SEQ ID NO: 5025 - DNA, 37 bp, Artificial Sequence
  Synthetic
gagcgcggccccagacttacctggcccatgatgcagg

SEQ ID NO: 5026 - DNA, 41 bp, Artificial Sequence
  Synthetic
ctgcatgtagcggtcgtagtggcgaacctttagccccgagg

SEQ ID NO: 5027 - DNA, 39 bp, Artificial Sequence
  Synthetic
gctctccggcggcgttgatggcggctttacgaccactac

SEQ ID NO: 5028 - DNA, 39 bp, Artificial Sequence
  Synthetic
gagagtccgtacccgccccacatgaactacgggccggac

SEQ ID NO: 5029 - DNA, 36 bp, Artificial Sequence
  Synthetic
ggggtgagcgagtggagcacgttgccaggttctgcc

SEQ ID NO: 5030 - DNA, 35 bp, Artificial Sequence
  Synthetic
cggagaacgcgaggcccatcgaaacagccgcctgg

SEQ ID NO: 5031 - DNA, 37 bp, Artificial Sequence
  Synthetic
cgtgcttcagggggcggttcaccggagctctcggtaa

SEQ ID NO: 5032 - DNA, 39 bp, Artificial Sequence
  Synthetic
cgaagagcgcactcccccaaaaagagtggtttgccgtgg

SEQ ID NO: 5033 - DNA, 40 bp, Artificial Sequence
  Synthetic
aaaggcgccaacaaacctaggaccagaccctgcagctaca

SEQ ID NO: 5034 - DNA, 35 bp, Artificial Sequence
  Synthetic
gcgggacttcgcccagttccgtagtctccgcgaga

SEQ ID NO: 5035 - DNA, 38 bp, Artificial Sequence
  Synthetic
gtttgcctccagccacaacacaccggggaaacaggcac

SEQ ID NO: 5036 - DNA, 36 bp, Artificial Sequence
  Synthetic
ggacaaggccgggtcccgtatcagcctcgcagaccc

SEQ ID NO: 5037 - DNA, 40 bp, Artificial Sequence
  Synthetic
ctcccggaaggtattgctcgcagcttcatggagggcagcc

SEQ ID NO: 5038 - DNA, 39 bp, Artificial Sequence
  Synthetic
cggcgtagatgcgcttctcccggatctggtggccatagg

SEQ ID NO: 5039 - DNA, 35 bp, Artificial Sequence
  Synthetic
ccggcggacgcgactaacagttggtcgggttgccc

SEQ ID NO: 5040 - DNA, 36 bp, Artificial Sequence
  Synthetic
caagggggtgtgggtgacgaagccccggatcctcgt

SEQ ID NO: 5041 - DNA, 37 bp, Artificial Sequence
  Synthetic
gtccgccgggatgtcggatgagggcgggttcatcctg

SEQ ID NO: 5042 - DNA, 37 bp, Artificial Sequence
  Synthetic
cgtactaccctttcgacgcgctcctggagtcggcgac

SEQ ID NO: 5043 - DNA, 35 bp, Artificial Sequence
  Synthetic
gtgcgccgtgctgtgtctgatcgcgatcgggggag

SEQ ID NO: 5044 - DNA, 36 bp, Artificial Sequence
  Synthetic
gctgggcatgctgatcccggtccaatccggacgccc

SEQ ID NO: 5045 - DNA, 39 bp, Artificial Sequence
  Synthetic
gtgacgtcggcgcgactcagggctacgtgtacttcgagg

SEQ ID NO: 5046 - DNA, 35 bp, Artificial Sequence
  Synthetic
aggagccccacgttctcgaacagcttcgcccagcc

SEQ ID NO: 5047 - DNA, 37 bp, Artificial Sequence
  Synthetic
gggcggtccagaaccactgctttcccaacggcaagcc

SEQ ID NO: 5048 - DNA, 37 bp, Artificial Sequence
  Synthetic
acaacccccacctcgctcagtacgtatggcgctgagc

SEQ ID NO: 5049 - DNA, 39 bp, Artificial Sequence
  Synthetic
agcgacgtcgagtttaactgcaggcaggtcacacatggc

SEQ ID NO: 5050 - DNA, 39 bp, Artificial Sequence
  Synthetic
ggaacgcgtaatcggccaccgcaccatcgagctgtacaa

SEQ ID NO: 5051 - DNA, 37 bp, Artificial Sequence
  Synthetic
ttcggtgctgtttcaggggtttgctccgccgtgatcg

SEQ ID NO: 5052 - DNA, 35 bp, Artificial Sequence
  Synthetic
gctttgtgcgcatgccccgtgcgaacggcgtcctc

SEQ ID NO: 5053 - DNA, 40 bp, Artificial Sequence
  Synthetic
cttcgcccaccgattcctgtccaacaatctgtcgacagga

SEQ ID NO: 5054 - DNA, 34 bp, Artificial Sequence
  Synthetic
gtatgcgacgcggctggtatacaggcgggcggac

SEQ ID NO: 5055 - DNA, 36 bp, Artificial Sequence
  Synthetic
tggtggcggcgcacaacattccaggtacacgcacgc

SEQ ID NO: 5056 - DNA, 38 bp, Artificial Sequence
  Synthetic
cacacggcgtgcctgaagagttcaggtcccggaactcg

SEQ ID NO: 5057 - DNA, 37 bp, Artificial Sequence
  Synthetic
gcgagcaccgaccccctagatggggcacaccggaatc

SEQ ID NO: 5058 - DNA, 42 bp, Artificial Sequence
  Synthetic
aggacgtctccaagctctccgacgacaggaaggcaaacagaa

SEQ ID NO: 5059 - DNA, 36 bp, Artificial Sequence
  Synthetic
gcgacgtccggcgacatagtcgtgcaggtccccaac

SEQ ID NO: 5060 - DNA, 39 bp, Artificial Sequence
  Synthetic
cgctatcgtcggctgcggttggaaaagaagacaaccggc

SEQ ID NO: 5061 - DNA, 36 bp, Artificial Sequence
  Synthetic
caggtcgaggatcgcgtcgcagacgctgcagcaggg

SEQ ID NO: 5062 - DNA, 38 bp, Artificial Sequence
  Synthetic
gggggcggagtcgttcaacctgccggggtaaaatccac

SEQ ID NO: 5063 - DNA, 39 bp, Artificial Sequence
  Synthetic
tgcgttatcacctcctcgctcgatacaacggctcggccc

SEQ ID NO: 5064 - DNA, 35 bp, Artificial Sequence
  Synthetic
cggctccctgacgatgcgtcggtccaacagcaccg

SEQ ID NO: 5065 - DNA, 38 bp, Artificial Sequence
  Synthetic
ttttcgagaagaaggcgtcgcgtccgtcagggtctcgc

SEQ ID NO: 5066 - DNA, 38 bp, Artificial Sequence
  Synthetic
cgcctatgcgcgtccctgtggcaggcggttgttatcgc

SEQ ID NO: 5067 - DNA, 39 bp, Artificial Sequence
  Synthetic
acgacgatgcatgttcggcgcaaaagataggtcgccggg

SEQ ID NO: 5068 - DNA, 37 bp, Artificial Sequence
  Synthetic
gttcgaggcggatccggtcagcccacgatgacgccaa

SEQ ID NO: 5069 - DNA, 34 bp, Artificial Sequence
  Synthetic
tggcaggccgaaaacgccataactccgcgcggcc

SEQ ID NO: 5070 - DNA, 36 bp, Artificial Sequence
  Synthetic
cggtcgtagtccaacgtgcctagtggtcggcgtggg

SEQ ID NO: 5071 - DNA, 34 bp, Artificial Sequence
  Synthetic
gcatgccccgcaaaacgccccaccacaacacggc

SEQ ID NO: 5072 - DNA, 36 bp, Artificial Sequence
  Synthetic
atgcagaaggggtgcaggcaacggacgagatcgccc

SEQ ID NO: 5073 - DNA, 37 bp, Artificial Sequence
  Synthetic
ggggcggggtttgttgtgagaacgcagctgtcttcgc

SEQ ID NO: 5074 - DNA, 36 bp, Artificial Sequence
  Synthetic
ctccccagagcctgctggttgggtcgtgccatccga

SEQ ID NO: 5075 - DNA, 39 bp, Artificial Sequence
  Synthetic
tttcgcgggaagaaccttccggaacacgcttcaccccgg

SEQ ID NO: 5076 - DNA, 39 bp, Artificial Sequence
  Synthetic
ccatcggaggccccccagattgtacgtgtgctttcgggc

SEQ ID NO: 5077 - DNA, 37 bp, Artificial Sequence
  Synthetic
gggtggcgctctctgccaatcgcaggagccgtagtcc

SEQ ID NO: 5078 - DNA, 40 bp, Artificial Sequence
  Synthetic
cgatcctgccgctcgttcgacgagtcgaaatcccacacag

SEQ ID NO: 5079 - DNA, 39 bp, Artificial Sequence
  Synthetic
acgaagtgtcttgtgcagccaaaggtcgctgaggctctg

SEQ ID NO: 5080 - DNA, 45 bp, Artificial Sequence
  Synthetic
aatcgtgcgtaaattgctataccccaatttcttgcaggtcaacac

SEQ ID NO: 5081 - DNA, 41 bp, Artificial Sequence
  Synthetic
caggcactcctggtcaacagtcgccattctgctcgacacag

SEQ ID NO: 5082 - DNA, 43 bp, Artificial Sequence
  Synthetic
tttgctgcgacaacaatgccgaacagtataatgccatcattgt

SEQ ID NO: 5083 - DNA, 41 bp, Artificial Sequence
  Synthetic
gtggtgtctaatcagcagacagacagatcgttgtccagtgc

SEQ ID NO: 5084 - DNA, 41 bp, Artificial Sequence
  Synthetic
tggaccatggggaagctgattgatacctcagaaaatgcaca

SEQ ID NO: 5085 - DNA, 39 bp, Artificial Sequence
  Synthetic
gggcacggtgctgtctaatagatgttttggtccgcgtac

SEQ ID NO: 5086 - DNA, 44 bp, Artificial Sequence
  Synthetic
tgaatggtataaagctagaggtggcacagactcgtggtcaatgt

SEQ ID NO: 5087 - DNA, 38 bp, Artificial Sequence
  Synthetic
aaggtactacgaccgcaggggtttaggggctggggcga

SEQ ID NO: 5088 - DNA, 39 bp, Artificial Sequence
  Synthetic
aagggttaaacgcgctaatccaacatcgggtggacaatc

SEQ ID NO: 5089 - DNA, 38 bp, Artificial Sequence
  Synthetic
ggtccccgggatattttgccaaacacggggtgccatgg

SEQ ID NO: 5090 - DNA, 40 bp, Artificial Sequence
  Synthetic
ggcgaggaggagactgccttatcgctcctgtataggcaca

SEQ ID NO: 5091 - DNA, 40 bp, Artificial Sequence
  Synthetic
gttagtcgcctggggcaacgagcctacctgaacaccagag

SEQ ID NO: 5092 - DNA, 49 bp, Artificial Sequence
  Synthetic
ttgagcaagacataggactaaccggcagttaataaatctatttcctgca

SEQ ID NO: 5093 - DNA, 39 bp, Artificial Sequence
  Synthetic
cactgaccgtttgcttactgtgaccacctctttgccatc

SEQ ID NO: 5094 - DNA, 39 bp, Artificial Sequence
  Synthetic
actgaccaaggttcagactcaagcagctgtgtttgctta

SEQ ID NO: 5095 - DNA, 43 bp, Artificial Sequence
  Synthetic
cataggcctgggaaacttgaatcacaatatctaatggggcatc

SEQ ID NO: 5096 - DNA, 41 bp, Artificial Sequence
  Synthetic
gaggagtttcagcttgcctttaaattctcaggggtaaggtc

SEQ ID NO: 5097 - DNA, 45 bp, Artificial Sequence
  Synthetic
tgatctacgggatcgtatgacagagaaacaaaaacttcctgccaa

SEQ ID NO: 5098 - DNA, 41 bp, Artificial Sequence
  Synthetic
actgaaacggtgtgtactgccacgcctaaatccttgcgctt

SEQ ID NO: 5099 - DNA, 43 bp, Artificial Sequence
  Synthetic
agaatgcacctgttttaattgtggtaaaggccccaatacctcc

SEQ ID NO: 5100 - DNA, 46 bp, Artificial Sequence
  Synthetic
tcgaaaaaacatcaaaagacgcttgatttgtagcttcatcttcctc

SEQ ID NO: 5101 - DNA, 50 bp, Artificial Sequence
  Synthetic
ttgctttctcaaattgaacattggacttttctagcatagtataaagtcac

SEQ ID NO: 5102 - DNA, 45 bp, Artificial Sequence
  Synthetic
acttgggaaatttgggtattggtacgcagcaggtgtaataggttt

SEQ ID NO: 5103 - DNA, 42 bp, Artificial Sequence
  Synthetic
tacacaaatcccgcctttgatccaaaatctggatctggtgca

SEQ ID NO: 5104 - DNA, 46 bp, Artificial Sequence
  Synthetic
agaactacagcctttagggtcttactttctgcaagattatccacta

SEQ ID NO: 5105 - DNA, 48 bp, Artificial Sequence
  Synthetic
tgttggacatccatactttgaagtgctaactttaggaacttctacagc

SEQ ID NO: 5106 - DNA, 44 bp, Artificial Sequence
  Synthetic
aatccaaatcagtatcctccagaggatcatgtgctacgtccatg

SEQ ID NO: 5107 - DNA, 41 bp, Artificial Sequence
  Synthetic
ggtcttagcctggtttggagaagctcaaactcaaaccgtgc

SEQ ID NO: 5108 - DNA, 43 bp, Artificial Sequence
  Synthetic
ctggaaaggtttgtgtagacagttgatatcacgcaaagtaggt

SEQ ID NO: 5109 - DNA, 38 bp, Artificial Sequence
  Synthetic
tgctgtttgcagaacttggtgatctgccatggcgatag

SEQ ID NO: 5110 - DNA, 40 bp, Artificial Sequence
  Synthetic
agctgattgatgatgccgatggtcttctgtaacctgctgg

SEQ ID NO: 5111 - DNA, 43 bp, Artificial Sequence
  Synthetic
agaaacatctgtggtggaaaagcactacaccgtaacagttcaa

SEQ ID NO: 5112 - DNA, 44 bp, Artificial Sequence
  Synthetic
acaatgggcatttgacaatgacacatctgcagctaaagcataat

SEQ ID NO: 5113 - DNA, 41 bp, Artificial Sequence
  Synthetic
agacttgagaaaagaggatggcgtcgaaacgctctgtcaga

SEQ ID NO: 5114 - DNA, 40 bp, Artificial Sequence
  Synthetic
cgcagagcctcagccctagagaggtttccgaagacgagga

SEQ ID NO: 5115 - DNA, 42 bp, Artificial Sequence
  Synthetic
cgcgacttcaacgacttcaagcagtttgcaggaccttgaaca

SEQ ID NO: 5116 - DNA, 39 bp, Artificial Sequence
  Synthetic
aaacgggacactgctgaaaatatcaggagggcatgtacc

SEQ ID NO: 5117 - DNA, 43 bp, Artificial Sequence
  Synthetic
gtggtacaacccactgttaaacctgtctagagggacaccaaat

SEQ ID NO: 5118 - DNA, 44 bp, Artificial Sequence
  Synthetic
aactctaggggctacaggaggaaggtgtaatttctaataaggct

SEQ ID NO: 5119 - DNA, 44 bp, Artificial Sequence
  Synthetic
tctttgcaaagaactagcacaccccataaagttctctgggtctt

SEQ ID NO: 5120 - DNA, 38 bp, Artificial Sequence
  Synthetic
tgctccagatcccgcctttacgtatatttccgctgggc

SEQ ID NO: 5121 - DNA, 45 bp, Artificial Sequence
  Synthetic
ttgatgtttttggtgacttcagtgacttcacgaaacacatcatcc

SEQ ID NO: 5122 - DNA, 49 bp, Artificial Sequence
  Synthetic
aattaggtgacactgaaaatcctgccattctgcctattatcattaccag

SEQ ID NO: 5123 - DNA, 43 bp, Artificial Sequence
  Synthetic
ttggggctgcaaacttcaaaacggccatttgcaagtttgatta

SEQ ID NO: 5124 - DNA, 45 bp, Artificial Sequence
  Synthetic
tgctttaattctactgactcatgggagctgacaacatgtatgagg

SEQ ID NO: 5125 - DNA, 40 bp, Artificial Sequence
  Synthetic
agactgactcaaatctggcagcactcccggtacatgagtg

SEQ ID NO: 5126 - DNA, 43 bp, Artificial Sequence
  Synthetic
aaatggactacatcaaggaaggaaaaatttgctgctcattgcc

SEQ ID NO: 5127 - DNA, 45 bp, Artificial Sequence
  Synthetic
tactggagtgagcaagaagaattcttcctttctgctgaataaagc

SEQ ID NO: 5128 - DNA, 46 bp, Artificial Sequence
  Synthetic
ttcaggatgtaagctttcaacatccttgttatggccgttttctcat

SEQ ID NO: 5129 - DNA, 49 bp, Artificial Sequence
  Synthetic
gaagggtttagtgtttgtgaaaacgccacatcaattaaatcttgtcttg

SEQ ID NO: 5130 - DNA, 47 bp, Artificial Sequence
  Synthetic
aagaatctagctgatgtggtatgcttttcaggtaaatcaagcaatga

SEQ ID NO: 5131 - DNA, 42 bp, Artificial Sequence
  Synthetic
atctgatgaggagacccaggacgcaactggtatctatttgga

SEQ ID NO: 5132 - DNA, 43 bp, Artificial Sequence
  Synthetic
caaggcttcaagcagtttcaattctgtcatcgaataagcgtct

SEQ ID NO: 5133 - DNA, 47 bp, Artificial Sequence
  Synthetic
aatacgtttttttgggggaaaagtttttagtatcttgcaatggttgt

SEQ ID NO: 5134 - DNA, 47 bp, Artificial Sequence
  Synthetic
attgggagctggttagaaaagagcccaagtctattatagccactctt

SEQ ID NO: 5135 - DNA, 40 bp, Artificial Sequence
  Synthetic
agaagaagaacagccaccgacgatcccacctgcgaaggag

SEQ ID NO: 5136 - DNA, 40 bp, Artificial Sequence
  Synthetic
attgctgcgcatttttggtagtaatacctgttgtgccctc

SEQ ID NO: 5137 - DNA, 49 bp, Artificial Sequence
  Synthetic
agagagctcactacctacagaatccaatttcacctgtaatattagcatc

SEQ ID NO: 5138 - DNA, 43 bp, Artificial Sequence
  Synthetic
ctggtgatgtaagtcttgaatttgcaatctggatcaggagccg

SEQ ID NO: 5139 - DNA, 48 bp, Artificial Sequence
  Synthetic
ctaatttaggggagtttagtggggactactgtatgcccagataaaatt

SEQ ID NO: 5140 - DNA, 47 bp, Artificial Sequence
  Synthetic
ttggaactcagttacattttcatgctttcatagtagggatggtctac

SEQ ID NO: 5141 - DNA, 48 bp, Artificial Sequence
  Synthetic
aaggtattcaaattggtagaggtgggctttgttaaataaaggatgacc

SEQ ID NO: 5142 - DNA, 45 bp, Artificial Sequence
  Synthetic
taatgctgttattcaggacggaacagttcttaaaatttgctgccc

SEQ ID NO: 5143 - DNA, 43 bp, Artificial Sequence
  Synthetic
tatggctcgtgaaggtaaaatggagcatttgtaggtggcaata

SEQ ID NO: 5144 - DNA, 46 bp, Artificial Sequence
  Synthetic
ctactgaaaatcctgctccagaaatcttgcaaatcaactaaccaaa

SEQ ID NO: 5145 - DNA, 39 bp, Artificial Sequence
  Synthetic
tctctcgaacggaagcggtacgccaaaataccagagacg

SEQ ID NO: 5146 - DNA, 48 bp, Artificial Sequence
  Synthetic
gtgcagaaattgtaagtcatgaaggcaaattaacaggcaataccaaat

SEQ ID NO: 5147 - DNA, 41 bp, Artificial Sequence
  Synthetic
aacttctgcttcaattcgcacaagacagatcacaggcaatt

SEQ ID NO: 5148 - DNA, 43 bp, Artificial Sequence
  Synthetic
ggaaattccctggcactatacaacaagtccccaatagctctgt

SEQ ID NO: 5149 - DNA, 44 bp, Artificial Sequence
  Synthetic
cccataacactgcgttgttggccaaataaatctttgaatttgcc

SEQ ID NO: 5150 - DNA, 46 bp, Artificial Sequence
  Synthetic
tcaagaggaagctagggatccacacattaaatctattcctccaaca

SEQ ID NO: 5151 - DNA, 42 bp, Artificial Sequence
  Synthetic
gcaaaggtcctgaaataactgtgaaagggtatgacatcagcg

SEQ ID NO: 5152 - DNA, 46 bp, Artificial Sequence
  Synthetic
aagaattatcaatcaagggcaacgagtctggatttctggtttgaac

SEQ ID NO: 5153 - DNA, 48 bp, Artificial Sequence
  Synthetic
atagggttttcagatttcatttgccctggattataaactttgggatct

SEQ ID NO: 5154 - DNA, 45 bp, Artificial Sequence
  Synthetic
atggagcctaagcaaaatcaattgtcccaatgttctcctattgtg

SEQ ID NO: 5155 - DNA, 48 bp, Artificial Sequence
  Synthetic
tcagattggaatgttaaatgggagcgcagattttttagaaactgaagt

SEQ ID NO: 5156 - DNA, 43 bp, Artificial Sequence
  Synthetic
atttggccagtattaatacccacacaggttgtaaagcgtccag

SEQ ID NO: 5157 - DNA, 42 bp, Artificial Sequence
  Synthetic
aaaacgtcaacaaaagccaggtatcttcccatgttctaggtg

SEQ ID NO: 5158 - DNA, 43 bp, Artificial Sequence
  Synthetic
attcctaactttgatggaaacgtcttgtcaaagttgctccacg

SEQ ID NO: 5159 - DNA, 42 bp, Artificial Sequence
  Synthetic
attcgttatggctaccgatgaaataatagggatcgagctggg

SEQ ID NO: 5160 - DNA, 40 bp, Artificial Sequence
  Synthetic
ggcggccaacccagcttatgcatgcgagtcttcacaccat

SEQ ID NO: 5161 - DNA, 41 bp, Artificial Sequence
  Synthetic
cgaatgttgaagcatgtggttactatggtggaattgcccag

SEQ ID NO: 5162 - DNA, 48 bp, Artificial Sequence
  Synthetic
ttaccattcacttggtagaacaggtctatgaaatttggtagcattgca

SEQ ID NO: 5163 - DNA, 45 bp, Artificial Sequence
  Synthetic
tggacggaactcttctaggcgtcctcaaatttataaattggtgag

SEQ ID NO: 5164 - DNA, 42 bp, Artificial Sequence
  Synthetic
ccacaagggttacccactactgtctgtcatctgtagtgagaa

SEQ ID NO: 5165 - DNA, 45 bp, Artificial Sequence
  Synthetic
ttgggtgaaatagctcagtactacatcctgtgtacatgagtgaaa

SEQ ID NO: 5166 - DNA, 46 bp, Artificial Sequence
  Synthetic
cattccatggacatcaggtgtaccccagcactagtataagtatcag

SEQ ID NO: 5167 - DNA, 47 bp, Artificial Sequence
  Synthetic
gctggcttggataatcacaggagacttgaaaggttaattttccaatc

SEQ ID NO: 5168 - DNA, 40 bp, Artificial Sequence
  Synthetic
tgcttctaaccccagtgtgtaaaagggacactaaacctgg

SEQ ID NO: 5169 - DNA, 40 bp, Artificial Sequence
  Synthetic
tggattccaagagcacctagagtctggggtagttagtgcg

SEQ ID NO: 5170 - DNA, 43 bp, Artificial Sequence
  Synthetic
acaggaagttctatcccatcatttgagtacgagctaccctcaa

SEQ ID NO: 5171 - DNA, 45 bp, Artificial Sequence
  Synthetic
agacaattggatttcattgctgatgtgctctccctaaactggtaa

SEQ ID NO: 5172 - DNA, 47 bp, Artificial Sequence
  Synthetic
aatcccactcaagagaaaagagagcttgtgacatttgttctaaccac

SEQ ID NO: 5173 - DNA, 42 bp, Artificial Sequence
  Synthetic
cgcgcattggcagaacatttaatgttttggatcaggaggtaa

SEQ ID NO: 5174 - DNA, 40 bp, Artificial Sequence
  Synthetic
atcttgaacccagaagctctgatgtgctgtgcatgcaaat

SEQ ID NO: 5175 - DNA, 47 bp, Artificial Sequence
  Synthetic
atgcccaaccaggtgataatgtggatctactagtttgtatttgtctt

SEQ ID NO: 5176 - DNA, 42 bp, Artificial Sequence
  Synthetic
atacaccaacaaccaggatgatctttttcctgttgtgcacaa

SEQ ID NO: 5177 - DNA, 46 bp, Artificial Sequence
  Synthetic
agtgtgttttacaatgtgttccctggtctagggtcattgtcattga

SEQ ID NO: 5178 - DNA, 49 bp, Artificial Sequence
  Synthetic
aaatcgaaacaaacaaatttgcagcgaaatctgaatacatgaagcatac

SEQ ID NO: 5179 - DNA, 39 bp, Artificial Sequence
  Synthetic
cctgttctcagcggtccaaatgggtcctcaatgcttaat

SEQ ID NO: 5180 - DNA, 43 bp, Artificial Sequence
  Synthetic
aggaattatttcacatcagaggtgttgatgtacacccccttca

SEQ ID NO: 5181 - DNA, 49 bp, Artificial Sequence
  Synthetic
ccaagacttgaaccacacaaatggcttagaagcatatctcctatctcaa

SEQ ID NO: 5182 - DNA, 43 bp, Artificial Sequence
  Synthetic
aagacatgaccaaagagttctttgattcctccactcctttggg

SEQ ID NO: 5183 - DNA, 42 bp, Artificial Sequence
  Synthetic
tgcccttaggatgaagtggatgccattatccttttgtctgcc

SEQ ID NO: 5184 - DNA, 38 bp, Artificial Sequence
  Synthetic
ggccccgttcacttcagaaactaagatctgcatggccc

SEQ ID NO: 5185 - DNA, 41 bp, Artificial Sequence
  Synthetic
acatgttggagagagaactggtcgatatacacgctgcttgt

SEQ ID NO: 5186 - DNA, 41 bp, Artificial Sequence
  Synthetic
agtacacagattggcgggatgttcttctgttgggttttgtc

SEQ ID NO: 5187 - DNA, 41 bp, Artificial Sequence
  Synthetic
cgaagagcaacagccattctaacccactcactatcagttgg

SEQ ID NO: 5188 - DNA, 44 bp, Artificial Sequence
  Synthetic
gtttcaaaactggggaattgaacctgtcaggcaatattccgatc

SEQ ID NO: 5189 - DNA, 46 bp, Artificial Sequence
  Synthetic
attcatcgtccatgatgtgggaattgatatgtgttaactagcactg

SEQ ID NO: 5190 - DNA, 44 bp, Artificial Sequence
  Synthetic
ctcttctctaactgtgaatgtgaggacaggagaattgcctctca

SEQ ID NO: 5191 - DNA, 45 bp, Artificial Sequence
  Synthetic
agtgagagggtattggagaggcaattgttactctatcacctttca

SEQ ID NO: 5192 - DNA, 43 bp, Artificial Sequence
  Synthetic
gacgatgagaattttcaagaacaggactcctctgcacactgta

SEQ ID NO: 5193 - DNA, 43 bp, Artificial Sequence
  Synthetic
tttctgaacaggtagaagtgcaaaactattacatgcggcactt

SEQ ID NO: 5194 - DNA, 38 bp, Artificial Sequence
  Synthetic
gggccctccagatccaccgacgctctgcgtctgtgctt

SEQ ID NO: 5195 - DNA, 44 bp, Artificial Sequence
  Synthetic
ggaggctcgggatccgtataccaacactttaatgtattctgagg

SEQ ID NO: 5196 - DNA, 40 bp, Artificial Sequence
  Synthetic
ggatacacaccttttggaggcaaattgcaggccttactgg

SEQ ID NO: 5197 - DNA, 45 bp, Artificial Sequence
  Synthetic
tggtgaacatccttccgttacattgtacttgaacatctatctgag

SEQ ID NO: 5198 - DNA, 40 bp, Artificial Sequence
  Synthetic
aaacgcaaacactcctcctctgaagataaagccgtccagt

SEQ ID NO: 5199 - DNA, 49 bp, Artificial Sequence
  Synthetic
taaagcaatagaggttccaaaggtggcaaatttattaggatcaggtaac

SEQ ID NO: 5200 - DNA, 46 bp, Artificial Sequence
  Synthetic
ctgcagaggtagatgacagtagaataaaaagctgattttgtttggg

SEQ ID NO: 5201 - DNA, 38 bp, Artificial Sequence; identical to SEQ ID NO: 4464
  Synthetic

SEQ ID NO: 5202 - DNA, 36 bp, Artificial Sequence
  Synthetic
ggtgtgcgcgccacaagaaaagatgggcgcgccttg

SEQ ID NO: 5203 - DNA, 41 bp, Artificial Sequence
  Synthetic
ttcacgctgctggcatcctgttccacatgtttgcggaaccc

SEQ ID NO: 5204 - DNA, 40 bp, Artificial Sequence
  Synthetic
cggtcactggggtgtcctgaaccttcaaccaattgcctga

SEQ ID NO: 5205 - DNA, 41 bp, Artificial Sequence
  Synthetic
tggggccctataacccacaagtgcatagtgccagcagtagg

SEQ ID NO: 5206 - DNA, 39 bp, Artificial Sequence
  Synthetic
gcttcaccaagacctgcggaggggcacaggagctggtta

SEQ ID NO: 5207 - DNA, 42 bp, Artificial Sequence
  Synthetic
cctctacggagtctcctcgagcatgaggacgacatactccca

SEQ ID NO: 5208 - DNA, 37 bp, Artificial Sequence
  Synthetic
tggaccctcatcttcctgtgctaggtgcatgcgggca

SEQ ID NO: 5209 - DNA, 41 bp, Artificial Sequence
  Synthetic
gtggcgacatcttgaggggtctgtcccagcagcaccaagtc

SEQ ID NO: 5210 - DNA, 39 bp, Artificial Sequence
  Synthetic
aagggcccgtatgccagatgtaagtgacctagcccccag

SEQ ID NO: 5211 - DNA, 40 bp, Artificial Sequence
  Synthetic
ggccctggacttcatccctgtggcgaggagttgtcggtaa

SEQ ID NO: 5212 - DNA, 39 bp, Artificial Sequence
  Synthetic
cagacccaacgacggtgcttggcgtagcgagcaccgtga

SEQ ID NO: 5213 - DNA, 38 bp, Artificial Sequence
  Synthetic
gacggacgcccttatgaccgtctaccacctgcgtcacg

SEQ ID NO: 5214 - DNA, 40 bp, Artificial Sequence
  Synthetic
cacggggtgcgcatggtatgggagtgtttaggtaggcacg

SEQ ID NO: 5215 - DNA, 42 bp, Artificial Sequence
  Synthetic
ctgggggctgtccaaaatgagaacttccaggtctgcagacat

SEQ ID NO: 5216 - DNA, 42 bp, Artificial Sequence
  Synthetic
tgcagaagaactgaaacccgctccacatgtgtttcctccaga

SEQ ID NO: 5217 - DNA, 38 bp, Artificial Sequence
  Synthetic
tcgtcgtgagcggcttagcccggcaaggatgtcaacaa

SEQ ID NO: 5218 - DNA, 40 bp, Artificial Sequence
  Synthetic
gttacgcaggctacaccagtggtctcgcagccatgaggac

SEQ ID NO: 5219 - DNA, 40 bp, Artificial Sequence
  Synthetic
tgtgcagcaacacttggcatggcacactagggctggtagt

SEQ ID NO: 5220 - DNA, 41 bp, Artificial Sequence
  Synthetic
tgttgtggggtctcagctccccagtgagcattgacgtgact

SEQ ID NO: 5221 - DNA, 38 bp, Artificial Sequence
  Synthetic
gttccctcctgctctcccgatcgtatccgggcatttgc

SEQ ID NO: 5222 - DNA, 42 bp, Artificial Sequence
  Synthetic
catctcctgacccgacaacagcggggcattgagctaaaggat

SEQ ID NO: 5223 - DNA, 40 bp, Artificial Sequence
  Synthetic
tgcgagaagatggcactctacgtgcagatcccatcacggt

SEQ ID NO: 5224 - DNA, 41 bp, Artificial Sequence
  Synthetic
gtggggtgctcactaccagtttgatgttggctgccctacac

SEQ ID NO: 5225 - DNA, 40 bp, Artificial Sequence
  Synthetic
gcgagctgcttgggagacagtgatgatgttgcccaaccac

SEQ ID NO: 5226 - DNA, 40 bp, Artificial Sequence
  Synthetic
ggcgccacccttaagagcttaccttgggcaatgagtttgg

SEQ ID NO: 5227 - DNA, 45 bp, Artificial Sequence
  Synthetic
gtaaggaagtgggccttaatggctttttcaattgctatgccattt

SEQ ID NO: 5228 - DNA, 45 bp, Artificial Sequence
  Synthetic
aagccgctcaagaattgttcaatttgctctgtttagttcatttcc

SEQ ID NO: 5229 - DNA, 44 bp, Artificial Sequence
  Synthetic
aattggagttcttatagctgacgcctcctcttttgccttctctc

SEQ ID NO: 5230 - DNA, 43 bp, Artificial Sequence
  Synthetic
aaagcctcagataaccaacaagatgagagtaagtctggcagcc

SEQ ID NO: 5231 - DNA, 44 bp, Artificial Sequence
  Synthetic
ccaccctcttaagttgagaaacaggagaaagcactgttgaaact

SEQ ID NO: 5232 - DNA, 43 bp, Artificial Sequence
  Synthetic
tatcagcagattggaagaagaaggtcatcttcttggcttgtcc

SEQ ID NO: 5233 - DNA, 49 bp, Artificial Sequence
  Synthetic
tttggagagaaggaagatgttatgcgctgttgaaattcaaataaagcag

SEQ ID NO: 5234 - DNA, 43 bp, Artificial Sequence
  Synthetic
agagttacttctgatccacgaaggaagatcgtctcctggaaca

SEQ ID NO: 5235 - DNA, 40 bp, Artificial Sequence
  Synthetic
ccatagcggttcagaaaatggccagttgctcgccaattag

SEQ ID NO: 5236 - DNA, 41 bp, Artificial Sequence
  Synthetic
ccagattgggttgctagacaaaaatcaaattggtctgcagc

SEQ ID NO: 5237 - DNA, 44 bp, Artificial Sequence
  Synthetic
agggtagtatgctttaaattcccaaaacatatacacaggctccc

SEQ ID NO: 5238 - DNA, 48 bp, Artificial Sequence
  Synthetic
aacaagcaatttccataagtctgacatgtttcttttccaaatggtgat

SEQ ID NO: 5239 - DNA, 45 bp, Artificial Sequence
  Synthetic
aaaacctacactatctcccctcccgtggttctagagtaagagctg

SEQ ID NO: 5240 - DNA, 42 bp, Artificial Sequence
  Synthetic
aaaacgcattccagcagtaaacaccccaacccatttaaacac

SEQ ID NO: 5241 - DNA, 43 bp, Artificial Sequence
  Synthetic
taggcctactgttcctgtagagcattatagctgatgcctctgg

SEQ ID NO: 5242 - DNA, 43 bp, Artificial Sequence
  Synthetic
ttttacaacaaccaaccagaaacgttcaaattgaacagcccga

SEQ ID NO: 5243 - DNA, 49 bp, Artificial Sequence
  Synthetic
tggttttacgtactggtagtagacattcctaattcaggtggtaaactag

SEQ ID NO: 5244 - DNA, 49 bp, Artificial Sequence
  Synthetic
agtttcaggcaatcagtttagagtgatctattaaagcaaacttgttagg

SEQ ID NO: 5245 - DNA, 44 bp, Artificial Sequence
  Synthetic
atatgccagacatttttggacacggagcatgtggttcaggtatg

SEQ ID NO: 5246 - DNA, 42 bp, Artificial Sequence
  Synthetic
atcaatgctatgaatccaggcattgtcctcaataccggatgg

SEQ ID NO: 5247 - DNA, 41 bp, Artificial Sequence
  Synthetic
cacttgtccatttgtgtcattcgtgtttgttttgacagccg

SEQ ID NO: 5248 - DNA, 40 bp, Artificial Sequence
  Synthetic
tccatggggccaaagaaatagctatgaggcccatgcaact

SEQ ID NO: 5249 - DNA, 43 bp, Artificial Sequence
  Synthetic
ctatcgactcttcaaacacggcatagactcaggtactccttcc

SEQ ID NO: 5250 - DNA, 46 bp, Artificial Sequence
  Synthetic
cgagaacgaaaatgacagtgatacactgtttctgcctgtgttaaat

SEQ ID NO: 5251 - DNA, 38 bp, Artificial Sequence
  Synthetic
tacaggtagaagggcgccatccccacttccaccactat

SEQ ID NO: 5252 - DNA, 49 bp, Artificial Sequence
  Synthetic
acagacctacgtgaccatatagacttgtaataaatagcacattctaggc

SEQ ID NO: 5253 - DNA, 46 bp, Artificial Sequence
  Synthetic
tggagacatatgcaatacaatgcagttactgatgcttcttcacaaa

SEQ ID NO: 5254 - DNA, 39 bp, Artificial Sequence
  Synthetic
aatcccactttcactgacccaaatgccctccagtttctg

SEQ ID NO: 5255 - DNA, 41 bp, Artificial Sequence
  Synthetic
acggatgaatatgttgcacgcgcaagtagtctggatgttcc

SEQ ID NO: 5256 - DNA, 45 bp, Artificial Sequence
  Synthetic
gtgttgaggtaggtcgtggtccaatttatttaataaaggatggcc

SEQ ID NO: 5257 - DNA, 44 bp, Artificial Sequence
  Synthetic
tatggttgatactggctttggtgaacttcacttttgttagcctg

SEQ ID NO: 5258 - DNA, 44 bp, Artificial Sequence
  Synthetic
tttcctacacctagtggttctatggtgtgctcgttgtaaccaat

SEQ ID NO: 5259 - DNA, 47 bp, Artificial Sequence
  Synthetic
taggacgcaaatttttactacaagctgtagcttttcgttttcctaat

SEQ ID NO: 5260 - DNA, 42 bp, Artificial Sequence
  Synthetic
atgcgtgccaaatccctgtttaaaaaacaatggaatggttgg

SEQ ID NO: 5261 - DNA, 41 bp, Artificial Sequence
  Synthetic
agaatgtgtgtactgcaagcaatcccgaaaagcaaagtcat

SEQ ID NO: 5262 - DNA, 44 bp, Artificial Sequence
  Synthetic
ttccataatataaggggtcggtggcgtgttcttgatgatctgca

SEQ ID NO: 5263 - DNA, 43 bp, Artificial Sequence
  Synthetic
cggacagagcccattacaatattgtttgtacgcacaaccgaag

SEQ ID NO: 5264 - DNA, 42 bp, Artificial Sequence
  Synthetic
atatgcacacacttagaagtctgcagttgattcgcctcgttc

SEQ ID NO: 5265 - DNA, 50 bp, Artificial Sequence
  Synthetic
aggaaaaccgtttcattgaaattggctttctctaggtaatatatgtggac

SEQ ID NO: 5266 - DNA, 41 bp, Artificial Sequence
  Synthetic
aacaagccaattaaagtgggcatcctcaaagtccaccttct

SEQ ID NO: 5267 - DNA, 45 bp, Artificial Sequence
  Synthetic
ttttacagcagaggtgtcccactgtatttatgtacactcccttca

SEQ ID NO: 5268 - DNA, 43 bp, Artificial Sequence
  Synthetic
gttggaaccacataaatgggaaaagcttggcctactgcagttc

SEQ ID NO: 5269 - DNA, 41 bp, Artificial Sequence; identical to SEQ ID NO: 4498
  Synthetic

SEQ ID NO: 5270 - DNA, 46 bp, Artificial Sequence
  Synthetic
acaaagactgaacaaaaggagctacgcatcctttgtcattgtgttc

SEQ ID NO: 5271 - DNA, 44 bp, Artificial Sequence
  Synthetic
aattggcaaatgttgtgaggaagaaattgtgaaggagagctctg

SEQ ID NO: 5272 - DNA, 43 bp, Artificial Sequence
  Synthetic
agtaccagcggaaatgctcgctctcttgttgatttgttgaagt

SEQ ID NO: 5273 - DNA, 40 bp, Artificial Sequence
  Synthetic
tgacttcgccctcatagtgaaacctatctactcctgcctg

SEQ ID NO: 5274 - DNA, 38 bp, Artificial Sequence
  Synthetic
cccaaatggcccttcagctacccctgtgacatcggtat

SEQ ID NO: 5275 - DNA, 44 bp, Artificial Sequence
  Synthetic
ggatgaagactaccaaggcaggatttccttatgactgacaaacg

SEQ ID NO: 5276 - DNA, 47 bp, Artificial Sequence
  Synthetic
agatggacctgacatctgtacattctcaataaatgggatacggagag

SEQ ID NO: 5277 - DNA, 48 bp, Artificial Sequence
  Synthetic
attggtttaaggtgtgttacatgcaagaaacaacagctaacttttctg

SEQ ID NO: 5278 - DNA, 43 bp, Artificial Sequence
  Synthetic
aggaggagtctgaatatccatatgcgccttaacagctgatcgc

SEQ ID NO: 5279 - DNA, 46 bp, Artificial Sequence
  Synthetic
cgggatgatgatgagagcgaattatctgatatgtcactttcagatc

SEQ ID NO: 5280 - DNA, 39 bp, Artificial Sequence
  Synthetic
tgcaatagcctcagtcccagttgcctttttttccctctg

SEQ ID NO: 5281 - DNA, 44 bp, Artificial Sequence
  Synthetic
cacagtaggtgtcagttttactgaaactacagcatgtcttgttg

SEQ ID NO: 5282 - DNA, 41 bp, Artificial Sequence
  Synthetic
aagtgaccaagaagacgaggagcttgtagccagtctaagcg

SEQ ID NO: 5283 - DNA, 47 bp, Artificial Sequence
  Synthetic
gactcacaatatggttctgaacagttggtgctaaaaagatttctctg

SEQ ID NO: 5284 - DNA, 38 bp, Artificial Sequence
  Synthetic
ccggctgttcgcaagcgatctgagggtggtatctctgg

SEQ ID NO: 5285 - DNA, 43 bp, Artificial Sequence
  Synthetic
agctgctccacaagatatttatcctttgtatatcaggggggca

SEQ ID NO: 5286 - DNA, 49 bp, Artificial Sequence
  Synthetic
tcctttattcaggatcacagctagtaatattatcagatgctgaagcttc

SEQ ID NO: 5287 - DNA, 43 bp, Artificial Sequence
  Synthetic
tagacgctattatgaacaagtgccgtaactaaggaagcaggcc

SEQ ID NO: 5288 - DNA, 43 bp, Artificial Sequence
  Synthetic
ttgagttacaaacactgggtgaagcgatgcagcaagagaactt

SEQ ID NO: 5289 - DNA, 38 bp, Artificial Sequence
  Synthetic
cagatggctgtttggcttccttggtgatcggttgggta

SEQ ID NO: 5290 - DNA, 44 bp, Artificial Sequence
  Synthetic
cctaaccgatttgcctttggagccaaactagtctctcagtttct

SEQ ID NO: 5291 - DNA, 46 bp, Artificial Sequence
  Synthetic
tgtgcaggaacacagtttcagcctcaataactgtgttaactaattc

SEQ ID NO: 5292 - DNA, 46 bp, Artificial Sequence
  Synthetic
tttcagaaaacgtagatcctccaatattcacatgtatattcaggcc

SEQ ID NO: 5293 - DNA, 39 bp, Artificial Sequence
  Synthetic
tggcatgcaattggtatgtggaacttcaaaattcgcgcg

SEQ ID NO: 5294 - DNA, 48 bp, Artificial Sequence
  Synthetic
tcggaagaatgattggtggaatcgcataatcactgagtttgagttcag

SEQ ID NO: 5295 - DNA, 44 bp, Artificial Sequence
  Synthetic
ggtgaaaatggacgaaggacaatgtttgaaattttcctttgagg

SEQ ID NO: 5296 - DNA, 42 bp, Artificial Sequence
  Synthetic
agggaagggtactcactggtcggaccacttggctgttttgga

SEQ ID NO: 5297 - DNA, 44 bp, Artificial Sequence
  Synthetic
ttgcttcaaatgagaatgtggaaaccccagtatctgcttctcag

SEQ ID NO: 5298 - DNA, 43 bp, Artificial Sequence
  Synthetic
acttggaatgcaggaccttttttccccatttgaatgcctgtca

SEQ ID NO: 5299 - DNA, 49 bp, Artificial Sequence
  Synthetic
ttgaggacacaagagtctgaatgtccatcagtcattatagtaaaacatg

SEQ ID NO: 5300 - DNA, 47 bp, Artificial Sequence
  Synthetic
gacaattggcatggttcgaaccgtatcctatttgataatccaggttt

SEQ ID NO: 5301 - DNA, 44 bp, Artificial Sequence
  Synthetic
aatggatggacagagactgatagtcaatcagtcattgccacaac

SEQ ID NO: 5302 - DNA, 41 bp, Artificial Sequence
  Synthetic
gtgtcttgaaacgatggaagttggtcataggtttggcgacc

SEQ ID NO: 5303 - DNA, 48 bp, Artificial Sequence
  Synthetic
aattggcaaatgtcgtgaggaagagtaattgtaaaagagagctctgta

SEQ ID NO: 5304 - DNA, 44 bp, Artificial Sequence
  Synthetic
atgttcgaaagtaagagcatgaagctcaagtcaatgcttgcaag

SEQ ID NO: 5305 - DNA, 43 bp, Artificial Sequence
  Synthetic
tccaatcctctgatgatttcgctcctgcttctattccctcatg

SEQ ID NO: 5306 - DNA, 41 bp, Artificial Sequence
  Synthetic
ggacaacgaccttggaccagcgtggcatcggtatgggtatc

SEQ ID NO: 5307 - DNA, 40 bp, Artificial Sequence
  Synthetic
caacacggcgaccctacaagtcttgcagtgaagtgttcag

SEQ ID NO: 5308 - DNA, 43 bp, Artificial Sequence
  Synthetic
ttggaaaaactaactaacactgggtttcaacggtttctggcac

SEQ ID NO: 5309 - DNA, 47 bp, Artificial Sequence
  Synthetic
aattccggttgaccttctatgtccatctatttcatcgttttcttcct

SEQ ID NO: 5310 - DNA, 38 bp, Artificial Sequence
  Synthetic
acgaaagtttgcaggaggcatctgtatccacctccagc

SEQ ID NO: 5311 - DNA, 46 bp, Artificial Sequence
  Synthetic
ggcagtacggaggctatagacctatattgctattgtcacttgtacc

SEQ ID NO: 5312 - DNA, 47 bp, Artificial Sequence
  Synthetic
agatgaagggggagattggagaggctcctaaaaatgttataaactct

SEQ ID NO: 5313 - DNA, 46 bp, Artificial Sequence
  Synthetic
ggcatacagacattaaaccaccagttcaatagctttatgtgcttta

SEQ ID NO: 5314 - DNA, 41 bp, Artificial Sequence
  Synthetic
gacaaaaccgctacctgtgtaacgtgttgtacccttccttt

SEQ ID NO: 5315 - DNA, 39 bp, Artificial Sequence
  Synthetic
gggcaccgcaaagacctacggagtccacagtgtccaggt

SEQ ID NO: 5316 - DNA, 43 bp, Artificial Sequence
  Synthetic
ttggacaggtgcaggcaatgtctttgtgtttcactatggtatg

SEQ ID NO: 5317 - DNA, 44 bp, Artificial Sequence
  Synthetic
attgtggtaataacgtcccctgcgcaatagtaacatgggcaata

SEQ ID NO: 5318 - DNA, 44 bp, Artificial Sequence
  Synthetic
tatccgtctacataggcctgcctaatctactaaagcgaacagtc

SEQ ID NO: 5319 - DNA, 41 bp, Artificial Sequence
  Synthetic
gcctgtaccatcgcgttctacagaagatatagtgggcgaat

SEQ ID NO: 5320 - DNA, 39 bp, Artificial Sequence
  Synthetic
attggggaacactgggctaataagttctaaaggggggca

SEQ ID NO: 5321 - DNA, 40 bp, Artificial Sequence
  Synthetic
ggtactatgggtgacactgtgccaggtgaagcaggcatac

SEQ ID NO: 5322 - DNA, 44 bp, Artificial Sequence
  Synthetic
ctgtacctgggcaatatgatgcatcatattcctcaacatgtctg

SEQ ID NO: 5323 - DNA, 43 bp, Artificial Sequence
  Synthetic
tcctacaatcctccattttgctgaaaccacagacataagccaa

SEQ ID NO: 5324 - DNA, 40 bp, Artificial Sequence
  Synthetic
gagaccctccttacagccatgactgatgtgtcctgttgac

SEQ ID NO: 5325 - DNA, 40 bp, Artificial Sequence
  Synthetic
tgaaacgatggaggttgttcagagtcataggtctgtcggc

SEQ ID NO: 5326 - DNA, 43 bp, Artificial Sequence
  Synthetic
gaaagcaaagttggcaaatgttgtaagaaagttcggtgtcctg

SEQ ID NO: 5327 - DNA, 43 bp, Artificial Sequence
  Synthetic
tcttcaatcctctgacgattttgccggcttgaatcccttcatg

SEQ ID NO: 5328 - DNA, 43 bp, Artificial Sequence
  Synthetic
cggacatgagtattggagttactgtgctggaccaagatcattg

SEQ ID NO: 5329 - DNA, 41 bp, Artificial Sequence
  Synthetic
acagaagaccagtcgggatatccgcatcaattcgggctctg

SEQ ID NO: 5330 - DNA, 39 bp, Artificial Sequence
  Synthetic
ggtggtaaatcccagcacaggttccagggaagcggtcac

SEQ ID NO: 5331 - DNA, 38 bp, Artificial Sequence
  Synthetic
gagttcctctagggatggccgatgccgcctgtagcacg

SEQ ID NO: 5332 - DNA, 38 bp, Artificial Sequence
  Synthetic
ccggtggcctcagctgcttcgagggagaatggttcacc

SEQ ID NO: 5333 - DNA, 41 bp, Artificial Sequence
  Synthetic
agggtggcatcttcgacaactgtgatgtccagcctaggagg

SEQ ID NO: 5334 - DNA, 37 bp, Artificial Sequence
  Synthetic
cagtggggctccgcgtactctcctgggcagctcatca

SEQ ID NO: 5335 - DNA, 41 bp, Artificial Sequence
  Synthetic
taggaggttattggcacgccctcactgggattccgggaatc

SEQ ID NO: 5336 - DNA, 40 bp, Artificial Sequence
  Synthetic
tcttcagtggtcagcgtcggtaccaacatggcaagaacca

SEQ ID NO: 5337 - DNA, 37 bp, Artificial Sequence
  Synthetic
tgcttcgctggttccgacttgtggcgccagaaagggc

SEQ ID NO: 5338 - DNA, 38 bp, Artificial Sequence
  Synthetic
cgtgctggtggcgatgcactgccaacactagcatgact

SEQ ID NO: 5339 - DNA, 40 bp, Artificial Sequence
  Synthetic
gccggcctttgtgcaaactgacacacttcagcagcaatgt

SEQ ID NO: 5340 - DNA, 42 bp, Artificial Sequence
  Synthetic
aggactgtgccatagttcgggagcacaccattcactctctga

SEQ ID NO: 5341 - DNA, 39 bp, Artificial Sequence
  Synthetic
ccattgccaatgggggctaccttctcacgacccaaacgc

SEQ ID NO: 5342 - DNA, 42 bp, Artificial Sequence
  Synthetic
ctccctagggaggctcagaccaacgatagccggttttacccg

SEQ ID NO: 5343 - DNA, 37 bp, Artificial Sequence
  Synthetic
gtgcccggttgctggcgaagggtcgcagtggcaaaca

SEQ ID NO: 5344 - DNA, 39 bp, Artificial Sequence
  Synthetic
ctgggtgtgtcggcagtgaccacatcaccggctggaatt

SEQ ID NO: 5345 - DNA, 38 bp, Artificial Sequence
  Synthetic
ggcaggtaccgtgcgctcttaccacgtgacaccagcct

SEQ ID NO: 5346 - DNA, 38 bp, Artificial Sequence
  Synthetic
ggaacatgtggccccccatcacccgccaagcaaggggt

SEQ ID NO: 5347 - DNA, 39 bp, Artificial Sequence
  Synthetic
tgtgaagccggtggcggaagcgtagctagcagccatggg

SEQ ID NO: 5348 - DNA, 36 bp, Artificial Sequence
  Synthetic
cggcctctttcctgctgggaaggagcagagcagccg

SEQ ID NO: 5349 - DNA, 39 bp, Artificial Sequence
  Synthetic
gcgctcggcgttctactctggagacggttgacccagtcg

SEQ ID NO: 5350 - DNA, 40 bp, Artificial Sequence
  Synthetic
gatggggtgcagcaaaggatggatccacaagtacagcgcg

SEQ ID NO: 5351 - DNA, 39 bp, Artificial Sequence
  Synthetic
cgtctagcgcctacgacctgaggcaaatcaccggcgaag

SEQ ID NO: 5352 - DNA, 39 bp, Artificial Sequence
  Synthetic
ctgctgtgtccctactgccctctcggcaagaacagtcgt

SEQ ID NO: 5353 - DNA, 41 bp, Artificial Sequence
  Synthetic
agctggtgtgcaggagagaagaccctcccacaacctaaggg

SEQ ID NO: 5354 - DNA, 40 bp, Artificial Sequence
  Synthetic
tcgacgaacatgacatgcaggtcaaagcatgcacccggac

SEQ ID NO: 5355 - DNA, 41 bp, Artificial Sequence
  Synthetic
cttggctgaatgtgttgctgggggcttccgcatatccgtac

SEQ ID NO: 5356 - DNA, 40 bp, Artificial Sequence
  Synthetic
gagttggtgatgtgccaggtccgcgaggcaagagcttcag

SEQ ID NO: 5357 - DNA, 42 bp, Artificial Sequence
  Synthetic
atttggaagcttgtgaattcgactagcacgcaaacacacaat

SEQ ID NO: 5358 - DNA, 47 bp, Artificial Sequence
  Synthetic
aggcagtgtaagcatttttatcatgagctccagaataatatcttgca

SEQ ID NO: 5359 - DNA, 43 bp, Artificial Sequence
  Synthetic
ggcaattccctggaactatttcaagtttttgcaattgctcctc

SEQ ID NO: 5360 - DNA, 42 bp, Artificial Sequence
  Synthetic
tgcgttctagcaacaaaaaagcaacctactccaaacgactct

SEQ ID NO: 5361 - DNA, 40 bp, Artificial Sequence
  Synthetic
gtgggataggtgcaatgtcatttatgaactgtcccgcgat

SEQ ID NO: 5362 - DNA, 39 bp, Artificial Sequence
  Synthetic
caaggcttgctcccgaagaccaaatttggcctggttgtt

SEQ ID NO: 5363 - DNA, 48 bp, Artificial Sequence
  Synthetic
ctaaaagtcagttttggctgcaactgttacatcatccaatagagctat

SEQ ID NO: 5364 - DNA, 42 bp, Artificial Sequence
  Synthetic
tttggacacaattagacctgagtgattgaaacgctcgctgag

SEQ ID NO: 5365 - DNA, 40 bp, Artificial Sequence
  Synthetic
ccccaccacctccacaaccgtcggtttgttgtggctgttt

SEQ ID NO: 5366 - DNA, 37 bp, Artificial Sequence
  Synthetic
gtggaaggtcacccaggcggtgtggtgcaggaggagg

SEQ ID NO: 5367 - DNA, 38 bp, Artificial Sequence
  Synthetic
gcgaccccccagtaatcatttttagctctgttgcggac

SEQ ID NO: 5368 - DNA, 47 bp, Artificial Sequence
  Synthetic
atgctgcttttgctactaacatactcgccatagcaaatacaaaatgt

SEQ ID NO: 5369 - DNA, 41 bp, Artificial Sequence
  Synthetic
ccactagcacaggttccagtgctgacccgtgttggaggaat

SEQ ID NO: 5370 - DNA, 43 bp, Artificial Sequence
  Synthetic
tccagacagagattttcttgatgttcatatcccgctggtgttg

SEQ ID NO: 5371 - DNA, 43 bp, Artificial Sequence
  Synthetic
agtcattatacaccctcatgacagtttttacgtttgcgcctgt

SEQ ID NO: 5372 - DNA, 45 bp, Artificial Sequence
  Synthetic
ccaaatgtttattgtaggatgcacatcattttctgcacatggaac

SEQ ID NO: 5373 - DNA, 46 bp, Artificial Sequence
  Synthetic
atccagtgatgctcaattgtttaacccattattatgaccttgggct

SEQ ID NO: 5374 - DNA, 48 bp, Artificial Sequence
  Synthetic
caaacgtaaaaattgaggtctgaccttccttgaatactgtgtaaaagt

SEQ ID NO: 5375 - DNA, 43 bp, Artificial Sequence
  Synthetic
tcgaacaatcaagcagtgccactatctctgttatgttcctttc

SEQ ID NO: 5376 - DNA, 42 bp, Artificial Sequence
  Synthetic
atcgtgcggtcttggtaaatgtttgttgttcaaagtggttcc

SEQ ID NO: 5377 - DNA, 45 bp, Artificial Sequence
  Synthetic
atgcgactgctagcatcatttatgatgagttctgaggatgttctt

SEQ ID NO: 5378 - DNA, 48 bp, Artificial Sequence
  Synthetic
ccagaagttagatgtgtttgcagaacatttatatatagcacgggtcta

SEQ ID NO: 5379 - DNA, 47 bp, Artificial Sequence
  Synthetic
ctggttatgagactttcagggtcgtgacttgcctatttatttgtgac

SEQ ID NO: 5380 - DNA, 39 bp, Artificial Sequence
  Synthetic
aagaactgactcccggaaccagttcgtttgttgcttggc

SEQ ID NO: 5381 - DNA, 48 bp, Artificial Sequence
  Synthetic
ctaattcaaaatgcacaagctgtggttcagttttcttgtcatcagttg

SEQ ID NO: 5382 - DNA, 45 bp, Artificial Sequence
  Synthetic
tgagattccaattaagcagaccatctcataatcctctgctgtgtc

SEQ ID NO: 5383 - DNA, 44 bp, Artificial Sequence
  Synthetic
tctctcctatcattgttggcaacttatagtaaccggtgctggtt

SEQ ID NO: 5384 - DNA, 49 bp, Artificial Sequence
  Synthetic
actttgtcgatttgaaaatgagaggtggtagaactaagctttctaattc

SEQ ID NO: 5385 - DNA, 45 bp, Artificial Sequence
  Synthetic
ccctccgtgctcgaagatttgttaagtcagtacctttattactgt

SEQ ID NO: 5386 - DNA, 42 bp, Artificial Sequence
  Synthetic
tgaaacggaggatcataactctgcgctgaggagaggtggtaa

SEQ ID NO: 5387 - DNA, 40 bp, Artificial Sequence
  Synthetic
agcattgcctacagatatgccaatgcttcagaaacgcagc

SEQ ID NO: 5388 - DNA, 43 bp, Artificial Sequence
  Synthetic
cgaggcgcattagatggtaatgttcaattgagtaggtgctcta

SEQ ID NO: 5389 - DNA, 47 bp, Artificial Sequence
  Synthetic
agatgaatcaggccgatttgacctcataaagattcattaggttttcc

SEQ ID NO: 5390 - DNA, 39 bp, Artificial Sequence
  Synthetic
aaaaggcgaagagggaggagccgtcgtcgtcgtcgtaac

SEQ ID NO: 5391 - DNA, 45 bp, Artificial Sequence
  Synthetic
tctccagaaaatggggttgcaatttaatagtgtcatgtgcaaaca

SEQ ID NO: 5392 - DNA, 46 bp, Artificial Sequence
  Synthetic
cccctattgaacgtctacaatcctaacttgctgtacaaaacgtcta

SEQ ID NO: 5393 - DNA, 43 bp, Artificial Sequence
  Synthetic
tttcagatgtcttggacaaagtcagcacctttgcaacaggctt

SEQ ID NO: 5394 - DNA, 46 bp, Artificial Sequence
  Synthetic
aatttgctatcacagatgcatgtgtactagtctccatactaatcgc

SEQ ID NO: 5395 - DNA, 41 bp, Artificial Sequence
  Synthetic
agacaggatatggcatttgaccctactgtcctgttggtggt

SEQ ID NO: 5396 - DNA, 46 bp, Artificial Sequence
  Synthetic
aaatgggcaaggatatttatggtgatcttgcataaagctgttcctt

SEQ ID NO: 5397 - DNA, 48 bp, Artificial Sequence
  Synthetic
atggtgttttatggggtaatgactgctgaagttaatatttcgcgtatt

SEQ ID NO: 5398 - DNA, 41 bp, Artificial Sequence
  Synthetic
aacatgccctcaaactttggtttttgtgctacgtttgcagt

SEQ ID NO: 5399 - DNA, 40 bp, Artificial Sequence
  Synthetic
ggagatcctccatacagccattgtgttctgttgactgtgt

SEQ ID NO: 5400 - DNA, 42 bp, Artificial Sequence
  Synthetic
gaactcatgccttgaaacaatggaggccttgggttagtttgt

SEQ ID NO: 5401 - DNA, 48 bp, Artificial Sequence
  Synthetic
aatggtcacacaaagaacaataggggctcttattagatagcctctctt

SEQ ID NO: 5402 - DNA, 43 bp, Artificial Sequence
  Synthetic
ccaaactggcaaatgttgtgagtgaaagaaagctcagtgtctt

SEQ ID NO: 5403 - DNA, 45 bp, Artificial Sequence
  Synthetic
tgaagctccgaacacaaatacccattgaaatacttcaggtcaatg

SEQ ID NO: 5404 - DNA, 43 bp, Artificial Sequence
  Synthetic
tccaatcctccgacgattttgcgaatctatccactcctgcttg

SEQ ID NO: 5405 - DNA, 42 bp, Artificial Sequence
  Synthetic
cccagatggctctccaattgttcctctatggcacctatatgt

SEQ ID NO: 5406 - DNA, 43 bp, Artificial Sequence
  Synthetic
tgaagtctgcttaaagtgggagccagggggttacaaagtcttc

SEQ ID NO: 5407 - DNA, 43 bp, Artificial Sequence
  Synthetic
ccctagtagttcatataggagaccgattctggcatcaatccgg

SEQ ID NO: 5408 - DNA, 46 bp, Artificial Sequence
  Synthetic
tggagcctcagagagctaaaaattacaagcactgtagctctaattc

SEQ ID NO: 5409 - DNA, 44 bp, Artificial Sequence
  Synthetic
aaggtcaccattcaagattgattctgacacaacacagtctaacg

SEQ ID NO: 5410 - DNA, 47 bp, Artificial Sequence
  Synthetic
aacaccagaaagacaatccaaaaggttttcagcttcatcttcaatcc

SEQ ID NO: 5411 - DNA, 38 bp, Artificial Sequence
  Synthetic
tcctcaaggagtgcgtttggtgtcgtacgatgtggaag

SEQ ID NO: 5412 - DNA, 46 bp, Artificial Sequence
  Synthetic
gcttttaaaaatcctgaacaaaggcaatgtcccatagagtacgtag

SEQ ID NO: 5413 - DNA, 38 bp, Artificial Sequence
  Synthetic
caggaagaggaactgggggttgagttggccttccagac

SEQ ID NO: 5414 - DNA, 46 bp, Artificial Sequence
  Synthetic
caacagatgttggtgctgttggctacttcaaattcttcgttagagg

SEQ ID NO: 5415 - DNA, 48 bp, Artificial Sequence
  Synthetic
tcaaacctttgacattttagagccaacaaacctattacctaattgggt

SEQ ID NO: 5416 - DNA, 45 bp, Artificial Sequence
  Synthetic
cgccattgcaggaatttgctgcttactcttattgtaccttctgag

SEQ ID NO: 5417 - DNA, 45 bp, Artificial Sequence
  Synthetic
agtgagcgtttactaattgtgggaactttgatatctccaccatct

SEQ ID NO: 5418 - DNA, 50 bp, Artificial Sequence
  Synthetic
gttggagacacagaaaatcctagctgtttgtttaggatctatagacaagt

SEQ ID NO: 5419 - DNA, 41 bp, Artificial Sequence
  Synthetic
aactacaacaggacagagcaggtcaggccataagctgattg

SEQ ID NO: 5420 - DNA, 43 bp, Artificial Sequence
  Synthetic
aggatttgtcacaagaggcggcaactgaaacaatacacaacaa

SEQ ID NO: 5421 - DNA, 44 bp, Artificial Sequence
  Synthetic
ggactaggaaatgaagctgaagatcccattgctatcagactcag

SEQ ID NO: 5422 - DNA, 40 bp, Artificial Sequence
  Synthetic
cgtcgacgcctagaagacgacgttgttctctccgttgggc

SEQ ID NO: 5423 - DNA, 41 bp, Artificial Sequence
  Synthetic
gcaaactaaaatacaggggcatgccttcagcaacccatgaa

SEQ ID NO: 5424 - DNA, 42 bp, Artificial Sequence
  Synthetic
aattggtgccaatagacgcccgcactactatttcaggaccaa

SEQ ID NO: 5425 - DNA, 39 bp, Artificial Sequence
  Synthetic
cctagacgggtagcgactagctgtagtggccacaaatgt

SEQ ID NO: 5426 - DNA, 44 bp, Artificial Sequence
  Synthetic
tgtacaatagaagagtcagacaggtaattgaactgaatcgcctg

SEQ ID NO: 5427 - DNA, 41 bp, Artificial Sequence
  Synthetic
tcgtccttaatactggctctcgacctttaatgctgctccac

SEQ ID NO: 5428 - DNA, 45 bp, Artificial Sequence
  Synthetic
tgcttctggtaaggtgtatcttccaatcatctgtactcagcactc

SEQ ID NO: 5429 - DNA, 46 bp, Artificial Sequence
  Synthetic
acttctaagtcttccaaacgcaaagcaagtagaacaaagttcacat

SEQ ID NO: 5430 - DNA, 41 bp, Artificial Sequence
  Synthetic
gactcacagccaacctctctgttgcaagaggattatgtctc

SEQ ID NO: 5431 - DNA, 46 bp, Artificial Sequence
  Synthetic
ttcaggatcttgcatcgtttgaaccataacaaaatggtcctttcca

SEQ ID NO: 5432 - DNA, 44 bp, Artificial Sequence
  Synthetic
atcagattttatgtaagtgccagcgctgagaaagaagcagttgc

SEQ ID NO: 5433 - DNA, 48 bp, Artificial Sequence
  Synthetic
cagtgcagaaaatgaagctgaagcattgttattttcagttccagtttc

SEQ ID NO: 5434 - DNA, 42 bp, Artificial Sequence
  Synthetic
gcataatgccagagtggataacaatgactcactagctgtagc

SEQ ID NO: 5435 - DNA, 46 bp, Artificial Sequence
  Synthetic
tgatgttacatatgcatgttggagtggattaccatctaaacccgtt

SEQ ID NO: 5436 - DNA, 48 bp, Artificial Sequence
  Synthetic
aaatgctgcaaaagacattgatacaacataataacatgctcttgtctt

SEQ ID NO: 5437 - DNA, 39 bp, Artificial Sequence
  Synthetic
ctctcccactgcctggaaacatagtttcggagttccagg

SEQ ID NO: 5438 - DNA, 48 bp, Artificial Sequence
  Synthetic
gacactgtcacactaccaaaaggaattaacccttttactggtattcat

SEQ ID NO: 5439 - DNA, 41 bp, Artificial Sequence
  Synthetic
ttttcctgatgtcaccgttgttggaccagaaacagtgacat

SEQ ID NO: 5440 - DNA, 43 bp, Artificial Sequence
  Synthetic
tacactttttaaatcagccttcccgtctgctcctcctcaaagg

SEQ ID NO: 5441 - DNA, 48 bp, Artificial Sequence
  Synthetic
cccacaaacaaatataattcctggcattgcaggttcaatattagaagt

SEQ ID NO: 5442 - DNA, 43 bp, Artificial Sequence
  Synthetic
aatccagaaactcaacggctagtgtagttccaataccaagcgg

SEQ ID NO: 5443 - DNA, 40 bp, Artificial Sequence
  Synthetic
ctatggaaaacgagagcagctgtctcccattgttcctgct

SEQ ID NO: 5444 - DNA, 41 bp, Artificial Sequence
  Synthetic
acaaccaacatccagtattgaggcagcttgttcaggacagg

SEQ ID NO: 5445 - DNA, 45 bp, Artificial Sequence
  Synthetic
tgtttgactcatggggtcagtcgatggacagtctaaaatctgttt

SEQ ID NO: 5446 - DNA, 42 bp, Artificial Sequence
  Synthetic
ttcaggtacgtctttattgttgcctaccactcccggtcattg

SEQ ID NO: 5447 - DNA, 38 bp, Artificial Sequence
  Synthetic
gcccatcctggacatggagacgcccgtctggtccacca

SEQ ID NO: 5448 - DNA, 42 bp, Artificial Sequence
  Synthetic
ctcaagttttcgcacccgtcgcgaggaaatgctggcaggttc

SEQ ID NO: 5449 - DNA, 36 bp, Artificial Sequence
  Synthetic
gattccattcggggtgccgctgtggcctcccgttcc

SEQ ID NO: 5450 - DNA, 38 bp, Artificial Sequence
  Synthetic
taaggccctgggagcgcgtgccataaacgccgactacg

SEQ ID NO: 5451 - DNA, 38 bp, Artificial Sequence
  Synthetic
gcctcttccagtaactcggccctttgcggacgagctgc

SEQ ID NO: 5452 - DNA, 37 bp, Artificial Sequence
  Synthetic
gcgagtagttggtgatgcggcgcccggcctgacgatt

SEQ ID NO: 5453 - DNA, 36 bp, Artificial Sequence
  Synthetic
gagcttggccatgtacgcgcaacctccccggctgga

SEQ ID NO: 5454 - DNA, 36 bp, Artificial Sequence
  Synthetic
gtcggcgagcccacacacaaccacaccccccagtac

SEQ ID NO: 5455 - DNA, 35 bp, Artificial Sequence
  Synthetic
agaactgcccccgaagccacgagccacgccagaac

SEQ ID NO: 5456 - DNA, 36 bp, Artificial Sequence
  Synthetic
gttcgtcctgccccactggacagggccgagagaacg

SEQ ID NO: 5457 - DNA, 35 bp, Artificial Sequence
  Synthetic
gtggtccgtctcgctaacggagccgtcaagcgcgt

SEQ ID NO: 5458 - DNA, 37 bp, Artificial Sequence
  Synthetic
ccgaaggtcctcccagatccctgcagcaccatggccg

SEQ ID NO: 5459 - DNA, 40 bp, Artificial Sequence
  Synthetic
gcagaaccgggccacgatctggggcgataacatctgcatt

SEQ ID NO: 5460 - DNA, 35 bp, Artificial Sequence
  Synthetic
attggcgcgcggaccacaaccttccccaacgcgag

SEQ ID NO: 5461 - DNA, 39 bp, Artificial Sequence
  Synthetic
tgcactttgcgtgtctggtgtgatacgtcccgctcagga

SEQ ID NO: 5462 - DNA, 38 bp, Artificial Sequence
  Synthetic
cgtgtcgtcgaatgccaggccgcatcgatccggagatc

SEQ ID NO: 5463 - DNA, 36 bp, Artificial Sequence
  Synthetic
ggtgcggtgcctgccgataagccacttccccgactg

SEQ ID NO: 5464 - DNA, 37 bp, Artificial Sequence
  Synthetic
gaatgggagctcgggtccacaaccttccgtcccctgc

SEQ ID NO: 5465 - DNA, 37 bp, Artificial Sequence
  Synthetic
atcgccttgtgtgtgtgctggcccaagattcggcgcg

SEQ ID NO: 5466 - DNA, 37 bp, Artificial Sequence
  Synthetic
ggcgaacacggggctgcattccccctcgcacatcctc

SEQ ID NO: 5467 - DNA, 35 bp, Artificial Sequence
  Synthetic
cgccggatcgaggtaccgttggaggagcaagcggc

SEQ ID NO: 5468 - DNA, 40 bp, Artificial Sequence
  Synthetic
aggatcttgggtgctgacgcgccgagatttacaaggacca

SEQ ID NO: 5469 - DNA, 35 bp, Artificial Sequence
  Synthetic
tcagggggtgcgtcacgcttttaaccgcgagcgcc

SEQ ID NO: 5470 - DNA, 39 bp, Artificial Sequence
  Synthetic
ggccacctgacacagaggcgagcggctcaagatctttcg

SEQ ID NO: 5471 - DNA, 35 bp, Artificial Sequence
  Synthetic
tgtgggtgtgtaggcgatgctacgcgcgccaaacc

SEQ ID NO: 5472 - DNA, 35 bp, Artificial Sequence
  Synthetic
aagtctgcgggggagcggtgaggccgctgttggtg

SEQ ID NO: 5473 - DNA, 38 bp, Artificial Sequence
  Synthetic
atggtcgccgtcattatggccgcgaatgtgtgcggagg

SEQ ID NO: 5474 - DNA, 37 bp, Artificial Sequence
  Synthetic
cgctctccatcctgcatcaggagtgtcacgcgggagg

SEQ ID NO: 5475 - DNA, 36 bp, Artificial Sequence
  Synthetic
caggggcgatggaagcggagtgcgcctggattcgct

SEQ ID NO: 5476 - DNA, 39 bp, Artificial Sequence
  Synthetic
tccaggcagcgatgtttggcgtgctcagcccctgcttta

SEQ ID NO: 5477 - DNA, 39 bp, Artificial Sequence
  Synthetic
gtcctgtcggacgacggtgcatcatcagctcaagacggg

SEQ ID NO: 5478 - DNA, 39 bp, Artificial Sequence
  Synthetic
gccagggcgcagaagacgtcggtgttttacctgctgcag

SEQ ID NO: 5479 - DNA, 36 bp, Artificial Sequence
  Synthetic
cgctcaaacgccccgaggagttgcgcgccatccaac

SEQ ID NO: 5480 - DNA, 42 bp, Artificial Sequence
  Synthetic
acagggtgttgcaatacgacccatgcaaacagcctgtacgac

SEQ ID NO: 5481 - DNA, 38 bp, Artificial Sequence
  Synthetic
ggcggcgaacaaggcacatgttttgggggatgtccgtg

SEQ ID NO: 5482 - DNA, 38 bp, Artificial Sequence
  Synthetic
gctacgccaccaccatgcaggtttcggtccgttgtgac

SEQ ID NO: 5483 - DNA, 39 bp, Artificial Sequence
  Synthetic
cttcgaccggggtctcggacgagagcgtgtttatcctgg

SEQ ID NO: 5484 - DNA, 37 bp, Artificial Sequence
  Synthetic
gccccgttaggcgccagaagtttttctcgggggacgc

SEQ ID NO: 5485 - DNA, 39 bp, Artificial Sequence
  Synthetic
tgtgtctgtcctccggaagggctcatcccgccgaccttg

SEQ ID NO: 5486 - DNA, 36 bp, Artificial Sequence
  Synthetic
cggcacgctgttgacgcttgtggcctcgaataccga

SEQ ID NO: 5487 - DNA, 37 bp, Artificial Sequence
  Synthetic
ccccgcgtcagacaaaccctgagtcttcggacctcgc

SEQ ID NO: 5488 - DNA, 37 bp, Artificial Sequence
  Synthetic
ccgggacttttggatgtcgccacgaccacctgctccg

SEQ ID NO: 5489 - DNA, 39 bp, Artificial Sequence
  Synthetic
ccttcatgacggcgctggtactggaatagtggcgctggc

SEQ ID NO: 5490 - DNA, 38 bp, Artificial Sequence
  Synthetic
gtcaaagtcgccgccctccctcaagaaccccaccaacc

SEQ ID NO: 5491 - DNA, 37 bp, Artificial Sequence
  Synthetic
cggctcagctggtgggagtcaccttcggtgggggcta

SEQ ID NO: 5492 - DNA, 34 bp, Artificial Sequence
  Synthetic
tcagcttgcgggcctcgttgccatcgcgtggtgc

SEQ ID NO: 5493 - DNA, 36 bp, Artificial Sequence
  Synthetic
tgtacctgcgggcgaagatgtgggggactgcatcgg

SEQ ID NO: 5494 - DNA, 36 bp, Artificial Sequence
  Synthetic
tccacctcctgccacttggttggcctgggactgggt

SEQ ID NO: 5495 - DNA, 36 bp, Artificial Sequence
  Synthetic
gatggccgcgtggaactgcaagcgcgtggacatcct

SEQ ID NO: 5496 - DNA, 35 bp, Artificial Sequence
  Synthetic
tgcgaaagttgcgcccctgccctgagtcagtgcca

SEQ ID NO: 5497 - DNA, 38 bp, Artificial Sequence
  Synthetic
gcagggtctcgagttcggctcatgcaggagacgtaccg

SEQ ID NO: 5498 - DNA, 39 bp, Artificial Sequence
  Synthetic
ccgagcctcccaggtgcagaaccgagggcttcaaggagg

SEQ ID NO: 5499 - DNA, 39 bp, Artificial Sequence
  Synthetic
gttgccgtcttgggctttgtcggattacctccgttcgcg

SEQ ID NO: 5500 - DNA, 36 bp, Artificial Sequence
  Synthetic
cgtctacgtccgaagcgggatggccgggcagaagtt

SEQ ID NO: 5501 - DNA, 37 bp, Artificial Sequence
  Synthetic
gattccccagagcagccccgcttgatggcggcctgct

SEQ ID NO: 5502 - DNA, 38 bp, Artificial Sequence
  Synthetic
acatctcgcgcgcgctgtggtgaacgtcttttcgcact

SEQ ID NO: 5503 - DNA, 42 bp, Artificial Sequence
  Synthetic
ggtccgggtaaaacaacagccgagctttttttcgtccacacg

SEQ ID NO: 5504 - DNA, 37 bp, Artificial Sequence
  Synthetic
caggaggctgggatcgaaggcgcagcagctggaaggc

SEQ ID NO: 5505 - DNA, 36 bp, Artificial Sequence
  Synthetic
ggatcagctgctttgtgcgctcggggcccatgaacc

SEQ ID NO: 5506 - DNA, 36 bp, Artificial Sequence
  Synthetic
cgtcaggacggagagccaggatccagcggggccaga

SEQ ID NO: 5507 - DNA, 36 bp, Artificial Sequence
  Synthetic
gtgcggggcattgtgtctccggcgaggtgggcttct

SEQ ID NO: 5508 - DNA, 38 bp, Artificial Sequence
  Synthetic
gatcccccccgcgttccatgcagggcacatatgatcgc

SEQ ID NO: 5509 - DNA, 38 bp, Artificial Sequence
  Synthetic
ggtaggccgcgctacacgtcctacgttctggccctggt

SEQ ID NO: 5510 - DNA, 38 bp, Artificial Sequence
  Synthetic
gaggccctcttgcacgaacggaaccttaccaccccggc

SEQ ID NO: 5511 - DNA, 35 bp, Artificial Sequence
  Synthetic
gggtggttccgccttgcgtagcaagacccggggga

SEQ ID NO: 5512 - DNA, 38 bp, Artificial Sequence
  Synthetic
aaaagccagcgcgggtgggaccggcaagtttccaaagc

SEQ ID NO: 5513 - DNA, 36 bp, Artificial Sequence
  Synthetic
tgcgtgcaggcgtttaacgaccttgagggcgggcat

SEQ ID NO: 5514 - DNA, 38 bp, Artificial Sequence
  Synthetic
ctgcaccgagatcgtccatcccgcttcccaggttgcag

SEQ ID NO: 5515 - DNA, 39 bp, Artificial Sequence
  Synthetic
atcaggggccgtgatatgccgaggacatccgcgacgaaa

SEQ ID NO: 5516 - DNA, 39 bp, Artificial Sequence
  Synthetic
ctcctcgtccgtccggcactttgtgtttggagccaaggc

SEQ ID NO: 5517 - DNA, 40 bp, Artificial Sequence
  Synthetic
ttcagtcggtatcgctggcgccgcttctggtccacgagag

SEQ ID NO: 5518 - DNA, 38 bp, Artificial Sequence
  Synthetic
ccacgttcgagctcggggtggtgacgcaggtactcgtg

SEQ ID NO: 5519 - DNA, 36 bp, Artificial Sequence
  Synthetic
ggggacacgggctaccctcatgtgcgttcgatgcgg

SEQ ID NO: 5520 - DNA, 39 bp, Artificial Sequence
  Synthetic
tgtctggttcgaggacgaccactcgtgcgtctgcgtgtc

SEQ ID NO: 5521 - DNA, 37 bp, Artificial Sequence
  Synthetic
ggccgtgaatcccccgtcatttgccgacaccgtggtg

SEQ ID NO: 5522 - DNA, 36 bp, Artificial Sequence
  Synthetic
gtgtcccgcggggagaaaggacgacgcccccgaaga

SEQ ID NO: 5523 - DNA, 37 bp, Artificial Sequence
  Synthetic
tggtcgccaccacgcattgggaagtcacgaggtacgg

SEQ ID NO: 5524 - DNA, 35 bp, Artificial Sequence
  Synthetic
actcgttggcgcgctgaatcaccaccatccgcgtg

SEQ ID NO: 5525 - DNA, 38 bp, Artificial Sequence
  Synthetic
gcggcccgggagagaagagacacagagggccactcacg

SEQ ID NO: 5526 - DNA, 36 bp, Artificial Sequence
  Synthetic
aggttcaccatgcaggcgtgcccgacgcctcgtgaa

SEQ ID NO: 5527 - DNA, 39 bp, Artificial Sequence
  Synthetic
taacgatgcggggggtggcctccacaaaatctcggtcca

SEQ ID NO: 5528 - DNA, 38 bp, Artificial Sequence
  Synthetic
cgcctgtgcgtgtccttgtgttgcaggcggttgctgtc

SEQ ID NO: 5529 - DNA, 35 bp, Artificial Sequence
  Synthetic
ccgtcttcggtgccagtcctgttggtgccggtggg

SEQ ID NO: 5530 - DNA, 39 bp, Artificial Sequence
  Synthetic
tgtttggcgtcgtgagtcccgcctgcgtagttcaagagg

SEQ ID NO: 5531 - DNA, 37 bp, Artificial Sequence
  Synthetic
ggacagcagcggggagtgttcctctccgtgggggtct

SEQ ID NO: 5532 - DNA, 34 bp, Artificial Sequence
  Synthetic
cggccatgcacaccagcaggcgcggaccaggtaa

SEQ ID NO: 5533 - DNA, 37 bp, Artificial Sequence
  Synthetic
acgaacggccacgacagtgacgtacgccgaggctatg

SEQ ID NO: 5534 - DNA, 37 bp, Artificial Sequence
  Synthetic
ataacgacaaacggcccctcgttgctgatcccccgcc

SEQ ID NO: 5535 - DNA, 39 bp, Artificial Sequence
  Synthetic
tccaagccagccaagttaacggcaaaatccgccggggtg

SEQ ID NO: 5536 - DNA, 41 bp, Artificial Sequence
  Synthetic
ccccggtgtcgttcaacaaagattggggagaagcaggtgtc

SEQ ID NO: 5537 - DNA, 38 bp, Artificial Sequence
  Synthetic
tctggacatgtcggcggaatcctgtcgtcggggtcgtc

SEQ ID NO: 5538 - DNA, 36 bp, Artificial Sequence
  Synthetic
ttcttgcggaccacggcccgcgtgtatgggcatgcc

SEQ ID NO: 5539 - DNA, 37 bp, Artificial Sequence
  Synthetic
tcctccgcaaacaggcccgatcgtgcgcactaggtcc

SEQ ID NO: 5540 - DNA, 36 bp, Artificial Sequence
  Synthetic
gcaggaagctccacagggcagaacaacgccctgccc

SEQ ID NO: 5541 - DNA, 40 bp, Artificial Sequence
  Synthetic
gtcgttcggggtgctcgttgacaaaacttacgacaggcca

SEQ ID NO: 5542 - DNA, 36 bp, Artificial Sequence
  Synthetic
ccccggagacccccaaaccttgacacaggcgctcgg

SEQ ID NO: 5543 - DNA, 36 bp, Artificial Sequence
  Synthetic
ctggacgccatggacagggatggtcgaggggggctt

SEQ ID NO: 5544 - DNA, 37 bp, Artificial Sequence
  Synthetic
gtggtacacgagcacgagccaaggatcgccgggtggt

SEQ ID NO: 5545 - DNA, 39 bp, Artificial Sequence
  Synthetic
ccgcagatcgcagcggtctccctggcggtgaatgtagtc

SEQ ID NO: 5546 - DNA, 42 bp, Artificial Sequence
  Synthetic
tcagatcacccgcatcatccgatctggatgcggggaaaactc

SEQ ID NO: 5547 - DNA, 38 bp, Artificial Sequence
  Synthetic
tcagccttaccacgcccgacctcctcctccagtccaat

SEQ ID NO: 5548 - DNA, 38 bp, Artificial Sequence
  Synthetic
acttccgggcctcagaaccctccggatagccaggcctg

SEQ ID NO: 5549 - DNA, 37 bp, Artificial Sequence
  Synthetic
gggacctgcggccaacacactggggtgaggggacact

SEQ ID NO: 5550 - DNA, 38 bp, Artificial Sequence
  Synthetic
cgggctaaccaggaaatccgtgtcacacggccgggcta

SEQ ID NO: 5551 - DNA, 38 bp, Artificial Sequence
  Synthetic
cccgacggcgtagtggaggaggtcccccacaaagcgaa

SEQ ID NO: 5552 - DNA, 38 bp, Artificial Sequence
  Synthetic
cgccagcctgtttgtcctgggagccgttgtacgccaga

SEQ ID NO: 5553 - DNA, 37 bp, Artificial Sequence
  Synthetic
gtataccctgtccgtgggcgaccaccaggaccaccga

SEQ ID NO: 5554 - DNA, 38 bp, Artificial Sequence
  Synthetic
actcggaaagcgaagacgaggcaccgactgttggcggc

SEQ ID NO: 5555 - DNA, 42 bp, Artificial Sequence
  Synthetic
gctccgctaaaagaccgcatcggtgatgggggggaagagaga

SEQ ID NO: 5556 - DNA, 45 bp, Artificial Sequence
  Synthetic
ttcaattcagacagggaatcaacactgatttacccaggtgttgtt

SEQ ID NO: 5557 - DNA, 42 bp, Artificial Sequence
  Synthetic
ggggctgtggctgtattgaattgagttctcagtatgttgttc

SEQ ID NO: 5558 - DNA, 44 bp, Artificial Sequence
  Synthetic
gctggcgaaatcacatgtgtccaaattttgattgaaagataccc

SEQ ID NO: 5559 - DNA, 40 bp, Artificial Sequence
  Synthetic
agcggctttgaaatgatttgggcaccgagaagctactgtc

SEQ ID NO: 5560 - DNA, 42 bp, Artificial Sequence
  Synthetic
attcctatgggagtgggcctcaaccactgaacaaatggcact

SEQ ID NO: 5561 - DNA, 41 bp, Artificial Sequence
  Synthetic
tccttgccacaagaacacatcaggcctgttaataggaagtt

SEQ ID NO: 5562 - DNA, 40 bp, Artificial Sequence
  Synthetic
gaacgcccaccaaatattgcccatgcctcaaggtcggtcg

SEQ ID NO: 5563 - DNA, 44 bp, Artificial Sequence
  Synthetic
tttggaagatccagcgtctagagacacaagagttgcctgaactt

SEQ ID NO: 5564 - DNA, 42 bp, Artificial Sequence
  Synthetic
ctttcccgaccaccagttggataggtgtccttgttgggattg

SEQ ID NO: 5565 - DNA, 44 bp, Artificial Sequence
  Synthetic
gtggaccatatggccataattaagatcctaagtgacgggttctt

SEQ ID NO: 5566 - DNA, 47 bp, Artificial Sequence
  Synthetic
caagtacggtccattacccaaaagatgttttaacctttcgactttgt

SEQ ID NO: 5567 - DNA, 41 bp, Artificial Sequence
  Synthetic
attggagatgtgccacagcactgtctaagaatgtccaccat

SEQ ID NO: 5568 - DNA, 43 bp, Artificial Sequence
  Synthetic
atgaggagttcacaatggtgggatcttctggttgcttttctga

SEQ ID NO: 5569 - DNA, 40 bp, Artificial Sequence
  Synthetic
ttcagaaagatgcgaaagtgctccatcacactgtcgatgt

SEQ ID NO: 5570 - DNA, 45 bp, Artificial Sequence
  Synthetic
attcatcgtcgatgatgtgggaatgatccattgataggtattgac

SEQ ID NO: 5571 - DNA, 38 bp, Artificial Sequence
  Synthetic
ggacatttgacaccacccagtgctttgctttggtggag

SEQ ID NO: 5572 - DNA, 46 bp, Artificial Sequence
  Synthetic
aggtaaggaagacagaagatacggcttttgcaaggttactcagttc

SEQ ID NO: 5573 - DNA, 44 bp, Artificial Sequence
  Synthetic
gaaagcgtctgagtttagtatggaagtgcaacacatctcacaca

SEQ ID NO: 5574 - DNA, 44 bp, Artificial Sequence
  Synthetic
tctggttctaaatttcaactggtgcgcatcttagaagcattcgc

SEQ ID NO: 5575 - DNA, 43 bp, Artificial Sequence
  Synthetic
actgaaactggcattagagcatttttggggcaaagaaacgaaa

SEQ ID NO: 5576 - DNA, 39 bp, Artificial Sequence
  Synthetic
gtgatgaggtggatcaggggatttgtcacaatcctcccg

SEQ ID NO: 5577 - DNA, 47 bp, Artificial Sequence
  Synthetic
gttagtacgcctgaagaaaatggctgctttctgattagttctttcca

SEQ ID NO: 5578 - DNA, 44 bp, Artificial Sequence
  Synthetic
ccgttacctgtagcagcagtcttttttaatgactgcaacaacag

SEQ ID NO: 5579 - DNA, 41 bp, Artificial Sequence
  Synthetic
accgtatcccaatcggaaagccactggtactagagccgacc

SEQ ID NO: 5580 - DNA, 39 bp, Artificial Sequence
  Synthetic
aaagggttcagggggtgctactgtgactctaggtgttgt

SEQ ID NO: 5581 - DNA, 49 bp, Artificial Sequence
  Synthetic
agatcctatatcagacgttacagcagctatattttcatcttgtcctgta

SEQ ID NO: 5582 - DNA, 46 bp, Artificial Sequence
  Synthetic
ttgcagatgttatcacagtacacagtaactctaacgcgaccactat

SEQ ID NO: 5583 - DNA, 48 bp, Artificial Sequence
  Synthetic
aactgcaattgtagatgcagtggcctcatcatcaaattgtatttcact

SEQ ID NO: 5584 - DNA, 41 bp, Artificial Sequence
  Synthetic
aacgcttactacaagtaggccacctcaacagtttcctgagg

SEQ ID NO: 5585 - DNA, 40 bp, Artificial Sequence
  Synthetic
atcctctggctcaaacagatgaagctgtgtttgttttggg

SEQ ID NO: 5586 - DNA, 49 bp, Artificial Sequence
  Synthetic
cttgcaatttcagaacatttcagcagaaaatctggatatttacaggtgc

SEQ ID NO: 5587 - DNA, 45 bp, Artificial Sequence
  Synthetic
atcaatttccactaggtagacggtgctcttttctaacacgtttgt

SEQ ID NO: 5588 - DNA, 45 bp, Artificial Sequence
  Synthetic
tttgtctgaataaattgctgatgcgtgaaaaatatttgccagccc

SEQ ID NO: 5589 - DNA, 45 bp, Artificial Sequence
  Synthetic
aacggtctcttagagtcaaacaaggaaacacttgagtcagccata

SEQ ID NO: 5590 - DNA, 42 bp, Artificial Sequence
  Synthetic
agtcattgtcaccagatgctactattgtgacacttggagtct

SEQ ID NO: 5591 - DNA, 44 bp, Artificial Sequence
  Synthetic
tagtggagttgttgaagatgaagctgtctttttgcaccaacagt

SEQ ID NO: 5592 - DNA, 42 bp, Artificial Sequence
  Synthetic
accaactccttcggaagtgggaagtcgtgagtaaccgtgtct

SEQ ID NO: 5593 - DNA, 46 bp, Artificial Sequence
  Synthetic
ttggatatagaccattaggatccgcgtctagtcactggtaagtctg

SEQ ID NO: 5594 - DNA, 45 bp, Artificial Sequence
  Synthetic
aactgatgtaggtggtgttagtggtagctgtctcactttcttctg

SEQ ID NO: 5595 - DNA, 41 bp, Artificial Sequence
  Synthetic
ttaaatttcagttttccgcgggatgagctggtgttcgtaaa

SEQ ID NO: 5596 - DNA, 41 bp, Artificial Sequence
  Synthetic
ctgcgccaaatccagcttttgtccttctgatgtagcagaca

SEQ ID NO: 5597 - DNA, 44 bp, Artificial Sequence
  Synthetic
aagtcagttttccttgggtcgagctcgtttaccatttaacaaac

SEQ ID NO: 5598 - DNA, 41 bp, Artificial Sequence
  Synthetic
ggtcagtcatttggtcagcagatctcacaaatggacgtctg

SEQ ID NO: 5599 - DNA, 43 bp, Artificial Sequence
  Synthetic
gaattatactcatgggccaggagactgatactagcttccacag

SEQ ID NO: 5600 - DNA, 41 bp, Artificial Sequence
  Synthetic
ttcagtcgctctgcggagaggtgctagtgctggagagaacc

SEQ ID NO: 5601 - DNA, 40 bp, Artificial Sequence
  Synthetic
aagaggactgagaagccctggacgtggtttgttcctgccg

SEQ ID NO: 5602 - DNA, 43 bp, Artificial Sequence
  Synthetic
acaggttaaaacatattgtgtgggcgactccaacaggctctct

SEQ ID NO: 5603 - DNA, 42 bp, Artificial Sequence
  Synthetic
tggcaactatgtccatgtgccacccgaacttcttttcctcca

SEQ ID NO: 5604 - DNA, 46 bp, Artificial Sequence
  Synthetic
cagaagatggatccaaatagggctttttggtccctgttttatgtct

SEQ ID NO: 5605 - DNA, 42 bp, Artificial Sequence
  Synthetic
gtgccgagcacctagaagacagtttgccatgatgtgtcctgg

SEQ ID NO: 5606 - DNA, 41 bp, Artificial Sequence
  Synthetic
ttaccagttgccaagatagagccgccttggtccatctttcc

SEQ ID NO: 5607 - DNA, 45 bp, Artificial Sequence
  Synthetic
agatgtaggggatgcctatttttccctggtagggtaaatgcagta

SEQ ID NO: 5608 - DNA, 42 bp, Artificial Sequence
  Synthetic
tctactccagatgagaagttccaattggccatagttcacagc

SEQ ID NO: 5609 - DNA, 45 bp, Artificial Sequence
  Synthetic
tagaggcaacaatccaaaaaagccggattttctcttcctggtgta

SEQ ID NO: 5610 - DNA, 44 bp, Artificial Sequence
  Synthetic
gcagagaccttctacacagatggcatatcctgcttttccctctt

SEQ ID NO: 5611 - DNA, 48 bp, Artificial Sequence
  Synthetic
attcctggaaaagatagagcccggggttagttcttttataatgctatg

SEQ ID NO: 5612 - DNA, 38 bp, Artificial Sequence
  Synthetic
gcacacagacaatggccccaacctacccaccatgccac

SEQ ID NO: 5613 - DNA, 44 bp, Artificial Sequence
  Synthetic
tttccaggtctattacagagaaggcttccacagtagttcaccag

SEQ ID NO: 5614 - DNA, 38 bp, Artificial Sequence
  Synthetic
ccagactgtgcagacatcctcttcacctgccgtaaagc

SEQ ID NO: 5615 - DNA, 48 bp, Artificial Sequence
  Synthetic
ggcaaaggtcctggagatattgggcacaaatatctatactttgtgtag

SEQ ID NO: 5616 - DNA, 38 bp, Artificial Sequence
  Synthetic
aggcgccagagagctcattatacatcccgctctgaagt

SEQ ID NO: 5617 - DNA, 44 bp, Artificial Sequence
  Synthetic
atggagcctggtaggaatcagacaatatactaagcaagcacttg

SEQ ID NO: 5618 - DNA, 43 bp, Artificial Sequence
  Synthetic
acacctctatgtgtggcaatgaattgaggttgtggaactcgag

SEQ ID NO: 5619 - DNA, 47 bp, Artificial Sequence
  Synthetic
gagtcatgtgataagcactattgggttacatcttaatagggcaaagc

SEQ ID NO: 5620 - DNA, 40 bp, Artificial Sequence
  Synthetic
agccaatcaacacaaggcctagggtttgcttcacctcctg

SEQ ID NO: 5621 - DNA, 44 bp, Artificial Sequence
  Synthetic
cctcctagggaaggggagttgtccgatttttatctatgtcaatg

SEQ ID NO: 5622 - DNA, 45 bp, Artificial Sequence
  Synthetic
aatgactctttatcgcctgactggtgatatttgcctctaggtagc

SEQ ID NO: 5623 - DNA, 40 bp, Artificial Sequence
  Synthetic
agacttaaggcggcccaactgcctcgcgaatgcttggaaa

SEQ ID NO: 5624 - DNA, 50 bp, Artificial Sequence
  Synthetic
acctaataggagttcctgttacacccatatctattgccaatttataggtc

SEQ ID NO: 5625 - DNA, 46 bp, Artificial Sequence
  Synthetic
gtttgggcacaagtcaggattgcctgttattcactatatggtatcc

SEQ ID NO: 5626 - DNA, 41 bp, Artificial Sequence
  Synthetic
cagtacttggccggtactgggtgcttctaactggcagcttt

SEQ ID NO: 5627 - DNA, 42 bp, Artificial Sequence
  Synthetic
aacatcgtcaaactcacctcatgatcacaccagtcacattga

SEQ ID NO: 5628 - DNA, 49 bp, Artificial Sequence
  Synthetic
acatctggatgctttcctataatgcctctgagaagattaggtagttgtc

SEQ ID NO: 5629 - DNA, 45 bp, Artificial Sequence
  Synthetic
accatacatttgttcagaaggggattttgtcatcagagtggaacc

SEQ ID NO: 5630 - DNA, 46 bp, Artificial Sequence
  Synthetic
aggaacaattgtttatcaaagaggccttttattaccttgctcctgc

SEQ ID NO: 5631 - DNA, 42 bp, Artificial Sequence
  Synthetic
aagaggtttcttcggagctattgacctgcaatcattccttcc

SEQ ID NO: 5632 - DNA, 48 bp, Artificial Sequence
  Synthetic
taagctcacaaatagagcttgcagctcatcttcactgtttattatccc

SEQ ID NO: 5633 - DNA, 44 bp, Artificial Sequence
  Synthetic
tgctgcatctttaaatgatgatggcctagaagcagcagttgagt

SEQ ID NO: 5634 - DNA, 44 bp, Artificial Sequence
  Synthetic
aaggaggtcgcactcagctattgtatatgagacccatacaactg

SEQ ID NO: 5635 - DNA, 40 bp, Artificial Sequence
  Synthetic
cggaagccatggaggttgctcccaattgtcctcattgcct

SEQ ID NO: 5636 - DNA, 44 bp, Artificial Sequence
  Synthetic
tcttgatcgtcttttcttcaaatgcgaaggccctcttttcaaac

SEQ ID NO: 5637 - DNA, 44 bp, Artificial Sequence
  Synthetic
aggccattttcatcatgggagatctcctccataacaaaccagtt

SEQ ID NO: 5638 - DNA, 46 bp, Artificial Sequence
  Synthetic
actgaggaatgtgatttagccttacaacagaatgtttcggactaca

SEQ ID NO: 5639 - DNA, 38 bp, Artificial Sequence
  Synthetic
agaggaagcagatggagagcgagtctcctgtagtgcag

SEQ ID NO: 5640 - DNA, 43 bp, Artificial Sequence
  Synthetic
accttttatgaggaggttacaggaccatatctggcagcatctg

SEQ ID NO: 5641 - DNA, 49 bp, Artificial Sequence
  Synthetic
aaaattgaaggagatacatgggcagacccaagtatattacacttccaaa

SEQ ID NO: 5642 - DNA, 49 bp, Artificial Sequence
  Synthetic
ggcagggccatctgttatagatttctatgtcaataatagatggatcagg

SEQ ID NO: 5643 - DNA, 46 bp, Artificial Sequence
  Synthetic
tcttcaactacacatcctgaccctttcaccttgataatttggtgaa

SEQ ID NO: 5644 - DNA, 43 bp, Artificial Sequence
  Synthetic
ctgtttgaacaggttcctacacgaatattcaaactgcacagcg

SEQ ID NO: 5645 - DNA, 50 bp, Artificial Sequence
  Synthetic
ctcgtgcatctataactaccagaaggactcaatagcagataaatcttgat

SEQ ID NO: 5646 - DNA, 41 bp, Artificial Sequence
  Synthetic
ttttgcagatgactgtctggatgaagtactctggctgtggg

SEQ ID NO: 5647 - DNA, 44 bp, Artificial Sequence
  Synthetic
agagacagagaacgcttagtatggccaacacctagaggatttcc

SEQ ID NO: 5648 - DNA, 40 bp, Artificial Sequence
  Synthetic
tcctccatggggtgaatattggcctggcttcaagggtcta

SEQ ID NO: 5649 - DNA, 38 bp, Artificial Sequence
  Synthetic
ttttgggcgtaaggagcagcatccccaacatttcctgc

SEQ ID NO: 5650 - DNA, 47 bp, Artificial Sequence
  Synthetic
tttagcatttgtacccccaccacaagaagacaaatatctgtatgtgt

SEQ ID NO: 5651 - DNA, 49 bp, Artificial Sequence
  Synthetic
aagcgcaaaaggtctaagtaatttcgcatacagtaaacatttcacagta

SEQ ID NO: 5652 - DNA, 45 bp, Artificial Sequence
  Synthetic
ttaacggcgaaatatgaatcagagaaatagcccatgcaaatcttg

SEQ ID NO: 5653 - DNA, 44 bp, Artificial Sequence
  Synthetic
ccttaccaggttgacactatttgtgtagctaacacacacagtct

SEQ ID NO: 5654 - DNA, 47 bp, Artificial Sequence
  Synthetic
agactttatcagatgaaactgtggccaaaatatcctgtaaggcagtg

SEQ ID NO: 5655 - DNA, 38 bp, Artificial Sequence
  Synthetic
aagtcaaatggtgcagtggggtatgcaatggctggttc

SEQ ID NO: 5656 - DNA, 47 bp, Artificial Sequence
  Synthetic
aattgggacccaccgatttatccagcataatactccaatacactttc

SEQ ID NO: 5657 - DNA, 38 bp, Artificial Sequence
  Synthetic
acaaccgcagacgacaagcccttgtcctcgtcgtcgtc

SEQ ID NO: 5658 - DNA, 45 bp, Artificial Sequence
  Synthetic
aagttgaaggaacaacatgggctttcccaaatatataacactgct

SEQ ID NO: 5659 - DNA, 45 bp, Artificial Sequence
  Synthetic
agaagaaggaattccagatgttgggtgtttctgctcctaaaccag

SEQ ID NO: 5660 - DNA, 43 bp, Artificial Sequence
  Synthetic
actcgttctgctgaccttttccgggattttcaaattcaaatgt

SEQ ID NO: 5661 - DNA, 45 bp, Artificial Sequence
  Synthetic
agtgataaataacaccggcctaccctggcacatttttttcactag

SEQ ID NO: 5662 - DNA, 43 bp, Artificial Sequence
  Synthetic
tcctgaaagagaacgtttagtttggtaccgactccaagaggac

SEQ ID NO: 5663 - DNA, 43 bp, Artificial Sequence
  Synthetic
atgccagacatttcttttgtaaggagctcatctggaggattcc

SEQ ID NO: 5664 - DNA, 46 bp, Artificial Sequence
  Synthetic
tcctcctcaaggattggaggatacctttaggacacatagctgctaa

SEQ ID NO: 5665 - DNA, 38 bp, Artificial Sequence
  Synthetic
aacaaccggttctggtcgttaagacacaggcaccgata

SEQ ID NO: 5666 - DNA, 42 bp, Artificial Sequence
  Synthetic
agaagaatcccgctcttagaatgatttgtcagctgtgatcgg

SEQ ID NO: 5667 - DNA, 47 bp, Artificial Sequence
  Synthetic
agtacagtccattatccaaaggtgttccgtgttttaatctttcaacc

SEQ ID NO: 5668 - DNA, 42 bp, Artificial Sequence
  Synthetic
aatattgctcctttaatggtggcaaggaatctggtcttgcga

SEQ ID NO: 5669 - DNA, 41 bp, Artificial Sequence
  Synthetic
agagcaacagtatcagcagaccccaatttgtgtgctatggc

SEQ ID NO: 5670 - DNA, 41 bp, Artificial Sequence
  Synthetic
gaagagcaacagccattctaagacccttccgctgactatca

SEQ ID NO: 5671 - DNA, 43 bp, Artificial Sequence
  Synthetic
tgagacactttcaaaaggatgcaacattgtcgatgggttcaat

SEQ ID NO: 5672 - DNA, 41 bp, Artificial Sequence
  Synthetic
cagggaatggaaaagttgacgattctggcccgttaatctcc

SEQ ID NO: 5673 - DNA, 43 bp, Artificial Sequence
  Synthetic
acgttcgacactgttcaaataatcacctactctgttccggtgg

SEQ ID NO: 5674 - DNA, 41 bp, Artificial Sequence
  Synthetic
agagtctgcagtattgagaggattgcttaatgctggtccat

SEQ ID NO: 5675 - DNA, 45 bp, Artificial Sequence
  Synthetic
aacacattaactgaaagaggagtgggatgtttgttcgttccactg

SEQ ID NO: 5676 - DNA, 48 bp, Artificial Sequence
  Synthetic
tgaggcaaattctcagagaatcaggccattagttcttattccactgta

SEQ ID NO: 5677 - DNA, 47 bp, Artificial Sequence
  Synthetic
atcaacaatcttttgtaccgagtcccaattcttccagatagaccatt

SEQ ID NO: 5678 - DNA, 47 bp, Artificial Sequence
  Synthetic
cttgccatttcagaacatagatagcctcctttgcttaacatatctcg

SEQ ID NO: 5679 - DNA, 43 bp, Artificial Sequence
  Synthetic
caccagaatgcacagggagatgttatttgatcaattgccgatt

SEQ ID NO: 5680 - DNA, 47 bp, Artificial Sequence
  Synthetic
aactgtacgaacgagtgaaaagactgaaatatttcaaagcaaccagt

SEQ ID NO: 5681 - DNA, 41 bp, Artificial Sequence
  Synthetic
acttctgcctcatcacagccgcagatttgtaaattccgcag

SEQ ID NO: 5682 - DNA, 49 bp, Artificial Sequence
  Synthetic
tatcgccaagtgagaaagatcatcgtccacctatttaaaatgaatctga

SEQ ID NO: 5683 - DNA, 40 bp, Artificial Sequence
  Synthetic
gtgtggttgtacacagtgtggatgcagctgttgtatgtcc

SEQ ID NO: 5684 - DNA, 44 bp, Artificial Sequence
  Synthetic
agggtggtggaattgcttaagtgaccaaatgacaatccaaacag

SEQ ID NO: 5685 - DNA, 46 bp, Artificial Sequence
  Synthetic
accacagtgtctaaaggaatgtggctctattaacagttgattagca

SEQ ID NO: 5686 - DNA, 45 bp, Artificial Sequence
  Synthetic
acacagatagtaatgcagctgctgtctacacataattccacaatc

SEQ ID NO: 5687 - DNA, 41 bp, Artificial Sequence
  Synthetic
aacatgtgcagcactggaagtccatttcacgagccttaaat

SEQ ID NO: 5688 - DNA, 46 bp, Artificial Sequence
  Synthetic
actgtggaggttgtattcgatggcgtatataaatgtccatgctgta

SEQ ID NO: 5689 - DNA, 38 bp, Artificial Sequence
  Synthetic
ccccgccgcgaaaacgatacttgtgacgccgtagtgct

SEQ ID NO: 5690 - DNA, 41 bp, Artificial Sequence
  Synthetic
tgtgttgtgtgtgtggattagttagctagcaagacaggagg

SEQ ID NO: 5691 - DNA, 48 bp, Artificial Sequence
  Synthetic
ttaaactactgcagacatacgtgtgtacaaacaatacaaaaacccaac

SEQ ID NO: 5692 - DNA, 46 bp, Artificial Sequence
  Synthetic
ggacatttctcctcccaccaatacgtaaagtaaaaggatcactgta

SEQ ID NO: 5693 - DNA, 45 bp, Artificial Sequence
  Synthetic
aggctatagaattgcaacctttaggtcattaattgcggatgaagc

SEQ ID NO: 5694 - DNA, 41 bp, Artificial Sequence
  Synthetic
ctcctgtttccaaggtggtcaactgctggcatgataaaagt

SEQ ID NO: 5695 - DNA, 44 bp, Artificial Sequence
  Synthetic
tatggcagatgtagggtttggagcacctcagcttttgaagtttg

SEQ ID NO: 5696 - DNA, 41 bp, Artificial Sequence
  Synthetic
attggaatgttggtgtagctccatatggcctgagactgcac

SEQ ID NO: 5697 - DNA, 46 bp, Artificial Sequence
  Synthetic
tgtactgccaaatggtattgctaagctttctaaaacatgcttgtgc

SEQ ID NO: 5698 - DNA, 45 bp, Artificial Sequence
  Synthetic
aaatggttcaatgggcgtatgaaaagcataatagtaagcaattgc

SEQ ID NO: 5699 - DNA, 49 bp, Artificial Sequence
  Synthetic
aaatgttgtagggaatgtgatggtccctgatacttaagtaaattagcaa

SEQ ID NO: 5700 - DNA, 41 bp, Artificial Sequence
  Synthetic
gattcctcaagaagcggcaggatcgtcgtcgttgtcctctt

SEQ ID NO: 5701 - DNA, 49 bp, Artificial Sequence
  Synthetic
caagagttgagcgacttaaagcagctccaacatttcaatttattagcac

SEQ ID NO: 5702 - DNA, 40 bp, Artificial Sequence
  Synthetic
tgtaggtgagcatcccaatgtagctgcacatcgatttgag

SEQ ID NO: 5703 - DNA, 44 bp, Artificial Sequence
  Synthetic
tggggacagattgtttttttatggtatcaccaacaactccatct

SEQ ID NO: 5704 - DNA, 43 bp, Artificial Sequence
  Synthetic
tcgttagttagcagcgaatctcattccctgagctttatgtacc

SEQ ID NO: 5705 - DNA, 40 bp, Artificial Sequence
  Synthetic
attaatgcaatggactctcgcacctgaggaggtgaaggaa

SEQ ID NO: 5706 - DNA, 42 bp, Artificial Sequence
  Synthetic
aagcgaccacggaatatctatgagtttagtagtgcgacgctt

SEQ ID NO: 5707 - DNA, 43 bp, Artificial Sequence
  Synthetic
ttaccctcctattatttgcccacaaacgtttgtgtgcgatgtt

SEQ ID NO: 5708 - DNA, 41 bp, Artificial Sequence
  Synthetic
aagctggcaagaacaacacccagaagatgactcaaatgcct

SEQ ID NO: 5709 - DNA, 42 bp, Artificial Sequence
  Synthetic
atggctggatcaagtgagcaggccatttgcctagcctgactt

SEQ ID NO: 5710 - DNA, 42 bp, Artificial Sequence
  Synthetic
tcttcaaatgcatttatcgtcgctagactcaggcactccttc

SEQ ID NO: 5711 - DNA, 49 bp, Artificial Sequence
  Synthetic
acctaacaacaaatggaagtaatgcgttttagatctttctcgatcatgt

SEQ ID NO: 5712 - DNA, 46 bp, Artificial Sequence
  Synthetic
aagctatcactagtatctcagggttcttgtctgaaagcttccaatc

SEQ ID NO: 5713 - DNA, 46 bp, Artificial Sequence
  Synthetic
atatgttccagctaggacaagcaccaagttcatcttctagtgttga

SEQ ID NO: 5714 - DNA, 41 bp, Artificial Sequence
  Synthetic
atcaactaatatctcctcggccctaggtcttcttgggggtc

SEQ ID NO: 5715 - DNA, 43 bp, Artificial Sequence
  Synthetic
gaggaatctccagaagcatcacgatcaatatcctccgtgttct

SEQ ID NO: 5716 - DNA, 43 bp, Artificial Sequence
  Synthetic
aatcctcatcatggaatctcaccaagttgtgtttgtctgttcg

SEQ ID NO: 5717 - DNA, 48 bp, Artificial Sequence
  Synthetic
atacactagagaacgatgtgcaagtgttgcatttgattcattgtatga

SEQ ID NO: 5718 - DNA, 45 bp, Artificial Sequence
  Synthetic
gaacagagaaaagcagtaccccatctaaataccgagatccatgtt

SEQ ID NO: 5719 - DNA, 44 bp, Artificial Sequence
  Synthetic
acaaagttgctcttgctcctccgtacaattcacgaagattactc

SEQ ID NO: 5720 - DNA, 49 bp, Artificial Sequence
  Synthetic
aatctctacttcaatctggacgcagtcctaagtttttgattatccctta

SEQ ID NO: 5721 - DNA, 44 bp, Artificial Sequence
  Synthetic
tgtgatagtaaccaatcaggaatcccccctccaaagaatcgttt

SEQ ID NO: 5722 - DNA, 43 bp, Artificial Sequence
  Synthetic
agaatggtatattcctcttcccagcacatctgctccacctaga

SEQ ID NO: 5723 - DNA, 46 bp, Artificial Sequence
  Synthetic
agtacaataggtatcaacggaatgctgtgtagaatgcaagagttcc

SEQ ID NO: 5724 - DNA, 43 bp, Artificial Sequence
  Synthetic
aagcataccaatcacggaaagggagcttgttgttatgagtagc

SEQ ID NO: 5725 - DNA, 43 bp, Artificial Sequence
  Synthetic
acccaaaaataaggttaatgccaggcacagccatcaacagtcg

SEQ ID NO: 5726 - DNA, 46 bp, Artificial Sequence
  Synthetic
atgagaatgtaatctgcaacacaacgactataagatgcctgattgc

SEQ ID NO: 5727 - DNA, 42 bp, Artificial Sequence
  Synthetic
acttactcaacagcaactgaaagaccagctgagagtgttctg

SEQ ID NO: 5728 - DNA, 48 bp, Artificial Sequence
  Synthetic
aaacgctgttgattattaccagagcaattgtcaaatcctcatctaact

SEQ ID NO: 5729 - DNA, 48 bp, Artificial Sequence
  Synthetic
tagacgaaacaagatcagcatcttctgaataaccattctcaattgctt

SEQ ID NO: 5730 - DNA, 42 bp, Artificial Sequence
  Synthetic
cagtgttgggggattcaattacaatgcagcaactgatggatc

SEQ ID NO: 5731 - DNA, 45 bp, Artificial Sequence
  Synthetic
aagtggacttgaaacacctgaccttctgatcctgttattaccacc

SEQ ID NO: 5732 - DNA, 49 bp, Artificial Sequence
  Synthetic
gtctcaaaattttaacaccggtagcttgcagtatcttttaatctgtgtg

SEQ ID NO: 5733 - DNA, 40 bp, Artificial Sequence
  Synthetic
atttgggttgcaacagtttggaaatctcgtgacggaacac

SEQ ID NO: 5734 - DNA, 41 bp, Artificial Sequence
  Synthetic
tagggcatgccgatttgtttctgcagacccataacatatgt

SEQ ID NO: 5735 - DNA, 48 bp, Artificial Sequence
  Synthetic
cgtaagcccttagattacaaacgtcaccatgcacatattcaatctctt

SEQ ID NO: 5736 - DNA, 40 bp, Artificial Sequence
  Synthetic
ccaagtcttggtctgttggtgactgatcacgttgcaacaa

SEQ ID NO: 5737 - DNA, 43 bp, Artificial Sequence
  Synthetic
ggatacattctgcttcaatgtacgctttcagcacccaacatgg

SEQ ID NO: 5738 - DNA, 43 bp, Artificial Sequence
  Synthetic
tgaaacttgtactattgccggtaaaagcgcattatcaagcaaa

SEQ ID NO: 5739 - DNA, 44 bp, Artificial Sequence
  Synthetic
acttacaatcgccaacaattattccacatcgccaattacaacag

SEQ ID NO: 5740 - DNA, 45 bp, Artificial Sequence
  Synthetic
tgattacagggcttttatcagtgttttagactctgcagctttcac

SEQ ID NO: 5741 - DNA, 48 bp, Artificial Sequence
  Synthetic
ggtttctactgttaaaattggtggcacaatgtaaggtttatcaaaagc

SEQ ID NO: 5742 - DNA, 46 bp, Artificial Sequence
  Synthetic
agatgcagagtttgtagaaccagttcttataaaagacgtgctcatc

SEQ ID NO: 5743 - DNA, 46 bp, Artificial Sequence
  Synthetic
ttcaatcagcactttctgttgtttccgccttcttcatcataaatgt

SEQ ID NO: 5744 - DNA, 45 bp, Artificial Sequence
  Synthetic
tatgcagttttttaaaatgggccgacgtatacattgctcagcagt

SEQ ID NO: 5745 - DNA, 43 bp, Artificial Sequence
  Synthetic
aggcgtttccttatggtacttgaactgcctaattgtacacatg

SEQ ID NO: 5746 - DNA, 46 bp, Artificial Sequence
  Synthetic
cttcctcgttcatgacaatgtagcgtcaacaccattaacaacagta

SEQ ID NO: 5747 - DNA, 46 bp, Artificial Sequence
  Synthetic
aaccagtgtccgtaattaaagttgcacacacaacaagtcttctgta

SEQ ID NO: 5748 - DNA, 48 bp, Artificial Sequence
  Synthetic
ataccagctgactacatcttgcccctacaaaagaaacattacaagtca

SEQ ID NO: 5749 - DNA, 45 bp, Artificial Sequence
  Synthetic
agatgctgttacttttgcaacagtccattaacaacagcactttca

SEQ ID NO: 5750 - DNA, 44 bp, Artificial Sequence
  Synthetic
gctattatagtcagtgtcgaacagcagcaacaccactcaaaagt

SEQ ID NO: 5751 - DNA, 47 bp, Artificial Sequence
  Synthetic
gttcttaaatctaagtggtggctgcgcaaaactactgagtacaatgt

SEQ ID NO: 5752 - DNA, 42 bp, Artificial Sequence
  Synthetic
tttggatgttgtgtggaagcatgacaatgaaaggttgcatat

SEQ ID NO: 5753 - DNA, 46 bp, Artificial Sequence
  Synthetic
acacaattgtcaatggtgtgcaacacaaaacttactaccaccattt

SEQ ID NO: 5754 - DNA, 42 bp, Artificial Sequence
  Synthetic
aacaactttgtcagttcgtatgcttacaacacgccaagtcat

SEQ ID NO: 5755 - DNA, 40 bp, Artificial Sequence
  Synthetic
ctggtgatgctggccattcaatcaaacacacaagaccaca

SEQ ID NO: 5756 - DNA, 44 bp, Artificial Sequence
  Synthetic
ttttacactacaagctgcttttggtcaggtgttgtgactccaaa

SEQ ID NO: 5757 - DNA, 40 bp, Artificial Sequence
  Synthetic
gtgttgaatccaatgcaggtgtaacgtaaccattggcaac

SEQ ID NO: 5758 - DNA, 42 bp, Artificial Sequence
  Synthetic
ttttgctccatggtggttgtgtcagcaaactaggtaacaaac

SEQ ID NO: 5759 - DNA, 38 bp, Artificial Sequence
  Synthetic
tttgcgcaaaatggcacaacatagcagacacggacaac

SEQ ID NO: 5760 - DNA, 44 bp, Artificial Sequence
  Synthetic
ctggtgaaggttttaacatcttagctgttcacaccaaaaacacc

SEQ ID NO: 5761 - DNA, 47 bp, Artificial Sequence
  Synthetic
ttatgctgctatattgaatggttgctcattataatgctccacaaaca

SEQ ID NO: 5762 - DNA, 46 bp, Artificial Sequence
  Synthetic
taaccctggttttcttactccgtaaatgtaagacagagtgacaaag

SEQ ID NO: 5763 - DNA, 45 bp, Artificial Sequence
  Synthetic
gcacttatttgttctcactcattgcaccagcaaactaacgtagtc

SEQ ID NO: 5764 - DNA, 47 bp, Artificial Sequence
  Synthetic
tatggttgctaatggtttgaatgcaagtttaaaagacagaaagagcg

SEQ ID NO: 5765 - DNA, 40 bp, Artificial Sequence
  Synthetic
aacttgtgtgacgaccctgaaaagaaaaaggccaacaacg

SEQ ID NO: 5766 - DNA, 42 bp, Artificial Sequence
  Synthetic
tgctgcagctatgtacaaagaagtgcatggcactaacaactt

SEQ ID NO: 5767 - DNA, 43 bp, Artificial Sequence
  Synthetic
agatgttacaaaggaaaaccaggaaacgacacgttcacaagtc

SEQ ID NO: 5768 - DNA, 46 bp, Artificial Sequence
  Synthetic
tacagttgaattggaaccaccttgagatacttaatttggggtccag

SEQ ID NO: 5769 - DNA, 41 bp, Artificial Sequence
  Synthetic
gactaatggttctggtagcggttcctgcgtagtgttggaat

SEQ ID NO: 5770 - DNA, 40 bp, Artificial Sequence
  Synthetic
ctagtgccgctcgactagagaatgcacggacacagtaatc

SEQ ID NO: 5771 - DNA, 45 bp, Artificial Sequence
  Synthetic
ggagatattggttcttactggttgttctatggggtcaaaccaatt

SEQ ID NO: 5772 - DNA, 47 bp, Artificial Sequence
  Synthetic
tgatgcctgttatgggtatgactaagatgtcacttttcataaagcac

SEQ ID NO: 5773 - DNA, 43 bp, Artificial Sequence
  Synthetic
agttgctactgctggttaccatgttaacatctttgttccacac

SEQ ID NO: 5774 - DNA, 43 bp, Artificial Sequence
  Synthetic
tttcgatgagggttcagaattaacaattgcagcatcacccttt

SEQ ID NO: 5775 - DNA, 45 bp, Artificial Sequence
  Synthetic
tgtctgaaatccatagtagctaccagccataaaacttggtagtgc

SEQ ID NO: 5776 - DNA, 45 bp, Artificial Sequence
  Synthetic
agccactttgtattatcagaatggtagatcttcctcagtccaaca

SEQ ID NO: 5777 - DNA, 46 bp, Artificial Sequence
  Synthetic
ttgtctaagcatcctaaacctgagtagatgtttgacccagtctaac

SEQ ID NO: 5778 - DNA, 42 bp, Artificial Sequence
  Synthetic
tttgggttccatggacattgatggcgaatgtcagaccaatca

SEQ ID NO: 5779 - DNA, 47 bp, Artificial Sequence
  Synthetic
atacggttacttacaaatccactgcagcaacattatgagaagtcaaa

SEQ ID NO: 5780 - DNA, 38 bp, Artificial Sequence
  Synthetic
cgctctgtgcaaaagctgtcaacactcaactctggcac

SEQ ID NO: 5781 - DNA, 44 bp, Artificial Sequence
  Synthetic
gcttccagctcctagagttctcaacattatagtcaattggttcc

SEQ ID NO: 5782 - DNA, 50 bp, Artificial Sequence
  Synthetic
tttaggcttacaaactcagacagtggcgaatataacatagtcatattcac

SEQ ID NO: 5783 - DNA, 43 bp, Artificial Sequence
  Synthetic
aagactagtggtgacttggctcacatgttcataggtacaaaca

SEQ ID NO: 5784 - DNA, 45 bp, Artificial Sequence
  Synthetic
tgtacctctacaagttggtttttccgttagaacacaaccttcagg

SEQ ID NO: 5785 - DNA, 45 bp, Artificial Sequence
  Synthetic
acattgccaatgtggtactgttgcaatgcatgtttaaagcaacaa

SEQ ID NO: 5786 - DNA, 41 bp, Artificial Sequence
  Synthetic
gtcgcactgtgcagagtcatgattgctttagggttgtacaa

SEQ ID NO: 5787 - DNA, 39 bp, Artificial Sequence
  Synthetic
tcatgcatttcacactcctgcaacggtgctggtttcaat

SEQ ID NO: 5788 - DNA, 47 bp, Artificial Sequence
  Synthetic
agagaacattgcttttaacgttgttctaatggctactggtaattcac

SEQ ID NO: 5789 - DNA, 46 bp, Artificial Sequence
  Synthetic
ctgtttgtggttatacagactttgccagagtaaaacgttcgtatga

SEQ ID NO: 5790 - DNA, 40 bp, Artificial Sequence
  Synthetic
acaagactttttgcctcgcacacgcctatatccatgttca

SEQ ID NO: 5791 - DNA, 48 bp, Artificial Sequence
  Synthetic
ccaaggttcatgaggtcataattgagcattatctttacaccatagcat

SEQ ID NO: 5792 - DNA, 40 bp, Artificial Sequence
  Synthetic
tggctctgattatggtgttgcaaacaacaattgcgtcgtg

SEQ ID NO: 5793 - DNA, 50 bp, Artificial Sequence
  Synthetic
aactccactgttatgagtttgtcctgtgtttgcaattaaatttactcagg

SEQ ID NO: 5794 - DNA, 48 bp, Artificial Sequence
  Synthetic
aaatgtatttgctgttgagagtggtaggaaccaattattgaatgcaaa

SEQ ID NO: 5795 - DNA, 38 bp, Artificial Sequence
  Synthetic
ctgcttttgtgggtgcactaaatgtcctgtgcgtgaaa

SEQ ID NO: 5796 - DNA, 44 bp, Artificial Sequence
  Synthetic
acgtttattgtgttgtacgttgactaacagttaaagcacttgcc

SEQ ID NO: 5797 - DNA, 44 bp, Artificial Sequence
  Synthetic
ggcaccatctactctatcactcccagcttgctgataaacaacaa

SEQ ID NO: 5798 - DNA, 41 bp, Artificial Sequence
  Synthetic
agtgtttcagctatcgtcacagcctcaacctggaccgaagt

SEQ ID NO: 5799 - DNA, 38 bp, Artificial Sequence
  Synthetic
agcgtcatacctagcttgcccttctatggcactgcgac

SEQ ID NO: 5800 - DNA, 44 bp, Artificial Sequence
  Synthetic
atgttgcattgcagactgatgttgttaaaagatgcagcaagaat

SEQ ID NO: 5801 - DNA, 43 bp, Artificial Sequence
  Synthetic
ctgctttgaatgtattcgtttctcattgttgtgcaagctgtct

SEQ ID NO: 5802 - DNA, 48 bp, Artificial Sequence
  Synthetic
tcacatctcgcataatgtttgaaccgtgacattgcaattttcaatttg

SEQ ID NO: 5803 - DNA, 45 bp, Artificial Sequence
  Synthetic
acactgttcaaaaattgcaaactctagccactttaagtcgactaa

SEQ ID NO: 5804 - DNA, 46 bp, Artificial Sequence
  Synthetic
tacagtaatggctctaggtttgttcgcattgctaagcgattgatta

SEQ ID NO: 5805 - DNA, 43 bp, Artificial Sequence
  Synthetic
ttttccatacagcttggcactggtgtggttacattgaagacaa

SEQ ID NO: 5806 - DNA, 48 bp, Artificial Sequence
  Synthetic
aagctttgtttcacttgccatatgtatatgattggtaaatgtggtaca

SEQ ID NO: 5807 - DNA, 42 bp, Artificial Sequence
  Synthetic
aattgggattctaattgggcctttaacgagtgttgatacggc

SEQ ID NO: 5808 - DNA, 46 bp, Artificial Sequence
  Synthetic
acgagtaaaacacggtgatttttctctttcgttttctgtcatgttg

SEQ ID NO: 5809 - DNA, 39 bp, Artificial Sequence
  Synthetic
gaaagggcaaacgggtggatggtcctgtgccaagataat

SEQ ID NO: 5810 - DNA, 43 bp, Artificial Sequence
  Synthetic
tttgacaagcctcaggaaaaagatacgagaaggcttaggagta

SEQ ID NO: 5811 - DNA, 42 bp, Artificial Sequence
  Synthetic
ccagagaccttgaccacaacttttagctttaacaccattggc

SEQ ID NO: 5812 - DNA, 44 bp, Artificial Sequence
  Synthetic
aacttcacctgcaactgctgagcatgtttagtttacttcatcaa

SEQ ID NO: 5813 - DNA, 43 bp, Artificial Sequence
  Synthetic
actgaacctaggtgaacgctagtgcgatctttgattactccag

SEQ ID NO: 5814 - DNA, 46 bp, Artificial Sequence
  Synthetic
cttttagtatttggcttccgtccttaagtagccaaatacctaggac

SEQ ID NO: 5815 - DNA, 38 bp, Artificial Sequence
  Synthetic
ggaaatccccatgcactgttcacacttagcagctgact

SEQ ID NO: 5816 - DNA, 40 bp, Artificial Sequence
  Synthetic
aatggggaacaggagcagcagtgcaaaatgtccaggcact

SEQ ID NO: 5817 - DNA, 46 bp, Artificial Sequence
  Synthetic
agaagcaaactatgttaaaccaccaattgcaccataggagctaatt

SEQ ID NO: 5818 - DNA, 49 bp, Artificial Sequence
  Synthetic
aggacaatggataaaaaagtgtgggattaattagctttttccagtctcc

SEQ ID NO: 5819 - DNA, 46 bp, Artificial Sequence
  Synthetic
agtgctatatgacaacgaggaaaataggtcttctgaatcttggtaa

SEQ ID NO: 5820 - DNA, 43 bp, Artificial Sequence
  Synthetic
cactatccgtcgagacttgcagtgtgttagatggtccttttac

SEQ ID NO: 5821 - DNA, 40 bp, Artificial Sequence
  Synthetic
aaatggattgccagtgtggtgtacatacccagaggaaccc

SEQ ID NO: 5822 - DNA, 42 bp, Artificial Sequence
  Synthetic
gcttccattgttcccctggagggcagagggtctacaggtaca

SEQ ID NO: 5823 - DNA, 47 bp, Artificial Sequence
  Synthetic
cagccgcagaggttattattggtatccaaaggtatagattcaccaat

SEQ ID NO: 5824 - DNA, 40 bp, Artificial Sequence
  Synthetic
cgcctttgaggaggaggtaaccgcagcagcagcaagtgta

SEQ ID NO: 5825 - DNA, 42 bp, Artificial Sequence
  Synthetic
atctcctgccttggaaactgtgtttaccaccagtagaggtta

SEQ ID NO: 5826 - DNA, 45 bp, Artificial Sequence
  Synthetic
tccggtaaattatatttgccaccctcacgtaatcatctgtaggca

SEQ ID NO: 5827 - DNA, 41 bp, Artificial Sequence
  Synthetic
aatcctgagtctgaacgtttgggtagacccaacacctaacg

SEQ ID NO: 5828 - DNA, 48 bp, Artificial Sequence
  Synthetic
tggtgacaagattccagaacaaaatgactccccaggaataatatatgt

SEQ ID NO: 5829 - DNA, 40 bp, Artificial Sequence
  Synthetic
ccatctattggggatgcgtacatttccttagggggctctg

SEQ ID NO: 5830 - DNA, 41 bp, Artificial Sequence
  Synthetic
ggcagtttggcttcgaggtgcattgatggcctggaactgac

SEQ ID NO: 5831 - DNA, 36 bp, Artificial Sequence
  Synthetic
tcctgtcacaccccaccgttgaccctgtccgtgtgc

SEQ ID NO: 5832 - DNA, 41 bp, Artificial Sequence
  Synthetic
agcatgtgccccaatcttggagatccaggtgtagatgcagg

SEQ ID NO: 5833 - DNA, 40 bp, Artificial Sequence
  Synthetic
tccgactacctcccggagatgcgctcctccacctcaaaca

SEQ ID NO: 5834 - DNA, 39 bp, Artificial Sequence
  Synthetic
ccagagacggtgttgcgccggcaaaggatgaccaggttc

SEQ ID NO: 5835 - DNA, 38 bp, Artificial Sequence
  Synthetic
tgggtgcaaggctcgtgcgcaaaacatatggcatcccg

SEQ ID NO: 5836 - DNA, 42 bp, Artificial Sequence
  Synthetic
acacccagttatgcagtgccatgatagaattccaggaggttt

SEQ ID NO: 5837 - DNA, 37 bp, Artificial Sequence
  Synthetic
gtaggtgcctccagagcccctaagtttgggggcgccc

SEQ ID NO: 5838 - DNA, 38 bp, Artificial Sequence
  Synthetic
ccggtatcgggccagaggtggtggagtgttgggcttag

SEQ ID NO: 5839 - DNA, 40 bp, Artificial Sequence
  Synthetic
tccgtagaagggtcctcgtcctacccctgaaggtgaaccg

SEQ ID NO: 5840 - DNA, 35 bp, Artificial Sequence
  Synthetic
tgggccctcaagtccagccagagaagggccggtgg

SEQ ID NO: 5841 - DNA, 40 bp, Artificial Sequence
  Synthetic
gggccaagaacccagacgagtaccacctcctcttcttgct

SEQ ID NO: 5842 - DNA, 42 bp, Artificial Sequence
  Synthetic
aagccagacagcagccaattgtccactttataccaggggcag

SEQ ID NO: 5843 - DNA, 38 bp, Artificial Sequence
  Synthetic
accggtcgcccagtcctacggacccttctacggactcg

SEQ ID NO: 5844 - DNA, 40 bp, Artificial Sequence
  Synthetic
cccgtcttactgcccagcctggaaatgcataggagtgcga

SEQ ID NO: 5845 - DNA, 37 bp, Artificial Sequence
  Synthetic
cgagttacgctccttggagggccttcttccacggcgc

SEQ ID NO: 5846 - DNA, 35 bp, Artificial Sequence
  Synthetic
tgaccctcgcgccccatcttccacacccaccaccg

SEQ ID NO: 5847 - DNA, 38 bp, Artificial Sequence
  Synthetic
cacaaagctgtgtgacggtcccatcgagctcgctggcg

SEQ ID NO: 5848 - DNA, 37 bp, Artificial Sequence
  Synthetic
cggaagccctcgtttcggccatcactctcccaggccc

SEQ ID NO: 5849 - DNA, 40 bp, Artificial Sequence
  Synthetic
gtggattcgggggaagctggtccttctacgagcacgaaga

SEQ ID NO: 5850 - DNA, 37 bp, Artificial Sequence
  Synthetic
tcttgagctggcgcgggtaacgctgcaggatctggtc

SEQ ID NO: 5851 - DNA, 37 bp, Artificial Sequence
  Synthetic
gccagagccaacctcagctcaagtcgagggcatggcc

SEQ ID NO: 5852 - DNA, 39 bp, Artificial Sequence
  Synthetic
gcaccaccatcgtccacgagccgctatgctattgggaat

SEQ ID NO: 5853 - DNA, 38 bp, Artificial Sequence
  Synthetic
gaccggacggccacgttgtgagagtatggggcccctcc

SEQ ID NO: 5854 - DNA, 40 bp, Artificial Sequence
  Synthetic
cgtcgtccaggaccaaggggaaggaggagaacccgaggat

SEQ ID NO: 5855 - DNA, 37 bp, Artificial Sequence
  Synthetic
ccgaagggaggtgatggggaaaaaccatcccccggcc

SEQ ID NO: 5856 - DNA, 38 bp, Artificial Sequence
  Synthetic
gagggggaatcgtcggttagggtttgctcgcacggccc

SEQ ID NO: 5857 - DNA, 40 bp, Artificial Sequence
  Synthetic
aacgctcttttccttcaccgctcagatccctctggcgacg

SEQ ID NO: 5858 - DNA, 39 bp, Artificial Sequence
  Synthetic
gtggccaggcccaacgactacctccctcttttcactcct

SEQ ID NO: 5859 - DNA, 40 bp, Artificial Sequence
  Synthetic
agaaggggctgtggacataggctactgccggtccctgagg

SEQ ID NO: 5860 - DNA, 37 bp, Artificial Sequence
  Synthetic
gacacgccctggtcggactagagcctctccaggtccc

SEQ ID NO: 5861 - DNA, 34 bp, Artificial Sequence
  Synthetic
ccggcagccccttcatcctgcaggtcgcgccaaa

SEQ ID NO: 5862 - DNA, 36 bp, Artificial Sequence
  Synthetic
cgctgcctggtgaatgcgctcatccccctgcgtgtc

SEQ ID NO: 5863 - DNA, 36 bp, Artificial Sequence
  Synthetic
gctcggtagcagcggactcctaacggccggaatgcg

SEQ ID NO: 5864 - DNA, 38 bp, Artificial Sequence
  Synthetic
cctgccattcccagccactcccctcgcgagctgaacag

SEQ ID NO: 5865 - DNA, 40 bp, Artificial Sequence
  Synthetic
gagggccagatgcaggagcttgatagagggacatctgggc

SEQ ID NO: 5866 - DNA, 36 bp, Artificial Sequence
  Synthetic
ttcagctgctggacacgcagcgcacctacttcaccc

SEQ ID NO: 5867 - DNA, 35 bp, Artificial Sequence
  Synthetic
ggcgaggcgttgtggcacatgccatcctctcgcgg

SEQ ID NO: 5868 - DNA, 40 bp, Artificial Sequence
  Synthetic
gccaggtggattttgagctccgcctccagaatcagcggcg

SEQ ID NO: 5869 - DNA, 42 bp, Artificial Sequence
  Synthetic
ggcatagaggcctaggtccacaaacaagaccaccatcctgct

SEQ ID NO: 5870 - DNA, 42 bp, Artificial Sequence
  Synthetic
agcccaggaccagttctactccctggtcaaagaaggcgagaa

SEQ ID NO: 5871 - DNA, 44 bp, Artificial Sequence
  Synthetic
agatggggatatttaaaaggggcaggtttaacgagcagagaaga

SEQ ID NO: 5872 - DNA, 39 bp, Artificial Sequence
  Synthetic
acctacgcccttgccccctccgtcgctaaaaacacctgg

SEQ ID NO: 5873 - DNA, 40 bp, Artificial Sequence
  Synthetic
ctcccagtcagatgtccgtgctttgacctgtgcctcagca

SEQ ID NO: 5874 - DNA, 36 bp, Artificial Sequence
  Synthetic
gccaggatgccaccgaggttgaacaggccactcggg

SEQ ID NO: 5875 - DNA, 38 bp, Artificial Sequence
  Synthetic
acccggtccttgtgactgcttacgttgttgcatgccgc

SEQ ID NO: 5876 - DNA, 38 bp, Artificial Sequence
  Synthetic
atgacccaacgaaacagtcccgtcgcaggggcattggc

SEQ ID NO: 5877 - DNA, 39 bp, Artificial Sequence
  Synthetic
catggtcgggctcgggagagagtccggacagtttcatgc

SEQ ID NO: 5878 - DNA, 44 bp, Artificial Sequence
  Synthetic
ggggcattaactaagcttatgagctttcctccagaaagagtgac

SEQ ID NO: 5879 - DNA, 39 bp, Artificial Sequence
  Synthetic
ccagtttgccccatcgtttcccgcaaggatcccatgccc

SEQ ID NO: 5880 - DNA, 40 bp, Artificial Sequence
  Synthetic
cgaggatgaagcaacccccgggtagatggcgagactcttg

SEQ ID NO: 5881 - DNA, 40 bp, Artificial Sequence
  Synthetic
gctccgccacgtattccccgatctacgcttttagccacgg

SEQ ID NO: 5882 - DNA, 38 bp, Artificial Sequence
  Synthetic
tctctcaggacctcaaaggcgggcgaaccaagcccagg

SEQ ID NO: 5883 - DNA, 39 bp, Artificial Sequence
  Synthetic
atgtggcggctcttgaacccagacactccgagcctactg

SEQ ID NO: 5884 - DNA, 37 bp, Artificial Sequence
  Synthetic
cccggccatctttgccggattctggtagaggcgctgc

SEQ ID NO: 5885 - DNA, 38 bp, Artificial Sequence
  Synthetic
ggggacacggagcctgaccaaacttccagcaccaggcg

SEQ ID NO: 5886 - DNA, 40 bp, Artificial Sequence
  Synthetic
gatctcgtcccagttttgcggctcgacctggtcctcggag

SEQ ID NO: 5887 - DNA, 35 bp, Artificial Sequence
  Synthetic
gcccccggccatactccaatcttgagccggctggg

SEQ ID NO: 5888 - DNA, 39 bp, Artificial Sequence
  Synthetic
gcccatcatcccccgagcatcttccagcctctctttcca

SEQ ID NO: 5889 - DNA, 40 bp, Artificial Sequence
  Synthetic
catcgcaatcatgaagtcctccacaagcgttttgacccac

SEQ ID NO: 5890 - DNA, 38 bp, Artificial Sequence
  Synthetic
ggaccacgggtgtcaccagcgacctgcttctggacgcc

SEQ ID NO: 5891 - DNA, 41 bp, Artificial Sequence
  Synthetic
aatcccatgtcagggttggggttggtatcatgcacctcgct

SEQ ID NO: 5892 - DNA, 36 bp, Artificial Sequence
  Synthetic
cccgtgccgcagcgtaaacttctacggccccaggtc

SEQ ID NO: 5893 - DNA, 38 bp, Artificial Sequence
  Synthetic
gtgacgatgccatcaaccagctcggctactcgggggtt

SEQ ID NO: 5894 - DNA, 38 bp, Artificial Sequence
  Synthetic
aaacaccccccccactggcctcaagggggtcagtacct

SEQ ID NO: 5895 - DNA, 37 bp, Artificial Sequence
  Synthetic
ggggcacctaaagacccccctttcgctcttggccggg

SEQ ID NO: 5896 - DNA, 41 bp, Artificial Sequence
  Synthetic
tgtcttccacaccatccacagcacattttccccaggcagtc

SEQ ID NO: 5897 - DNA, 38 bp, Artificial Sequence
  Synthetic
cggagccccaagccacctttgtcgcccgatgtcgtaaa

SEQ ID NO: 5898 - DNA, 39 bp, Artificial Sequence
  Synthetic
tcttcatacaggcccgcaatttcactatctgctgctgac

SEQ ID NO: 5899 - DNA, 40 bp, Artificial Sequence
  Synthetic
cctggtccagcgttgcctcccgatttgacctcacacgaga

SEQ ID NO: 5900 - DNA, 40 bp, Artificial Sequence
  Synthetic
ttggtatagggcaaggttgggcgtggtgctacgcgagttg

SEQ ID NO: 5901 - DNA, 39 bp, Artificial Sequence
  Synthetic
ccttggggtagccgacggtgggtcacctgactactgaga

SEQ ID NO: 5902 - DNA, 41 bp, Artificial Sequence
  Synthetic
tgggcagcatgcttggataacttctcttcgaacacctggcc

SEQ ID NO: 5903 - DNA, 39 bp, Artificial Sequence
  Synthetic
ccgaaagggccaggtcggagcagcctatttttgagcacc

SEQ ID NO: 5904 - DNA, 38 bp, Artificial Sequence
  Synthetic
atttccgtcagccagggtgaccatgtgtgtgggcgcag

SEQ ID NO: 5905 - DNA, 37 bp, Artificial Sequence
  Synthetic
tcacctggatcccctcaccgcgtgagtggcaagggct

SEQ ID NO: 5906 - DNA, 41 bp, Artificial Sequence
  Synthetic
ggatcgattggaaaagggcccagcggcctgtttctaaacgt

SEQ ID NO: 5907 - DNA, 39 bp, Artificial Sequence
  Synthetic
gccagcaggtaaggcaggcccagatcttcctcagtggct

SEQ ID NO: 5908 - DNA, 39 bp, Artificial Sequence
  Synthetic
ctagattcagcgatcccccggtacgagcgggatagcagg

SEQ ID NO: 5909 - DNA, 36 bp, Artificial Sequence
  Synthetic
gagcttgcggctgagctcctccgtgaaggcagggtc

SEQ ID NO: 5910 - DNA, 36 bp, Artificial Sequence
  Synthetic
ctccagggagatgggggccattgccgatgccctggc

SEQ ID NO: 5911 - DNA, 39 bp, Artificial Sequence
  Synthetic
cagctgctgcttgtcgaggatgaagaagctgctggcggc

SEQ ID NO: 5912 - DNA, 39 bp, Artificial Sequence
  Synthetic
acacggcgtacatgtcgatgggtcttgcgggccaacacc

SEQ ID NO: 5913 - DNA, 36 bp, Artificial Sequence
  Synthetic
cccctgtcgaccagaggacgacggccaccaacgagg

SEQ ID NO: 5914 - DNA, 36 bp, Artificial Sequence
  Synthetic
gcaggcacagggtctcggtgccaagctgcagtcctg

SEQ ID NO: 5915 - DNA, 37 bp, Artificial Sequence
  Synthetic
ccagcagggcacagaggtgacgctttcggggcgtaag

SEQ ID NO: 5916 - DNA, 41 bp, Artificial Sequence
  Synthetic
ttccttcagcgtctatgcccagactggcagctgaaccagaa

SEQ ID NO: 5917 - DNA, 36 bp, Artificial Sequence
  Synthetic
cgggcctctggaccctcacaccggccagcctcaact

SEQ ID NO: 5918 - DNA, 39 bp, Artificial Sequence
  Synthetic
agatgtagccgcacggaccctgcacagactagcgaggat

SEQ ID NO: 5919 - DNA, 37 bp, Artificial Sequence
  Synthetic
tgagccggcagaggaccagcggtgttcacccgggatg

SEQ ID NO: 5920 - DNA, 38 bp, Artificial Sequence
  Synthetic
cgggtgaggcggctaagaggatatccgccgtctgctgc

SEQ ID NO: 5921 - DNA, 44 bp, Artificial Sequence
  Synthetic
ttcgagtatccttctttgatgttcgctgctaactcttgcaaaca

SEQ ID NO: 5922 - DNA, 44 bp, Artificial Sequence
  Synthetic
cttagtgaagagtctttgtcaccactctataagggctatgctcc

SEQ ID NO: 5923 - DNA, 42 bp, Artificial Sequence
  Synthetic
cccgcgattggaagctgtataaacaatcgtcttttgctttgt

SEQ ID NO: 5924 - DNA, 46 bp, Artificial Sequence
  Synthetic
ttcctttaagttcggtgattatccagctgactcatgactaagcata

SEQ ID NO: 5925 - DNA, 40 bp, Artificial Sequence
  Synthetic
tgtcccccaaggaagagctacagtgcatcgaaacgaactg

SEQ ID NO: 5926 - DNA, 43 bp, Artificial Sequence
  Synthetic
ttccacttctcttagttctcaaaggggaggaactgactgatcc

SEQ ID NO: 5927 - DNA, 43 bp, Artificial Sequence
  Synthetic
tgcaagcaggcccatagatgggggtaatttctgatagaggtac

SEQ ID NO: 5928 - DNA, 43 bp, Artificial Sequence
  Synthetic
acacctttagacagagttcagagagctgaatgtgacgcccata

SEQ ID NO: 5929 - DNA, 45 bp, Artificial Sequence
  Synthetic
cagaacggttgcttatggttggtttcatcgtctacagtatccatt

SEQ ID NO: 5930 - DNA, 43 bp, Artificial Sequence
  Synthetic
tgagtcttttcaacaagacagagctggccaaagagctgtttca

SEQ ID NO: 5931 - DNA, 49 bp, Artificial Sequence
  Synthetic
gatgttattccagcagaaaagcctgtcatatctatttcccaaaatgtgt

SEQ ID NO: 5932 - DNA, 44 bp, Artificial Sequence
  Synthetic
ctgaagccatttgcacttatcttctaaacggttggtgaatgtcc

SEQ ID NO: 5933 - DNA, 41 bp, Artificial Sequence
  Synthetic
ttcaaccgacactgttgacacaggttaacagagtgtgtcac

SEQ ID NO: 5934 - DNA, 43 bp, Artificial Sequence
  Synthetic
gctgagggagcaattgagctttctttgggaaatatttcgaatc

SEQ ID NO: 5935 - DNA, 48 bp, Artificial Sequence
  Synthetic
ccttgtactgtggggtattcatcattctgatagatattctgttgatcc

SEQ ID NO: 5936 - DNA, 41 bp, Artificial Sequence
  Synthetic
ttcgcactgagtagaggctttgttacactcatgcattgatg

SEQ ID NO: 5937 - DNA, 41 bp, Artificial Sequence
  Synthetic
ttgaagggggatggactggaccctgttcattctgatgatga

SEQ ID NO: 5938 - DNA, 43 bp, Artificial Sequence
  Synthetic
ctatcagattctggcgatctactcagaaactgattgcccccag

SEQ ID NO: 5939 - DNA, 44 bp, Artificial Sequence
  Synthetic
aggtggttatttgatcgttgggagcggtcatatgaaaatgtgta

SEQ ID NO: 5940 - DNA, 43 bp, Artificial Sequence
  Synthetic
atggactctgtagtagctgtgctcttttccaactacagcaaat

SEQ ID NO: 5941 - DNA, 41 bp, Artificial Sequence
  Synthetic
attgtgcagacactgtgggtccacctctggtatagtagctt

SEQ ID NO: 5942 - DNA, 45 bp, Artificial Sequence
  Synthetic
gaggcagacttcgccatgagctacagcattctttaggatctaatt

SEQ ID NO: 5943 - DNA, 40 bp, Artificial Sequence
  Synthetic
aaactcccgcgaactgttttggcaattgtgtttgttgctc

SEQ ID NO: 5944 - DNA, 41 bp, Artificial Sequence
  Synthetic
ctcagggaactaagggcttggacagctttcacattgctatg

SEQ ID NO: 5945 - DNA, 44 bp, Artificial Sequence
  Synthetic
aacgtaggcaaaagtagagaaactacttcagatacttgcagcaa

SEQ ID NO: 5946 - DNA, 45 bp, Artificial Sequence
  Synthetic
ttgatgaagctaccattgcatatcagtaaaaaagccctggcatta

SEQ ID NO: 5947 - DNA, 42 bp, Artificial Sequence
  Synthetic
aaaaggctttggacacagttagagctgagagtttccatcctc

SEQ ID NO: 5948 - DNA, 43 bp, Artificial Sequence
  Synthetic
taccaacctgtacctccgttggcaatagtaaaaccatgccaat

SEQ ID NO: 5949 - DNA, 40 bp, Artificial Sequence
  Synthetic
cgccaacaacatcgcgactcgggatgatgtcctggatcct

SEQ ID NO: 5950 - DNA, 37 bp, Artificial Sequence
  Synthetic
gacaggcgaaggggaaggggaggagtgggagcgggaa

SEQ ID NO: 5951 - DNA, 40 bp, Artificial Sequence
  Synthetic
agtactacgtggtcatgggtagaatcattcgcgctcttcc

SEQ ID NO: 5952 - DNA, 41 bp, Artificial Sequence
  Synthetic
cgtactaaacgtgcctctgttacgtggacatgtaccagcag

SEQ ID NO: 5953 - DNA, 41 bp, Artificial Sequence
  Synthetic
agttcgccctggggtgataccgggtcaattggtctgactgt

SEQ ID NO: 5954 - DNA, 40 bp, Artificial Sequence
  Synthetic
ggctcgtctgccattttagaggattgagttcgtgcaacac

SEQ ID NO: 5955 - DNA, 41 bp, Artificial Sequence
  Synthetic
acagaaacacctcagggatatgttacgtgtgcggattgttg

SEQ ID NO: 5956 - DNA, 45 bp, Artificial Sequence
  Synthetic
acctgatggtttggaggtgggaattaaaatccacatcttcaacag

SEQ ID NO: 5957 - DNA, 46 bp, Artificial Sequence
  Synthetic
gtgggtcatccatattatgatgtccagacactttagggacttcaat

SEQ ID NO: 5958 - DNA, 45 bp, Artificial Sequence
  Synthetic
ggttagagacacagaaaactctagcgatgtgttttgcctgtcatc

SEQ ID NO: 5959 - DNA, 49 bp, Artificial Sequence
  Synthetic
gtgatcaacaacaacgaacaatagcgttactaatgacccacttactgta

SEQ ID NO: 5960 - DNA, 40 bp, Artificial Sequence
  Synthetic
cttctgtatgcctcttggggacttggattttcgtgtcctc

SEQ ID NO: 5961 - DNA, 41 bp, Artificial Sequence
  Synthetic
cctgagctcacctatgtccggtcccaggatatattcgtctc

SEQ ID NO: 5962 - DNA, 42 bp, Artificial Sequence
  Synthetic
ggagatcccaaaagattttcaacgtgtcctatgagcgctgat

SEQ ID NO: 5963 - DNA, 42 bp, Artificial Sequence
  Synthetic
agtctgctcctaagcctgaaaagatttcttcttacccttggg

SEQ ID NO: 5964 - DNA, 44 bp, Artificial Sequence
  Synthetic
cttccctgaaggttgagacaatttgaatgctcaaatcaaaggcg

SEQ ID NO: 5965 - DNA, 46 bp, Artificial Sequence
  Synthetic
aaatccatctacgtgcatttccttactctgaaatggattcttgatg

SEQ ID NO: 5966 - DNA, 46 bp, Artificial Sequence
  Synthetic
aacggtttcaataaaaagctgtgctagacatgaagtatgcagagac

SEQ ID NO: 5967 - DNA, 40 bp, Artificial Sequence
  Synthetic
gtacagctcacagttggcgtaagcgatacgactatctagc

SEQ ID NO: 5968 - DNA, 45 bp, Artificial Sequence
  Synthetic
caaggcagcgtggaattatacaaccatattcaaagcctaaaacgg

SEQ ID NO: 5969 - DNA, 45 bp, Artificial Sequence
  Synthetic
gatctttatgctctgggggttgcttttttctggatcaaaacgttc

SEQ ID NO: 5970 - DNA, 47 bp, Artificial Sequence
  Synthetic
tctgtttctgtctataaccgaagtcactctctccatgatctttcaag

SEQ ID NO: 5971 - DNA, 42 bp, Artificial Sequence
  Synthetic
gctgttgccgagggaagaaacgattcttttctcgttcaatga

SEQ ID NO: 5972 - DNA, 45 bp, Artificial Sequence
  Synthetic
ttgcctgaatgagagtggacttgattatctaattcaaacagctcc

SEQ ID NO: 5973 - DNA, 43 bp, Artificial Sequence
  Synthetic
tcaaacagcatgatgtccgatagcaggcgttatggttatgcta

SEQ ID NO: 5974 - DNA, 45 bp, Artificial Sequence
  Synthetic
ataccctgtcagaaatacacgagcacaaaacaatcacaacagctc

SEQ ID NO: 5975 - DNA, 40 bp, Artificial Sequence
  Synthetic
gcagactttctgggggaggaaagagagctcagatctgtgt

SEQ ID NO: 5976 - DNA, 41 bp, Artificial Sequence
  Synthetic
tgatgagttgcgtaattggatgcacaggagacaatggcaac

SEQ ID NO: 5977 - DNA, 39 bp, Artificial Sequence
  Synthetic
tgcttgcgaaaggtgtgtacccattattccacccccatc

SEQ ID NO: 5978 - DNA, 41 bp, Artificial Sequence
  Synthetic
aaaggagaacctcgagccttgttggtaaaggatgtctgatg

SEQ ID NO: 5979 - DNA, 44 bp, Artificial Sequence
  Synthetic
ttagctcccaggttacgtcatgtatgagactgatagatgtttgt

SEQ ID NO: 5980 - DNA, 50 bp, Artificial Sequence
  Synthetic
tatcgatgtttctcgcttaacagaactctagatccttaaatagagcattt

SEQ ID NO: 5981 - DNA, 43 bp, Artificial Sequence
  Synthetic
ccgctttcctgtgtgtaatcatctctgctatcgaaaaggtttc

SEQ ID NO: 5982 - DNA, 44 bp, Artificial Sequence
  Synthetic
gatcttcagttacaacttgacagctgagttcgaggtgtttctct

SEQ ID NO: 5983 - DNA, 42 bp, Artificial Sequence
  Synthetic
aacgacctcggtacaaaaaccctggtttatgaagtggtggat

SEQ ID NO: 5984 - DNA, 42 bp, Artificial Sequence
  Synthetic
gcaaaacatctccttcctgcattgttgcttataagaaggctg

SEQ ID NO: 5985 - DNA, 41 bp, Artificial Sequence
  Synthetic
gaagctgacttcgccgatcttacttctcccagactgttctt

SEQ ID NO: 5986 - DNA, 42 bp, Artificial Sequence
  Synthetic
cgtatccttgccggtattcactcgatattacggagacaaaga

SEQ ID NO: 5987 - DNA, 43 bp, Artificial Sequence
  Synthetic
tgcacaagctttactgaacactacgaactcatagactagggat

SEQ ID NO: 5988 - DNA, 41 bp, Artificial Sequence
  Synthetic
cactgttcgcggttacaaacccttgtggttcagtaggagaa

SEQ ID NO: 5989 - DNA, 38 bp, Artificial Sequence
  Synthetic
tctagggatttggcctccacgaacccctacatccatgc

SEQ ID NO: 5990 - DNA, 41 bp, Artificial Sequence
  Synthetic
aggtttagggcttcttcctgcataccataaacagcctcagt

SEQ ID NO: 5991 - DNA, 46 bp, Artificial Sequence
  Synthetic
caagtagcgaaaaatccaacagcccacaaaccaaaaccttctatag

SEQ ID NO: 5992 - DNA, 38 bp, Artificial Sequence
  Synthetic
ctgctcagctcttgcggttataaccgcgaatcccatag

SEQ ID NO: 5993 - DNA, 43 bp, Artificial Sequence
  Synthetic
tttgtcacgaatatagccactgatttgggttcttctgagctag

SEQ ID NO: 5994 - DNA, 48 bp, Artificial Sequence
  Synthetic
agatcctctaaatttgaacctccgcatactaagttgtccattgttgat

SEQ ID NO: 5995 - DNA, 44 bp, Artificial Sequence
  Synthetic
tccagacatagcaacaatgacagaaacttcaataaacgaaagcg

SEQ ID NO: 5996 - DNA, 45 bp, Artificial Sequence
  Synthetic
tgatggttacttcctcaaaacaagaacggtaaaagaaggtcgttt

SEQ ID NO: 5997 - DNA, 40 bp, Artificial Sequence
  Synthetic
tcagaaccctgacggattgtctgagagagattgtggtact

SEQ ID NO: 5998 - DNA, 43 bp, Artificial Sequence
  Synthetic
ggctgcatcgtctcgagaacttaaaaaacacttgttggagaga

SEQ ID NO: 5999 - DNA, 45 bp, Artificial Sequence
  Synthetic
tctccagcagcaaaaactaaaattctggttcggtttctttacctc

SEQ ID NO: 6000 - DNA, 42 bp, Artificial Sequence
  Synthetic
tgtacggaagaagaattgaggtctaagaagaaggtggacgac

SEQ ID NO: 6001 - DNA, 41 bp, Artificial Sequence
  Synthetic
caacgttctctcctgcacgagttactggggttgaaatgttc

SEQ ID NO: 6002 - DNA, 44 bp, Artificial Sequence
  Synthetic
caagtagtcattgctatgctcgaatagagttgtacaagcgattg

SEQ ID NO: 6003 - DNA, 41 bp, Artificial Sequence
  Synthetic
agccgataatgctcgctcactcctccaactaaaagaccatt

SEQ ID NO: 6004 - DNA, 48 bp, Artificial Sequence
  Synthetic
gtccttcctgtttagggaaacgacgttttatttttatagcggacttct

SEQ ID NO: 6005 - DNA, 41 bp, Artificial Sequence
  Synthetic
cattctgtggcttctgcattagataaggatggccgattcgt

SEQ ID NO: 6006 - DNA, 46 bp, Artificial Sequence
  Synthetic
tacgatccaaattgagaaccttgcctgatacaccagaaatagtcga

SEQ ID NO: 6007 - DNA, 43 bp, Artificial Sequence
  Synthetic
tcttactagctccttgtcgagaacaggacttggagaagctttc

SEQ ID NO: 6008 - DNA, 38 bp, Artificial Sequence
  Synthetic
aatgccgctcgagtcaatgtagttcacgagcagtttgc

SEQ ID NO: 6009 - DNA, 38 bp, Artificial Sequence
  Synthetic
cgacaacccacgatcttgctgcgctcatttcttggttg

SEQ ID NO: 6010 - DNA, 41 bp, Artificial Sequence
  Synthetic
tcgctcccactaatgcaactcttgaagcttttggtacagta

SEQ ID NO: 6011 - DNA, 42 bp, Artificial Sequence
  Synthetic
aaacagtgaggacgacaaagtaaagtcggagatactgggagg

SEQ ID NO: 6012 - DNA, 42 bp, Artificial Sequence
  Synthetic
gcaatcgctaaaacaatcgattgcagcaattgtggctatcgc

SEQ ID NO: 6013 - DNA, 47 bp, Artificial Sequence
  Synthetic
gtaggtaaaacctcgtttggtcaacatctgtatcaaaaaaaggcagc

SEQ ID NO: 6014 - DNA, 43 bp, Artificial Sequence
  Synthetic
caggctgcacaccatcactacttttttatggttttgtctgtgc

SEQ ID NO: 6015 - DNA, 43 bp, Artificial Sequence
  Synthetic
ggaactgaccctataaggaatgcgtaacgacatcattgcatga

SEQ ID NO: 6016 - DNA, 41 bp, Artificial Sequence
  Synthetic
gacaaccatttttgctttgctgtgggatttggcgaagaaga

SEQ ID NO: 6017 - DNA, 42 bp, Artificial Sequence
  Synthetic
cgatcaaatcgcaaacaaacacttgatcgtgtgtgtcgtgat

SEQ ID NO: 6018 - DNA, 44 bp, Artificial Sequence
  Synthetic
gcgaacgtttacaaatggctcccaaaattttcgcaaaagcatac

SEQ ID NO: 6019 - DNA, 50 bp, Artificial Sequence
  Synthetic
atctgtgcagcttaaaacctaatgtctttagagaaagtcataaatacgga

SEQ ID NO: 6020 - DNA, 40 bp, Artificial Sequence
  Synthetic
ggcttctgtcaccttgctcagctttagttgtggcttcaac

SEQ ID NO: 6021 - DNA, 40 bp, Artificial Sequence
  Synthetic
ccgcacaagaaagccctcttggaaagactcctttggtgtt

SEQ ID NO: 6022 - DNA, 46 bp, Artificial Sequence
  Synthetic
ctgtcaattctacattatgtgcagcgatcttttttggagcatatgc

SEQ ID NO: 6023 - DNA, 46 bp, Artificial Sequence
  Synthetic
gaagctggttctacaacagaaactacagtttctccatagatagcac

SEQ ID NO: 6024 - DNA, 41 bp, Artificial Sequence
  Synthetic
gctcaaagtccaaaaaaacgcatcttggagcatcttgtgga

SEQ ID NO: 6025 - DNA, 44 bp, Artificial Sequence
  Synthetic
gcctgaccccagaaaccatttcttcttcattaaaatcagcaacg

SEQ ID NO: 6026 - DNA, 42 bp, Artificial Sequence
  Synthetic
tcgtttccttttccaggttcattggtcgaggacaatatgctc

SEQ ID NO: 6027 - DNA, 44 bp, Artificial Sequence
  Synthetic
ttaggtcctgtagctttagactcatcaaagagactcccgtagac

SEQ ID NO: 6028 - DNA, 41 bp, Artificial Sequence
  Synthetic
aaggcactattcgttgcaccaaagagttcagttccttggat

SEQ ID NO: 6029 - DNA, 41 bp, Artificial Sequence
  Synthetic
aatcacaatgcgctcccatttagtgcatgagaatcgtcttg

SEQ ID NO: 6030 - DNA, 42 bp, Artificial Sequence
  Synthetic
agaagcaaggatgaggttttctgtgttggagcacacatcacg

SEQ ID NO: 6031 - DNA, 42 bp, Artificial Sequence
  Synthetic
gcccctaaaacccgacaaagagaacgtccctaatattgaaga

SEQ ID NO: 6032 - DNA, 42 bp, Artificial Sequence
  Synthetic
aaaagcatctaggagctccccaaaggactggatatgaagtgg

SEQ ID NO: 6033 - DNA, 39 bp, Artificial Sequence
  Synthetic
cacaggagcaaccacgaagagtaaaagagtgccttggtg

SEQ ID NO: 6034 - DNA, 49 bp, Artificial Sequence
  Synthetic
acctctctgtaagcaaatactgacaggttacttccggatattaatgatc

SEQ ID NO: 6035 - DNA, 41 bp, Artificial Sequence
  Synthetic
cgaagcggtgaatgcatgaaggatgagatgttgaagagagc

SEQ ID NO: 6036 - DNA, 48 bp, Artificial Sequence
  Synthetic
actggaaaagctacaatggattgtagaagagtaagaagttcattgctt

SEQ ID NO: 6037 - DNA, 40 bp, Artificial Sequence
  Synthetic
tctgccatcaaagcatttcgaatgggaatgacgagtgatt

SEQ ID NO: 6038 - DNA, 38 bp, Artificial Sequence
  Synthetic
aatttggcggctggtaatcctgacttcggcgaatttgg

SEQ ID NO: 6039 - DNA, 42 bp, Artificial Sequence
  Synthetic
ttccgaccgagcaatctcagtttgggagtaaaagttcaggtt

SEQ ID NO: 6040 - DNA, 45 bp, Artificial Sequence
  Synthetic
caacacttttttaaggcatcttccagtagtgttgttgaagctcaa

SEQ ID NO: 6041 - DNA, 45 bp, Artificial Sequence
  Synthetic
ccaaagcgttcatatctcggactaagaaaaggtccttttgttgat

SEQ ID NO: 6042 - DNA, 40 bp, Artificial Sequence
  Synthetic
aagcaaccttgacgggcattgccattccactaaaaagcct

SEQ ID NO: 6043 - DNA, 40 bp, Artificial Sequence
  Synthetic
aaaccggcgtatttcttcctgaaaacaattcccctgtgga

SEQ ID NO: 6044 - DNA, 46 bp, Artificial Sequence
  Synthetic
agaccctcttacgctggttaacctttggagataataatagaggatt

SEQ ID NO: 6045 - DNA, 41 bp, Artificial Sequence
  Synthetic
tctttgtcatcgatttggtcacggaggggaaagcatcatca

SEQ ID NO: 6046 - DNA, 42 bp, Artificial Sequence
  Synthetic
cgtccactaccaagacctagatacgccaatcaaaatctcctt

SEQ ID NO: 6047 - DNA, 42 bp, Artificial Sequence
  Synthetic
tagctctgcagattttgtagcaccctccgggatagtcttagg

SEQ ID NO: 6048 - DNA, 45 bp, Artificial Sequence
  Synthetic
agctaaaccaacccgaagaatctgttcttacacatatcgatcgta

SEQ ID NO: 6049 - DNA, 47 bp, Artificial Sequence
  Synthetic
tctcaaaatccctttaaagcagagcatacgcggaaatttctacttct

SEQ ID NO: 6050 - DNA, 45 bp, Artificial Sequence
  Synthetic
atctggaaattcaagaaagtcgtggggtaagggatcaggaattcc

SEQ ID NO: 6051 - DNA, 42 bp, Artificial Sequence
  Synthetic
ctgaaggaatcgctcaaggacgtgttccaatttggtttggtt

SEQ ID NO: 6052 - DNA, 39 bp, Artificial Sequence
  Synthetic
tggaggggccattccgtaattgttgttcgagatccttgg

SEQ ID NO: 6053 - DNA, 39 bp, Artificial Sequence
  Synthetic
aacctgggagacaagatgcaccattggagataaaagcgc

SEQ ID NO: 6054 - DNA, 44 bp, Artificial Sequence
  Synthetic
caccctaatatagttccgctgcctcttgatacagtttgaaagct

SEQ ID NO: 6055 - DNA, 42 bp, Artificial Sequence
  Synthetic
cagatgcttttacgacttgcaaccaagatattggtgtgcggt

SEQ ID NO: 6056 - DNA, 40 bp, Artificial Sequence
  Synthetic
aagttcccatgatcgcctcaacaggaaactctaacccttt

SEQ ID NO: 6057 - DNA, 40 bp, Artificial Sequence
  Synthetic
gagcttgtcccaattgctccgtcaaaaagaaacggatcgt

SEQ ID NO: 6058 - DNA, 46 bp, Artificial Sequence
  Synthetic
tatcagcgatgcagtttctacagcagaagatacccacaataaaagc

SEQ ID NO: 6059 - DNA, 38 bp, Artificial Sequence
  Synthetic
tgttccccgtacaagcaagtttctgccccatatctgca

SEQ ID NO: 6060 - DNA, 43 bp, Artificial Sequence
  Synthetic
ctgctcagctgttaaaaagtcaaatggtaagtgttcttcccac

SEQ ID NO: 6061 - DNA, 38 bp, Artificial Sequence
  Synthetic
ccccaggcaaagcaaaaagcaagctcactgttgctgtt

SEQ ID NO: 6062 - DNA, 45 bp, Artificial Sequence
  Synthetic
ggtaactgttgtattcgcacgggcgatatatcaatgaggtaggac

SEQ ID NO: 6063 - DNA, 46 bp, Artificial Sequence
  Synthetic
gatcctaacgtgtctcctattgctgtagtaggtatctgaatctgtg

SEQ ID NO: 6064 - DNA, 43 bp, Artificial Sequence
  Synthetic
ttttcctgtgttttttcgatcagcggagcaactcttactgacg

SEQ ID NO: 6065 - DNA, 43 bp, Artificial Sequence
  Synthetic
gggagttggagaaatcatgggaccctcaaactcaacaagaact

SEQ ID NO: 6066 - DNA, 42 bp, Artificial Sequence
  Synthetic
ttcgagcccttttgaagagtgatcgcaatctaatgacgagaa

SEQ ID NO: 6067 - DNA, 42 bp, Artificial Sequence
  Synthetic
tcagagcctgtggatagtcttgcagcgtattccattccattt

SEQ ID NO: 6068 - DNA, 43 bp, Artificial Sequence
  Synthetic
agggaaatcagaaaatcccgcaaaaccttcctcttaagtctcc

SEQ ID NO: 6069 - DNA, 43 bp, Artificial Sequence
  Synthetic
agcgtacatccatgatttattgtgttatcgcggctatcgtctt

SEQ ID NO: 6070 - DNA, 39 bp, Artificial Sequence
  Synthetic
cgcgctccgttaagatgattcaaggccctattgacaaag

SEQ ID NO: 6071 - DNA, 43 bp, Artificial Sequence
  Synthetic
ccttcggcaacaaaaatcgttgcaaaaattctccaacggaaag

SEQ ID NO: 6072 - DNA, 40 bp, Artificial Sequence
  Synthetic
ttaacttcaacaagcgctgcaacaaaagagggcgtgattg

SEQ ID NO: 6073 - DNA, 44 bp, Artificial Sequence
  Synthetic
caggacgcaccggagataaaattaaagatgctgttattgatgcg

SEQ ID NO: 6074 - DNA, 38 bp, Artificial Sequence
  Synthetic
gtagtgccagctcgggataaacccgtcactaaacactg

SEQ ID NO: 6075 - DNA, 40 bp, Artificial Sequence
  Synthetic
tcctgcagccagaccatgtaatgtctccggaaaagacaac

SEQ ID NO: 6076 - DNA, 42 bp, Artificial Sequence
  Synthetic
cttaatctttctgaatggggcgttccagtaggagcatacagc

SEQ ID NO: 6077 - DNA, 40 bp, Artificial Sequence
  Synthetic
ttacgaaggccatacggtatctaaattggctattcgtgcg

SEQ ID NO: 6078 - DNA, 44 bp, Artificial Sequence
  Synthetic
gtgcggggagaactcttgttggttctcgtatttaaaatcgattc

SEQ ID NO: 6079 - DNA, 46 bp, Artificial Sequence
  Synthetic
caacgaaatacgcttgatacccattggaagttgcaaaaaagattgt

SEQ ID NO: 6080 - DNA, 42 bp, Artificial Sequence
  Synthetic
aatgtcgaggctttaaacgttttcatatcgcaaacgccttgt

SEQ ID NO: 6081 - DNA, 40 bp, Artificial Sequence
  Synthetic
cgtctgcgtaagatgcatcttaacgtcttccctaatccca

SEQ ID NO: 6082 - DNA, 40 bp, Artificial Sequence
  Synthetic
gcgtaatggtgtgatgcctgctgcttgctctctaaactct

SEQ ID NO: 6083 - DNA, 44 bp, Artificial Sequence
  Synthetic
tccgtaacttctgattcagaattgaccttcccatgaatgcctat

SEQ ID NO: 6084 - DNA, 38 bp, Artificial Sequence
  Synthetic
catggcaaaggttcgcctcacacactttcttcgcgaag

SEQ ID NO: 6085 - DNA, 41 bp, Artificial Sequence
  Synthetic
aggcgattctggaccaaaatcgaacgcttactacaggagat

SEQ ID NO: 6086 - DNA, 41 bp, Artificial Sequence
  Synthetic
ttgccttaggagaaaagggaaggacaatcacacatcccacc

SEQ ID NO: 6087 - DNA, 39 bp, Artificial Sequence
  Synthetic
agcttcggaaggagacaagttcgatccgagatggcttta

SEQ ID NO: 6088 - DNA, 42 bp, Artificial Sequence
  Synthetic
agcaattacgggatgaacatctggcaagctttgaatacggtg

SEQ ID NO: 6089 - DNA, 45 bp, Artificial Sequence
  Synthetic
gttcacctctttcaacggtatatgagtatggctaaggagattcgc

SEQ ID NO: 6090 - DNA, 43 bp, Artificial Sequence
  Synthetic
ctccacaaatcagccgatccctatcgatcagatttatgcagat

SEQ ID NO: 6091 - DNA, 41 bp, Artificial Sequence
  Synthetic
tgctcgctgcaaattccgaaagttttgcgttagtagaagct

SEQ ID NO: 6092 - DNA, 44 bp, Artificial Sequence
  Synthetic
aacagctcaccaatcgagaatcagatgtcggttttatgcttagt

SEQ ID NO: 6093 - DNA, 40 bp, Artificial Sequence
  Synthetic
catgtgcggcaagccttttggtgtttgcctctctacaaga

SEQ ID NO: 6094 - DNA, 42 bp, Artificial Sequence
  Synthetic
caagagcacaatggtatccgagctagcattgcatcaggacta

SEQ ID NO: 6095 - DNA, 43 bp, Artificial Sequence
  Synthetic
tggaagaggttcttttatgaatcgttagcactgcattcacagc

SEQ ID NO: 6096 - DNA, 45 bp, Artificial Sequence
  Synthetic
tatagggagcgaatgttgctgtttgctaagaaactatctctctgg

SEQ ID NO: 6097 - DNA, 38 bp, Artificial Sequence
  Synthetic
ttggcgagatagcgttgttcacaggctgtgatggaaat

SEQ ID NO: 6098 - DNA, 41 bp, Artificial Sequence
  Synthetic
ggtgctttgtgccaactctttgctttaccaataagctcgaa

SEQ ID NO: 6099 - DNA, 43 bp, Artificial Sequence
  Synthetic
ctaagggaacagaaggcttgataatctccaagcaagcgtctac

SEQ ID NO: 6100 - DNA, 39 bp, Artificial Sequence
  Synthetic
tgctaaaaggtcgcgctagaagcatgatctttgttgcag

SEQ ID NO: 6101 - DNA, 42 bp, Artificial Sequence
  Synthetic
gtggaaattcgggggagtcttttctaaggacaaaaaccactg

SEQ ID NO: 6102 - DNA, 45 bp, Artificial Sequence
  Synthetic
aaggacaatatagccttggagaaaccgactctcctagtactccat

SEQ ID NO: 6103 - DNA, 47 bp, Artificial Sequence
  Synthetic
tcctggttttcctctcttaatagctcaccacattctgaaatccaaat

SEQ ID NO: 6104 - DNA, 47 bp, Artificial Sequence
  Synthetic
ccggaagacttattagcagcagctgtctgattactagaaaattgcat

SEQ ID NO: 6105 - DNA, 44 bp, Artificial Sequence
  Synthetic
actagctaagcagttaggccttttgactaaacatccgattgttc

SEQ ID NO: 6106 - DNA, 40 bp, Artificial Sequence
  Synthetic
ttcacactacacaatgtgtcgcccaccctttcctggagta

SEQ ID NO: 6107 - DNA, 44 bp, Artificial Sequence
  Synthetic
tgacggatgttgttaaaggttctccacaatgacatcttcttggc

SEQ ID NO: 6108 - DNA, 48 bp, Artificial Sequence
  Synthetic
ttctcagaagaggatgtgcatgagaaatcggatcatctaaattctgaa

SEQ ID NO: 6109 - DNA, 42 bp, Artificial Sequence
  Synthetic
tcgcagaattgatgatcatatgcctgcgttatcgagcgtatg

SEQ ID NO: 6110 - DNA, 43 bp, Artificial Sequence
  Synthetic
atatgctgaggatttagaacaagcagtatccccttctgcgatg

SEQ ID NO: 6111 - DNA, 40 bp, Artificial Sequence
  Synthetic
gtcgcatcgagcaaagcatctgatgttttgtcgagcaatt

SEQ ID NO: 6112 - DNA, 44 bp, Artificial Sequence
  Synthetic
tagcagggatagaggaagccaaggattcttcaagaaatctacga

SEQ ID NO: 6113 - DNA, 47 bp, Artificial Sequence
  Synthetic
ctccttctttgacaaagtcagagatctgtcatatttctgaattgtct

SEQ ID NO: 6114 - DNA, 50 bp, Artificial Sequence
  Synthetic
ggagcatatttagaaacagttcccttcatatccttaatcttatgacacag

SEQ ID NO: 6115 - DNA, 42 bp, Artificial Sequence
  Synthetic
gcgattcagttagcacgtattccccagctcctaaacgcaaat

SEQ ID NO: 6116 - DNA, 39 bp, Artificial Sequence
  Synthetic
tccgaagaaagcttgggtgctgcaggtatcagcatttgg

SEQ ID NO: 6117 - DNA, 40 bp, Artificial Sequence
  Synthetic
cgttgcgtgatctcaaggctctctcgtaacagcagatacc

SEQ ID NO: 6118 - DNA, 44 bp, Artificial Sequence
  Synthetic
ggaaattttctttccggagaacgagtgcgtcgggttaattttcc

SEQ ID NO: 6119 - DNA, 44 bp, Artificial Sequence
  Synthetic
gatcccagccatcaatgtgatagctttactgtatcggtgtcaaa

SEQ ID NO: 6120 - DNA, 40 bp, Artificial Sequence
  Synthetic
ctagtcagcgagtgggatgacattatatcaccccccctcc

SEQ ID NO: 6121 - DNA, 47 bp, Artificial Sequence
  Synthetic
tatgccgcatattttaacgcgtacaacagaatccctataaagaatgt

SEQ ID NO: 6122 - DNA, 42 bp, Artificial Sequence
  Synthetic
tccacagttacagaaatcgatgagtagaccgatgaaacgcat

SEQ ID NO: 6123 - DNA, 38 bp, Artificial Sequence
  Synthetic
gcgctatgatggttacagcgagcatcgtcgctacaatc

SEQ ID NO: 6124 - DNA, 44 bp, Artificial Sequence
  Synthetic
accagtattttgggtcatatcttgtctcaaagaggggaagagtc

SEQ ID NO: 6125 - DNA, 41 bp, Artificial Sequence
  Synthetic
gaaagggggagctatttatgccaagaattgtacagggccac

SEQ ID NO: 6126 - DNA, 42 bp, Artificial Sequence
  Synthetic
gcaattcaagcaagtgtggatgcgaaactccagaaacccata

SEQ ID NO: 6127 - DNA, 41 bp, Artificial Sequence
  Synthetic
atacacatttgcagaggagagcccaatctctccaaccagac

SEQ ID NO: 6128 - DNA, 41 bp, Artificial Sequence
  Synthetic
gcatcgacaccatcaccatctccggactgattaatcgtgac

SEQ ID NO: 6129 - DNA, 42 bp, Artificial Sequence
  Synthetic
tttacgcagttgctgtactactcaaaaagaggcgaggtctct

SEQ ID NO: 6130 - DNA, 43 bp, Artificial Sequence
  Synthetic
ttgctctgaaacacttctgtcgtttcatttttttctcacgtcg

SEQ ID NO: 6131 - DNA, 44 bp, Artificial Sequence
  Synthetic
ttgatggaattggacgattctacatgcccctcataatcactgag

SEQ ID NO: 6132 - DNA, 48 bp, Artificial Sequence
  Synthetic
gccaagccaataatggtgatgatggtatgttgtatcattcaaattgga

SEQ ID NO: 6133 - DNA, 44 bp, Artificial Sequence
  Synthetic
ggtgagaatggacggaaaacaattttcctttgagaatgttgcac

SEQ ID NO: 6134 - DNA, 40 bp, Artificial Sequence
  Synthetic
aaggaccagaagtggaggaaagtacactgatttgacctgc

SEQ ID NO: 6135 - DNA, 46 bp, Artificial Sequence
  Synthetic
gggatgtgtttgtcataagggaacttgagtcaagaagaaggttctg

SEQ ID NO: 6136 - DNA, 45 bp, Artificial Sequence
  Synthetic
aacagacactatcaagagttggagaacacatgcacattcagactc

SEQ ID NO: 6137 - DNA, 41 bp, Artificial Sequence
  Synthetic
cacatgtgtgtgcagggataacttctggttgaaagacaccc

SEQ ID NO: 6138 - DNA, 47 bp, Artificial Sequence
  Synthetic
tgagatgatttgggatccgaacgcgatatcttgctttattgagaagt

SEQ ID NO: 6139 - DNA, 40 bp, Artificial Sequence
  Synthetic
tctacggaaggagtacctgagttatcgtcagcatccacag

SEQ ID NO: 6140 - DNA, 41 bp, Artificial Sequence
  Synthetic
tggcttcggaggaaatttgtatgtcaagacagaggctccag

SEQ ID NO: 6141 - DNA, 46 bp, Artificial Sequence
  Synthetic
tgaaggagttaactggagtccacttcagtttgatatcagtccaatt

SEQ ID NO: 6142 - DNA, 45 bp, Artificial Sequence
  Synthetic
aaatccagcattgtacacacaagagcaagattttctttcccacat

SEQ ID NO: 6143 - DNA, 42 bp, Artificial Sequence
  Synthetic
atcaccttacacagggaattctgggtttcagctggagcatgt

SEQ ID NO: 6144 - DNA, 42 bp, Artificial Sequence
  Synthetic
actggactatgaagctagatgcacgtaaaagggctggtttca

SEQ ID NO: 6145 - DNA, 44 bp, Artificial Sequence
  Synthetic
agagcagaatttttggaatcgatgactgcttcaacgattgcaac

SEQ ID NO: 6146 - DNA, 49 bp, Artificial Sequence
  Synthetic
aggagaattgggaataataagagccgttcccataaagattcttgtaatc

SEQ ID NO: 6147 - DNA, 43 bp, Artificial Sequence
  Synthetic
caatcagatcctttttactggggagccaatgaaatagcagcag

SEQ ID NO: 6148 - DNA, 38 bp, Artificial Sequence
  Synthetic
ccagttgcatgggcctcataccaaaagcagcttctgtg

SEQ ID NO: 6149 - DNA, 42 bp, Artificial Sequence
  Synthetic
tcatcctagctccagtgctggtcttctggtaggcctgcaaat

SEQ ID NO: 6150 - DNA, 46 bp, Artificial Sequence
  Synthetic
catcacaatggcaaaacctccttccaatggaatatctaactgtctt

SEQ ID NO: 6151 - DNA, 41 bp, Artificial Sequence
  Synthetic
cctgcattgtgacgaagacttgtctattctttgaggtgcag

SEQ ID NO: 6152 - DNA, 42 bp, Artificial Sequence
  Synthetic
tttgacaaagacacagactcagattttcccaattctgcgtcc

SEQ ID NO: 6153 - DNA, 41 bp, Artificial Sequence
  Synthetic
aagaggcgactgttcgaggagaatcttcagcttcatgagtt

SEQ ID NO: 6154 - DNA, 46 bp, Artificial Sequence
  Synthetic
atacccatggagaatacccagagtcatattcctgatgagaaagcaa

SEQ ID NO: 6155 - DNA, 48 bp, Artificial Sequence
  Synthetic
cactgcaagacaagttaatgacaatgttccaatgttcaatttgatctt

SEQ ID NO: 6156 - DNA, 41 bp, Artificial Sequence
  Synthetic
agtgaaactggagaatgggaagtgttggtggagctggtaac

SEQ ID NO: 6157 - DNA, 40 bp, Artificial Sequence
  Synthetic
gacgaccgaaagcgtcaccgtgtgatcccgatctcgatcc

SEQ ID NO: 6158 - DNA, 39 bp, Artificial Sequence
  Synthetic
cctccagaggccgtagaggggccacttgtgccaacagat

SEQ ID NO: 6159 - DNA, 46 bp, Artificial Sequence
  Synthetic
gcaggtagcaacgatagaataggtctttgagatttactggtaaagc

SEQ ID NO: 6160 - DNA, 41 bp, Artificial Sequence
  Synthetic
tgaggctataggaccaagtgaacagaagcactggggtcaat

SEQ ID NO: 6161 - DNA, 46 bp, Artificial Sequence
  Synthetic
caaacgagctactataaggaccagccctaaaaaaatgtacctgacc

SEQ ID NO: 6162 - DNA, 41 bp, Artificial Sequence
  Synthetic
ttttgcagatgtcctattggctttttgtacccttgcaaccg

SEQ ID NO: 6163 - DNA, 45 bp, Artificial Sequence
  Synthetic
atcagtttagagcttttcgactgaacagacatgtcagctaaagca

SEQ ID NO: 6164 - DNA, 40 bp, Artificial Sequence
  Synthetic
taggtgaacattgggacacagcctctaatggtgggcatcc

SEQ ID NO: 6165 - DNA, 43 bp, Artificial Sequence
  Synthetic
acgacgagaacaatgttatgttagggggatggtatcacccaca

SEQ ID NO: 6166 - DNA, 45 bp, Artificial Sequence
  Synthetic
attggttacaaagagcacaaggcgtcagaaacagttcattactcc

SEQ ID NO: 6167 - DNA, 39 bp, Artificial Sequence
  Synthetic
gttaacagctttcagccagggcattgtgacctatgggcg

SEQ ID NO: 6168 - DNA, 43 bp, Artificial Sequence
  Synthetic
tgaatgcaagtccatatgatttggaaaaactgcttcacgggac

SEQ ID NO: 6169 - DNA, 47 bp, Artificial Sequence
  Synthetic
ttgttccatgggttatgtacttgctccatgatctttattgtaagcac

SEQ ID NO: 6170 - DNA, 44 bp, Artificial Sequence
  Synthetic
gagtgctgctactatacgtagtgtaaccatcacacaagtcttca

SEQ ID NO: 6171 - DNA, 44 bp, Artificial Sequence
  Synthetic
tggtaacatgatagatggttttgcttgccatcaaatcacctact

SEQ ID NO: 6172 - DNA, 43 bp, Artificial Sequence
  Synthetic
acgggagttgctaggtgtttacagaggtttataaacacctcta

SEQ ID NO: 6173 - DNA, 45 bp, Artificial Sequence
  Synthetic
acgtagaagaatttgtctttcaggcgatgaatgtaacaagccacg

SEQ ID NO: 6174 - DNA, 43 bp, Artificial Sequence
  Synthetic
tgacaaatattaccctgttgtggtggaactctccatgcttgat

SEQ ID NO: 6175 - DNA, 43 bp, Artificial Sequence
  Synthetic
ttaactgtcacaagtgctggacaagacttcagaagactcctcc

SEQ ID NO: 6176 - DNA, 46 bp, Artificial Sequence
  Synthetic
acctgctaatattgtacttccacaaactgccaatcacataaggtta

SEQ ID NO: 6177 - DNA, 48 bp, Artificial Sequence
  Synthetic
aaactgtgcttaatgttgttggaccgctctaacaatacataactttgt

SEQ ID NO: 6178 - DNA, 47 bp, Artificial Sequence
  Synthetic
atcaatgacgttgcatttgtttcggtgctatatcatgtcttaaggat

SEQ ID NO: 6179 - DNA, 46 bp, Artificial Sequence
  Synthetic
aggaaatgtgttttgtgatggagtactggaaaaagactttaccttt

SEQ ID NO: 6180 - DNA, 42 bp, Artificial Sequence
  Synthetic
aaaattgttcaatggcaagaggcctacaaatctagcagggcg

SEQ ID NO: 6181 - DNA, 48 bp, Artificial Sequence
  Synthetic
ttgagtcgtgaagatcttgagattgatgaattagctttttaccgcaag

SEQ ID NO: 6182 - DNA, 48 bp, Artificial Sequence
  Synthetic
ttaaattgataggacacaccgtctgctttagagctatcaaaacccaac

SEQ ID NO: 6183 - DNA, 43 bp, Artificial Sequence
  Synthetic
ggtgacagctcagagagtggtggttttttaacaccacttaact

SEQ ID NO: 6184 - DNA, 48 bp, Artificial Sequence
  Synthetic
tggctttagctaatatgttaccagcagagcttaataaaagaggcaata

SEQ ID NO: 6185 - DNA, 45 bp, Artificial Sequence
  Synthetic
ctaaggaattgaaacggcccattcttaacatcagtaaccgtatga

SEQ ID NO: 6186 - DNA, 48 bp, Artificial Sequence
  Synthetic
aactggtttgaaactgaagcttactggtgtagttaaaacagagacatt

SEQ ID NO: 6187 - DNA, 47 bp, Artificial Sequence
  Synthetic
tgtgttgcactttattacacatgcatacgatatttgactatgtggcg

SEQ ID NO: 6188 - DNA, 45 bp, Artificial Sequence
  Synthetic
actcgttctatgtcgtattgcagtaaagcatataccctcatcagc

SEQ ID NO: 6189 - DNA, 42 bp, Artificial Sequence
  Synthetic
aagcttaaacgtgcttttggtgacaccacacaatcacgttaa

SEQ ID NO: 6190 - DNA, 43 bp, Artificial Sequence
  Synthetic
gcctactgcttccgtctcaaagtaggatttaccattttcacaa

SEQ ID NO: 6191 - DNA, 47 bp, Artificial Sequence
  Synthetic
gatcttgtggatctgttggttatgtctaagctccaattgatgcatat

SEQ ID NO: 6192 - DNA, 48 bp, Artificial Sequence
  Synthetic
agatgctttagcttctatgactggtaccattcttaagacgcttaatag

SEQ ID NO: 6193 - DNA, 45 bp, Artificial Sequence
  Synthetic
tgtgtacaagcatacatttagaggcgtgtactcaactgatggaac

SEQ ID NO: 6194 - DNA, 46 bp, Artificial Sequence
  Synthetic
gcaaaggttattgctaagtgggttagcacaaaagcactatcttaat

SEQ ID NO: 6195 - DNA, 48 bp, Artificial Sequence
  Synthetic
tgactgatgtcaaatgtgctaatgtacttagaattagaagcaacatgc

SEQ ID NO: 6196 - DNA, 47 bp, Artificial Sequence
  Synthetic
tgctaagaaaaatcttgatgaggcggctttctctagctgttttaact

SEQ ID NO: 6197 - DNA, 50 bp, Artificial Sequence
  Synthetic
gtatggcagattcaaactatccaggatcagatatctcattcaactgctta

SEQ ID NO: 6198 - DNA, 46 bp, Artificial Sequence
  Synthetic
gaactgctactgaatatgcttccacttaggatctacagaaaacgca

SEQ ID NO: 6199 - DNA, 44 bp, Artificial Sequence
  Synthetic
cggcaagtttgtacaagtgcccatgtgtcaaaacataagacaca

SEQ ID NO: 6200 - DNA, 47 bp, Artificial Sequence
  Synthetic
tcagttctttgttgttaagaggacacttttacacgctcatagcattt

SEQ ID NO: 6201 - DNA, 48 bp, Artificial Sequence
  Synthetic
ttttggtgactatgttattgcagcccagcataggcatgatataagaat

SEQ ID NO: 6202 - DNA, 41 bp, Artificial Sequence
  Synthetic
atccagctttgcatgtagcttcacactaaaacagcaagtgc

SEQ ID NO: 6203 - DNA, 50 bp, Artificial Sequence
  Synthetic
ttggaaaagccaggctctattatgatagtataagcgtaaatttcatcctg

SEQ ID NO: 6204 - DNA, 40 bp, Artificial Sequence
  Synthetic
ctgggatgatatgttacgccgcccaacccataagtacagg

SEQ ID NO: 6205 - DNA, 47 bp, Artificial Sequence
  Synthetic
gttgattcaacctttgtcacagaatccatcatcactcaaaatcatca

SEQ ID NO: 6206 - DNA, 42 bp, Artificial Sequence
  Synthetic
agatggatggtgacgatgtctacaaaacatccagctcctaat

SEQ ID NO: 6207 - DNA, 40 bp, Artificial Sequence
  Synthetic
ttatgcagagtgttggagcttgttctgatgcaactgccac

SEQ ID NO: 6208 - DNA, 46 bp, Artificial Sequence
  Synthetic
cttgaaattgtttgctgcagaaacctgatgcataactctgcttaaa

SEQ ID NO: 6209 - DNA, 44 bp, Artificial Sequence
  Synthetic
acacattggtatgaaacgttactgcgcaagatgtgacttccctg

SEQ ID NO: 6210 - DNA, 48 bp, Artificial Sequence
  Synthetic
accataaatgcattacctgagatggtggtaagcatactaacttcatct

SEQ ID NO: 6211 - DNA, 41 bp, Artificial Sequence
  Synthetic
caaaccgtggattctgctcaatgtttctgcagtctgtgaat

SEQ ID NO: 6212 - DNA, 38 bp, Artificial Sequence
  Synthetic
atcacccagctcatgctcctaaatcgccagttgcctta

SEQ ID NO: 6213 - DNA, 39 bp, Artificial Sequence
  Synthetic
gaagccactggtttgtttgcttcaccaggaggagctttc

SEQ ID NO: 6214 - DNA, 48 bp, Artificial Sequence
  Synthetic
taaacgtgccacagtttacaattcttacaagtaatcacatgtaacact

SEQ ID NO: 6215 - DNA, 48 bp, Artificial Sequence
  Synthetic
tttgaggcacataaggactcttttacttatccacattacagttccaaa

SEQ ID NO: 6216 - DNA, 42 bp, Artificial Sequence
  Synthetic
gcatggatgctaagcaggttgacctaaattgcatcttgtgat

SEQ ID NO: 6217 - DNA, 42 bp, Artificial Sequence
  Synthetic
acaacataccctactaatgtggccttaagctctgggtggtgt

SEQ ID NO: 6218 - DNA, 44 bp, Artificial Sequence
  Synthetic
agagtctttcgatgataagaggtcccaaccttgtccaccactac

SEQ ID NO: 6219 - DNA, 46 bp, Artificial Sequence
  Synthetic
tgcatttgttaataggcttgtaccgaaacaaactcctgaacaacca

SEQ ID NO: 6220 - DNA, 45 bp, Artificial Sequence
  Synthetic
ttctccaatggaaagagttagtctcttcatcatacagcctgtagg

SEQ ID NO: 6221 - DNA, 47 bp, Artificial Sequence
  Synthetic
aatggggtattttgcattttggacgccaattaaaaatccttcactag

SEQ ID NO: 6222 - DNA, 41 bp, Artificial Sequence
  Synthetic
ctggacatacagcctgaagactccatcaccccaatgcatat

SEQ ID NO: 6223 - DNA, 47 bp, Artificial Sequence
  Synthetic
ccggctagacttgaaatagttaagcccagtgactaactatggtttca

SEQ ID NO: 6224 - DNA, 43 bp, Artificial Sequence
  Synthetic
tcatgcctttaaatgcaaccgtaacaagcctttattctgcatc

SEQ ID NO: 6225 - DNA, 42 bp, Artificial Sequence
  Synthetic
gtaaggattttacgcctgtacagggttatcagactgcctggc

SEQ ID NO: 6226 - DNA, 45 bp, Artificial Sequence
  Synthetic
acaaggtcttttagaggtctctgtggttaggatgacaaatcgttt

SEQ ID NO: 6227 - DNA, 47 bp, Artificial Sequence
  Synthetic
attgggttacacctctcacttctagactcatacaatcaacagcatta

SEQ ID NO: 6228 - DNA, 48 bp, Artificial Sequence
  Synthetic
tgagcagcctgatgtcttttattcaccatatatcttagcagcatcaat

SEQ ID NO: 6229 - DNA, 47 bp, Artificial Sequence
  Synthetic
cctgcaggtgttcttactaatcatacagaaatttttaggagctttga

SEQ ID NO: 6230 - DNA, 43 bp, Artificial Sequence
  Synthetic
aagtgattattgtggaggcaattcttctgcagaccaacccaaa

SEQ ID NO: 6231 - DNA, 40 bp, Artificial Sequence
  Synthetic
ccgaaccagcattgctatttcgcagctgtcgtgtaagact

SEQ ID NO: 6232 - DNA, 48 bp, Artificial Sequence
  Synthetic
tgtggtgattatgcagcatgtaagcattaatgttatcacagaaactac

SEQ ID NO: 6233 - DNA, 38 bp, Artificial Sequence
  Synthetic
gcatcaaagtgttgcctccaggcagccaaagtgtatcc

SEQ ID NO: 6234 - DNA, 44 bp, Artificial Sequence
  Synthetic
tgcttatgtttctcaacagcttagtccttctccatagcttgtgc

SEQ ID NO: 6235 - DNA, 43 bp, Artificial Sequence
  Synthetic
gtagtggttactactaccctgaaccacagcgcaggtactcata

SEQ ID NO: 6236 - DNA, 50 bp, Artificial Sequence
  Synthetic
gtaaaatggccttggtatgtatggcaatagtaaaacaagcatagctacac

SEQ ID NO: 6237 - DNA, 46 bp, Artificial Sequence
  Synthetic
agagttcctagtcatgcttggtggatttaccataaagagtgaatgt

SEQ ID NO: 6238 - DNA, 49 bp, Artificial Sequence
  Synthetic
ttgaggactatcatactctgacgggtacctagttttataccttgaatgt

SEQ ID NO: 6239 - DNA, 40 bp, Artificial Sequence
  Synthetic
aatccagtagtagagcgtcctcaaactggtcggactgatc

SEQ ID NO: 6240 - DNA, 42 bp, Artificial Sequence
  Synthetic
ccaggctgatgtcaataccccgcggaatagcctcatcgctac

SEQ ID NO: 6241 - DNA, 45 bp, Artificial Sequence
  Synthetic
ttgctagtcttgttctggcaaaacatgcttagttacttgctgagg

SEQ ID NO: 6242 - DNA, 47 bp, Artificial Sequence
  Synthetic
tgacagtacactttcaggttttgagtgataggcattcaaattctcat

SEQ ID NO: 6243 - DNA, 47 bp, Artificial Sequence
  Synthetic
gcagaaaagtcgagataaggcacctatagtctgctataaccttctct

SEQ ID NO: 6244 - DNA, 42 bp, Artificial Sequence
  Synthetic
ggaaggacctctttgcatcagattcgctttcaacatgatgtt

SEQ ID NO: 6245 - DNA, 46 bp, Artificial Sequence
  Synthetic
ctacagagattcgcttggagaagcttctgttttggagtaagtggag

SEQ ID NO: 6246 - DNA, 41 bp, Artificial Sequence
  Synthetic
ggcttcgccgagatcagaagtgtggcagttctgatgtccag

SEQ ID NO: 6247 - DNA, 42 bp, Artificial Sequence
  Synthetic
gaaagtgacagggcccctttttcaatatgatggttttaccca

SEQ ID NO: 6248 - DNA, 42 bp, Artificial Sequence
  Synthetic
aacacagttcgagtctctgaaactcccattctcatcactgct

SEQ ID NO: 6249 - DNA, 40 bp, Artificial Sequence
  Synthetic
ccctcccgggagagccatagtggtcaccccagcgattccg

SEQ ID NO: 6250 - DNA, 40 bp, Artificial Sequence
  Synthetic
tggagtatacgtgttgccgcgcagaagttttacgcgtcgc

SEQ ID NO: 6251 - DNA, 35 bp, Artificial Sequence
  Synthetic
gctcgtcggcgctcctgtatcaagggccctcacgc

SEQ ID NO: 6252 - DNA, 42 bp, Artificial Sequence
  Synthetic
acacctacagtggcagtcaggtcgcgcctactaataggtcca

SEQ ID NO: 6253 - DNA, 39 bp, Artificial Sequence
  Synthetic
gcatgtcctgcgtttaccccagccaagatgccccaatgg

SEQ ID NO: 6254 - DNA, 38 bp, Artificial Sequence
  Synthetic
tactgctggcactacgcaccggccgcagacacttgatg

SEQ ID NO: 6255 - DNA, 40 bp, Artificial Sequence
  Synthetic
ctcccagtggtcggtggtttgcgcacgtcttgagaaaccc

SEQ ID NO: 6256 - DNA, 41 bp, Artificial Sequence
  Synthetic
tgaccgcagtgagcaacatccagcaaggcagtatagcaagc

SEQ ID NO: 6257 - DNA, 38 bp, Artificial Sequence
  Synthetic
cgctgctgctgggacacatgttaccccgcacgtaccac

SEQ ID NO: 6258 - DNA, 39 bp, Artificial Sequence
  Synthetic
aggtcatcacctggggtgcgctaatcgtgcagagacggg

SEQ ID NO: 6259 - DNA, 41 bp, Artificial Sequence
  Synthetic
atggagcaggttcgagaacgctcccaacgaggtcctgatct

SEQ ID NO: 6260 - DNA, 42 bp, Artificial Sequence
  Synthetic
tgttgcggggatctttagggcttgctaagggtttccactggt

SEQ ID NO: 6261 - DNA, 41 bp, Artificial Sequence
  Synthetic
gggaaccgcaccgttacaactccgcgagaaacttaccgtag

SEQ ID NO: 6262 - DNA, 40 bp, Artificial Sequence
  Synthetic
acgtaccgatatgtcgcctccgacagaggacgaccgagtc

SEQ ID NO: 6263 - DNA, 40 bp, Artificial Sequence
  Synthetic
gcaggctcctcccccaagttggtccatgtagtgttggctt

SEQ ID NO: 6264 - DNA, 42 bp, Artificial Sequence
  Synthetic
atggaggagtgctcacaagctgccttgaactggtgggctatt

SEQ ID NO: 6265 - DNA, 38 bp, Artificial Sequence
  Synthetic
tactcggggggtgggttgccaagccgcttaccacgaac

SEQ ID NO: 6266 - DNA, 36 bp, Artificial Sequence
  Synthetic
cgtaggacctggggagggagtggttgccccgggatg

SEQ ID NO: 6267 - DNA, 40 bp, Artificial Sequence
  Synthetic
aaagggatacaagggcgtgtggcagttattgctgccccgc

SEQ ID NO: 6268 - DNA, 38 bp, Artificial Sequence
  Synthetic
tgccggctgctgagttctttaggggcttacatggaggg

SEQ ID NO: 6269 - DNA, 41 bp, Artificial Sequence
  Synthetic
cagacgctgagctagtggacgtgtaatgttgctgcccatct

SEQ ID NO: 6270 - DNA, 41 bp, Artificial Sequence
  Synthetic
tcagctggacggctctaatgtgtcctgtggtttcgaggacg

SEQ ID NO: 6271 - DNA, 42 bp, Artificial Sequence
  Synthetic
aagagaaactgcccatcagccccgcttctagacgacgttgaa

SEQ ID NO: 6272 - DNA, 38 bp, Artificial Sequence
  Synthetic
ttccaaccaccatcatggcgaatgcggccccctttagc

SEQ ID NO: 6273 - DNA, 39 bp, Artificial Sequence
  Synthetic
ctccctcacggagcggctttacgataaccacactgggcc

SEQ ID NO: 6274 - DNA, 39 bp, Artificial Sequence
  Synthetic
tagagcagccctgagagcctttggcctgtggagcatctc

SEQ ID NO: 6275 - DNA, 45 bp, Artificial Sequence
  Synthetic
tcaagaagtacacatcaggaagacattcattgccatcatccattt

SEQ ID NO: 6276 - DNA, 44 bp, Artificial Sequence
  Synthetic
agtcgaaaggctaaagcatggaaacgtattttgacttggtttct

SEQ ID NO: 6277 - DNA, 45 bp, Artificial Sequence
  Synthetic
agagaagaaagaagaactccaggatctctccaacatgtatgcaac

SEQ ID NO: 6278 - DNA, 45 bp, Artificial Sequence
  Synthetic
tagcatctttattggagatgtgccactgcttaaggatgtctacca

SEQ ID NO: 6279 - DNA, 42 bp, Artificial Sequence
  Synthetic
tgaagagttcacaatggttgggatcaatctcctggttgcttt

SEQ ID NO: 6280 - DNA, 44 bp, Artificial Sequence
  Synthetic
aaagtgctttttcaaaattggggagcaatatcccaatcattccc

SEQ ID NO: 6281 - DNA, 42 bp, Artificial Sequence
  Synthetic
acacagggaacagagaaactgattgaccaacactgattcagg

SEQ ID NO: 6282 - DNA, 42 bp, Artificial Sequence
  Synthetic
gatgtgcttgggacatttgataccactttgctttggtggagc

SEQ ID NO: 6283 - DNA, 42 bp, Artificial Sequence
  Synthetic
agacaggagatatgggccagcagccttctctcctttcgcaag

SEQ ID NO: 6284 - DNA, 40 bp, Artificial Sequence
  Synthetic
ctgccgacgccttaccgattgcttccgttggcataactga

SEQ ID NO: 6285 - DNA, 40 bp, Artificial Sequence
  Synthetic
gcccccttgtgtcatcggaggaaacaatcagtggggcaga

SEQ ID NO: 6286 - DNA, 39 bp, Artificial Sequence
  Synthetic
gcccattgctgctgtccaccggcagggtcgtgaaagaac

SEQ ID NO: 6287 - DNA, 40 bp, Artificial Sequence
  Synthetic
atctgaagggtaggtgggtgccggaggagaggccacatcc

SEQ ID NO: 6288 - DNA, 39 bp, Artificial Sequence; identical to SEQ ID NO: 4473
  Synthetic

SEQ ID NO: 6289 - DNA, 37 bp, Artificial Sequence
  Synthetic
ccgcgtgcggtgacatcagtatctcctggcccctacg

SEQ ID NO: 6290 - DNA, 37 bp, Artificial Sequence
  Synthetic
agaccttgtgggctggccctaaaggtccgaggagccg

SEQ ID NO: 6291 - DNA, 38 bp, Artificial Sequence
  Synthetic
tcacggacaactcctctccaccgagcatgcaggtgggc

SEQ ID NO: 6292 - DNA, 40 bp, Artificial Sequence
  Synthetic
tttgtgacgagtgccactccacggtcaaggacagtgccga

SEQ ID NO: 6293 - DNA, 38 bp, Artificial Sequence
  Synthetic
accgcggtcttgacgtgtctgagcatcggtcgacacga

SEQ ID NO: 6294 - DNA, 40 bp, Artificial Sequence
  Synthetic
gagtgctatgacgcgggctgagcctaactgtagtctcggc

SEQ ID NO: 6295 - DNA, 38 bp, Artificial Sequence
  Synthetic
acctggaggtcgtcacgagcttgacaggcaatacgcgg

SEQ ID NO: 6296 - DNA, 42 bp, Artificial Sequence
  Synthetic
accaactggcagaaactcgaggcccgccaagtattgtatccc

SEQ ID NO: 6297 - DNA, 38 bp, Artificial Sequence
  Synthetic
agatcatgagcggtgaggtcccagaggatggcgggcag

SEQ ID NO: 6298 - DNA, 42 bp, Artificial Sequence
  Synthetic
ctcagcagcctcactgtaacccacactccgagcttatccact

SEQ ID NO: 6299 - DNA, 39 bp, Artificial Sequence
  Synthetic
gggacgttccccattaacgcctagttcggcgcaggaagg

SEQ ID NO: 6300 - DNA, 39 bp, Artificial Sequence
  Synthetic
cgagcccgaaccggacgtacgcctctgctgttatatggg

SEQ ID NO: 6301 - DNA, 39 bp, Artificial Sequence
  Synthetic
ccggactacaaccccccgctccacaggtggttcgtagtc

SEQ ID NO: 6302 - DNA, 36 bp, Artificial Sequence
  Synthetic
tcttccatgccccccctggccatgacccgtcgctga

SEQ ID NO: 6303 - DNA, 39 bp, Artificial Sequence
  Synthetic
ctgacgcccccacattcagccatggcaacggacgtcttt

SEQ ID NO: 6304 - DNA, 39 bp, Artificial Sequence
  Synthetic
acgacgtggttagcaagctcccccgctgtcctggtgagt

SEQ ID NO: 6305 - DNA, 40 bp, Artificial Sequence
  Synthetic
tcacttgctacatcaaggcccggcatggtgcagtcctgga

SEQ ID NO: 6306 - DNA, 42 bp, Artificial Sequence
  Synthetic
ccagtcaattcctggctaggcatatcatcctcgcccacagtg

SEQ ID NO: 6307 - DNA, 40 bp, Artificial Sequence
  Synthetic
gtccgcgctaggcttctgtctgcccagttgaagaggtact

SEQ ID NO: 6308 - DNA, 48 bp, Artificial Sequence
  Synthetic
acccagaaacatattgcttttgtgttgttttgtgcaaaatatacagca

SEQ ID NO: 6309 - DNA, 40 bp, Artificial Sequence
  Synthetic
tgtgtcacaaaccgctggtatgatattttgtgcagtcgtc

SEQ ID NO: 6310 - DNA, 39 bp, Artificial Sequence
  Synthetic
gcacaacaagcgtatagggtgtgcactctaccaccagtc

SEQ ID NO: 6311 - DNA, 41 bp, Artificial Sequence
  Synthetic
gacagtcagcaaaggccaaacgacctgtgtttggccatagc

SEQ ID NO: 6312 - DNA, 41 bp, Artificial Sequence
  Synthetic
gggaatgacagtgcttatgctgtttagccactgtttccctg

SEQ ID NO: 6313 - DNA, 39 bp, Artificial Sequence
  Synthetic
tggggggggctgttatatcccagataatggctgcaacca

SEQ ID NO: 6314 - DNA, 41 bp, Artificial Sequence
  Synthetic
tatgggcacgtttaagccttacctaaacggttcgctagggt

SEQ ID NO: 6315 - DNA, 41 bp, Artificial Sequence
  Synthetic
atgtgaatttcaaggatgacgctcccacatgtacctcccat

SEQ ID NO: 6316 - DNA, 38 bp, Artificial Sequence
  Synthetic
ttccacccagaaggccgcgaaccgggtcctgtcactgt

SEQ ID NO: 6317 - DNA, 44 bp, Artificial Sequence
  Synthetic
gctgacgtgctatctggcattgtaaatataatgctataaggccc

SEQ ID NO: 6318 - DNA, 40 bp, Artificial Sequence
  Synthetic
tggcagatcgcattttgcagtggttccaatgcctaggccc

SEQ ID NO: 6319 - DNA, 43 bp, Artificial Sequence
  Synthetic
ccccagctgtgttggacatcgcaggatttgtaaagtttgtact

SEQ ID NO: 6320 - DNA, 40 bp, Artificial Sequence
  Synthetic
tacttgctccagctgcctcttcaccatcatcaacatcagc

SEQ ID NO: 6321 - DNA, 38 bp, Artificial Sequence
  Synthetic
cgactatgtgacacgcaccatggcctacagtaagcaac

SEQ ID NO: 6322 - DNA, 43 bp, Artificial Sequence
  Synthetic
atccagattatttgggaatggccctgcgcaagtaaaagaacat

SEQ ID NO: 6323 - DNA, 46 bp, Artificial Sequence
  Synthetic
attggaggattggaactttgggtaaatctatatgtgtcctccaagc

SEQ ID NO: 6324 - DNA, 42 bp, Artificial Sequence
  Synthetic
gtaaggttgttctaggtcaggagaaattggtggtgtgcacac

SEQ ID NO: 6325 - DNA, 44 bp, Artificial Sequence
  Synthetic
tgtgcgacacaagctgcaataacagcaaagataattcttgttgt

SEQ ID NO: 6326 - DNA, 46 bp, Artificial Sequence
  Synthetic
gaatcggagcagggaaattccgcaatagtattattacagtcctctg

SEQ ID NO: 6327 - DNA, 49 bp, Artificial Sequence
  Synthetic
tatcaggattcacatgaacagtggcaaagtacattccatcataatccac

SEQ ID NO: 6328 - DNA, 39 bp, Artificial Sequence
  Synthetic
accgcaaatcgcagctggagtgagacagtgcctctctcc

SEQ ID NO: 6329 - DNA, 41 bp, Artificial Sequence
  Synthetic
agacttcaagaggaggctcgggtaagctgtttcccggacct

SEQ ID NO: 6330 - DNA, 46 bp, Artificial Sequence
  Synthetic
ctccatctattacacgccctttgagtgggatattaaaaggtcttgt

SEQ ID NO: 6331 - DNA, 46 bp, Artificial Sequence
  Synthetic
acatcattaggtggtggggagtcatatgcaggatttaaaactgtag

SEQ ID NO: 6332 - DNA, 44 bp, Artificial Sequence
  Synthetic
catcagtttgcagtttcagcagtgaaagtctatatctggtgcag

SEQ ID NO: 6333 - DNA, 46 bp, Artificial Sequence
  Synthetic
atcacctacttacccttacacaccgggtgcaagaaaaaatcataat

SEQ ID NO: 6334 - DNA, 45 bp, Artificial Sequence
  Synthetic
ttatgctggatctgaaaggcttctttccaggatcaattacatcaa

SEQ ID NO: 6335 - DNA, 46 bp, Artificial Sequence
  Synthetic
acagaaaatcctaacacgtatcctgagacacgtccattctattgtc

SEQ ID NO: 6336 - DNA, 46 bp, Artificial Sequence
  Synthetic
gtgatgtaggatttggagctgctaggtactcctgatttatcttcct

SEQ ID NO: 6337 - DNA, 47 bp, Artificial Sequence
  Synthetic
acaaacctcaaaacaatttaggaccttgagtataaagagccactagg

SEQ ID NO: 6338 - DNA, 43 bp, Artificial Sequence
  Synthetic
gaggcaaacttagaaaccgtttctgtttgaacttgcacttacc

SEQ ID NO: 6339 - DNA, 39 bp, Artificial Sequence
  Synthetic
aagaatgaagtgggccatgtgttgccatatcacccttgg

SEQ ID NO: 6340 - DNA, 44 bp, Artificial Sequence
  Synthetic
tcagaaagatgagacttgacaatgcttactctctcaacagggcc

SEQ ID NO: 6341 - DNA, 41 bp, Artificial Sequence
  Synthetic
aactcccattgtactggcatacatactggcaggaaccttct

SEQ ID NO: 6342 - DNA, 43 bp, Artificial Sequence
  Synthetic
agctgtagagattgcaaataagactacatcacctccatccagg

SEQ ID NO: 6343 - DNA, 44 bp, Artificial Sequence
  Synthetic
ttcagccaaaaaggaggacatggtgtcttgagaaaataccatgc

SEQ ID NO: 6344 - DNA, 48 bp, Artificial Sequence
  Synthetic
tgaggaatcacctaaagcaagtgagaatgtatagtcagatgcattcat

SEQ ID NO: 6345 - DNA, 45 bp, Artificial Sequence
  Synthetic
ccaagatgtgggaaatgggaacactaaatttttaagcacccattg

SEQ ID NO: 6346 - DNA, 48 bp, Artificial Sequence
  Synthetic
aattgttgcctttctgtttttcgccaaaaattgataaggctctccatt

SEQ ID NO: 6347 - DNA, 43 bp, Artificial Sequence
  Synthetic
tgaggaacttgaaagactaaaaccgacgggctttccttggtaa

SEQ ID NO: 6348 - DNA, 43 bp, Artificial Sequence
  Synthetic
actttccacacttttcatctctctgcattgcgacctatgggag

SEQ ID NO: 6349 - DNA, 45 bp, Artificial Sequence
  Synthetic
tcttggacaagaatggcatgtgaacatgtagatcttcatgaacaa

SEQ ID NO: 6350 - DNA, 48 bp, Artificial Sequence
  Synthetic
ctagcgaagttaaagcccaatcatcatcatggttaacagtatcagtac

SEQ ID NO: 6351 - DNA, 43 bp, Artificial Sequence
  Synthetic
attgacttgtttgttaagcgtcgaaaaccatctccacaaactg

SEQ ID NO: 6352 - DNA, 46 bp, Artificial Sequence
  Synthetic
tttgtcttttagatcaggcttggccaacaggtttctcgttaaaatt

SEQ ID NO: 6353 - DNA, 42 bp, Artificial Sequence
  Synthetic
ttaatcctgctaatgggcatatgctttacctgcagctacagc

SEQ ID NO: 6354 - DNA, 42 bp, Artificial Sequence
  Synthetic
cagtggcaggaagcatggtagctaaaacaagagcaactaacc

SEQ ID NO: 6355 - DNA, 44 bp, Artificial Sequence
  Synthetic
ctcctctgagtaaggatttacctgagcctacacctacacccata

SEQ ID NO: 6356 - DNA, 48 bp, Artificial Sequence
  Synthetic
tgttgagtacaaagtaacagtctggacatataaatcatcagatgccaa

SEQ ID NO: 6357 - DNA, 50 bp, Artificial Sequence
  Synthetic
acgaaattgtagtgttcgtgttaagccaccattagcagtaatatcataat

SEQ ID NO: 6358 - DNA, 46 bp, Artificial Sequence
  Synthetic
cagtagctgctggtttggaatcactctttaaatatgtaggtaccaa

SEQ ID NO: 6359 - DNA, 49 bp, Artificial Sequence
  Synthetic
atacatctttggttccacatacacgccttcactaataacatcaggaaat

SEQ ID NO: 6360 - DNA, 43 bp, Artificial Sequence
  Synthetic
tggtaatgttaaacctggtgaaactgaaatgccccttgtggtc

SEQ ID NO: 6361 - DNA, 43 bp, Artificial Sequence
  Synthetic
attgtgcttggtttgtacaaaatgatttgccatagcccaaaca

SEQ ID NO: 6362 - DNA, 44 bp, Artificial Sequence
  Synthetic
agaggctcggattaatgataagaagacgaaccatgctaaaaagc

SEQ ID NO: 6363 - DNA, 48 bp, Artificial Sequence
  Synthetic
ctcagtttgtatttattgccgtgcccacgtaatttacatataccatct

SEQ ID NO: 6364 - DNA, 50 bp, Artificial Sequence
  Synthetic
tttggtgattttatacaaacagcccgtcaacataggcatcatataagaat

SEQ ID NO: 6365 - DNA, 44 bp, Artificial Sequence
  Synthetic
cagatcctgctatgcacgttgcactaaaacaacaagttcgtaaa

SEQ ID NO: 6366 - DNA, 47 bp, Artificial Sequence
  Synthetic
tgctatcagtgctaagaatagagctggcctgtcatagtactaagaat

SEQ ID NO: 6367 - DNA, 46 bp, Artificial Sequence
  Synthetic
acatgaattttgttgttcacatggttcaaaacttgagcacattcat

SEQ ID NO: 6368 - DNA, 46 bp, Artificial Sequence
  Synthetic
aagtctagctatagatgcttaccctacacgaaagactttttggtat

SEQ ID NO: 6369 - DNA, 44 bp, Artificial Sequence
  Synthetic
tgaacgtttaaagttatttgctgcatggtagcagaagcatagct

SEQ ID NO: 6370 - DNA, 43 bp, Artificial Sequence
  Synthetic
atgttgctaattatcagcacattggagactttcccgtaccagg

SEQ ID NO: 6371 - DNA, 49 bp, Artificial Sequence
  Synthetic
ctttccactgcaaataggtttttcaaagtataacaatctctctcagcaa

SEQ ID NO: 6372 - DNA, 45 bp, Artificial Sequence
  Synthetic
tgatgcttttcctgtagccaagatctttatgcacatcatagacat

SEQ ID NO: 6373 - DNA, 48 bp, Artificial Sequence
  Synthetic
atcacacggtgtaatctaggtggggtagttacaatattcttcagcatg

SEQ ID NO: 6374 - DNA, 41 bp, Artificial Sequence
  Synthetic
ctcaaagttgagttttggttcgcctgtctgttcggctgaag

SEQ ID NO: 6375 - DNA, 43 bp, Artificial Sequence
  Synthetic
ttttacatttaggtgcagggtctgccagatggtaaccactgtc

SEQ ID NO: 6376 - DNA, 46 bp, Artificial Sequence
  Synthetic
atcgttcttgtgagagtactactgtcaggtaaacaagaacacctac

SEQ ID NO: 6377 - DNA, 47 bp, Artificial Sequence
  Synthetic
tcgtaaacgtagaagtatttctgctaaactgacattaaagggttcaa

SEQ ID NO: 6378 - DNA, 45 bp, Artificial Sequence
  Synthetic
aaatgcttatgtctctcaacagctccttctccatagctaaagcag

SEQ ID NO: 6379 - DNA, 44 bp, Artificial Sequence
  Synthetic
tacagggtgtcaaacttggcatacagtaacatatacgggcaaat

SEQ ID NO: 6380 - DNA, 44 bp, Artificial Sequence
  Synthetic
atctgagcgaaattaccaaacctagacacagtgaatttaggttg

SEQ ID NO: 6381 - DNA, 47 bp, Artificial Sequence
  Synthetic
tcaacagtgttttggtaaaagaggaccaagctttaacatttcagcat

SEQ ID NO: 6382 - DNA, 46 bp, Artificial Sequence
  Synthetic
ctggtactcagcacatttcaaatgggatcatcaagagtagcaagta

SEQ ID NO: 6383 - DNA, 39 bp, Artificial Sequence
  Synthetic
tgcagcaatatgcacccacttcgccttgttcattgatga

SEQ ID NO: 6384 - DNA, 42 bp, Artificial Sequence
  Synthetic
cgaaagaggcgaagaaacaattgatttcggtgggagactttg

SEQ ID NO: 6385 - DNA, 45 bp, Artificial Sequence
  Synthetic
cctaatggacctccttgttatcagttcaatgctcaatttcaaagc

SEQ ID NO: 6386 - DNA, 45 bp, Artificial Sequence
  Synthetic
aaaacgagtcaactaaagtgggctgtcaaagtctactttctctgg

SEQ ID NO: 6387 - DNA, 49 bp, Artificial Sequence
  Synthetic
gaattatttcacagcagaggtgtcccagtattaatgtatacccccttca

SEQ ID NO: 6388 - DNA, 45 bp, Artificial Sequence
  Synthetic
aaatgggagaaatactgtgtccttgccttgaaatttggcctatgg

SEQ ID NO: 6389 - DNA, 42 bp, Artificial Sequence
  Synthetic
ccccaagggagtggaagaagtgacttagccaatagagtccta

SEQ ID NO: 6390 - DNA, 45 bp, Artificial Sequence
  Synthetic
aattgggaggttttacgtacagatgatcaaccttccttcttggtc

SEQ ID NO: 6391 - DNA, 40 bp, Artificial Sequence
  Synthetic
ggcgataatggacgaagaacattccctttgaggatgttgc

SEQ ID NO: 6392 - DNA, 39 bp, Artificial Sequence
  Synthetic
tcctgagaggatccgtagccctatccactggccacagcg

SEQ ID NO: 6393 - DNA, 44 bp, Artificial Sequence
  Synthetic
aagaggacaactatccactagaggagaatccattgcttccacgt

SEQ ID NO: 6394 - DNA, 47 bp, Artificial Sequence
  Synthetic
aagctttcagcatctattactgacactgtatatttctcctagcacac

SEQ ID NO: 6395 - DNA, 42 bp, Artificial Sequence
  Synthetic
aagagacggagagagaccgaggttcaatgttggacgaggagg

SEQ ID NO: 6396 - DNA, 45 bp, Artificial Sequence
  Synthetic
aaatgttggaggtggagatgtaaaaaaactgtagtgcatgctaaa

SEQ ID NO: 6397 - DNA, 43 bp, Artificial Sequence
  Synthetic
cggaggacttatatagggcttgttgcaagtgtagtttgttcaa

SEQ ID NO: 6398 - DNA, 43 bp, Artificial Sequence
  Synthetic
acacctgttaaaccaaatacagctgttgcagatgactcaggag

SEQ ID NO: 6399 - DNA, 39 bp, Artificial Sequence
  Synthetic
tgcagcctatacctgaaaggcctgggctgttgcatcaat

SEQ ID NO: 6400 - DNA, 45 bp, Artificial Sequence
  Synthetic
cactttagttagagccagggaactggatcacttataggtacctgt

SEQ ID NO: 6401 - DNA, 40 bp, Artificial Sequence
  Synthetic
ggtggttcgagtgagcagatgtgcactgtttgacctatag

SEQ ID NO: 6402 - DNA, 50 bp, Artificial Sequence
  Synthetic
tacaggtgaatattgggatgtagcagtttactaattgtattgcaggacaa

SEQ ID NO: 6403 - DNA, 39 bp, Artificial Sequence
  Synthetic
ctttcatggaagacgggagcaatcacccatagtccctgc

SEQ ID NO: 6404 - DNA, 38 bp, Artificial Sequence
  Synthetic
gtacctccccctcagactgcggtaaatgacagcgggtt

SEQ ID NO: 6405 - DNA, 44 bp, Artificial Sequence
  Synthetic
tcgcactgtttatgcagagcatgcagtattgtaaacaacattct

SEQ ID NO: 6406 - DNA, 43 bp, Artificial Sequence
  Synthetic
ttttggtaagtgacaaatgcccggctttaaagtgcacggtaac

SEQ ID NO: 6407 - DNA, 42 bp, Artificial Sequence
  Synthetic
attcggatttccatttcatcgacgatagtgcattcgggtcac

SEQ ID NO: 6408 - DNA, 46 bp, Artificial Sequence
  Synthetic
tcattgaaattggagtaacacggatattttgttggctttctctagg

SEQ ID NO: 6409 - DNA, 41 bp, Artificial Sequence
  Synthetic
aagaggcgaagagacaattgaaggttcggtgggagactttg

SEQ ID NO: 6410 - DNA, 43 bp, Artificial Sequence
  Synthetic
agactttgatgactgcaaagatgtttagagatctgggctctgg

SEQ ID NO: 6411 - DNA, 43 bp, Artificial Sequence
  Synthetic
gggctactgaatacataatgaagggaaagtcatccatggctgc

SEQ ID NO: 6412 - DNA, 43 bp, Artificial Sequence
  Synthetic
tgtgttcttgaaataggagacatgcataggaacatgggcctcg

SEQ ID NO: 6413 - DNA, 41 bp, Artificial Sequence
  Synthetic
gggagtggaggaaggctctaagacgcatatagactgttgaa

SEQ ID NO: 6414 - DNA, 39 bp, Artificial Sequence
  Synthetic
gtgatgccccctttgatgacacaagtgtgctgcctcttc

SEQ ID NO: 6415 - DNA, 48 bp, Artificial Sequence
  Synthetic
cagaaaataactggaggccttatggactgagaaatttgctttaaggat

SEQ ID NO: 6416 - DNA, 40 bp, Artificial Sequence
  Synthetic
acagagattcgcttggggaactgttttggagggagtgaag

SEQ ID NO: 6417 - DNA, 43 bp, Artificial Sequence
  Synthetic
agggacaacatgaccaagaaaatagctcttttttgtcagcttt

SEQ ID NO: 6418 - DNA, 45 bp, Artificial Sequence
  Synthetic
ccgttggagggaatgagaagagttagtcatcatctttctcacaac

SEQ ID NO: 6419 - DNA, 43 bp, Artificial Sequence
  Synthetic
tccaatcctctgatgatttcgctcctgcttgtattccctcatg

SEQ ID NO: 6420 - DNA, 43 bp, Artificial Sequence
  Synthetic
aacaacgaccttggaccagctgtagtctttaatgaacagctga

SEQ ID NO: 6421 - DNA, 41 bp, Artificial Sequence
  Synthetic
tcttccctagcagttcatatcggatcaattcgggccctaga

SEQ ID NO: 6422 - DNA, 38 bp, Artificial Sequence
  Synthetic
ccagctacccgaccctacaacttgcagtgatgtgtcca

SEQ ID NO: 6423 - DNA, 47 bp, Artificial Sequence
  Synthetic
tggaaccatataatgaagtgcaagacctctgagttgtttaattcctc

SEQ ID NO: 6424 - DNA, 44 bp, Artificial Sequence
  Synthetic
acatgccttaaaacgaaagtatggacttgctgtatcacgacatg

SEQ ID NO: 6425 - DNA, 48 bp, Artificial Sequence
  Synthetic
tgacagtgtatttgacctgtcagatcatatgctatgtcactttcatct

SEQ ID NO: 6426 - DNA, 41 bp, Artificial Sequence
  Synthetic
gacgtggtccagattagatttgcaacgttgggatagggcat

SEQ ID NO: 6427 - DNA, 45 bp, Artificial Sequence
  Synthetic
aaaagcaaagcacatgaagcaatactctgatttagcaagactctc

SEQ ID NO: 6428 - DNA, 40 bp, Artificial Sequence
  Synthetic
agagaattacaacaccccaccagaacccccactcttttgg

SEQ ID NO: 6429 - DNA, 43 bp, Artificial Sequence
  Synthetic
ggccttcagatccatctattgttacaacaggagctccagatgt

SEQ ID NO: 6430 - DNA, 41 bp, Artificial Sequence
  Synthetic
cacatggatacgaggaaattccaaataggttcggtgcctct

SEQ ID NO: 6431 - DNA, 46 bp, Artificial Sequence
  Synthetic
tgccttaacatccagacgtgggacatagttagttttttacccaatc

SEQ ID NO: 6432 - DNA, 43 bp, Artificial Sequence
  Synthetic
tcctgaaacacaacgtttagtatggtaacacctaaaggctgcc

SEQ ID NO: 6433 - DNA, 41 bp, Artificial Sequence
  Synthetic
attggttgtgttcctgctattggcagtcacctgtttgcaca

SEQ ID NO: 6434 - DNA, 43 bp, Artificial Sequence
  Synthetic
tttacgacgcgaacagttatttgcctgcatctcctatagtgcc

SEQ ID NO: 6435 - DNA, 40 bp, Artificial Sequence
  Synthetic
gaaccctatgtttcatgcgacctgttgttccttggctgag

SEQ ID NO: 6436 - DNA, 42 bp, Artificial Sequence
  Synthetic
tctgcagtagtatggtacaacagaagtatgtttcgggcccat

SEQ ID NO: 6437 - DNA, 48 bp, Artificial Sequence
  Synthetic
ggctcaaatagaccagtgattcagcatatatattgactagtgtgtgtc

SEQ ID NO: 6438 - DNA, 44 bp, Artificial Sequence
  Synthetic
ctcgaggtctggatacgagatgggctttgatctatcatctgtca

SEQ ID NO: 6439 - DNA, 42 bp, Artificial Sequence
  Synthetic
aaaagtacacatcaggaaggcaaattgccatcatccacttca

SEQ ID NO: 6440 - DNA, 49 bp, Artificial Sequence
  Synthetic
aaaaggtcgaaaggttgaaacatgcctccttattttaacttgatttctg

SEQ ID NO: 6441 - DNA, 42 bp, Artificial Sequence
  Synthetic
atgctagaaagagaattggtccgttaaacactgcctgttccg

SEQ ID NO: 6442 - DNA, 41 bp, Artificial Sequence
  Synthetic
tctctcttggaaatgtgccacagtctaaggatgtccaccat

SEQ ID NO: 6443 - DNA, 45 bp, Artificial Sequence
  Synthetic
gaagagcaacagctattctcagaaactctcccgcttactatcaac

SEQ ID NO: 6444 - DNA, 41 bp, Artificial Sequence
  Synthetic
agatcaatggccctgagtcacaatttcccagttcctgatta

SEQ ID NO: 6445 - DNA, 39 bp, Artificial Sequence
  Synthetic
tgccccaccagaacagagtatcaaccctgatcctctcac

SEQ ID NO: 6446 - DNA, 44 bp, Artificial Sequence
  Synthetic
aagagatatggcccagcattaagcacattagccttctctccttt

SEQ ID NO: 6447 - DNA, 43 bp, Artificial Sequence
  Synthetic
tggaggagtattgcaaacattatggatggcaaaacacgcatct

SEQ ID NO: 6448 - DNA, 46 bp, Artificial Sequence
  Synthetic
ggttagattaagggtttgtgtacgtaagagaagcacttgaagactg

SEQ ID NO: 6449 - DNA, 49 bp, Artificial Sequence
  Synthetic
aaaaggagattgtttttggacagtgctacctgtgtaacagtattttcag

SEQ ID NO: 6450 - DNA, 42 bp, Artificial Sequence
  Synthetic
gggaagtggatctagaacggttcattaatggcggatcccaag

SEQ ID NO: 6451 - DNA, 45 bp, Artificial Sequence
  Synthetic
gtggatcacgttctggtagacccatctactgttacagatggtctt

SEQ ID NO: 6452 - DNA, 43 bp, Artificial Sequence
  Synthetic
actggcggtgtcactcaatcctagaactgcaaaactagtctca

SEQ ID NO: 6453 - DNA, 45 bp, Artificial Sequence
  Synthetic
agcagcaccagacaatgcatttttctgttagtataggtctgtgta

SEQ ID NO: 6454 - DNA, 46 bp, Artificial Sequence
  Synthetic
agaccctataaatgcaacagatgttgctttctgcatattcatcctc

SEQ ID NO: 6455 - DNA, 43 bp, Artificial Sequence
  Synthetic
taggtgatacagagaatccagcaacaattcattcgttggtctg

SEQ ID NO: 6456 - DNA, 45 bp, Artificial Sequence
  Synthetic
gtgtgccattagaattagtggacactatcactggtcatgcgtaag

SEQ ID NO: 6457 - DNA, 39 bp, Artificial Sequence
  Synthetic
ctagtggacagcagtgaccttcaggcgccaaaaacttac

SEQ ID NO: 6458 - DNA, 49 bp, Artificial Sequence
  Synthetic
ctgtgtggaaacctggatattgtgtaagatgtacctttagtgtctttgt

SEQ ID NO: 6459 - DNA, 45 bp, Artificial Sequence
  Synthetic
gtgcctggatattttacacagcagttccttatatcccactccaaa

SEQ ID NO: 6460 - DNA, 46 bp, Artificial Sequence
  Synthetic
agaagtgtaccagtagcattgtttattgttccatgtacaaaacttg

SEQ ID NO: 6461 - DNA, 43 bp, Artificial Sequence
  Synthetic
agatggaaacgaggtgtctgtgaggtaatttaatttgcactgg

SEQ ID NO: 6462 - DNA, 43 bp, Artificial Sequence
  Synthetic
cattggcagcatctgaaagcaccatattgggatttctttaggc

SEQ ID NO: 6463 - DNA, 41 bp, Artificial Sequence
  Synthetic
atgtgcattttaccaaggaagcattccagtcctcacttgcc

SEQ ID NO: 6464 - DNA, 45 bp, Artificial Sequence
  Synthetic
ttttacatgggtggcggatgcctttgtgatgtattagtaaatcct

SEQ ID NO: 6465 - DNA, 40 bp, Artificial Sequence
  Synthetic
caggtgggggtcgggtaacacaggaggcccaataggatct

SEQ ID NO: 6466 - DNA, 43 bp, Artificial Sequence
  Synthetic
acagaccctgttacacaatctgccagatccttctgttacagca

SEQ ID NO: 6467 - DNA, 45 bp, Artificial Sequence
  Synthetic
gtatccaccctgactcatttgaattcaataatacctgtgtcaccg

SEQ ID NO: 6468 - DNA, 46 bp, Artificial Sequence
  Synthetic
ccacagtccggtaaactttatctaccgtattcatcagtaggcagta

SEQ ID NO: 6469 - DNA, 38 bp, Artificial Sequence
  Synthetic
cattgggatgctgcaaagcctaaaggaggacatgcacc

SEQ ID NO: 6470 - DNA, 45 bp, Artificial Sequence
  Synthetic
tgccaccagctataaacattatctgtgagaggaaccttgcataat

SEQ ID NO: 6471 - DNA, 41 bp, Artificial Sequence
  Synthetic
tctacctcctctagaaagcggtcttaaaccccccgtctacg

SEQ ID NO: 6472 - DNA, 43 bp, Artificial Sequence
  Synthetic
cttgatcctatgattgttgttggcatacacctctcccggttag

SEQ ID NO: 6473 - DNA, 50 bp, Artificial Sequence
  Synthetic
gcactatccctatacaatagacaccgcaataatagtaaatctaacacctg

SEQ ID NO: 6474 - DNA, 45 bp, Artificial Sequence
  Synthetic
tagcgaatggtatgttgtgacagtagctcttccattgtatccaaa

SEQ ID NO: 6475 - DNA, 48 bp, Artificial Sequence
  Synthetic
tttcacctcagagacaaagcaaaagtagcttcatcttctcctaatcca

SEQ ID NO: 6476 - DNA, 43 bp, Artificial Sequence
  Synthetic
gtgccgctgcagaagaagtaaaaaatcacaatgttgctgcata

SEQ ID NO: 6477 - DNA, 44 bp, Artificial Sequence
  Synthetic
ccaaattatttctgctcctgttaccgctttggaagtgtagtcgt

SEQ ID NO: 6478 - DNA, 39 bp, Artificial Sequence
  Synthetic
ctccagagagtcgccccgtaactctgtcggtcgacttcg

SEQ ID NO: 6479 - DNA, 47 bp, Artificial Sequence
  Synthetic
agaccctataagttcaggttctgaatctgcagcacttatatctgaaa

SEQ ID NO: 6480 - DNA, 44 bp, Artificial Sequence
  Synthetic
ggggagggatttcaacgtgttatcaatattttgtgttggctgtt

SEQ ID NO: 6481 - DNA, 48 bp, Artificial Sequence
  Synthetic
gaacaatacgagtcagcagattaggctttctgaccaatagttagtcca

SEQ ID NO: 6482 - DNA, 45 bp, Artificial Sequence
  Synthetic
tgaaggagaatctatgatcatgccccttgcagctatttctggaat

SEQ ID NO: 6483 - DNA, 43 bp, Artificial Sequence
  Synthetic
aatgttttacagatggctctttggtgagtacacgagcaacagg

SEQ ID NO: 6484 - DNA, 45 bp, Artificial Sequence
  Synthetic
tgtctttaacccagaaagagagagaccacctctaccaatttcaag

SEQ ID NO: 6485 - DNA, 38 bp, Artificial Sequence
  Synthetic
ccagccactggtgaacactgggatccttttgctggagc

SEQ ID NO: 6486 - DNA, 41 bp, Artificial Sequence
  Synthetic
ctcggatttaacaagcattgctgttgcctgtttcccctttg

SEQ ID NO: 6487 - DNA, 40 bp, Artificial Sequence
  Synthetic
gcagtttggcttcgaggtgcattgatggcctggaactgac

SEQ ID NO: 6488 - DNA, 39 bp, Artificial Sequence
  Synthetic
ccagagacggtgttgcgccggcaaaggaggaccaggttc

SEQ ID NO: 6489 - DNA, 43 bp, Artificial Sequence
  Synthetic
gtagacacccagttatgcagtgtgatagaattccaggaggttt

SEQ ID NO: 6490 - DNA, 36 bp, Artificial Sequence
  Synthetic
agtaggtgcctccagagcccaagtttgggggcgccc

SEQ ID NO: 6491 - DNA, 38 bp, Artificial Sequence; identical to SEQ ID NO: 5838
  Synthetic

SEQ ID NO: 6492 - DNA, 39 bp, Artificial Sequence
  Synthetic
cctggggccaccttcatcaccacttcggtctcccctagg

SEQ ID NO: 6493 - DNA, 36 bp, Artificial Sequence
  Synthetic
gtggctgcctttgggatgcagcaggcaaggcgagca

SEQ ID NO: 6494 - DNA, 39 bp, Artificial Sequence
  Synthetic
agttgatgatctgtaggcgcacatctacgaggccatcaa

SEQ ID NO: 6495 - DNA, 35 bp, Artificial Sequence
  Synthetic
atgcgggatctgccggtcgaaacccgatggccccg

SEQ ID NO: 6496 - DNA, 36 bp, Artificial Sequence
  Synthetic
actcgtgaggcaccccatcctggctcccgcgcatac

SEQ ID NO: 6497 - DNA, 40 bp, Artificial Sequence
  Synthetic
tccccgggagattcgcgacacatgatcagccacgaacgaa

SEQ ID NO: 6498 - DNA, 39 bp, Artificial Sequence
  Synthetic
gtttcagatcccacgcctccaaaaacacggccaagggag

SEQ ID NO: 6499 - DNA, 41 bp, Artificial Sequence
  Synthetic
agctatgcctcccgtcgactgagaagcccagttatccaccc

SEQ ID NO: 6500 - DNA, 40 bp, Artificial Sequence
  Synthetic
cggccaatcccggggtaactagggactggctgtctcctac

SEQ ID NO: 6501 - DNA, 39 bp, Artificial Sequence
  Synthetic
cctgcgtagaacgatggggcgctggtcggcacacatccg

SEQ ID NO: 6502 - DNA, 39 bp, Artificial Sequence
  Synthetic
gactctgtttccagccagagggacaatttctggcggcgg

SEQ ID NO: 6503 - DNA, 37 bp, Artificial Sequence
  Synthetic
ccgccatctcgtgggccttcgctggaagagcaggtcc

SEQ ID NO: 6504 - DNA, 39 bp, Artificial Sequence
  Synthetic
ggcctcattcgcctctcgcgctccgagaacaggaagaca

SEQ ID NO: 6505 - DNA, 39 bp, Artificial Sequence
  Synthetic
gcaggcaggcctccagcttaaacaagggaagagcgggag

SEQ ID NO: 6506 - DNA, 37 bp, Artificial Sequence
  Synthetic
gccgtgcctaggatgcggaggatgtgaatgcccccgg

SEQ ID NO: 6507 - DNA, 38 bp, Artificial Sequence
  Synthetic
tgcgagcaaaggcggcgatccggaacagatcacagtca

SEQ ID NO: 6508 - DNA, 36 bp, Artificial Sequence
  Synthetic
tcgccagagggatctgcacctggaggctgtgctccc

SEQ ID NO: 6509 - DNA, 38 bp, Artificial Sequence
  Synthetic
cgacctcagctccgagtgggaagaggtagcgccccagg

SEQ ID NO: 6510 - DNA, 35 bp, Artificial Sequence
  Synthetic
cccacttttggcgcgacctcctcggcgcacaggtt

SEQ ID NO: 6511 - DNA, 35 bp, Artificial Sequence
  Synthetic
actcctgctggccctcccttcaccgactgccccct

SEQ ID NO: 6512 - DNA, 36 bp, Artificial Sequence
  Synthetic
catgagcaagggcccagggacttccaatcccccggg

SEQ ID NO: 6513 - DNA, 38 bp, Artificial Sequence
  Synthetic
ttccggccgttagcgtgccaccacagctatgatgccag

SEQ ID NO: 6514 - DNA, 38 bp, Artificial Sequence
  Synthetic
gcctctggctgttcagctcgcttctgcttctgcctggc

SEQ ID NO: 6515 - DNA, 36 bp, Artificial Sequence
  Synthetic
aggggtcagcggctgtcaaccggtcttcctctgcca

SEQ ID NO: 6516 - DNA, 36 bp, Artificial Sequence
  Synthetic
cggccaggctctgaccagattgagaccctggcgcac

SEQ ID NO: 6517 - DNA, 37 bp, Artificial Sequence
  Synthetic
agatgcggcgcagacagccacagggggatgccagagg

SEQ ID NO: 6518 - DNA, 40 bp, Artificial Sequence
  Synthetic
ctcgtcaggccgcgagaggatggcctcaaacactgacatt

SEQ ID NO: 6519 - DNA, 35 bp, Artificial Sequence
  Synthetic
cctttgagcccgaggtgccagagtgctccggctgc

SEQ ID NO: 6520 - DNA, 40 bp, Artificial Sequence
  Synthetic
gtagcgccgctgattctggacatcatcgatcccggctaca

SEQ ID NO: 6521 - DNA, 42 bp, Artificial Sequence
  Synthetic
tctgttccttctgctccagtgctcattacctctcgctgtcga

SEQ ID NO: 6522 - DNA, 37 bp, Artificial Sequence
  Synthetic
gatgcgcctgacgttgtgcggccccactgtatccacc

SEQ ID NO: 6523 - DNA, 44 bp, Artificial Sequence
  Synthetic
tcgaagagtttatatggatgtgcatatggtttttgtctgatggc

SEQ ID NO: 6524 - DNA, 41 bp, Artificial Sequence
  Synthetic
ttggcttctgacatctcccagctgtgcgtagtgttgctgtg

SEQ ID NO: 6525 - DNA, 37 bp, Artificial Sequence
  Synthetic
agtagcgggcctcggtgtggatggacgaggagctcat

SEQ ID NO: 6526 - DNA, 40 bp, Artificial Sequence
  Synthetic
gcagtggctatgcctccatgccaagagctggtgggagagg

SEQ ID NO: 6527 - DNA, 38 bp, Artificial Sequence
  Synthetic
gagatggtgtccggagaccccacaccgtgggccccttt

SEQ ID NO: 6528 - DNA, 41 bp, Artificial Sequence
  Synthetic
aagagccagggggggaagtcgtcttttcaccacgtccacga

SEQ ID NO: 6529 - DNA, 39 bp, Artificial Sequence
  Synthetic
aagcctgcctcatccttgaccaaagcagcagcctcagga

SEQ ID NO: 6530 - DNA, 39 bp, Artificial Sequence
  Synthetic
ccctgggcttggttcgcctccaaatactggccggtactc

SEQ ID NO: 6531 - DNA, 37 bp, Artificial Sequence
  Synthetic
tgggcagtaggctcggagtgtcacgggagccacaacc

SEQ ID NO: 6532 - DNA, 36 bp, Artificial Sequence
  Synthetic
cccgcctggtgctggaagttcagggacgttggtggc

SEQ ID NO: 6533 - DNA, 39 bp, Artificial Sequence
  Synthetic
agatggccatcagtaggcaccctggcccgcagacacatt

SEQ ID NO: 6534 - DNA, 38 bp, Artificial Sequence
  Synthetic
cagtcctaggtcagcggccgactcgggggcctctacac

SEQ ID NO: 6535 - DNA, 38 bp, Artificial Sequence
  Synthetic
tgtgctggaaagagaggctggatcttgtccgccgccag

SEQ ID NO: 6536 - DNA, 37 bp, Artificial Sequence
  Synthetic
tgggacctggggccgtagacctggtgcctgaagaccc

SEQ ID NO: 6537 - DNA, 37 bp, Artificial Sequence
  Synthetic
tgctgtatgcctcgcagcgctatcctgctgcagggcg

SEQ ID NO: 6538 - DNA, 40 bp, Artificial Sequence
  Synthetic
ggggggcctggagtcgatcaccacccgctgtatgaggaag

SEQ ID NO: 6539 - DNA, 36 bp, Artificial Sequence
  Synthetic
tggcacgcgattggggcacccctcctcgtgcaccta

SEQ ID NO: 6540 - DNA, 37 bp, Artificial Sequence
  Synthetic
aagggcgcacaccactcctgtgatggatccagcgagt

SEQ ID NO: 6541 - DNA, 37 bp, Artificial Sequence
  Synthetic
acaccctcaacccccgagtgccggatcaacgtacacg

SEQ ID NO: 6542 - DNA, 35 bp, Artificial Sequence
  Synthetic
gccctccagatcgccaccttgggggtgcagggtga

SEQ ID NO: 6543 - DNA, 42 bp, Artificial Sequence
  Synthetic
tgacggatgtctttaacggcgcaggatgtgttggcctttagg

SEQ ID NO: 6544 - DNA, 42 bp, Artificial Sequence
  Synthetic
gcgtaacgtcattgtccaccgacattcatgacctgccccact

SEQ ID NO: 6545 - DNA, 40 bp, Artificial Sequence
  Synthetic
actgacccccttgagcacgcgaagccgtctctctgagatg

SEQ ID NO: 6546 - DNA, 39 bp, Artificial Sequence
  Synthetic
gtgtcctggtttaaggccgcagtgctgctccaatgtccg

SEQ ID NO: 6547 - DNA, 36 bp, Artificial Sequence
  Synthetic
tgtacccatcccggccctcatgggcaggctctcacg

SEQ ID NO: 6548 - DNA, 39 bp, Artificial Sequence
  Synthetic
tcgatgagggagcaaacacccgcacagtcacggggatct

SEQ ID NO: 6549 - DNA, 43 bp, Artificial Sequence
  Synthetic
gtggtcagcagcagatagtgaatcttgagctccaactactttg

SEQ ID NO: 6550 - DNA, 36 bp, Artificial Sequence
  Synthetic
cgtagcaccacgtggctgctccagcccctgcatacc

SEQ ID NO: 6551 - DNA, 36 bp, Artificial Sequence
  Synthetic
cgctctccgggcacgtcttagttcggggcctgtgtc

SEQ ID NO: 6552 - DNA, 37 bp, Artificial Sequence
  Synthetic
cccgtgcctccttactacggatggatcgcgagggagc

SEQ ID NO: 6553 - DNA, 37 bp, Artificial Sequence
  Synthetic
aggcctctgcgtccggagtcacagacttggccttggg

SEQ ID NO: 6554 - DNA, 40 bp, Artificial Sequence
  Synthetic
ctggatgagggagcgccaattacaagggtgggctaactct

SEQ ID NO: 6555 - DNA, 37 bp, Artificial Sequence
  Synthetic
ccagggtccccacagtggatggctctgaccagcaaga

SEQ ID NO: 6556 - DNA, 38 bp, Artificial Sequence
  Synthetic
gggcagttcctcgttgcgcacccagatgcctcacctgg

SEQ ID NO: 6557 - DNA, 39 bp, Artificial Sequence
  Synthetic
cagacgcccccagccctaacaggcacatctacagcatca

SEQ ID NO: 6558 - DNA, 37 bp, Artificial Sequence
  Synthetic
ccaccaccgtcagggagtctaggggtggtggatgtgc

SEQ ID NO: 6559 - DNA, 36 bp, Artificial Sequence
  Synthetic
cacgttgctgggtgggggaaccttcatcacggggcc

SEQ ID NO: 6560 - DNA, 36 bp, Artificial Sequence
  Synthetic
ctgtcctcccagggacccgacccgcatgcgcaacca

SEQ ID NO: 6561 - DNA, 40 bp, Artificial Sequence
  Synthetic
ggtggttacaggagacgtgggttggttctgcccaaccacg

SEQ ID NO: 6562 - DNA, 38 bp, Artificial Sequence
  Synthetic
cgtagctcaccgccagctccggactcgggagccttaat

SEQ ID NO: 6563 - DNA, 42 bp, Artificial Sequence
  Synthetic
aacgatggaatggccaccaggtggcaataaccgaggccttca

SEQ ID NO: 6564 - DNA, 38 bp, Artificial Sequence
  Synthetic
gcaccgtcaggcacctgtgctcttagggaggtggccac

SEQ ID NO: 6565 - DNA, 38 bp, Artificial Sequence
  Synthetic
gagtctgcgatagagggccaggcacaagagcgccgcct

SEQ ID NO: 6566 - DNA, 39 bp, Artificial Sequence
  Synthetic
cgtacgtgcgtgtctttgcccaggaagctgtacgcggag

SEQ ID NO: 6567 - DNA, 37 bp, Artificial Sequence
  Synthetic
tggactcagccaccttgtcgttgaggaccccggtcga

SEQ ID NO: 6568 - DNA, 35 bp, Artificial Sequence
  Synthetic
gccgctgggtgacacagacaacaccccccgatgcc

SEQ ID NO: 6569 - DNA, 44 bp, Artificial Sequence
  Synthetic
tttcaggctttgcaaacacagtgtattagttgctctgtaactgg

SEQ ID NO: 6570 - DNA, 42 bp, Artificial Sequence
  Synthetic
atagggtggacggtgagcaaccaccacagtatgaaaccaccc

SEQ ID NO: 6571 - DNA, 41 bp, Artificial Sequence
  Synthetic
aacaacatgtttggactgggtagttttacaccctccgcaac

SEQ ID NO: 6572 - DNA, 40 bp, Artificial Sequence
  Synthetic
agaagtacgcctgctgcattatatgtcacttgcgtttccc

SEQ ID NO: 6573 - DNA, 50 bp, Artificial Sequence
  Synthetic
gtagacattataaacgagcagagcacacttctaaatgatatccattgtga

SEQ ID NO: 6574 - DNA, 40 bp, Artificial Sequence
  Synthetic
tttgggtggggttgtcatttcattttgcatcagctaacgg

SEQ ID NO: 6575 - DNA, 43 bp, Artificial Sequence
  Synthetic
atgtgttgttatttaaggcaagggaaataccaagcacaggcac

SEQ ID NO: 6576 - DNA, 46 bp, Artificial Sequence
  Synthetic
gctggaaaaaaaaaggctacactgacacattgtcttttcctctttg

SEQ ID NO: 6577 - DNA, 40 bp, Artificial Sequence
  Synthetic
aaacctactgaccacggacccgggtttcgttggtgcccag

SEQ ID NO: 6578 - DNA, 43 bp, Artificial Sequence
  Synthetic
accaggatatatgtcattgtttgcagtacccttaacgttccgc

SEQ ID NO: 6579 - DNA, 49 bp, Artificial Sequence
  Synthetic
tactgctactacgtgtacataacctcacaacaggatacatatatgcaat

SEQ ID NO: 6580 - DNA, 44 bp, Artificial Sequence
  Synthetic
ctcctactcctgtagtgccgaaataatacctcagttccatacac

SEQ ID NO: 6581 - DNA, 47 bp, Artificial Sequence
  Synthetic
aaatcgtatagttgtccccaaagtgcaaatttatttgggtcgggtag

SEQ ID NO: 6582 - DNA, 48 bp, Artificial Sequence
  Synthetic
gctgtttgatgttaatcctggtgagcaaccaataatacatagttgtgt

SEQ ID NO: 6583 - DNA, 44 bp, Artificial Sequence
  Synthetic
tatcagattatttcgaatggctgcattaaaacattgctctcggc

SEQ ID NO: 6584 - DNA, 41 bp, Artificial Sequence
  Synthetic
actggctacaacgtgcacaggttacaaaaagcagattgccc

SEQ ID NO: 6585 - DNA, 41 bp, Artificial Sequence
  Synthetic
ggtgatacctaccgctttttacattttctgcaggaggagga

SEQ ID NO: 6586 - DNA, 38 bp, Artificial Sequence
  Synthetic
cagtgaccatgccctgccttaacggcggccattttagg

SEQ ID NO: 6587 - DNA, 42 bp, Artificial Sequence
  Synthetic
ccattgtttggggcatatagttgttacactgctgttgccaaa

SEQ ID NO: 6588 - DNA, 42 bp, Artificial Sequence
  Synthetic
ataccacttctgtcactggctgtgttaaggaaatgcaagcac

SEQ ID NO: 6589 - DNA, 38 bp, Artificial Sequence
  Synthetic
tcctgaagaggaggagcgactgcattacaggtaccgca

SEQ ID NO: 6590 - DNA, 42 bp, Artificial Sequence
  Synthetic
aaaacgaaagtatctgacaagccctacagcttccagtctcgg

SEQ ID NO: 6591 - DNA, 45 bp, Artificial Sequence
  Synthetic
tgaagttatgtgccagcctcccgaccgtttataaaaatacaaagc

SEQ ID NO: 6592 - DNA, 45 bp, Artificial Sequence
  Synthetic
ggcagcatggataaataaatgttgctgtgcaataggtttccaatc

SEQ ID NO: 6593 - DNA, 44 bp, Artificial Sequence
  Synthetic
aaaagctggctattccgttgatgtgtgtatggaaaggctttagc

SEQ ID NO: 6594 - DNA, 41 bp, Artificial Sequence
  Synthetic
agaagaaccaggtcccctcagcatgtcctgttcccacctcc

SEQ ID NO: 6595 - DNA, 42 bp, Artificial Sequence
  Synthetic
attcctttggaaactttacctccaaggcctaacgactggaat

SEQ ID NO: 6596 - DNA, 42 bp, Artificial Sequence
  Synthetic
ctgacccgattcctcccagatttcaataactacagcatttgc

SEQ ID NO: 6597 - DNA, 45 bp, Artificial Sequence
  Synthetic
agcccaatttcgactattgttgaaagcatatctgaagtgtcatgt

SEQ ID NO: 6598 - DNA, 41 bp, Artificial Sequence
  Synthetic
aattgcctttcagatgacactgtctactggctttgcaggag

SEQ ID NO: 6599 - DNA, 41 bp, Artificial Sequence
  Synthetic
ggttgtgaaccagcgttaggtttaacctcatcactgcaagg

SEQ ID NO: 6600 - DNA, 40 bp, Artificial Sequence
  Synthetic
tttcagctgaattgtcccagtttttagcagccctgtttga

SEQ ID NO: 6601 - DNA, 40 bp, Artificial Sequence
  Synthetic
ttgcggaacagcattaacagaacaacttgtagctccttgt

SEQ ID NO: 6602 - DNA, 40 bp, Artificial Sequence
  Synthetic
gcttgcctgcagtgttggaaaccgcatcaggctgatccag

SEQ ID NO: 6603 - DNA, 39 bp, Artificial Sequence
  Synthetic
ctccaggagcttctgttgggccttcaccgtcggccatag

SEQ ID NO: 6604 - DNA, 41 bp, Artificial Sequence
  Synthetic
acagacagcaggaggcacaagggccaacggactagctagat

SEQ ID NO: 6605 - DNA, 38 bp, Artificial Sequence
  Synthetic
gcacagggggggtacaggaagtgctgtaactgcacccg

SEQ ID NO: 6606 - DNA, 44 bp, Artificial Sequence
  Synthetic
cagcaacactgtcaatatgcacaatctcactagcattaggacca

SEQ ID NO: 6607 - DNA, 45 bp, Artificial Sequence
  Synthetic
agaaacaccagaatggattgtaagaactgaaactggcattcttct

SEQ ID NO: 6608 - DNA, 42 bp, Artificial Sequence
  Synthetic
ggcacaaatgacaatgtcagaatgaccgtactatgggtctcc

SEQ ID NO: 6609 - DNA, 43 bp, Artificial Sequence
  Synthetic
gctgcagccattatgtgatgcggtatctatatagctccagcac

SEQ ID NO: 6610 - DNA, 41 bp, Artificial Sequence
  Synthetic
tgatgcaaactggaaatgcttctattgtcctcctggtcgtc

SEQ ID NO: 6611 - DNA, 38 bp, Artificial Sequence
  Synthetic
acatggaccaaggtgtctgggttacacgtgtcccttcg

SEQ ID NO: 6612 - DNA, 42 bp, Artificial Sequence
  Synthetic
acagaagacaggatccagcggcgctgtcagggttacactggt

SEQ ID NO: 6613 - DNA, 39 bp, Artificial Sequence
  Synthetic
gatggtcaacgtgcagtaacaatcatgccacagggttac

SEQ ID NO: 6614 - DNA, 46 bp, Artificial Sequence
  Synthetic
tggcgttactgcttttcttattgtgtatgtatatgatcaggaggcc

SEQ ID NO: 6615 - DNA, 43 bp, Artificial Sequence
  Synthetic
atcctgtagtactgtggacacctaagacacacgaaaagcaaca

SEQ ID NO: 6616 - DNA, 35 bp, Artificial Sequence
  Synthetic
attgggacccgaccccccataacgacaggggggcg

SEQ ID NO: 6617 - DNA, 45 bp, Artificial Sequence
  Synthetic
acagaggaaaccatactatttgagcatccaaaaagtcaggatccg

SEQ ID NO: 6618 - DNA, 43 bp, Artificial Sequence
  Synthetic
gttcccaaggtgtctggatatcaacttattgggatcaggcaaa

SEQ ID NO: 6619 - DNA, 45 bp, Artificial Sequence
  Synthetic
acccagctatttattatagggtgcaagacatattgcatggggtac

SEQ ID NO: 6620 - DNA, 42 bp, Artificial Sequence
  Synthetic
tctgtttacgtagggaacagatgtgaattgcgtcgcccatag

SEQ ID NO: 6621 - DNA, 48 bp, Artificial Sequence
  Synthetic
actacacgtagcaccaatatgactgcatgtactctttaaaattggaag

SEQ ID NO: 6622 - DNA, 46 bp, Artificial Sequence
  Synthetic
gtactgttgtgtatgtatgggtggcacacaaacatgcataaggaaa

SEQ ID NO: 6623 - DNA, 39 bp, Artificial Sequence
  Synthetic
ccggtttcggtcgtgcacaagcgcgaaacagctaacagt

SEQ ID NO: 6624 - DNA, 40 bp, Artificial Sequence
  Synthetic
tgagtgtcgtacagcctccaggtactcaccggttccgcag

SEQ ID NO: 6625 - DNA, 38 bp, Artificial Sequence
  Synthetic
gcgcgcgacaaggaagactttttagggatgggctggcg

SEQ ID NO: 6626 - DNA, 39 bp, Artificial Sequence
  Synthetic
cgccagagctctcgcgcatcgggtaagttccctgttgca

SEQ ID NO: 6627 - DNA, 37 bp, Artificial Sequence
  Synthetic
tctcaccgaatgtggccgtgcgtcgatgtgcgtccgc

SEQ ID NO: 6628 - DNA, 40 bp, Artificial Sequence
  Synthetic
cgtcatgttcggcttggcctggccaacagaaggatgacaa

SEQ ID NO: 6629 - DNA, 40 bp, Artificial Sequence
  Synthetic
ggatggggcgccttgcaatatgccagcaatagggtctcat

SEQ ID NO: 6630 - DNA, 40 bp, Artificial Sequence
  Synthetic
tgacttcaacgccagcacggccgcatttgaggtaagtggt

SEQ ID NO: 6631 - DNA, 42 bp, Artificial Sequence
  Synthetic
ccttgctcttactcggacctgcacgatgttttggtggaggtg

SEQ ID NO: 6632 - DNA, 41 bp, Artificial Sequence
  Synthetic
attccctcactggcctgtggtgcacagatgcgtcataagca

SEQ ID NO: 6633 - DNA, 41 bp, Artificial Sequence
  Synthetic
ctaaaaggtgctttgacgcgcggcacatcctcagtagagcg

SEQ ID NO: 6634 - DNA, 40 bp, Artificial Sequence
  Synthetic
tggcccagctgatggctataccgtgtctgctgggcgtaag

SEQ ID NO: 6635 - DNA, 39 bp, Artificial Sequence
  Synthetic
tcacgcagatgtactccagtgccgtgcacggctccaaag

SEQ ID NO: 6636 - DNA, 41 bp, Artificial Sequence
  Synthetic
caggtcgggtacttgcatgcccagcatatgcgacaggaact

SEQ ID NO: 6637 - DNA, 42 bp, Artificial Sequence
  Synthetic
ctaccaccatccttggcatcgggcacagttagtctgacccca

SEQ ID NO: 6638 - DNA, 39 bp, Artificial Sequence
  Synthetic
caccgacgccctcatgacagtacgttgcagtcgatcacg

SEQ ID NO: 6639 - DNA, 40 bp, Artificial Sequence
  Synthetic
ccgtcaggctcagggcgtatctgcctcccaaaactcaaga

SEQ ID NO: 6640 - DNA, 40 bp, Artificial Sequence
  Synthetic
atacatcgccacctgcatgcaacctgccaagacccatgtg

SEQ ID NO: 6641 - DNA, 42 bp, Artificial Sequence
  Synthetic
ttctgggccaaacacatgtggatgttgatagtcctgcgaggt

SEQ ID NO: 6642 - DNA, 40 bp, Artificial Sequence
  Synthetic
tgtcgtcaacttgctgcctggacagaatggccgcgcagat

SEQ ID NO: 6643 - DNA, 38 bp, Artificial Sequence
  Synthetic
cgaaacccgcgccaaactttacctccgcgtactctgag

SEQ ID NO: 6644 - DNA, 35 bp, Artificial Sequence
  Synthetic
cgtttagcgcgggggtcatgccgatagctggctcg

SEQ ID NO: 6645 - DNA, 40 bp, Artificial Sequence
  Synthetic
cctgggcacggcctgattaccggttggtaatctggccttt

SEQ ID NO: 6646 - DNA, 40 bp, Artificial Sequence
  Synthetic
acctggagcctgagcaggtagaagaccaggaccccgagtc

SEQ ID NO: 6647 - DNA, 40 bp, Artificial Sequence
  Synthetic
cgcaaggctcctcaccatggagatcttgcagaatggggtg

SEQ ID NO: 6648 - DNA, 40 bp, Artificial Sequence
  Synthetic
tggattccagtattcccccgctggtccttcttttccgccc

SEQ ID NO: 6649 - DNA, 40 bp, Artificial Sequence
  Synthetic
aatcgcgcccacaatgctggggtcccctggctttctgaga

SEQ ID NO: 6650 - DNA, 40 bp, Artificial Sequence
  Synthetic
gggctgcctgggaaacagtttggatgatgtttcccagcca

SEQ ID NO: 6651 - DNA, 36 bp, Artificial Sequence
  Synthetic
ccacccctcagagcgtggaacgggagatgagggacg

SEQ ID NO: 6652 - DNA, 39 bp, Artificial Sequence
  Synthetic
cgcgattgatgcggatttgccgttccagcaccgttttgc

SEQ ID NO: 6653 - DNA, 40 bp, Artificial Sequence
  Synthetic
cgaggtgggcgtaacgcttgcaaagtccacgccaaaatgg

SEQ ID NO: 6654 - DNA, 39 bp, Artificial Sequence
  Synthetic
tcatgcccgggaagagtttgccggcttcgtcttcctgtc

SEQ ID NO: 6655 - DNA, 37 bp, Artificial Sequence
  Synthetic
gggcggacaatgccgtctgcgtcatgccgcctgaaac

SEQ ID NO: 6656 - DNA, 36 bp, Artificial Sequence
  Synthetic
cagcgtcagtccgaacgtcctcagtgccaccccgtc

SEQ ID NO: 6657 - DNA, 39 bp, Artificial Sequence
  Synthetic
gcgaaccgaaaacccaataccgagccccagtagcgttgg

SEQ ID NO: 6658 - DNA, 41 bp, Artificial Sequence
  Synthetic
gaccaatacatcggcggcatcgagtttggtgaagaagcgcg

SEQ ID NO: 6659 - DNA, 36 bp, Artificial Sequence
  Synthetic
gcaaaatcaccgtcgccgcctcgttggcgagtgcgg

SEQ ID NO: 6660 - DNA, 38 bp, Artificial Sequence
  Synthetic
gctcccaagccgaaacgtgatatcgcaagccgctttcg

SEQ ID NO: 6661 - DNA, 35 bp, Artificial Sequence
  Synthetic
gtgatgcggccgccgacttctatcgcgccgccaac

SEQ ID NO: 6662 - DNA, 37 bp, Artificial Sequence
  Synthetic
aaccgggaatcaggtcggtggcggtgtggcaggcgta

SEQ ID NO: 6663 - DNA, 35 bp, Artificial Sequence
  Synthetic
ggggtgtgcgtgccggaaattaccgccgaccgcac

SEQ ID NO: 6664 - DNA, 38 bp, Artificial Sequence
  Synthetic
ccgcccgcgacaatgtagttggcacgaacgcttggaag

SEQ ID NO: 6665 - DNA, 37 bp, Artificial Sequence
  Synthetic
gcgcttttgggcgaacagcgtaaggaagcgcgcgtgg

SEQ ID NO: 6666 - DNA, 36 bp, Artificial Sequence
  Synthetic
ggcagggaataccgcccgttacgtccgccagttcgc

SEQ ID NO: 6667 - DNA, 38 bp, Artificial Sequence
  Synthetic
ccgccctgcaagccgatgtcgtgcgtgatttgtccgaa

SEQ ID NO: 6668 - DNA, 42 bp, Artificial Sequence
  Synthetic
gcttcctgccatttgctgtcgggctggagaatgtacaaggcc

SEQ ID NO: 6669 - DNA, 36 bp, Artificial Sequence
  Synthetic
agtttcaccgccaccaacgcgcaaggactggcaccg

SEQ ID NO: 6670 - DNA, 39 bp, Artificial Sequence
  Synthetic
ttcgtcccaagccggacaccaaaaaccatgtgtcgtggc

SEQ ID NO: 6671 - DNA, 38 bp, Artificial Sequence
  Synthetic
ccgcgtttcgggcaactcggaatggtttgccgaacgcg

SEQ ID NO: 6672 - DNA, 36 bp, Artificial Sequence
  Synthetic
ggtacgcgccgtggatgacgacatcgggctgttgtc

SEQ ID NO: 6673 - DNA, 37 bp, Artificial Sequence
  Synthetic
ccgctttgccgtggaacagttcgtcagcctgtgtccg

SEQ ID NO: 6674 - DNA, 38 bp, Artificial Sequence
  Synthetic
tgcaggtggaggtagcgcgcaaaccgaagatgccgtct

SEQ ID NO: 6675 - DNA, 36 bp, Artificial Sequence
  Synthetic
tagagcagttcggcgtgtgctttctcgcgctcgccc

SEQ ID NO: 6676 - DNA, 42 bp, Artificial Sequence
  Synthetic
gccgccctaccgacttgataatgcgaagtgttttatgcgtgg

SEQ ID NO: 6677 - DNA, 37 bp, Artificial Sequence
  Synthetic
cgcgtgtcgcccaaaatgacttgcctccgccgaactc

SEQ ID NO: 6678 - DNA, 40 bp, Artificial Sequence
  Synthetic
ccaaaaacgcctcgaatcgtggatatgcggcgaaacgtgc

SEQ ID NO: 6679 - DNA, 39 bp, Artificial Sequence
  Synthetic
ttatgccgtctgtcgaacggcggcagtcatcgtcgcttc

SEQ ID NO: 6680 - DNA, 37 bp, Artificial Sequence
  Synthetic
ggcggagagtgcaccgtgttcaacgtcaacgatgccg

SEQ ID NO: 6681 - DNA, 40 bp, Artificial Sequence
  Synthetic
ttcgggccgatgaaggtaaagctgccgaaaacgccgattt

SEQ ID NO: 6682 - DNA, 40 bp, Artificial Sequence
  Synthetic
gattcgtcggcgagtttgacgtcaccgttgccgtgcattc

SEQ ID NO: 6683 - DNA, 37 bp, Artificial Sequence
  Synthetic
cgccggtggctttggagacgtgttggaagtgaacccg

SEQ ID NO: 6684 - DNA, 39 bp, Artificial Sequence
  Synthetic
acgtcttccaatgtcagcggcgtgtccaccgacttcgac

SEQ ID NO: 6685 - DNA, 39 bp, Artificial Sequence
  Synthetic
cgggtgtcgatgtcggcgaaagcctgcacgactatttgg

SEQ ID NO: 6686 - DNA, 36 bp, Artificial Sequence
  Synthetic
cgatgtgcgcgacagggaacagcgttcagacggcat

SEQ ID NO: 6687 - DNA, 35 bp, Artificial Sequence
  Synthetic
ggcgttgcccagttgcaggtgtccggactcgccac

SEQ ID NO: 6688 - DNA, 37 bp, Artificial Sequence
  Synthetic
cctgcgaaatgctggtcggattccgctgttgccggta

SEQ ID NO: 6689 - DNA, 40 bp, Artificial Sequence
  Synthetic
cgctcccttgcctacgatgcagagtttgtgcagcatacgg

SEQ ID NO: 6690 - DNA, 36 bp, Artificial Sequence
  Synthetic
gaccccagcttcaaagccgccctacccagccggcaa

SEQ ID NO: 6691 - DNA, 38 bp, Artificial Sequence
  Synthetic
gttccgaccagtggggcaactttttggttcaggcggcg

SEQ ID NO: 6692 - DNA, 37 bp, Artificial Sequence
  Synthetic
atcagccccctgcgtaccaaaacccaggcggcatcga

SEQ ID NO: 6693 - DNA, 40 bp, Artificial Sequence
  Synthetic
tcagtggtttgtcggcatggacttgatggctttgtcgcgc

SEQ ID NO: 6694 - DNA, 37 bp, Artificial Sequence
  Synthetic
ccgccgccatcgagcctttcttccgcctgcaaggacg

SEQ ID NO: 6695 - DNA, 38 bp, Artificial Sequence
  Synthetic
catggcagggcaggccgaaggaaaaatacggcggtccc

SEQ ID NO: 6696 - DNA, 39 bp, Artificial Sequence
  Synthetic
tcttcgaggctgacgaaggcgaattcgttaccgccgtgc

SEQ ID NO: 6697 - DNA, 38 bp, Artificial Sequence
  Synthetic
tcgatgctgtcgaacgcgccaacacatgaaccgccgca

SEQ ID NO: 6698 - DNA, 39 bp, Artificial Sequence
  Synthetic
gattcgtccgcctgatacacggggcggcgtgttgattgc

SEQ ID NO: 6699 - DNA, 35 bp, Artificial Sequence
  Synthetic
tgcggcgaggcgtgcattccgttgcgcatcgtagc

SEQ ID NO: 6700 - DNA, 37 bp, Artificial Sequence
  Synthetic
cgtccaaacgcgccatttcgcttcgcgcccgaccaac

SEQ ID NO: 6701 - DNA, 35 bp, Artificial Sequence
  Synthetic
tcgtgccacggcagcatgcgcaaaaccggccatcc

SEQ ID NO: 6702 - DNA, 38 bp, Artificial Sequence
  Synthetic
cgccacggcgtgttgtcgactatcaaggcggctgctcc

SEQ ID NO: 6703 - DNA, 40 bp, Artificial Sequence
  Synthetic
tgtttggtccgtcgggttcgggaacacgcccccttcagac

SEQ ID NO: 6704 - DNA, 37 bp, Artificial Sequence
  Synthetic
aacaaccagaatgaggcggcattgccgtaccgtccgg

SEQ ID NO: 6705 - DNA, 38 bp, Artificial Sequence
  Synthetic
gcggcaacatgcacgatacgacctcctgctgccggaaa

SEQ ID NO: 6706 - DNA, 37 bp, Artificial Sequence
  Synthetic
ccgtcagcggcaacagcacttttcgtccgcgcaactc

SEQ ID NO: 6707 - DNA, 38 bp, Artificial Sequence
  Synthetic
gccgccgtctgcatcagcatgctgtcgtggtatttccc

SEQ ID NO: 6708 - DNA, 39 bp, Artificial Sequence
  Synthetic
cggcacgcaaaacctgtacgcggcagcagcttttggatt

SEQ ID NO: 6709 - DNA, 40 bp, Artificial Sequence
  Synthetic
cgttgtgcattgaagggcgaaccgaactcaaaatgcccgc

SEQ ID NO: 6710 - DNA, 35 bp, Artificial Sequence
  Synthetic
cggcgacgggggaatttgcaaggcaaaggcgtgcg

SEQ ID NO: 6711 - DNA, 39 bp, Artificial Sequence
  Synthetic
cgccgtaacccatttccgcttcgcgcatggctcaacctc

SEQ ID NO: 6712 - DNA, 40 bp, Artificial Sequence
  Synthetic
caacacgctgttgggtatgggaccggtaaagcctgctacg

SEQ ID NO: 6713 - DNA, 35 bp, Artificial Sequence
  Synthetic
tttgccgtatccgggcggtaacgcttcgggcctgc

SEQ ID NO: 6714 - DNA, 36 bp, Artificial Sequence
  Synthetic
ggtggaacggaagctgctggatcacgccgcacatcg

SEQ ID NO: 6715 - DNA, 41 bp, Artificial Sequence
  Synthetic
ccgctgtcggcttcaaaatggtgatgctcgaccacagcctg

SEQ ID NO: 6716 - DNA, 36 bp, Artificial Sequence
  Synthetic
gtttgcgcgtcagctcgacaccgtacccgcgttacc

SEQ ID NO: 6717 - DNA, 39 bp, Artificial Sequence
  Synthetic
ttttccggcaggagcttgtcgcccaacgcatcgaagacg

SEQ ID NO: 6718 - DNA, 40 bp, Artificial Sequence
  Synthetic
gcgtgccgcagattttcatcgaaggcggtagaggtcggta

SEQ ID NO: 6719 - DNA, 42 bp, Artificial Sequence
  Synthetic
aagcctgcgccttttgcattcgcgtgccgtctgaaagttgat

SEQ ID NO: 6720 - DNA, 37 bp, Artificial Sequence
  Synthetic
aagtcggcgtagatgtgcccaaagcccatgcgctcgg

SEQ ID NO: 6721 - DNA, 42 bp, Artificial Sequence
  Synthetic
aaccctgaaatcgtcgaagcgcacccaaataaccttccctgc

SEQ ID NO: 6722 - DNA, 36 bp, Artificial Sequence
  Synthetic
gaaccggcgggcaggatgtaaaccgtcctgcgcgac

SEQ ID NO: 6723 - DNA, 39 bp, Artificial Sequence
  Synthetic
ccggcgatggtctgcctgaggcgacaacttcaaagccta

SEQ ID NO: 6724 - DNA, 39 bp, Artificial Sequence
  Synthetic
aaaggtcgatgacgcgcacgggcatcgccatgaaagacg

SEQ ID NO: 6725 - DNA, 38 bp, Artificial Sequence
  Synthetic
aatcggcaactgcggttcccccagatgtcgaagtcgcc

SEQ ID NO: 6726 - DNA, 39 bp, Artificial Sequence
  Synthetic
gctttcagacgacgtcaggttcccttttccaacgtatcc

SEQ ID NO: 6727 - DNA, 36 bp, Artificial Sequence
  Synthetic
gcaaggtcggcggcgctttattaccaatgcgccgcc

SEQ ID NO: 6728 - DNA, 39 bp, Artificial Sequence
  Synthetic
catgttgcgcgggatttctggtccattgctgctgccaaa

SEQ ID NO: 6729 - DNA, 35 bp, Artificial Sequence
  Synthetic
gggcatgaccgccgccatatcgaagccgccgacct

SEQ ID NO: 6730 - DNA, 40 bp, Artificial Sequence
  Synthetic
aacgtggtcgatgtggttgcagcccatctccgacacgacc

SEQ ID NO: 6731 - DNA, 36 bp, Artificial Sequence
  Synthetic
atgccgaacgtcccccagctcttcctgctcgccagc

SEQ ID NO: 6732 - DNA, 39 bp, Artificial Sequence
  Synthetic
aggcagtggagtcgaggatgtgccccgttaccgacaagt

SEQ ID NO: 6733 - DNA, 38 bp, Artificial Sequence
  Synthetic
gggttgccgccgaccaaaactgctgtctttaggcatcg

SEQ ID NO: 6734 - DNA, 39 bp, Artificial Sequence
  Synthetic
ttgatgccgacgacctgtccatcaatccgggcaattccg

SEQ ID NO: 6735 - DNA, 40 bp, Artificial Sequence
  Synthetic
gcttcgccgtcgccttgtttaaatcgccgttctgctttcg

SEQ ID NO: 6736 - DNA, 38 bp, Artificial Sequence
  Synthetic
ttcgcgcccaaccgttatttggtcgcgacggcaagcag

SEQ ID NO: 6737 - DNA, 37 bp, Artificial Sequence
  Synthetic
aaaaccctgcaccgcagtgatccggcaatctgcacgg

SEQ ID NO: 6738 - DNA, 35 bp, Artificial Sequence
  Synthetic
gtagcgcgctgatgcaggagccttgaccaccgcct

SEQ ID NO: 6739 - DNA, 38 bp, Artificial Sequence
  Synthetic
cgcaaggcaggccgtggttcggtaaaacgccgtgttcg

SEQ ID NO: 6740 - DNA, 39 bp, Artificial Sequence
  Synthetic
gggttcggacggcatctgtctgttttcgacattcgccgg

SEQ ID NO: 6741 - DNA, 38 bp, Artificial Sequence
  Synthetic
agccataagctgcccgtttcggctttgccgaccaccgc

SEQ ID NO: 6742 - DNA, 39 bp, Artificial Sequence
  Synthetic
gggtatggacggcagcaaggtgcggatttccttcagcct

SEQ ID NO: 6743 - DNA, 36 bp, Artificial Sequence
  Synthetic
tgctcctgctcgcccacgatagagcgtttgggcggc

SEQ ID NO: 6744 - DNA, 35 bp, Artificial Sequence
  Synthetic
agacggatgcgagggcgtacgacctgctccttgcc

SEQ ID NO: 6745 - DNA, 39 bp, Artificial Sequence
  Synthetic
gggtaccttccacgacgcgtaaatccccgaattcgcacc

SEQ ID NO: 6746 - DNA, 35 bp, Artificial Sequence
  Synthetic
ctgcgggcagttcgttggtttcgtccgcagcctcg

SEQ ID NO: 6747 - DNA, 39 bp, Artificial Sequence
  Synthetic
tttgggcgtgtcgtgtgttccacggcggacaatacagca

SEQ ID NO: 6748 - DNA, 38 bp, Artificial Sequence
  Synthetic
gcaaggtggcggctgtcgacaacggacaaaccactgcc

SEQ ID NO: 6749 - DNA, 36 bp, Artificial Sequence
  Synthetic
gccgctgcaagggcttttttgattgcaccgccgcag

SEQ ID NO: 6750 - DNA, 40 bp, Artificial Sequence
  Synthetic
tccgttgcggatgtggtggggcacgcaccaaaaaacctca

SEQ ID NO: 6751 - DNA, 41 bp, Artificial Sequence
  Synthetic
atgaggaagttgcagtgtcgggcctcacgacagaaaccgac

SEQ ID NO: 6752 - DNA, 37 bp, Artificial Sequence
  Synthetic
tgtgcaggctgtgtccgaagcgcatcccggcatcagc

SEQ ID NO: 6753 - DNA, 40 bp, Artificial Sequence
  Synthetic
ggtgcgttgttctgttcgccactcttggcacgcatcaatg

SEQ ID NO: 6754 - DNA, 38 bp, Artificial Sequence
  Synthetic
ggaggcggtcagtatgccgaagaggcttcagacggcat

SEQ ID NO: 6755 - DNA, 42 bp, Artificial Sequence
  Synthetic
tttccgcaggttcggctgtactatacttccgccgaaaccctt

SEQ ID NO: 6756 - DNA, 38 bp, Artificial Sequence
  Synthetic
aggctgtgttcgagttcggggttcaaagccgtcctgcc

SEQ ID NO: 6757 - DNA, 39 bp, Artificial Sequence
  Synthetic
gggaagcggccgatgtgttttgaacaccttcttccggca

SEQ ID NO: 6758 - DNA, 40 bp, Artificial Sequence
  Synthetic
gcttttcgcgtgatgccccgatggtcatgaaacgcaaagc

SEQ ID NO: 6759 - DNA, 38 bp, Artificial Sequence
  Synthetic
ggtgcaggcggggtggaaattgcgcctttttttgggca

SEQ ID NO: 6760 - DNA, 42 bp, Artificial Sequence
  Synthetic
ttgatggctttaggttttgtcgttaaaacgccattcgaaacg

SEQ ID NO: 6761 - DNA, 38 bp, Artificial Sequence
  Synthetic
caggttgcggctgccttcttctacatcctgcaagcccg

SEQ ID NO: 6762 - DNA, 39 bp, Artificial Sequence
  Synthetic
caggtgtcgccgctgacgaactcgttcccaaactcggat

SEQ ID NO: 6763 - DNA, 38 bp, Artificial Sequence
  Synthetic
agcgtgtgttttcggggttgacggttcgcaagccatcg

SEQ ID NO: 6764 - DNA, 39 bp, Artificial Sequence
  Synthetic
ccgacggtcagcgggatgacaccatcctgcacatcatcg

SEQ ID NO: 6765 - DNA, 36 bp, Artificial Sequence
  Synthetic
acgccatgtttttcggcggctcccgtcatcgcctcc

SEQ ID NO: 6766 - DNA, 37 bp, Artificial Sequence
  Synthetic
tggcactgcgttggacggggtcttccccgacctgaac

SEQ ID NO: 6767 - DNA, 34 bp, Artificial Sequence
  Synthetic
agcgcgtcggcatcggtatcccttgacgcggcag

SEQ ID NO: 6768 - DNA, 39 bp, Artificial Sequence
  Synthetic
aaccagtcgtcgcttttgcctttccaagccgttgacgca

SEQ ID NO: 6769 - DNA, 39 bp, Artificial Sequence
  Synthetic
ctcttgcgccgtcctgcctaccgtttaccgcaatatcgc

SEQ ID NO: 6770 - DNA, 36 bp, Artificial Sequence
  Synthetic
agcagggtggcggtcaacggcattaccgccgcattc

SEQ ID NO: 6771 - DNA, 37 bp, Artificial Sequence
  Synthetic
cgcctttgccgcgtgtttcagccaacctcctagagcc

SEQ ID NO: 6772 - DNA, 39 bp, Artificial Sequence
  Synthetic
gtttgcgacagtcggccatgatgctcgcctacgtcgaaa

SEQ ID NO: 6773 - DNA, 42 bp, Artificial Sequence
  Synthetic
ttcgacaatgccggtaatgcgttcatacggcatcgtcgaaac

SEQ ID NO: 6774 - DNA, 37 bp, Artificial Sequence
  Synthetic
gacgtgttcctcgggttgcagacgtcttccgggccga

SEQ ID NO: 6775 - DNA, 38 bp, Artificial Sequence
  Synthetic
agccttcaacggcactgcacgacaatttctcctgccgc

SEQ ID NO: 6776 - DNA, 40 bp, Artificial Sequence
  Synthetic
ccggcaaaatgcaggcaggcaactctggttcggctacacc

SEQ ID NO: 6777 - DNA, 36 bp, Artificial Sequence
  Synthetic
acgatgatgcccatcccgcgccccctccgtcaactt

SEQ ID NO: 6778 - DNA, 36 bp, Artificial Sequence
  Synthetic
ggagagggcggcgggtatcaacgtcctctcccgcct

SEQ ID NO: 6779 - DNA, 42 bp, Artificial Sequence
  Synthetic
tcgaaacagccttggatgtcgcttcccacttcacaacacccg

SEQ ID NO: 6780 - DNA, 38 bp, Artificial Sequence
  Synthetic
ttttggacacgctgccggaaccaagcccaagccctaat

SEQ ID NO: 6781 - DNA, 39 bp, Artificial Sequence
  Synthetic
gaacggattcggtttgcttggctcgggcatcagcaggac

SEQ ID NO: 6782 - DNA, 37 bp, Artificial Sequence
  Synthetic
ggtatgctgggcgcgtcgatcaccgacctcctcaacc

SEQ ID NO: 6783 - DNA, 41 bp, Artificial Sequence
  Synthetic
aagccacttcgataaaggcggccattcgcacaaagcatggg

SEQ ID NO: 6784 - DNA, 38 bp, Artificial Sequence
  Synthetic
tcggcaatctggaaatggtcgttttccaaccgctgccg

SEQ ID NO: 6785 - DNA, 36 bp, Artificial Sequence
  Synthetic
cacttctcccgcccccgaaatcatgcggcgacatgg

SEQ ID NO: 6786 - DNA, 38 bp, Artificial Sequence
  Synthetic
accgcatccgtgccgtattctttccctgatcgtgctgc

SEQ ID NO: 6787 - DNA, 34 bp, Artificial Sequence
  Synthetic
acaggcgcgcgagaaagacaaacgccgcgcacac

SEQ ID NO: 6788 - DNA, 34 bp, Artificial Sequence
  Synthetic
aaacaggtgcgccgacggcagcaacgccctgcct

SEQ ID NO: 6789 - DNA, 35 bp, Artificial Sequence
  Synthetic
tcctgtggcacggctaccctatccacaccggcggc

SEQ ID NO: 6790 - DNA, 35 bp, Artificial Sequence
  Synthetic
cgccgtgcggttgccgatactcctgcatacgcgcg

SEQ ID NO: 6791 - DNA, 34 bp, Artificial Sequence
  Synthetic
cccgaaggcagcgcgtttttcgggcgtggcttgg

SEQ ID NO: 6792 - DNA, 35 bp, Artificial Sequence
  Synthetic
agccgcccgcctcgttttggtgttgcggggtcacg

SEQ ID NO: 6793 - DNA, 42 bp, Artificial Sequence
  Synthetic
aggcgcacaaattcttcctcgggcgttttctttggcggattt

SEQ ID NO: 6794 - DNA, 35 bp, Artificial Sequence
  Synthetic
gcgatgtttgccgccgtcgcgcaccaccttttccg

SEQ ID NO: 6795 - DNA, 41 bp, Artificial Sequence
  Synthetic
ggtggttttcgtcgtggaggcgttgtttcaacacgacgcgg

SEQ ID NO: 6796 - DNA, 35 bp, Artificial Sequence
  Synthetic
ccggtgatgcggacggcttagccgtgggtgcttgc

SEQ ID NO: 6797 - DNA, 40 bp, Artificial Sequence
  Synthetic
tcgctgtcggtttgcgaaccttgccttccgtgatccttac

SEQ ID NO: 6798 - DNA, 38 bp, Artificial Sequence
  Synthetic
cgttttcggcggcggatttcgcaacggaaagccaaacg

SEQ ID NO: 6799 - DNA, 39 bp, Artificial Sequence
  Synthetic
gtctgtcgtcgaggcattccacggcgcataccagctttc

SEQ ID NO: 6800 - DNA, 40 bp, Artificial Sequence
  Synthetic
acgaaaacggccaagtcttgggcgatgccggggtaatcca

SEQ ID NO: 6801 - DNA, 44 bp, Artificial Sequence
  Synthetic
cctgttaacaagaaacggttttgccataacggggcattaaacct

SEQ ID NO: 6802 - DNA, 39 bp, Artificial Sequence
  Synthetic
cgactaccgttgctatgcgttccaacgtaccgatgattg

SEQ ID NO: 6803 - DNA, 35 bp, Artificial Sequence
  Synthetic
aattccgcgcgcgggcatgcaaccaccatcagccc

SEQ ID NO: 6804 - DNA, 35 bp, Artificial Sequence
  Synthetic
gccaaccatccgcttgccggtgtcgccgcacggat

SEQ ID NO: 6805 - DNA, 39 bp, Artificial Sequence
  Synthetic
gcactgtttgccgagcgcggcttgtcgatttcctgacgt

SEQ ID NO: 6806 - DNA, 39 bp, Artificial Sequence
  Synthetic
tgaagggcgatgtcccgcgttcttcgccttcttcctcca

SEQ ID NO: 6807 - DNA, 40 bp, Artificial Sequence
  Synthetic
ggctttggggcgacaaacagacggcggacgacggaaatcc

SEQ ID NO: 6808 - DNA, 37 bp, Artificial Sequence
  Synthetic
gccagcggctttccacaatgctgcaaaacgccttggc

SEQ ID NO: 6809 - DNA, 36 bp, Artificial Sequence
  Synthetic
aacgacgacgcgcaggtgggccggataaagggcgac

SEQ ID NO: 6810 - DNA, 38 bp, Artificial Sequence
  Synthetic
gtttgcccgaacgtgcggtccgcctttctcggtgtctg

SEQ ID NO: 6811 - DNA, 39 bp, Artificial Sequence
  Synthetic
gcagggcagtgtgtatccagtcgcctacctgttcggtct

SEQ ID NO: 6812 - DNA, 41 bp, Artificial Sequence
  Synthetic
aaacagtcatgccgatgccgaacaatacagcctgatgacgc

SEQ ID NO: 6813 - DNA, 41 bp, Artificial Sequence
  Synthetic
acgcatgatatttggctggcggggcaaccactttaaacgcc

SEQ ID NO: 6814 - DNA, 38 bp, Artificial Sequence
  Synthetic
cgccgtacacgaggtcttccggcccgaacacaaaccgc

SEQ ID NO: 6815 - DNA, 43 bp, Artificial Sequence
  Synthetic
aaccgtttacaccggaagatgtcttgggcaatcaattctttca

SEQ ID NO: 6816 - DNA, 39 bp, Artificial Sequence
  Synthetic
atggtgatgatgattgcgcccaatcggagtaagcggaaa

SEQ ID NO: 6817 - DNA, 44 bp, Artificial Sequence
  Synthetic
agaagtaacaggccgtctgaaaacatcgttactccaaaaacgta

SEQ ID NO: 6818 - DNA, 38 bp, Artificial Sequence
  Synthetic
tcatcgtcgaagaaagcggctcaatgcgttgcgtccga

SEQ ID NO: 6819 - DNA, 37 bp, Artificial Sequence
  Synthetic
gtagggcggcgaggttggttcatctactgcaccggcg

SEQ ID NO: 6820 - DNA, 41 bp, Artificial Sequence
  Synthetic
tccgagtccgaagcatcttgtgtgtctgcctccccgataat

SEQ ID NO: 6821 - DNA, 42 bp, Artificial Sequence
  Synthetic
tcgctgctcatcaggctaaggtcgtcttgccataggtacggc

SEQ ID NO: 6822 - DNA, 40 bp, Artificial Sequence
  Synthetic
gttctttacgtttttgtggggcttaccaggcatccaaacg

SEQ ID NO: 6823 - DNA, 39 bp, Artificial Sequence
  Synthetic
aggcgtggatttccgttaccgtttgccgcattgcccgac

SEQ ID NO: 6824 - DNA, 46 bp, Artificial Sequence
  Synthetic
gcatttttcggtatcggtgtaacggcgttttcggtatatatgcaaa

SEQ ID NO: 6825 - DNA, 39 bp, Artificial Sequence
  Synthetic
ggcgtggcgatgattgccgcgaatccccaaaccgcatta

SEQ ID NO: 6826 - DNA, 41 bp, Artificial Sequence
  Synthetic
taagccaagccgttgcaaccggcatagtgcttgcattgagc

SEQ ID NO: 6827 - DNA, 39 bp, Artificial Sequence
  Synthetic
acgtctggctttccattcgggtcaattcccgaagctcgc

SEQ ID NO: 6828 - DNA, 39 bp, Artificial Sequence
  Synthetic
cctaccgtttttctgcttgcgtggcacaaacagttgtcg

SEQ ID NO: 6829 - DNA, 40 bp, Artificial Sequence
  Synthetic
gcgtattgtctgtgcgcggattctcctgcaaggcattcat

SEQ ID NO: 6830 - DNA, 41 bp, Artificial Sequence
  Synthetic
cgaaaacacagcttccgaaccgagggacggtgcttctatgg

SEQ ID NO: 6831 - DNA, 41 bp, Artificial Sequence
  Synthetic
gcggcgaagatgaatgccaactcgaaggcgtaacgaagttg

SEQ ID NO: 6832 - DNA, 41 bp, Artificial Sequence
  Synthetic
tgcactgaagccgagtattccgactgtgcggtttcgtcaaa

SEQ ID NO: 6833 - DNA, 38 bp, Artificial Sequence
  Synthetic
gaccccgaacacgccaaaatctgccgtgatactgccgc

SEQ ID NO: 6834 - DNA, 40 bp, Artificial Sequence
  Synthetic
aagcccaatgggagaaatcgtggatttgggctttcatcaa

SEQ ID NO: 6835 - DNA, 37 bp, Artificial Sequence
  Synthetic
acgcttcgaccgtccaatcccaccggtcggattgcgc

SEQ ID NO: 6836 - DNA, 38 bp, Artificial Sequence
  Synthetic
ggcaacggcgtaaatcagtgccgcgatggacgaagccg

SEQ ID NO: 6837 - DNA, 35 bp, Artificial Sequence
  Synthetic
gacggtttcgcggctgtctcgccgacaaccccctt

SEQ ID NO: 6838 - DNA, 39 bp, Artificial Sequence
  Synthetic
ccagcccgcgatcctgatacacgacagcatatgcgtcgc

SEQ ID NO: 6839 - DNA, 39 bp, Artificial Sequence
  Synthetic
aggagtggtaaccatgccgacaatccaacgcggcctgac

SEQ ID NO: 6840 - DNA, 38 bp, Artificial Sequence
  Synthetic
gacttgttcgggcagccccacgccctgcttgtaccgat

SEQ ID NO: 6841 - DNA, 42 bp, Artificial Sequence
  Synthetic
ggcggttttgattttggagccggcgctgttgattttccttgc

SEQ ID NO: 6842 - DNA, 39 bp, Artificial Sequence
  Synthetic
acggtttatctgcccgccgaccatcaatgcgacaaagcg

SEQ ID NO: 6843 - DNA, 37 bp, Artificial Sequence
  Synthetic
gaacgcaggctgccgagcagctcgaaggcgacctcat

SEQ ID NO: 6844 - DNA, 35 bp, Artificial Sequence
  Synthetic
ggtgttgttcggcggcaaggacgaaaccgccgcac

SEQ ID NO: 6845 - DNA, 38 bp, Artificial Sequence
  Synthetic
cggctgccgtgtcggtaaatcacaggcctaggttacct

SEQ ID NO: 6846 - DNA, 36 bp, Artificial Sequence
  Synthetic
agagcggcatatcgggatgcaaccccgtcgtcagcg

SEQ ID NO: 6847 - DNA, 39 bp, Artificial Sequence
  Synthetic
tcgtcggcgtgtttaagcgctacaacactttcggcctgc

SEQ ID NO: 6848 - DNA, 36 bp, Artificial Sequence
  Synthetic
tttgcccgccgtcgaacgccgcttctgcatcttccg

SEQ ID NO: 6849 - DNA, 40 bp, Artificial Sequence
  Synthetic
gttgtcgtttcccccgaagccggccttcgacgtttttcac

SEQ ID NO: 6850 - DNA, 34 bp, Artificial Sequence
  Synthetic
gcatcggccctgcctacgaagcaaatcggcggcg

SEQ ID NO: 6851 - DNA, 40 bp, Artificial Sequence
  Synthetic
cgcgcgtcatatggtcgagcgcatcgagaaacagctccct

SEQ ID NO: 6852 - DNA, 36 bp, Artificial Sequence
  Synthetic
atctggtgatgggccgcccacttcgcgcaatacggc

SEQ ID NO: 6853 - DNA, 40 bp, Artificial Sequence
  Synthetic
gcgcgaactcgaaaaaccgcggcgcaatacttggtcaaac

SEQ ID NO: 6854 - DNA, 39 bp, Artificial Sequence
  Synthetic
tggtggaaggcttcgaacatcgcaccgttgccgaaaccg

SEQ ID NO: 6855 - DNA, 37 bp, Artificial Sequence
  Synthetic
ggccgggtttcgaccgtgtgcgttgccgaaaacaccc

SEQ ID NO: 6856 - DNA, 39 bp, Artificial Sequence
  Synthetic
gcccaattggaaaagggcagcggattgacggcgaaccag

SEQ ID NO: 6857 - DNA, 37 bp, Artificial Sequence
  Synthetic
ccggcatccgcgccttgttcaaacggctgagccttgc

SEQ ID NO: 6858 - DNA, 38 bp, Artificial Sequence
  Synthetic
accgtccgaccatcgtgtttgctggagcgtcccgaacc

SEQ ID NO: 6859 - DNA, 41 bp, Artificial Sequence
  Synthetic
gacgagttccacgtcgttcgccacgcttttttgtgtttgcc

SEQ ID NO: 6860 - DNA, 36 bp, Artificial Sequence
  Synthetic
ggatgttgggcgcgggcattacggacgcggcgaaac

SEQ ID NO: 6861 - DNA, 37 bp, Artificial Sequence
  Synthetic
gcgtgtcgggcaggtaggttcacccaaatcggcttgg

SEQ ID NO: 6862 - DNA, 38 bp, Artificial Sequence
  Synthetic
gtctgtgcccacatcggtctgaccgcgcccctgaactt

SEQ ID NO: 6863 - DNA, 38 bp, Artificial Sequence
  Synthetic
cgggaacggctctggcaaccggcgacttcgggggattt

SEQ ID NO: 6864 - DNA, 35 bp, Artificial Sequence
  Synthetic
gacaaaggcgtgctggcggtctgccgcaaagccgc

SEQ ID NO: 6865 - DNA, 40 bp, Artificial Sequence
  Synthetic
atacgcttagggtgtctgatcgaaaccatacgcccaagac

SEQ ID NO: 6866 - DNA, 37 bp, Artificial Sequence
  Synthetic
aagggttcgtccaaaagcaggaaacgccagcgcatcg

SEQ ID NO: 6867 - DNA, 42 bp, Artificial Sequence
  Synthetic
aacgttgtgaaacggtttgcgcgaaggaattgtcgggcgaat

SEQ ID NO: 6868 - DNA, 38 bp, Artificial Sequence
  Synthetic
ggagttgccgcgttggaagttggctggtgaaacccctg

SEQ ID NO: 6869 - DNA, 44 bp, Artificial Sequence
  Synthetic
ttctgcggatgtttttctccgtaattaatccgcttatccttgat

SEQ ID NO: 6870 - DNA, 36 bp, Artificial Sequence
  Synthetic
ggacagccggttccggtcacaggaacgcgccgtcaa

SEQ ID NO: 6871 - DNA, 40 bp, Artificial Sequence
  Synthetic
tcatcttgttgctgatggcggaaccaagaaagcagcgacg

SEQ ID NO: 6872 - DNA, 39 bp, Artificial Sequence
  Synthetic
cggcaaccggcttcttcttccttgagcgccgagatttgg

SEQ ID NO: 6873 - DNA, 36 bp, Artificial Sequence
  Synthetic
ctgacggcgcggcattccttggcggagaacatcggc

SEQ ID NO: 6874 - DNA, 38 bp, Artificial Sequence
  Synthetic
tgcgagatgctgggaacggaaaccggtttccttgtccc

SEQ ID NO: 6875 - DNA, 41 bp, Artificial Sequence
  Synthetic
gcgtgaaaccaagacattcggcagccttttgtccaaaccgc

SEQ ID NO: 6876 - DNA, 38 bp, Artificial Sequence
  Synthetic
accgttattggcggatttggcgccttatacgccgccgc

SEQ ID NO: 6877 - DNA, 42 bp, Artificial Sequence
  Synthetic
ttggacaacgccctgaaggttgcctgtcgttgtgataggcaa

SEQ ID NO: 6878 - DNA, 38 bp, Artificial Sequence
  Synthetic
ggctgaaatcaggcggcgcgccaagcccaaatccgtct

SEQ ID NO: 6879 - DNA, 38 bp, Artificial Sequence
  Synthetic
tcgccgtcgccgtcagctagcagggaaacgtctctgcc

SEQ ID NO: 6880 - DNA, 39 bp, Artificial Sequence
  Synthetic
agggcaattcgacgatgttgatacaggcttgcagaactt

SEQ ID NO: 6881 - DNA, 38 bp, Artificial Sequence
  Synthetic
gaagcgaggtcaggcggcatccgggattcgaccgtgtt

SEQ ID NO: 6882 - DNA, 41 bp, Artificial Sequence
  Synthetic
agccgataatcaggcgtgttgccaggcattacgcgcaacaa

SEQ ID NO: 6883 - DNA, 35 bp, Artificial Sequence
  Synthetic
ggcgatggcggacggtatgcttgccggcaaccagc

SEQ ID NO: 6884 - DNA, 39 bp, Artificial Sequence
  Synthetic
gcacatttttcggggcgcatacgcctgtcttgactttcg

SEQ ID NO: 6885 - DNA, 36 bp, Artificial Sequence
  Synthetic
gtgattccggctgttcgcggtcagaaccggccgcac

SEQ ID NO: 6886 - DNA, 35 bp, Artificial Sequence
  Synthetic
tgccgaagcagaagccgaaaagcgataccggggcg

SEQ ID NO: 6887 - DNA, 37 bp, Artificial Sequence
  Synthetic
gcctcctggccgccgattaacacgatgcggtctttgc

SEQ ID NO: 6888 - DNA, 37 bp, Artificial Sequence
  Synthetic
taaggcttcgctgcgccagatatcgcggcggtttcag

SEQ ID NO: 6889 - DNA, 37 bp, Artificial Sequence
  Synthetic
agcaggaagccgcacaagccaatcaccgcgccgaaac

SEQ ID NO: 6890 - DNA, 34 bp, Artificial Sequence
  Synthetic
cggcgcgcgggtcaaaatttcaccgcaccgacgg

SEQ ID NO: 6891 - DNA, 40 bp, Artificial Sequence
  Synthetic
gctgcatgaggacgctctatgacgcccgtttaccgtgaat

SEQ ID NO: 6892 - DNA, 36 bp, Artificial Sequence
  Synthetic
gcaggacggtcaaggcacacgggtagggcaggcgaa

SEQ ID NO: 6893 - DNA, 38 bp, Artificial Sequence
  Synthetic
tgctgacattgtgctacgtcgacgcccttcagttcggc

SEQ ID NO: 6894 - DNA, 39 bp, Artificial Sequence
  Synthetic
aagcatcaacggcttggaggcccgccactttgccgtttg

SEQ ID NO: 6895 - DNA, 38 bp, Artificial Sequence
  Synthetic
tggtggacacgcagaaaaaccgccgccttgccgttgac

SEQ ID NO: 6896 - DNA, 37 bp, Artificial Sequence
  Synthetic
cgccgccctgccttgtgaagcttacaaccgcgcaacc

SEQ ID NO: 6897 - DNA, 40 bp, Artificial Sequence
  Synthetic
acatcgggcatttcttcccagctgtccgaccttttggcgg

SEQ ID NO: 6898 - DNA, 39 bp, Artificial Sequence
  Synthetic
atacggctgcatcgcggtctgccgacaacgaagaaaacg

SEQ ID NO: 6899 - DNA, 35 bp, Artificial Sequence
  Synthetic
cggaacgcctcaaagccgccggcggacgatttgcg

SEQ ID NO: 6900 - DNA, 38 bp, Artificial Sequence
  Synthetic
gtcaaatcgtggtttgacgggcacaacgacggccagcc

SEQ ID NO: 6901 - DNA, 36 bp, Artificial Sequence
  Synthetic
aaaagccgggcgcaaatcagtcgggtctttggccgc

SEQ ID NO: 6902 - DNA, 39 bp, Artificial Sequence
  Synthetic
ccaaatgggcgaattggggcgcgcgtttgccctcgttct

SEQ ID NO: 6903 - DNA, 34 bp, Artificial Sequence
  Synthetic
gcggcggcggttctcaaaatgtcccagccgcctg

SEQ ID NO: 6904 - DNA, 34 bp, Artificial Sequence
  Synthetic
gcgcggcacttcgaccaatccccctgcccggttt

SEQ ID NO: 6905 - DNA, 35 bp, Artificial Sequence
  Synthetic
atgcgcgcggatgtttggcgcctggcgggttttgc

SEQ ID NO: 6906 - DNA, 36 bp, Artificial Sequence
  Synthetic
attgtccgaccatacgcccgtgctcagcacggggac

SEQ ID NO: 6907 - DNA, 44 bp, Artificial Sequence
  Synthetic
gagttcctgttgtcgctatttgcattttcaaatggtagggaagg

SEQ ID NO: 6908 - DNA, 44 bp, Artificial Sequence
  Synthetic
gcgaagagcggaaaatcaaacaccttgatttctttggaaatctc

SEQ ID NO: 6909 - DNA, 40 bp, Artificial Sequence
  Synthetic
tcccgggtagcagccttttttgcgcccaaatgctcaacca

SEQ ID NO: 6910 - DNA, 40 bp, Artificial Sequence
  Synthetic
aaatgccccgatggtgcaggtttacctccgaatgcgtctc

SEQ ID NO: 6911 - DNA, 40 bp, Artificial Sequence
  Synthetic
ctgttcggcagccgtttcacccgggcggcttgattttcct

SEQ ID NO: 6912 - DNA, 37 bp, Artificial Sequence
  Synthetic
gcgcgatgtccatccgcagccgaatttctgcccttcg

SEQ ID NO: 6913 - DNA, 35 bp, Artificial Sequence
  Synthetic
cccgccccgatcccttctatgctcgggcggtatcc

SEQ ID NO: 6914 - DNA, 35 bp, Artificial Sequence
  Synthetic
atttggccgatgcgctgcaaactgttccccgccgc

SEQ ID NO: 6915 - DNA, 40 bp, Artificial Sequence
  Synthetic
gttggcgatgacttcgttggtgtccgacgtgtatcagggc

SEQ ID NO: 6916 - DNA, 40 bp, Artificial Sequence
  Synthetic
cgcattaatgccgtttatgccagagaccgacaaaaatgcc

SEQ ID NO: 6917 - DNA, 41 bp, Artificial Sequence
  Synthetic
tggttttgccgatgtctgccggatcggtgaagtctgccttg

SEQ ID NO: 6918 - DNA, 35 bp, Artificial Sequence
  Synthetic
gcagtaccgcccagcaggacgacttggcttgggcg

SEQ ID NO: 6919 - DNA, 39 bp, Artificial Sequence
  Synthetic
ggtggtgcagcctgccgaacgcagcagttctttaccgta

SEQ ID NO: 6920 - DNA, 36 bp, Artificial Sequence
  Synthetic
tgtggacgacgtaaccgcgcatgcagcacgacagcg

SEQ ID NO: 6921 - DNA, 40 bp, Artificial Sequence
  Synthetic
tccgccaccaaaaacctgatgacgtaaatggcggacacgg

SEQ ID NO: 6922 - DNA, 38 bp, Artificial Sequence
  Synthetic
atttggacttcaaacgcggcagttcggcggggtacacg

SEQ ID NO: 6923 - DNA, 38 bp, Artificial Sequence
  Synthetic
tcaaaccataggccgcgccttgtcggcgtacaggatgg

SEQ ID NO: 6924 - DNA, 35 bp, Artificial Sequence
  Synthetic
cgaagctgacgttggcggcaccgtggcgatggtcg

SEQ ID NO: 6925 - DNA, 38 bp, Artificial Sequence
  Synthetic
ttgcccatgccgaccataatcggattgcctgcccgtgc

SEQ ID NO: 6926 - DNA, 40 bp, Artificial Sequence
  Synthetic
tcttcgggattggattcgccggtatcgaaagcggcagcgg

SEQ ID NO: 6927 - DNA, 38 bp, Artificial Sequence
  Synthetic
aatcgttgctgccggcatcgttcagaggaccgttcggc

SEQ ID NO: 6928 - DNA, 38 bp, Artificial Sequence
  Synthetic
agccgcagtggattaagaagggtgtcgagctgggtcgg

SEQ ID NO: 6929 - DNA, 36 bp, Artificial Sequence
  Synthetic
tgctccccgaacgcgctttggacggtatggacgggc

SEQ ID NO: 6930 - DNA, 38 bp, Artificial Sequence
  Synthetic
acataaagccggcggcaaacaactccgtcggcgaatgg

SEQ ID NO: 6931 - DNA, 39 bp, Artificial Sequence
  Synthetic
gagcaggcggtatggtcggcgatttccccaacagccacg

SEQ ID NO: 6932 - DNA, 41 bp, Artificial Sequence
  Synthetic
tccagcatcacatactcgaaagtcatgccaacgctatctgg

SEQ ID NO: 6933 - DNA, 39 bp, Artificial Sequence
  Synthetic
acgaagttttggtcgattgcccaagaaatgaacccgggt

SEQ ID NO: 6934 - DNA, 38 bp, Artificial Sequence
  Synthetic
gcaagggcgggttcggtaagcaagaaaccgtccgtacg

SEQ ID NO: 6935 - DNA, 38 bp, Artificial Sequence
  Synthetic
ggttttggcggcaggcgtataactacctcaacgccgca

SEQ ID NO: 6936 - DNA, 40 bp, Artificial Sequence
  Synthetic
tttggcggctttggatatcggaacaccgttcggatgttcg

SEQ ID NO: 6937 - DNA, 36 bp, Artificial Sequence
  Synthetic
aatcctgcatggcgagggtgacgcctcgacgccatc

SEQ ID NO: 6938 - DNA, 35 bp, Artificial Sequence
  Synthetic
ggcgagtacggcgacctgtaccgaagtcgccctgc

SEQ ID NO: 6939 - DNA, 40 bp, Artificial Sequence
  Synthetic
cgctttcatgcgcctgaccggctttatgtgcctgtttcgc

SEQ ID NO: 6940 - DNA, 37 bp, Artificial Sequence
  Synthetic
tccgccgcgccgcttttacaggatttggtgtcggagc

SEQ ID NO: 6941 - DNA, 35 bp, Artificial Sequence
  Synthetic
ggcccggggcgcatgattttcaacctgcgccaacg

SEQ ID NO: 6942 - DNA, 33 bp, Artificial Sequence
  Synthetic
ttgttcgaccgccgcgtcagcaaccgcctgacc

SEQ ID NO: 6943 - DNA, 37 bp, Artificial Sequence
  Synthetic
ggttcgatggcttcggatgccgccgatgcgcgtttgc

SEQ ID NO: 6944 - DNA, 36 bp, Artificial Sequence
  Synthetic
ggacgagccgttgacgagccgaacacgagccgcttg

SEQ ID NO: 6945 - DNA, 37 bp, Artificial Sequence
  Synthetic
caagcgcgcgcaggacgtaccgtatccagcggatccg

SEQ ID NO: 6946 - DNA, 36 bp, Artificial Sequence
  Synthetic
gcttcgccgaagcagacgggggcataccggcgtgct

SEQ ID NO: 6947 - DNA, 45 bp, Artificial Sequence
  Synthetic
aatttgcaggttatcactatgtgcagccagaatgaacaatctgat

SEQ ID NO: 6948 - DNA, 35 bp, Artificial Sequence
  Synthetic
ggcgaaaaaggcgctggcgtttcgggtggcgcagg

SEQ ID NO: 6949 - DNA, 37 bp, Artificial Sequence
  Synthetic
gacgttgtgcaaggtttccgggatggcgtgtgcggtc

SEQ ID NO: 6950 - DNA, 34 bp, Artificial Sequence
  Synthetic
cagtccgcacgccccaattttgcacggaggctgc

SEQ ID NO: 6951 - DNA, 37 bp, Artificial Sequence
  Synthetic
actttggtggcgacgacttcgtcccgtttcggcgtgc

SEQ ID NO: 6952 - DNA, 35 bp, Artificial Sequence
  Synthetic
gcgcccgaaatccccgtcagaaactcgctgcccgc

SEQ ID NO: 6953 - DNA, 39 bp, Artificial Sequence
  Synthetic
cgccatcgaagcctgcacgcgtgaaatcggtttcgtgtc

SEQ ID NO: 6954 - DNA, 39 bp, Artificial Sequence
  Synthetic
acctgaaagacctgttcggcacaccaggccagcaggatg

SEQ ID NO: 6955 - DNA, 40 bp, Artificial Sequence
  Synthetic
gcattggccgtcataccgctaggtcgagtgctttgacaaa

SEQ ID NO: 6956 - DNA, 39 bp, Artificial Sequence
  Synthetic
aaaaccgtgttggagctcggcttccaaatcggcatcggg

SEQ ID NO: 6957 - DNA, 42 bp, Artificial Sequence
  Synthetic
ccctgcgacggttttagacaggggggccgaatacttcttctc

SEQ ID NO: 6958 - DNA, 40 bp, Artificial Sequence
  Synthetic
cgatacgttcggggtggatgttttgccaacctcaaaccgc

SEQ ID NO: 6959 - DNA, 38 bp, Artificial Sequence
  Synthetic
ttgcgacgtatgcaccagctcacgctgacggacaaagc

SEQ ID NO: 6960 - DNA, 37 bp, Artificial Sequence
  Synthetic
gcgcaggcgatggtggtgtcaacgccgaaatcgtcgc

SEQ ID NO: 6961 - DNA, 44 bp, Artificial Sequence
  Synthetic
ttgctggaatctaaatcggctgcagacccttgttttttattccc

SEQ ID NO: 6962 - DNA, 38 bp, Artificial Sequence
  Synthetic
tgtgaatgtttcgccgcccgatcggctctccatcgacc

SEQ ID NO: 6963 - DNA, 38 bp, Artificial Sequence
  Synthetic
gggcgataatggcgcggaagtcttcacgcgaacatgcc

SEQ ID NO: 6964 - DNA, 40 bp, Artificial Sequence
  Synthetic
gcactttgccgccgatgttttcgaaccgcaagttacttgg

SEQ ID NO: 6965 - DNA, 36 bp, Artificial Sequence
  Synthetic
gcgaatcgccgcagacgatatggggcccgaacaagg

SEQ ID NO: 6966 - DNA, 39 bp, Artificial Sequence
  Synthetic
tattgcaggagttcggcagcttatgccgacagtttgccg

SEQ ID NO: 6967 - DNA, 36 bp, Artificial Sequence
  Synthetic
tccgcaccgcaaatcagggtgtgcggatgcggttga

SEQ ID NO: 6968 - DNA, 40 bp, Artificial Sequence
  Synthetic
acgaagcagtgctgatgctcactgttcgatcagccagacg

SEQ ID NO: 6969 - DNA, 36 bp, Artificial Sequence
  Synthetic
acagcctcgccaccaacgcacagcagcatcgcgatg

SEQ ID NO: 6970 - DNA, 38 bp, Artificial Sequence
  Synthetic
cgttggcgcggattttggcgaacacggcggaaacaggc

SEQ ID NO: 6971 - DNA, 38 bp, Artificial Sequence
  Synthetic
gccgtttcgacaaaggcggccacggatttgtgcagggc

SEQ ID NO: 6972 - DNA, 40 bp, Artificial Sequence
  Synthetic
aaacgccagcgacgaagtgcttccttcatcagcttggtcg

SEQ ID NO: 6973 - DNA, 39 bp, Artificial Sequence
  Synthetic
gcagcgaccaggaatggcgacgaacccttcagcgtgatg

SEQ ID NO: 6974 - DNA, 35 bp, Artificial Sequence
  Synthetic
agcccgttcatttgcgccacggcgtactcgtccgt

SEQ ID NO: 6975 - DNA, 40 bp, Artificial Sequence
  Synthetic
gcctgaacaatcaaaatggcgattgctgaccatcgtgaat

SEQ ID NO: 6976 - DNA, 41 bp, Artificial Sequence
  Synthetic
tatcggcttcactattggcagctgttcgttgctttgggatt

SEQ ID NO: 6977 - DNA, 40 bp, Artificial Sequence
  Synthetic
tgtacggcaaaggagacggctgtaatcgccgaaacggtct

SEQ ID NO: 6978 - DNA, 38 bp, Artificial Sequence
  Synthetic
cggcggcaagcgtctgaatgttggactactatccgcgt

SEQ ID NO: 6979 - DNA, 41 bp, Artificial Sequence
  Synthetic
accgtattcattgcaggtgccgatacagttgggcggtcaac

SEQ ID NO: 6980 - DNA, 38 bp, Artificial Sequence
  Synthetic
aaagccagttggacttcgccccgcaacagcggcattcc

SEQ ID NO: 6981 - DNA, 40 bp, Artificial Sequence
  Synthetic
acttctcggacgttccattcgggcttcgactccgttaccg

SEQ ID NO: 6982 - DNA, 36 bp, Artificial Sequence
  Synthetic
gtcggtcagcagcgccactactgaccccgcctttgg

SEQ ID NO: 6983 - DNA, 40 bp, Artificial Sequence
  Synthetic
acacgatggcgggtgcttcggtggttaaagtgtcagccgt

SEQ ID NO: 6984 - DNA, 38 bp, Artificial Sequence
  Synthetic
acagtaatgcgcttcagacggctttctgccccgccctc

SEQ ID NO: 6985 - DNA, 41 bp, Artificial Sequence
  Synthetic
gcaactgcgcgacgtattgtcttggaggcgatgatgaacag

SEQ ID NO: 6986 - DNA, 39 bp, Artificial Sequence
  Synthetic
cctgcttgccaacgtctttgccttcgtcgggggttttgc

SEQ ID NO: 6987 - DNA, 36 bp, Artificial Sequence
  Synthetic
gcaggattggcggggcatgcaatccgaccgaaaccg

SEQ ID NO: 6988 - DNA, 40 bp, Artificial Sequence
  Synthetic
ttcgccgtgggactttatccggctgtgcatcaaagccgcc

SEQ ID NO: 6989 - DNA, 38 bp, Artificial Sequence
  Synthetic
tttctgcgtcggtcattggggttccgagcacacccacc

SEQ ID NO: 6990 - DNA, 38 bp, Artificial Sequence
  Synthetic
ccccaaagccgaaatcgaaggcctcatcaggcgcgcct

SEQ ID NO: 6991 - DNA, 35 bp, Artificial Sequence
  Synthetic
ttcgcgggaatgacggtcgaagatctgccccccgg

SEQ ID NO: 6992 - DNA, 37 bp, Artificial Sequence
  Synthetic
ggtgcagcctgccttcgtagtcggtcaggaacacgtc

SEQ ID NO: 6993 - DNA, 39 bp, Artificial Sequence
  Synthetic
acgagttggtgtacttgccggaacgtccacccgaccaaa

SEQ ID NO: 6994 - DNA, 39 bp, Artificial Sequence
  Synthetic
tgtcgcggacaaaacgatggtccgactttcgccaaaggc

SEQ ID NO: 6995 - DNA, 40 bp, Artificial Sequence
  Synthetic
acgatttgcagttggcggcgagatacggcatatcgcaagg

SEQ ID NO: 6996 - DNA, 38 bp, Artificial Sequence
  Synthetic
cggctgcgtttggcgactacaactgttgcagctcgata

SEQ ID NO: 6997 - DNA, 37 bp, Artificial Sequence
  Synthetic
ttttccccgagcgcggcattcgaagccgccaatcagg

SEQ ID NO: 6998 - DNA, 39 bp, Artificial Sequence
  Synthetic
tcttcggcgatttcaaagccgttcccgtccgcatccttc

SEQ ID NO: 6999 - DNA, 40 bp, Artificial Sequence
  Synthetic
gggcattgtttgaccggtttcctttcgacccgagcattcg

SEQ ID NO: 7000 - DNA, 40 bp, Artificial Sequence
  Synthetic
gcttaagcccgcaacaaaaagacttggtcagtttgccttt

SEQ ID NO: 7001 - DNA, 39 bp, Artificial Sequence
  Synthetic
gaagtcggcggcgaattgctggatcatgcctttacccgg

SEQ ID NO: 7002 - DNA, 38 bp, Artificial Sequence
  Synthetic
ccaaatgcggatggtgcggagacggaagagcaggttgc

SEQ ID NO: 7003 - DNA, 45 bp, Artificial Sequence
  Synthetic
agtgactgggttatcttcggcttgtagtatcagaggataaagtgt

SEQ ID NO: 7004 - DNA, 39 bp, Artificial Sequence
  Synthetic
gttgagaagcgttgacggctatgcggatatgacctcagt

SEQ ID NO: 7005 - DNA, 42 bp, Artificial Sequence
  Synthetic
tgaaagaatgtccaggcgatttcgaatttcctgatgcaaagt

SEQ ID NO: 7006 - DNA, 44 bp, Artificial Sequence
  Synthetic
cccgatgttcgtgattacggaggtatttttgtgcgatagacatc

SEQ ID NO: 7007 - DNA, 46 bp, Artificial Sequence
  Synthetic
aatatttcacgggcaataacttcccaagcagatgaagtagtgattg

SEQ ID NO: 7008 - DNA, 43 bp, Artificial Sequence
  Synthetic
cgattgaggcttcatcgtttttagggcaatctcggtgctgaat

SEQ ID NO: 7009 - DNA, 43 bp, Artificial Sequence
  Synthetic
tggaattctaggcagaatctcttgccttgacccagagcagttg

SEQ ID NO: 7010 - DNA, 44 bp, Artificial Sequence
  Synthetic
tggcacaaattccatatccgaacatcaaaaagaggtatcggaaa

SEQ ID NO: 7011 - DNA, 35 bp, Artificial Sequence
  Synthetic
ctgcgcgacatccacaccccaggttggccgccaag

SEQ ID NO: 7012 - DNA, 34 bp, Artificial Sequence
  Synthetic
acatcgccaaaggacgcggattggcgcgcgtctg

SEQ ID NO: 7013 - DNA, 39 bp, Artificial Sequence
  Synthetic
ccgctttggatttggttgccgtcgaacccggaccgatac

SEQ ID NO: 7014 - DNA, 35 bp, Artificial Sequence
  Synthetic
gcatccgcttctccggcgaaccgccgagcatgacg

SEQ ID NO: 7015 - DNA, 39 bp, Artificial Sequence
  Synthetic
gttctgccgaccgctacttccttcgatgccttcggggac

SEQ ID NO: 7016 - DNA, 36 bp, Artificial Sequence
  Synthetic
gttcggtcaccgtcgggcaacacttcggcggtcagc

SEQ ID NO: 7017 - DNA, 33 bp, Artificial Sequence
  Synthetic
gttggatgcgcccgtcgatcaggcgcgcgcaat

SEQ ID NO: 7018 - DNA, 39 bp, Artificial Sequence
  Synthetic
cgtggcaaacatccaacccgaccgccgattcgatcatgg

SEQ ID NO: 7019 - DNA, 38 bp, Artificial Sequence
  Synthetic
gtctgtccctgcccggcaaacaattctttgcggcctgc

SEQ ID NO: 7020 - DNA, 38 bp, Artificial Sequence
  Synthetic
agcatcctcaaattcaccggcctaccttcgacggcggc

SEQ ID NO: 7021 - DNA, 34 bp, Artificial Sequence
  Synthetic
gccgacacgttggcgcaattcgcccaccacccga

SEQ ID NO: 7022 - DNA, 35 bp, Artificial Sequence
  Synthetic
tccaagacccaggcgagcatactcggcgtggcagg

SEQ ID NO: 7023 - DNA, 42 bp, Artificial Sequence
  Synthetic
atcgccaactcctgcgtcttcccgggtgtacagttcggtcag

SEQ ID NO: 7024 - DNA, 36 bp, Artificial Sequence
  Synthetic
cccctgcccaaaacgaccggtcggcaccgtcttacg

SEQ ID NO: 7025 - DNA, 42 bp, Artificial Sequence
  Synthetic
gatcgccgaaatcgattccccaggacagatgacggaagagga

SEQ ID NO: 7026 - DNA, 40 bp, Artificial Sequence
  Synthetic
cgcgtgccgccatatcttcgaccatcacccaaatgctcaa

SEQ ID NO: 7027 - DNA, 40 bp, Artificial Sequence
  Synthetic
gcgggatgattttttccgccaaacgttacccccttgtcgc

SEQ ID NO: 7028 - DNA, 38 bp, Artificial Sequence
  Synthetic
tcgttgagcaggcgcaatacgacgccaggccaccaaag

SEQ ID NO: 7029 - DNA, 42 bp, Artificial Sequence
  Synthetic
aagcccaaaaagtcggactggtggtcgatttcgttcaacagc

SEQ ID NO: 7030 - DNA, 34 bp, Artificial Sequence
  Synthetic
tacttgccaccgcgccctacgtgttcgggcgtgc

SEQ ID NO: 7031 - DNA, 41 bp, Artificial Sequence
  Synthetic
ctcgaggttgcaaaagtcgcctggaaatcggggtgcgaaca

SEQ ID NO: 7032 - DNA, 40 bp, Artificial Sequence
  Synthetic
ttgatgaccgcctgccagtagcacttgcgtccgaactgcc

SEQ ID NO: 7033 - DNA, 39 bp, Artificial Sequence
  Synthetic
gatggatgcccgattcgtgcgtatcccgtgcagcccaat

SEQ ID NO: 7034 - DNA, 39 bp, Artificial Sequence
  Synthetic
ttttcgcaatcgcattgaccgctcgaagcgggttttgcc

SEQ ID NO: 7035 - DNA, 35 bp, Artificial Sequence
  Synthetic
gccatcgttgccgccctgatacggcttcggggtcg

SEQ ID NO: 7036 - DNA, 37 bp, Artificial Sequence
  Synthetic
gcaccggtctcttccgattggccgtcctgccgggtat

SEQ ID NO: 7037 - DNA, 40 bp, Artificial Sequence
  Synthetic
tgctttccaacatcctccccctgaggttgagcagccaacg

SEQ ID NO: 7038 - DNA, 40 bp, Artificial Sequence
  Synthetic
cgcacacgctgccatatcctgacattggaacttcctgcgg

SEQ ID NO: 7039 - DNA, 38 bp, Artificial Sequence
  Synthetic
tgcccttcattgccgttggggagggcggtttcgtcagt

SEQ ID NO: 7040 - DNA, 39 bp, Artificial Sequence
  Synthetic
gcagaaagtcggcgaataccgggttcggcaggcaggttt

SEQ ID NO: 7041 - DNA, 40 bp, Artificial Sequence
  Synthetic
tccgcctgtaccgaaatcaacgccatacccaatacgccgg

SEQ ID NO: 7042 - DNA, 40 bp, Artificial Sequence
  Synthetic
cgaaaccgacgctcgcgtatcgtcttcgggattagccaat

SEQ ID NO: 7043 - DNA, 44 bp, Artificial Sequence
  Synthetic
ttttccagacggcattttttgttttggtcattttgctggaagag

SEQ ID NO: 7044 - DNA, 38 bp, Artificial Sequence
  Synthetic
catccgcacccagttgcgcggtttgtttgctgccgagg

SEQ ID NO: 7045 - DNA, 44 bp, Artificial Sequence
  Synthetic
gtcagacatcgggaaatgcttttttcaaaagcagattggacaaa

SEQ ID NO: 7046 - DNA, 38 bp, Artificial Sequence
  Synthetic
tgcaaaccgcgccgtatcagaattgcgcgcttgcttca

SEQ ID NO: 7047 - DNA, 37 bp, Artificial Sequence
  Synthetic
gcgaaccggcgcaagaactatacttcggggttgcggg

SEQ ID NO: 7048 - DNA, 39 bp, Artificial Sequence
  Synthetic
gttgccaagcctaagccgttgcgcaatcggcggattcgg

SEQ ID NO: 7049 - DNA, 40 bp, Artificial Sequence
  Synthetic
tggcggcttcgactgtttcgcctttatgcacgccaccttt

SEQ ID NO: 7050 - DNA, 41 bp, Artificial Sequence
  Synthetic
agcatccccatcatccacaaccggggaagtagaacacggct

SEQ ID NO: 7051 - DNA, 41 bp, Artificial Sequence
  Synthetic
tcgcttcgatcacttcgggacgcggaattgctgaaacagga

SEQ ID NO: 7052 - DNA, 39 bp, Artificial Sequence
  Synthetic
ggattgccggcgccgatgtccgatatgaagcggcggata

SEQ ID NO: 7053 - DNA, 34 bp, Artificial Sequence
  Synthetic
cgcgccgtccaagccttttggcgagggtcatcgc

SEQ ID NO: 7054 - DNA, 37 bp, Artificial Sequence
  Synthetic
ggcttggatttgccggactgtgcacgacctccggcaa

SEQ ID NO: 7055 - DNA, 36 bp, Artificial Sequence
  Synthetic
cgagggtgcgctccatctgccgaaatgggcgtcgtc

SEQ ID NO: 7056 - DNA, 38 bp, Artificial Sequence
  Synthetic
gtagcggtcgaagtcgtgcggacctggacatcctcgcc

SEQ ID NO: 7057 - DNA, 41 bp, Artificial Sequence
  Synthetic
cgggggaagtcggtcaggtagcctgttcaaccccttcgtcc

SEQ ID NO: 7058 - DNA, 38 bp, Artificial Sequence
  Synthetic
tttgaccagcagcgaagacaggtcggcttcggcgcaag

SEQ ID NO: 7059 - DNA, 39 bp, Artificial Sequence
  Synthetic
cacggtccgcgtgatttggtaatcggcaggggaaatgtg

SEQ ID NO: 7060 - DNA, 44 bp, Artificial Sequence
  Synthetic
acaggctggttactttgtttttttgccatcgtgaccaaactgac

SEQ ID NO: 7061 - DNA, 37 bp, Artificial Sequence
  Synthetic
ggtcggtatgcaatgcgtggtcgcgtgggctgtatgc

SEQ ID NO: 7062 - DNA, 37 bp, Artificial Sequence
  Synthetic
ccccgatagccgaaaagcagctaccgaagccctgcgc

SEQ ID NO: 7063 - DNA, 38 bp, Artificial Sequence
  Synthetic
ggacagcccgaacacacccgttttcgggaatcagggcg

SEQ ID NO: 7064 - DNA, 36 bp, Artificial Sequence
  Synthetic
ttgccggaacatggctgctagatgcctgcgccgtag

SEQ ID NO: 7065 - DNA, 38 bp, Artificial Sequence
  Synthetic
tgggcaacgaaggcgacggacaccagcatgtcgcaatg

SEQ ID NO: 7066 - DNA, 41 bp, Artificial Sequence
  Synthetic
ctacaccctctccgtcgtcccggctttgaaatggcggtaca

SEQ ID NO: 7067 - DNA, 36 bp, Artificial Sequence
  Synthetic
atatgtgccgtgccgcgctgccggtcgttgagttcg

SEQ ID NO: 7068 - DNA, 40 bp, Artificial Sequence
  Synthetic
aaaggggcgaagtttacaggcttcgcgttgttgtaggttt

SEQ ID NO: 7069 - DNA, 36 bp, Artificial Sequence
  Synthetic
ttggtttcgccgctcatggcaaagcccgcgccgaag

SEQ ID NO: 7070 - DNA, 36 bp, Artificial Sequence
  Synthetic
cgctcggcggcatccaaagaaagttacgaggccgcc

SEQ ID NO: 7071 - DNA, 35 bp, Artificial Sequence
  Synthetic
tcacaggcacacgtctgcgaaagcctcgaccgccc

SEQ ID NO: 7072 - DNA, 39 bp, Artificial Sequence
  Synthetic
cgtgggcttacctgccgctcgatgtaaacctcgggcagc

SEQ ID NO: 7073 - DNA, 40 bp, Artificial Sequence
  Synthetic
ttcagacggcattttcggcacaatttctggtggcggcttg

SEQ ID NO: 7074 - DNA, 41 bp, Artificial Sequence
  Synthetic
tacctcgccaaaaaactcggcaggcttggaggaattcgtgc

SEQ ID NO: 7075 - DNA, 41 bp, Artificial Sequence
  Synthetic
ggtcggtatggatgccttcctgagcccgtcaaagagtttgg

SEQ ID NO: 7076 - DNA, 42 bp, Artificial Sequence
  Synthetic
accaacaacagcaccttcctcgcgttctaggttcgggtatgc

SEQ ID NO: 7077 - DNA, 41 bp, Artificial Sequence
  Synthetic
atctggcgaaggaaatgcacgtgcgaaatactgtcgccgat

SEQ ID NO: 7078 - DNA, 41 bp, Artificial Sequence
  Synthetic
gcttgcccgattttgaaagccgggtgagttttgccagttgc

SEQ ID NO: 7079 - DNA, 36 bp, Artificial Sequence
  Synthetic
ccgcccgcccgattgtcaaaaggcagggcgatcagc

SEQ ID NO: 7080 - DNA, 42 bp, Artificial Sequence
  Synthetic
tcgagtacgccggtgattttgtgtccacggcttgaatatcga

SEQ ID NO: 7081 - DNA, 45 bp, Artificial Sequence
  Synthetic
aattcgactgctttttcggcgggataaaaatatgacgacacaaga

SEQ ID NO: 7082 - DNA, 42 bp, Artificial Sequence
  Synthetic
tccaacagttttgccacaccgtgtggaaaaacggtggacaga

SEQ ID NO: 7083 - DNA, 42 bp, Artificial Sequence
  Synthetic
agcccagtatgacaatttgctgtgctgattatctgccgtaaa

SEQ ID NO: 7084 - DNA, 40 bp, Artificial Sequence
  Synthetic
tgcccaagcacccaaatcatatttgttttgccgtgatgtg

SEQ ID NO: 7085 - DNA, 40 bp, Artificial Sequence
  Synthetic
cacgccaatgacgcgcaatctttcggattctttcgccagt

SEQ ID NO: 7086 - DNA, 39 bp, Artificial Sequence
  Synthetic
gcaaaattccgcgcattaagcatgattttcaggctgcct

SEQ ID NO: 7087 - DNA, 41 bp, Artificial Sequence
  Synthetic
gcctataccgaaaaatggcgcgaaaccattctgtgcgctcg

SEQ ID NO: 7088 - DNA, 38 bp, Artificial Sequence
  Synthetic
gtttgatgccgttttgtgcgtgattatttacgcggcgg

SEQ ID NO: 7089 - DNA, 38 bp, Artificial Sequence
  Synthetic
gcaaacaacaacactcgggcctgcccattgtgcatagg

SEQ ID NO: 7090 - DNA, 43 bp, Artificial Sequence
  Synthetic
cgaaatttttcatggtaaacgagcggataccgcaatggctttg

SEQ ID NO: 7091 - DNA, 39 bp, Artificial Sequence
  Synthetic
gtccgaagacggcggcttcacaacagccgaagccgtaag

SEQ ID NO: 7092 - DNA, 39 bp, Artificial Sequence
  Synthetic
ggtacgcaaccgaacagctctgttggctatgactgcccg

SEQ ID NO: 7093 - DNA, 47 bp, Artificial Sequence
  Synthetic
accgttcaaataaatcgctctacatgattagacccaacatgagtttg

SEQ ID NO: 7094 - DNA, 43 bp, Artificial Sequence
  Synthetic
ctgggcaaactggaaaaacggatatattatgctgacgcccaaa

SEQ ID NO: 7095 - DNA, 33 bp, Artificial Sequence
  Synthetic
cggcaaaggcgtgcacgtaatgcctgcgtcgcg

SEQ ID NO: 7096 - DNA, 36 bp, Artificial Sequence
  Synthetic
cgcctgcgcgttgtgaatcgccctgcaacactacgc

SEQ ID NO: 7097 - DNA, 41 bp, Artificial Sequence
  Synthetic
aaacggtttttctttggcttcggggataaaaccgcctacgc

SEQ ID NO: 7098 - DNA, 40 bp, Artificial Sequence
  Synthetic
gcggctgccgtacaatcaaaatgatatgtcgggcggcatc

SEQ ID NO: 7099 - DNA, 34 bp, Artificial Sequence
  Synthetic
gcatcagccttgccacgcttgcgcgtcggcttga

SEQ ID NO: 7100 - DNA, 40 bp, Artificial Sequence
  Synthetic
caggcagtgtcggtcatcctcactcttccagcctgccctc

SEQ ID NO: 7101 - DNA, 37 bp, Artificial Sequence
  Synthetic
tccaggcgtccccagttgtcatcacgcccaacctgac

SEQ ID NO: 7102 - DNA, 37 bp, Artificial Sequence
  Synthetic
acgttcgacggcggcttgtgcatcaaaagtcctgcgg

SEQ ID NO: 7103 - DNA, 39 bp, Artificial Sequence
  Synthetic
ttcagcttcggatggaaaaggacgttttttgctggcatc

SEQ ID NO: 7104 - DNA, 39 bp, Artificial Sequence
  Synthetic
catacggcgcatcgttggcggcgccggtttacaatcctt

SEQ ID NO: 7105 - DNA, 40 bp, Artificial Sequence
  Synthetic
cccgcctttccgacaacgagaacagtatgcccaactgcaa

SEQ ID NO: 7106 - DNA, 39 bp, Artificial Sequence
  Synthetic
tgtggcgaaaagctccatcggaatcgcccaagtgagctg

SEQ ID NO: 7107 - DNA, 38 bp, Artificial Sequence
  Synthetic
gggctgctggatgcgggtaaaagtcgccgaacggaaag

SEQ ID NO: 7108 - DNA, 37 bp, Artificial Sequence
  Synthetic
cgcccgccggtctgaaacatccagctcgaccatcagg

SEQ ID NO: 7109 - DNA, 41 bp, Artificial Sequence
  Synthetic
acggtggaacgtgggaacagggatagtttgggtactgccgc

SEQ ID NO: 7110 - DNA, 37 bp, Artificial Sequence
  Synthetic
aagcaacagcatccgccgcgcgtgatgtcgaaaccga

SEQ ID NO: 7111 - DNA, 39 bp, Artificial Sequence
  Synthetic
tccccgataccgatgccgtctgtaaacggcaggtgcatc

SEQ ID NO: 7112 - DNA, 39 bp, Artificial Sequence
  Synthetic
aaacggttgcccaaaccccgcaaccgaaccgtcattccc

SEQ ID NO: 7113 - DNA, 38 bp, Artificial Sequence
  Synthetic
tctgctcgccaaagtcaaagccacgcggatgtcgaggc

SEQ ID NO: 7114 - DNA, 40 bp, Artificial Sequence
  Synthetic
aacatctggcgcaaaaaaccggcggcatccaaagtgtcgg

SEQ ID NO: 7115 - DNA, 40 bp, Artificial Sequence
  Synthetic
cgaagtgttggacgcaccgctaaagagttgccgtcgatgg

SEQ ID NO: 7116 - DNA, 38 bp, Artificial Sequence
  Synthetic
ttttccacgcgtttgcccgggctgcggcaaagttgttg

SEQ ID NO: 7117 - DNA, 38 bp, Artificial Sequence
  Synthetic
cgacatccacggcaaagcgctgtggaaacgctcgtcgg

SEQ ID NO: 7118 - DNA, 37 bp, Artificial Sequence
  Synthetic
attcacacgcaaacccgcctgacaacacggcggaagg

SEQ ID NO: 7119 - DNA, 41 bp, Artificial Sequence
  Synthetic
agtgtccgccaacatattgcgcggcagtgacgacgatgacc

SEQ ID NO: 7120 - DNA, 39 bp, Artificial Sequence
  Synthetic
ccccgcccgtttcgccaaaggagaagtttaaccgccagg

SEQ ID NO: 7121 - DNA, 39 bp, Artificial Sequence
  Synthetic
accattgccgtctgcgacacggctttttgtggatgatgg

SEQ ID NO: 7122 - DNA, 37 bp, Artificial Sequence
  Synthetic
cgaaaccttaaaccccggcccgcgaggcggagaagct

SEQ ID NO: 7123 - DNA, 37 bp, Artificial Sequence
  Synthetic
tgtcaaaacgctccttcaggcgaacggttggcgcgtg

SEQ ID NO: 7124 - DNA, 34 bp, Artificial Sequence
  Synthetic
gcatccgcgccgaagagtcggcggcgttttggac

SEQ ID NO: 7125 - DNA, 35 bp, Artificial Sequence
  Synthetic
catctgcgccttgtccggcaggcggactggcggaa

SEQ ID NO: 7126 - DNA, 39 bp, Artificial Sequence
  Synthetic
cctgcggattcaataccggcaggaaacgtgcgcctgttg

SEQ ID NO: 7127 - DNA, 36 bp, Artificial Sequence
  Synthetic
cggccgattccgccaaaccggattatgcgccgggag

SEQ ID NO: 7128 - DNA, 39 bp, Artificial Sequence
  Synthetic
cccattccccgtttgccagcggaatcggccggtgagttt

SEQ ID NO: 7129 - DNA, 41 bp, Artificial Sequence
  Synthetic
gctgggcacgtcttccaaagccggcaaggcttatttgtcca

SEQ ID NO: 7130 - DNA, 34 bp, Artificial Sequence
  Synthetic
gccagttcgcgcgtggttttcggggcgcaacacc

SEQ ID NO: 7131 - DNA, 38 bp, Artificial Sequence
  Synthetic
gcctttggcggctttgcgttgggatttcatcggacagg

SEQ ID NO: 7132 - DNA, 34 bp, Artificial Sequence
  Synthetic
gtgtgcggcgcggatgtacggaaaaacgcgcggc

SEQ ID NO: 7133 - DNA, 37 bp, Artificial Sequence
  Synthetic
gcgtttttccagcgcgtcgacgaaatggcggcatacg

SEQ ID NO: 7134 - DNA, 40 bp, Artificial Sequence
  Synthetic
gatcctacacgccgcgaacctccgaaagctccttgtccgc

SEQ ID NO: 7135 - DNA, 42 bp, Artificial Sequence
  Synthetic
gactcggaagacgtcatccggcggtccagttgaagcagctga

SEQ ID NO: 7136 - DNA, 42 bp, Artificial Sequence
  Synthetic
aacttgaagcggcaatgagggccctgacgcagatagacgatg

SEQ ID NO: 7137 - DNA, 37 bp, Artificial Sequence
  Synthetic
cggctgtgcgtgaggtgctcaagtaatcccgcgtccc

SEQ ID NO: 7138 - DNA, 38 bp, Artificial Sequence
  Synthetic
tcaacgcctttcaccagctctcctccgcgatatagggt

SEQ ID NO: 7139 - DNA, 37 bp, Artificial Sequence
  Synthetic
gtccaccaccaagagcgcggccgacttggaagccttg

SEQ ID NO: 7140 - DNA, 38 bp, Artificial Sequence
  Synthetic
ggcgagcgtttgcggatgaatgccgaacggacaaaacc

SEQ ID NO: 7141 - DNA, 40 bp, Artificial Sequence
  Synthetic
atgtgtgccgaaaacaaccgcttgaggaagacggttgcga

SEQ ID NO: 7142 - DNA, 35 bp, Artificial Sequence
  Synthetic
cttccgtcctcgccgatcctgtggatgacggcggg

SEQ ID NO: 7143 - DNA, 35 bp, Artificial Sequence
  Synthetic
cgaagccctgcgcctcgaaaccgcccaagccttgc

SEQ ID NO: 7144 - DNA, 35 bp, Artificial Sequence
  Synthetic
tttgcagacgaccgcgtgctccgacaagcagcccg

SEQ ID NO: 7145 - DNA, 36 bp, Artificial Sequence
  Synthetic
aaatcctgtttgccgccgccttggggcgcaattcgg

SEQ ID NO: 7146 - DNA, 35 bp, Artificial Sequence
  Synthetic
tttggccttggctgccgatccgccgaaacagcttg

SEQ ID NO: 7147 - DNA, 38 bp, Artificial Sequence
  Synthetic
cgctacggcagccgcgaaagcggttgttggtggtttgc

SEQ ID NO: 7148 - DNA, 39 bp, Artificial Sequence
  Synthetic
tgccggtatggtttcaagacgaaagagcagacggagaag

SEQ ID NO: 7149 - DNA, 41 bp, Artificial Sequence
  Synthetic
cctctcgtactaggagcagccccgtgagacagtttggtccc

SEQ ID NO: 7150 - DNA, 36 bp, Artificial Sequence
  Synthetic
gcggggccctcgaaaacctccgcacggttaccaacc

SEQ ID NO: 7151 - DNA, 42 bp, Artificial Sequence
  Synthetic
agcacaaaaatcttgccgtcgcgcgattgacgtgattgtcga

SEQ ID NO: 7152 - DNA, 39 bp, Artificial Sequence
  Synthetic
gacgggcaaaggttcgcgtgttgaggttggacacggtaa

SEQ ID NO: 7153 - DNA, 41 bp, Artificial Sequence
  Synthetic
atctccatccacgacgtgggcgcatcgttgaccaattcagg

SEQ ID NO: 7154 - DNA, 41 bp, Artificial Sequence
  Synthetic
cggcaaataccaaacccccgtcgataggtgttgaagcccat

SEQ ID NO: 7155 - DNA, 39 bp, Artificial Sequence
  Synthetic
aatggccgccgccttcaccaggtcggacatatgcacgtc

SEQ ID NO: 7156 - DNA, 38 bp, Artificial Sequence
  Synthetic
ccctgccttgcgcgaccaacccaatgtcagcgtgttcg

SEQ ID NO: 7157 - DNA, 37 bp, Artificial Sequence
  Synthetic
tctcgctcgcgtccaaatctgatgccgccgatggagc

SEQ ID NO: 7158 - DNA, 36 bp, Artificial Sequence
  Synthetic
ccgtgggtatgtcgctcggctgcgttcgagcgaggc

SEQ ID NO: 7159 - DNA, 37 bp, Artificial Sequence
  Synthetic
caccgtcggtgcagtcttcatttggcgatgtggacgg

SEQ ID NO: 7160 - DNA, 39 bp, Artificial Sequence
  Synthetic
ctacgaagcccccgtcggagcccaatagctgaatacggt

SEQ ID NO: 7161 - DNA, 35 bp, Artificial Sequence
  Synthetic
cgttcaggctgcccgaacacttgtccgccgtcgtc

SEQ ID NO: 7162 - DNA, 40 bp, Artificial Sequence
  Synthetic
agaacaaatcaaacgcgcccgcctgcaggtagcggctgag

SEQ ID NO: 7163 - DNA, 36 bp, Artificial Sequence
  Synthetic
cgcaccccgtgggcacaatgcgcagggtcatggctt

SEQ ID NO: 7164 - DNA, 46 bp, Artificial Sequence
  Synthetic
catgcagatatgcagattctgacaaaggtttagatcagttttcgga

SEQ ID NO: 7165 - DNA, 40 bp, Artificial Sequence
  Synthetic
tatcgagttgcgccaccaaccccaaatattgcacgcccca

SEQ ID NO: 7166 - DNA, 40 bp, Artificial Sequence
  Synthetic
tcaaccaatccgtttacgcccataaagctgcggcccattt

SEQ ID NO: 7167 - DNA, 38 bp, Artificial Sequence
  Synthetic
ttttggacgaaccctccatcggtgagggtggcgagcag

SEQ ID NO: 7168 - DNA, 41 bp, Artificial Sequence
  Synthetic
gcgacggcgtgattaaagtcgaagacttcgcaggggacgta

SEQ ID NO: 7169 - DNA, 38 bp, Artificial Sequence
  Synthetic
acgccgtacgccgaaacaggccgatgaggttttcgagg

SEQ ID NO: 7170 - DNA, 36 bp, Artificial Sequence
  Synthetic
aacgcatcgtgccgcccatgacgaatggcaaaccgc

SEQ ID NO: 7171 - DNA, 40 bp, Artificial Sequence
  Synthetic
agctgcaactgctcggtaatgacgaatgccccgaaatgct

SEQ ID NO: 7172 - DNA, 38 bp, Artificial Sequence
  Synthetic
ccgccagattgccgcgtgttcgtcccctatgctttggc

SEQ ID NO: 7173 - DNA, 39 bp, Artificial Sequence
  Synthetic
tggggtctttttcggtcaggcatcgtcaaaccgctcgac

SEQ ID NO: 7174 - DNA, 42 bp, Artificial Sequence
  Synthetic
tgtccgtcgggattttggtgtcatgcgctcttctctgctttg

SEQ ID NO: 7175 - DNA, 39 bp, Artificial Sequence
  Synthetic
atgaccccgcttttgctggtagcgggtcaatacggtcag

SEQ ID NO: 7176 - DNA, 39 bp, Artificial Sequence
  Synthetic
cttggtcgagctgcttgccctttgactttggcggcatcg

SEQ ID NO: 7177 - DNA, 37 bp, Artificial Sequence
  Synthetic
caggttcaggcttggtcgcttcgggcatatcgagcgg

SEQ ID NO: 7178 - DNA, 38 bp, Artificial Sequence
  Synthetic
cgcgaaagagttgtccgacgaattccatacgcgcgccg

SEQ ID NO: 7179 - DNA, 40 bp, Artificial Sequence
  Synthetic
ctgcggaaaatgcggcaaagcgccgatgtcttccttacgc

SEQ ID NO: 7180 - DNA, 37 bp, Artificial Sequence
  Synthetic
ggcacgacacccgccgattttcgtcgtgttcggcctg

SEQ ID NO: 7181 - DNA, 40 bp, Artificial Sequence
  Synthetic
ctcgatgcgatggaaagccccgccattcccgcatcagggc

SEQ ID NO: 7182 - DNA, 40 bp, Artificial Sequence
  Synthetic
ccgtcctcgaagccgtcaggggttgttcgggtaggcgata

SEQ ID NO: 7183 - DNA, 38 bp, Artificial Sequence
  Synthetic
cactcggcgacaaaaaaggcatagggcttcgtcgagcg

SEQ ID NO: 7184 - DNA, 40 bp, Artificial Sequence
  Synthetic
gcgtatacaaccgctcgccctgccgtaaacttttgctcct

SEQ ID NO: 7185 - DNA, 40 bp, Artificial Sequence
  Synthetic
tcggttttctctgtgcggacacgttttgggttatgaggat

SEQ ID NO: 7186 - DNA, 35 bp, Artificial Sequence
  Synthetic
caaccggcgtggcgatgtaggacagggtgtgccag

SEQ ID NO: 7187 - DNA, 35 bp, Artificial Sequence
  Synthetic
cgcggccaaactcgttgcttacggtttcgcgcagg

SEQ ID NO: 7188 - DNA, 36 bp, Artificial Sequence
  Synthetic
atgagcgtggtcaaaggtcgccgctgcacgggcttt

SEQ ID NO: 7189 - DNA, 40 bp, Artificial Sequence
  Synthetic
tggcaatggcaggctttgagaccgatcatcgtgatgtcgg

SEQ ID NO: 7190 - DNA, 42 bp, Artificial Sequence
  Synthetic
cttgcccatgaaaaccacgtcgggttgagcacgatttggttc

SEQ ID NO: 7191 - DNA, 39 bp, Artificial Sequence
  Synthetic
gacaagcccccgcctaccagtagggcaggtaaacgtcga

SEQ ID NO: 7192 - DNA, 39 bp, Artificial Sequence
  Synthetic
aaccgtctgcaccgtaaatgttaaagatggtcgggttgc

SEQ ID NO: 7193 - DNA, 39 bp, Artificial Sequence
  Synthetic
tttccagtgcggcgagatacatcatccttgcaacaggtc

SEQ ID NO: 7194 - DNA, 37 bp, Artificial Sequence
  Synthetic
acatccgccgtggtgttgcatcccgttcaagttgccg

SEQ ID NO: 7195 - DNA, 45 bp, Artificial Sequence
  Synthetic
ttcatgcagtggcgttagcttaaaaaactgagcttcgagaattac

SEQ ID NO: 7196 - DNA, 38 bp, Artificial Sequence
  Synthetic
gtgcctctccaaacgccacgcctgacgaagcgacaacg

SEQ ID NO: 7197 - DNA, 40 bp, Artificial Sequence
  Synthetic
gtttgtcgtcaaaccgcgcgttgggcttcgtattgttggt

SEQ ID NO: 7198 - DNA, 37 bp, Artificial Sequence
  Synthetic
gaggcggaggtagagccggaatgttgggcggcgttcc

SEQ ID NO: 7199 - DNA, 36 bp, Artificial Sequence
  Synthetic
ttgccgccagttgcagcgcggaatgggagcagatgc

SEQ ID NO: 7200 - DNA, 38 bp, Artificial Sequence
  Synthetic
cgcatcgacgttgtcctttggtttcggcgggtgagagc

SEQ ID NO: 7201 - DNA, 36 bp, Artificial Sequence
  Synthetic
tgccgcacgcgcagaagctttcagttttgccgcttc

SEQ ID NO: 7202 - DNA, 38 bp, Artificial Sequence
  Synthetic
caagccgaaacacgagcgaaacggtgcggcaggtttcg

SEQ ID NO: 7203 - DNA, 34 bp, Artificial Sequence
  Synthetic
cgtgtccgcgcgtttgcaaccctgaccctgctcg

SEQ ID NO: 7204 - DNA, 39 bp, Artificial Sequence
  Synthetic
acggtgcgtttctgacttcgcgcaaaacctcgctcctgc

SEQ ID NO: 7205 - DNA, 40 bp, Artificial Sequence
  Synthetic
ccgtcctgccactcggtctccgccgaaaatcgtcttgaac

SEQ ID NO: 7206 - DNA, 36 bp, Artificial Sequence
  Synthetic
ctggtccgcatacagccgcacgtggtttcggggcaa

SEQ ID NO: 7207 - DNA, 39 bp, Artificial Sequence
  Synthetic
cgcgggcttggcgttatacggggtttcagcctgtcatcg

SEQ ID NO: 7208 - DNA, 40 bp, Artificial Sequence
  Synthetic
accgcaaaagacgacaaggtgtaccgattacgcccatccc

SEQ ID NO: 7209 - DNA, 32 bp, Artificial Sequence
  Synthetic
aaggcagccgcgcgatttcgccgcccgatacg

SEQ ID NO: 7210 - DNA, 39 bp, Artificial Sequence
  Synthetic
cgggcctataccgttgccgcttttgacggcagggagcaa

SEQ ID NO: 7211 - DNA, 40 bp, Artificial Sequence
  Synthetic
gcccactgcagatagggaccaaagtggtacgtgagctggg

SEQ ID NO: 7212 - DNA, 41 bp, Artificial Sequence
  Synthetic
aaaccataaaacgggttgccttcagaagttgaagcaggtaa

SEQ ID NO: 7213 - DNA, 41 bp, Artificial Sequence
  Synthetic
cagatcgaccgcttcctcgtgcggatattgtggaacgggaa

SEQ ID NO: 7214 - DNA, 42 bp, Artificial Sequence
  Synthetic
acaggcgaacaccaccaactacatgcgttcgacaccaatgtt

SEQ ID NO: 7215 - DNA, 40 bp, Artificial Sequence
  Synthetic
cggtagattgcccggaatgcgcgcctctcccttgtccaac

SEQ ID NO: 7216 - DNA, 37 bp, Artificial Sequence
  Synthetic
ccgccgacggccgaaaagttacaaaacaaccgccgcc

SEQ ID NO: 7217 - DNA, 39 bp, Artificial Sequence
  Synthetic
cgtatcgaccaaagcggcgtaagcgatgtacgaacccga

SEQ ID NO: 7218 - DNA, 41 bp, Artificial Sequence
  Synthetic
gcattcaaccgtttggacagcatccatttgtcggtactgcc

SEQ ID NO: 7219 - DNA, 40 bp, Artificial Sequence
  Synthetic
cgactttgtcggcaacaccttgtcgggcaaatcgagttcg

SEQ ID NO: 7220 - DNA, 39 bp, Artificial Sequence
  Synthetic
gccgaagcgatggcgatggccacaaagaaacgctcggat

SEQ ID NO: 7221 - DNA, 39 bp, Artificial Sequence
  Synthetic
caagtgccgggcaaacctccaatcggcaggatggatgca

SEQ ID NO: 7222 - DNA, 38 bp, Artificial Sequence
  Synthetic
cgaaagcaaagccgaactcgactgcacttcgcggcgaa

SEQ ID NO: 7223 - DNA, 36 bp, Artificial Sequence
  Synthetic
agaagccgtcttcccgctgcgcggttgacgaagggc

SEQ ID NO: 7224 - DNA, 39 bp, Artificial Sequence
  Synthetic
tctgccttcgcttctgccgcgcttcaggaacagcttctg

SEQ ID NO: 7225 - DNA, 38 bp, Artificial Sequence
  Synthetic
gagcgcggggttgcctttggtttggacgtttaccgcag

SEQ ID NO: 7226 - DNA, 40 bp, Artificial Sequence
  Synthetic
ctttgtcgcgggcgagtttggaactcttcctcgtcgaagg

SEQ ID NO: 7227 - DNA, 36 bp, Artificial Sequence
  Synthetic
tcgtcttcgcctttgaccggaaagccgtgctgctgc

SEQ ID NO: 7228 - DNA, 40 bp, Artificial Sequence
  Synthetic
cttggcagatatgtgtcgggctagccggtcaaagaacgtc

SEQ ID NO: 7229 - DNA, 41 bp, Artificial Sequence
  Synthetic
tcttcagccgccttcaaatccacgtgaaaactgtggcgttg

SEQ ID NO: 7230 - DNA, 36 bp, Artificial Sequence
  Synthetic
ggaggtgtggatgcggccttgaatcgggcggacacc

SEQ ID NO: 7231 - DNA, 36 bp, Artificial Sequence
  Synthetic
ggaagctgtccgagcccgtgtccgcacgcttatccc

SEQ ID NO: 7232 - DNA, 39 bp, Artificial Sequence
  Synthetic
ggcaagtgcgccgaaatggagcaaaatcagcacggaaac

SEQ ID NO: 7233 - DNA, 38 bp, Artificial Sequence
  Synthetic
gtcgccttcacatcgtgcacggcggctttggcttccgt

SEQ ID NO: 7234 - DNA, 39 bp, Artificial Sequence
  Synthetic
ggcaacgcggctgtcttccccgcattttggacacatgga

SEQ ID NO: 7235 - DNA, 36 bp, Artificial Sequence
  Synthetic
tttcaggcaggtcgggctgtgtttgccgggcagacg

SEQ ID NO: 7236 - DNA, 40 bp, Artificial Sequence
  Synthetic
cgattgcgatatacccggcggggtttggaatgggtgcgtt

SEQ ID NO: 7237 - DNA, 36 bp, Artificial Sequence
  Synthetic
cgtcgcataccaaacgcgcccgttcctgcccgctat

SEQ ID NO: 7238 - DNA, 37 bp, Artificial Sequence
  Synthetic
gaagcctgccgcgagattctccacgccgtaatacgcg

SEQ ID NO: 7239 - DNA, 40 bp, Artificial Sequence
  Synthetic
acgcaccacaacgacagtatggtgcagggcgtattgttgc

SEQ ID NO: 7240 - DNA, 36 bp, Artificial Sequence
  Synthetic
ttgggacgggcagaacgacctcggtttcccagccgc

SEQ ID NO: 7241 - DNA, 39 bp, Artificial Sequence
  Synthetic
ccgaaatgcctgcccataccgtccgcatccgcacatcaa

SEQ ID NO: 7242 - DNA, 40 bp, Artificial Sequence
  Synthetic
gtttgcctgtttgagcgcgtcgaagtattgctcgaccgtc

SEQ ID NO: 7243 - DNA, 36 bp, Artificial Sequence
  Synthetic
gacattgccgccgctcaagctcctgcccacgcttgc

SEQ ID NO: 7244 - DNA, 40 bp, Artificial Sequence
  Synthetic
gtaaccgccgcccaattcgtctttccaccgggcaggctat

SEQ ID NO: 7245 - DNA, 41 bp, Artificial Sequence
  Synthetic
gcaaacgaaatgccttgcgcctcgccgcagttgaaaatcga

SEQ ID NO: 7246 - DNA, 38 bp, Artificial Sequence
  Synthetic
ggcaggaacgaagtcggcagatatcggcttggcggttg

SEQ ID NO: 7247 - DNA, 39 bp, Artificial Sequence
  Synthetic
cgatttgctccgcgtgttgcgaaccccatatcggcgaag

SEQ ID NO: 7248 - DNA, 41 bp, Artificial Sequence
  Synthetic
caaccaggtcgaatacggcgggttgggtttgaacgacggag

SEQ ID NO: 7249 - DNA, 39 bp, Artificial Sequence
  Synthetic
cggatgtggcggatgacgggaaaccgaattggcgcaatt

SEQ ID NO: 7250 - DNA, 36 bp, Artificial Sequence
  Synthetic
ctgccgccatatccgggcattcggacgttttgccgc

SEQ ID NO: 7251 - DNA, 39 bp, Artificial Sequence
  Synthetic
aaacagctgatccgtgccgccgatttgaacgtccgctgg

SEQ ID NO: 7252 - DNA, 41 bp, Artificial Sequence
  Synthetic
caatgcatcccgctcggattgagcacaagctgtccgaacat

SEQ ID NO: 7253 - DNA, 40 bp, Artificial Sequence
  Synthetic
tacctgcccaagcaatacccgtggaacttgggtgtcgttg

SEQ ID NO: 7254 - DNA, 40 bp, Artificial Sequence
  Synthetic
cgcccacacgtgccaaatcatacgaccatccgttccaatg

SEQ ID NO: 7255 - DNA, 38 bp, Artificial Sequence
  Synthetic
tcgccccttatgacctcgactaatgccttcgaatgccc

SEQ ID NO: 7256 - DNA, 38 bp, Artificial Sequence
  Synthetic
gacaccgtgcgcgaagaaggtttgggcgtgagtttggc

SEQ ID NO: 7257 - DNA, 36 bp, Artificial Sequence
  Synthetic
cgctcgcccgccacaaactcttccaagtcgcgggac

SEQ ID NO: 7258 - DNA, 40 bp, Artificial Sequence
  Synthetic
ggtacgacttcgatgccgcgcgtttccttcctgaccaacc

SEQ ID NO: 7259 - DNA, 41 bp, Artificial Sequence
  Synthetic
aaccttggtcgcccataacggaacttgtccgccctgaaagg

SEQ ID NO: 7260 - DNA, 39 bp, Artificial Sequence
  Synthetic
ggccgaccgacagtttccagccttcggcaaacagggttt

SEQ ID NO: 7261 - DNA, 39 bp, Artificial Sequence
  Synthetic
ggcaagggcgaggatgatgagatcccatttggcgcaacc

SEQ ID NO: 7262 - DNA, 36 bp, Artificial Sequence
  Synthetic
ctctgcctgccctgctgctcgaaacgctggtgtccg

SEQ ID NO: 7263 - DNA, 40 bp, Artificial Sequence
  Synthetic
cgttaacaccgagcttgtcgcatgatgacggttgccaacc

SEQ ID NO: 7264 - DNA, 37 bp, Artificial Sequence
  Synthetic
cgaggttcgcaccgacttcggcgcaagagctgttggg

SEQ ID NO: 7265 - DNA, 40 bp, Artificial Sequence
  Synthetic
aagccgcacaagcctttccccattttttccagcagggcga

SEQ ID NO: 7266 - DNA, 40 bp, Artificial Sequence
  Synthetic
tgccgcgttgtcgtgaaaagcctgatgtgggacagctcgg

SEQ ID NO: 7267 - DNA, 41 bp, Artificial Sequence
  Synthetic
tcgtctttcaactgcgcttccacgagccggcttatgaggat

SEQ ID NO: 7268 - DNA, 39 bp, Artificial Sequence
  Synthetic
gcgtcgtggtttcagacgtgccacgggtttggcgggtac

SEQ ID NO: 7269 - DNA, 38 bp, Artificial Sequence
  Synthetic
ggacaggcgcggcgaaactagggtaatcaggtgcaggg

SEQ ID NO: 7270 - DNA, 35 bp, Artificial Sequence
  Synthetic
gcaccatcagcatcggggcaaaccctcgccccgct

SEQ ID NO: 7271 - DNA, 38 bp, Artificial Sequence
  Synthetic
cggcacgtcggcaaaacgggaaatcaacctcacgccgc

SEQ ID NO: 7272 - DNA, 39 bp, Artificial Sequence
  Synthetic
gctgtccgcccgagagttcaggatttgggtttggcaagt

SEQ ID NO: 7273 - DNA, 39 bp, Artificial Sequence
  Synthetic
cgcgacacgcctttttcctgtgaccatggaaatggcgga

SEQ ID NO: 7274 - DNA, 35 bp, Artificial Sequence
  Synthetic
ggcggggttgaggctgaacccggcggcgaaaaagc

SEQ ID NO: 7275 - DNA, 38 bp, Artificial Sequence
  Synthetic
cctcctgctgctgcaacaggcaaaccaagctgccgcag

SEQ ID NO: 7276 - DNA, 34 bp, Artificial Sequence
  Synthetic
actgtgccagttcgcgctctctggcgcgcaccaa

SEQ ID NO: 7277 - DNA, 35 bp, Artificial Sequence
  Synthetic
ggcaaaggtgcgggcggtatgccgaacgcctgcac

SEQ ID NO: 7278 - DNA, 42 bp, Artificial Sequence
  Synthetic
tgcgacaggatttgcgacaacggcctgaagcagcaacacatt

SEQ ID NO: 7279 - DNA, 39 bp, Artificial Sequence
  Synthetic
tcctgctgggtttggaaggccgtctgcccgaattggaag

SEQ ID NO: 7280 - DNA, 37 bp, Artificial Sequence
  Synthetic
ctttcggcgcgggggtttccgttttgtgcggcaaccg

SEQ ID NO: 7281 - DNA, 37 bp, Artificial Sequence
  Synthetic
ataccggcctgtccgtgacccattgcccatcgcgccg

SEQ ID NO: 7282 - DNA, 38 bp, Artificial Sequence
  Synthetic
ggcttcgtacagcttatcgcctgtcggcaagcgggttg

SEQ ID NO: 7283 - DNA, 39 bp, Artificial Sequence
  Synthetic
ccgacaatggcaagggcgtttcgtcaaaggggacaaacg

SEQ ID NO: 7284 - DNA, 38 bp, Artificial Sequence
  Synthetic
ccgccgtacaacgaatggctctcggaagggatgccgac

SEQ ID NO: 7285 - DNA, 37 bp, Artificial Sequence
  Synthetic
ccctcgccgctgattgacgtgtccgtagtcgcattgc

SEQ ID NO: 7286 - DNA, 38 bp, Artificial Sequence
  Synthetic
acggcgaaatcgaatgggtcaattcggtcagcggctcg

SEQ ID NO: 7287 - DNA, 38 bp, Artificial Sequence
  Synthetic
gcggcggatgctgttgctacggtttatcctcctcacga

SEQ ID NO: 7288 - DNA, 37 bp, Artificial Sequence
  Synthetic
cgccgtcgcggaatgggaagtctcgacctcaacggcg

SEQ ID NO: 7289 - DNA, 38 bp, Artificial Sequence
  Synthetic
agcggcacttccaatacgcgaaattcaccgccgaagcc

SEQ ID NO: 7290 - DNA, 38 bp, Artificial Sequence
  Synthetic
aggcgagtttgtaggcggtctgaaacacgccaatccgt

SEQ ID NO: 7291 - DNA, 36 bp, Artificial Sequence
  Synthetic
aacgcaccatggtcgggcgctgcacactggaagacg

SEQ ID NO: 7292 - DNA, 37 bp, Artificial Sequence
  Synthetic
agaaacaccgccgctccgacagcgtcttccccgaaat

SEQ ID NO: 7293 - DNA, 39 bp, Artificial Sequence
  Synthetic
cgtccacacgcccaacatcggtgtataacgtgccgctcg

SEQ ID NO: 7294 - DNA, 37 bp, Artificial Sequence
  Synthetic
gcgcggtaagccacgcctagcgacggtgcgaacgata

SEQ ID NO: 7295 - DNA, 39 bp, Artificial Sequence
  Synthetic
tgttgtcggtttagcagcaaggttcaggaaaggcattgc

SEQ ID NO: 7296 - DNA, 40 bp, Artificial Sequence
  Synthetic
gtttgaacacgattgaccgctagatgctttgatgtcggtt

SEQ ID NO: 7297 - DNA, 41 bp, Artificial Sequence
  Synthetic
ccacctacttacattttgcggttttctatccgccgtttgtc

SEQ ID NO: 7298 - DNA, 40 bp, Artificial Sequence
  Synthetic
ggtcgcgccattcagaaaactttcaaggatttccaaacgg

SEQ ID NO: 7299 - DNA, 38 bp, Artificial Sequence
  Synthetic
aaacagcccgaatcacaacctgttccaatgcttcggag

SEQ ID NO: 7300 - DNA, 40 bp, Artificial Sequence
  Synthetic
acacaaagcgagatgcccgacttcggtatctgcaatcggc

SEQ ID NO: 7301 - DNA, 45 bp, Artificial Sequence
  Synthetic
acgtgatgatgctaaatttttgcagaaaataggtaattgccaccg

SEQ ID NO: 7302 - DNA, 43 bp, Artificial Sequence
  Synthetic
ggtcgtcatgaagttttaatgcggcgtctgaaacaaccaacca

SEQ ID NO: 7303 - DNA, 44 bp, Artificial Sequence
  Synthetic
cggaagcgatgcacaatctggttaaatattgctgataagtgcca

SEQ ID NO: 7304 - DNA, 43 bp, Artificial Sequence
  Synthetic
tctgaaagatgatgatgagccaagcatcacatcggcaatcagt

SEQ ID NO: 7305 - DNA, 45 bp, Artificial Sequence
  Synthetic
tgcaactgacctgcaaattttctgacagaaagtgtgtaaaaactc

SEQ ID NO: 7306 - DNA, 43 bp, Artificial Sequence
  Synthetic
gtgcctgtcataatcgcttaatgcctgccataaataaaccgcg

SEQ ID NO: 7307 - DNA, 38 bp, Artificial Sequence
  Synthetic
cgttggaaacgttgtgcgacttaacgggcaactttcct

SEQ ID NO: 7308 - DNA, 39 bp, Artificial Sequence
  Synthetic
catagccagcagcgtccaagcccctggttttggcactgc

SEQ ID NO: 7309 - DNA, 37 bp, Artificial Sequence
  Synthetic
cggttggtcaggcgcacgttacgccgccgttccaaat

SEQ ID NO: 7310 - DNA, 40 bp, Artificial Sequence
  Synthetic
tcgcccaggtaagtctttggaaaggatgatgattgggagg

SEQ ID NO: 7311 - DNA, 38 bp, Artificial Sequence
  Synthetic
acattgacacacggcggcggcttcctcgttcggtatgg

SEQ ID NO: 7312 - DNA, 35 bp, Artificial Sequence
  Synthetic
ccgcagtttaccgccgcagctttccagcgtcaggc

SEQ ID NO: 7313 - DNA, 36 bp, Artificial Sequence
  Synthetic
tttcaccagcccctccgcgtggtcgcgcctttggtg

SEQ ID NO: 7314 - DNA, 38 bp, Artificial Sequence
  Synthetic
gctgggcagcgaatccttcctagcgttggacacccgag

SEQ ID NO: 7315 - DNA, 34 bp, Artificial Sequence
  Synthetic
gccgccggcaaattcccatacctgctcggctcgc

SEQ ID NO: 7316 - DNA, 35 bp, Artificial Sequence
  Synthetic
gcccgatgccgatgttgcgtcgccaaagccgtcgg

SEQ ID NO: 7317 - DNA, 34 bp, Artificial Sequence
  Synthetic
ggctgtgtgcgtcggcatatgatgtcggcgcgcc

SEQ ID NO: 7318 - DNA, 36 bp, Artificial Sequence
  Synthetic
ggcgcggtgcagggttttgttcgtccctgccagcgt

SEQ ID NO: 7319 - DNA, 38 bp, Artificial Sequence
  Synthetic
ctgttgggtaaacgtgccctgcctcgccgtcgaacgtc

SEQ ID NO: 7320 - DNA, 40 bp, Artificial Sequence
  Synthetic
acccgaaaaacagcacggcggggattgtcgtccaatttgc

SEQ ID NO: 7321 - DNA, 37 bp, Artificial Sequence
  Synthetic
gcaatcagcctttgcgtcggctggtgttgttggcggg

SEQ ID NO: 7322 - DNA, 36 bp, Artificial Sequence
  Synthetic
aagcgacagcatccgccggcgtgatgtcgaaaccga

SEQ ID NO: 7323 - DNA, 37 bp, Artificial Sequence
  Synthetic
acaccgatgccgtctgaacctccgcgcctgtaaacgg

SEQ ID NO: 7324 - DNA, 39 bp, Artificial Sequence
  Synthetic
ccacttccgtgggaatgacggtcagacggcatcggtgtc

SEQ ID NO: 7325 - DNA, 42 bp, Artificial Sequence
  Synthetic
cggcggataaatcgaattgcccctgactttgggcatgatggc

SEQ ID NO: 7326 - DNA, 40 bp, Artificial Sequence
  Synthetic
tccaaacgctcgcggatttcatcctgatgctgcccgaaga

SEQ ID NO: 7327 - DNA, 35 bp, Artificial Sequence
  Synthetic
gttcctgcgcggcgaggattgcatcccgttcgccc

SEQ ID NO: 7328 - DNA, 34 bp, Artificial Sequence
  Synthetic
tttacgcgttccgccgcctcgcctcggtcgccat

SEQ ID NO: 7329 - DNA, 37 bp, Artificial Sequence
  Synthetic
cgcgacgaaggcgggttttcagcgacgtatccgaagc

SEQ ID NO: 7330 - DNA, 41 bp, Artificial Sequence
  Synthetic
tgtacgttcccctgccagtgccgatgtccacctacatccgc

SEQ ID NO: 7331 - DNA, 39 bp, Artificial Sequence
  Synthetic
aggctcttcgtaaggcttcgcccacgcgcgttttgccac

SEQ ID NO: 7332 - DNA, 39 bp, Artificial Sequence
  Synthetic
ccccgaccacgcgctctttctgccacagacatcgtgttg

SEQ ID NO: 7333 - DNA, 37 bp, Artificial Sequence
  Synthetic
ccacgccacggaaatcacgcgatacctgcgtcggcac

SEQ ID NO: 7334 - DNA, 35 bp, Artificial Sequence
  Synthetic
aaaacggcggcgcaccacacaggaagcctaccgcc

SEQ ID NO: 7335 - DNA, 41 bp, Artificial Sequence
  Synthetic
cgtatttttggaagcggcggctgaagcgatccaaaaaggct

SEQ ID NO: 7336 - DNA, 42 bp, Artificial Sequence
  Synthetic
agagtgggtaagctggtagccgcgggtagtggcatttttgga

SEQ ID NO: 7337 - DNA, 37 bp, Artificial Sequence
  Synthetic
gacgccgatcaggaacacgcaggacttcacgcccctg

SEQ ID NO: 7338 - DNA, 42 bp, Artificial Sequence
  Synthetic
gcttgaacgcctcgatatccggtcgatattctggcgctcagt

SEQ ID NO: 7339 - DNA, 35 bp, Artificial Sequence
  Synthetic
gcactgcctgcccgcattgatgttcggcccgtgga

SEQ ID NO: 7340 - DNA, 34 bp, Artificial Sequence
  Synthetic
aaccggcagccaaagccacggccgccacaatgtc

SEQ ID NO: 7341 - DNA, 35 bp, Artificial Sequence
  Synthetic
gctgccgcgcccatcaatgtattcggttgcggcgg

SEQ ID NO: 7342 - DNA, 41 bp, Artificial Sequence
  Synthetic
aacggtagagcagggtttggaccattggaagaaaccgcgca

SEQ ID NO: 7343 - DNA, 37 bp, Artificial Sequence
  Synthetic
cggccgggtctgttgggatcgcacgggggaaatcctc

SEQ ID NO: 7344 - DNA, 40 bp, Artificial Sequence
  Synthetic
caggttgcccatcgggtaatttgggtttggaaaactttgt

SEQ ID NO: 7345 - DNA, 40 bp, Artificial Sequence
  Synthetic
cgccgaacatgacatgtcccagtggggcaaagtgtctctt

SEQ ID NO: 7346 - DNA, 39 bp, Artificial Sequence
  Synthetic
acctcgtcggctttgtcggcgagcagtcggatgcggaaa

SEQ ID NO: 7347 - DNA, 38 bp, Artificial Sequence
  Synthetic
cgtttgcttacgggcggatagggaatggaagcaggttt

SEQ ID NO: 7348 - DNA, 35 bp, Artificial Sequence
  Synthetic
acgcactgctttcgcccgaagtccccagcctgtcc

SEQ ID NO: 7349 - DNA, 39 bp, Artificial Sequence
  Synthetic
caaactctccgccatccatccgagttcgcccatcacgcg

SEQ ID NO: 7350 - DNA, 38 bp, Artificial Sequence
  Synthetic
agccgtcgatttctgccgctttgcgtcttgaggcaggg

SEQ ID NO: 7351 - DNA, 38 bp, Artificial Sequence
  Synthetic
agcctgattgccggttatgccagggcggaagtcgggat

SEQ ID NO: 7352 - DNA, 35 bp, Artificial Sequence
  Synthetic
aaagcccttgccaaacgcggcgttttgtccgccgg

SEQ ID NO: 7353 - DNA, 40 bp, Artificial Sequence
  Synthetic
ccgacttggacggtttgctgcgacgtggttcacaccggtg

SEQ ID NO: 7354 - DNA, 40 bp, Artificial Sequence
  Synthetic
cgcttggaaaacacccgcttcaatcagaagcggtagcgca

SEQ ID NO: 7355 - DNA, 36 bp, Artificial Sequence
  Synthetic
aaggcgcacgcaattccgctatagccgcccacgcct

SEQ ID NO: 7356 - DNA, 37 bp, Artificial Sequence
  Synthetic
tgggcggcagtgcgcaatgggatactgcaccagcgtc

SEQ ID NO: 7357 - DNA, 39 bp, Artificial Sequence
  Synthetic
cgcgccaagtccataccggcgccaaacttttcctcgtca

SEQ ID NO: 7358 - DNA, 36 bp, Artificial Sequence
  Synthetic
gtccgcaccatcctgtcgcatcgaacgccacgccct

SEQ ID NO: 7359 - DNA, 38 bp, Artificial Sequence
  Synthetic
tttcccgtccatccatcggcatggcttggcgcgtgatg

SEQ ID NO: 7360 - DNA, 38 bp, Artificial Sequence
  Synthetic
ctgcgcctgcggcaatttgaacccgaagttacccgcaa

SEQ ID NO: 7361 - DNA, 37 bp, Artificial Sequence
  Synthetic
gtgttgctgctggacgaaccgcgtcttccaacgcgcg

SEQ ID NO: 7362 - DNA, 40 bp, Artificial Sequence
  Synthetic
gcatggcgacaatctcgtcccggaacgtgaaacgggtgtc

SEQ ID NO: 7363 - DNA, 38 bp, Artificial Sequence
  Synthetic
attcggcgaacacatcatccggtgtcggtatggcggcg

SEQ ID NO: 7364 - DNA, 42 bp, Artificial Sequence
  Synthetic
atcttgatgtgtttgtgttcgacgagccgcacattatccaag

SEQ ID NO: 7365 - DNA, 35 bp, Artificial Sequence
  Synthetic
ctgcaccgcagcaggatgttttcggcggcggtttg

SEQ ID NO: 7366 - DNA, 39 bp, Artificial Sequence
  Synthetic
aacatcagcgtactcccccccggcatattgcccggccct

SEQ ID NO: 7367 - DNA, 42 bp, Artificial Sequence
  Synthetic
gcgtaaccacttccacatcggtgtccgttgtttttcgtcagg

SEQ ID NO: 7368 - DNA, 41 bp, Artificial Sequence
  Synthetic
gatgacggtccgttgcagtcgtcaaacgactgagccggata

SEQ ID NO: 7369 - DNA, 39 bp, Artificial Sequence
  Synthetic
ctggtgtggttggaagacggcttggccaaaccgataccg

SEQ ID NO: 7370 - DNA, 34 bp, Artificial Sequence
  Synthetic
gcgggcgcgttcgtgtatgcaggcagcgtgatgc

SEQ ID NO: 7371 - DNA, 38 bp, Artificial Sequence
  Synthetic
cgccattttgcgcccgatatgttgcaagggcagggtcg

SEQ ID NO: 7372 - DNA, 37 bp, Artificial Sequence
  Synthetic
accgacgcaggcatcgatgcaggttcacgctgatgcc

SEQ ID NO: 7373 - DNA, 37 bp, Artificial Sequence
  Synthetic
agcttcttcatctcgcgcgtggcctttgagccggtcg

SEQ ID NO: 7374 - DNA, 39 bp, Artificial Sequence
  Synthetic
atgggcatctaccggcgtgacaggctgtcaacgtagagc

SEQ ID NO: 7375 - DNA, 40 bp, Artificial Sequence
  Synthetic
cgacatcggcgatttcgtcctgacgacggcgagctggtat

SEQ ID NO: 7376 - DNA, 40 bp, Artificial Sequence
  Synthetic
ttccgacaccgcaatatgccccgaccatttctgcccttgc

SEQ ID NO: 7377 - DNA, 39 bp, Artificial Sequence
  Synthetic
atcggcgtattcgatcggggctgatgcgcgaatgggaca

SEQ ID NO: 7378 - DNA, 35 bp, Artificial Sequence
  Synthetic
tcttcggcggctttggcggtcgccctgcaactggg

SEQ ID NO: 7379 - DNA, 37 bp, Artificial Sequence
  Synthetic
cgcacgggattcagcggctgggcattcaggcggacaa

SEQ ID NO: 7380 - DNA, 38 bp, Artificial Sequence
  Synthetic
atgcgggcggaggattatgcccggcagggaagttaagc

SEQ ID NO: 7381 - DNA, 37 bp, Artificial Sequence
  Synthetic
agtgctgaacgacacgcgcgttcccagcatctcgcac

SEQ ID NO: 7382 - DNA, 41 bp, Artificial Sequence
  Synthetic
cgcgattgagcaagacgcaaattccgtcgtagtagctttcg

SEQ ID NO: 7383 - DNA, 36 bp, Artificial Sequence
  Synthetic
ggaggcggcggcgtataaggttcggacggcatcgcg

SEQ ID NO: 7384 - DNA, 36 bp, Artificial Sequence
  Synthetic
atccgccgtggtgttgccatcccgttcaagttgccg

SEQ ID NO: 7385 - DNA, 35 bp, Artificial Sequence
  Synthetic
acactgcctgggcaaagcgtgcccaggctttggcg

SEQ ID NO: 7386 - DNA, 35 bp, Artificial Sequence
  Synthetic
gcccgaaactgccgcaccttaccggccgccttcag

SEQ ID NO: 7387 - DNA, 42 bp, Artificial Sequence
  Synthetic
aactgacgggcattttgaatttgctgaaccttggttttgcct

SEQ ID NO: 7388 - DNA, 38 bp, Artificial Sequence
  Synthetic
ccagtccgacccactgcatctcaggcggctttcctgta

SEQ ID NO: 7389 - DNA, 40 bp, Artificial Sequence
  Synthetic
gggcggactgaatatccggtccggttacggtaatgctgcc

SEQ ID NO: 7390 - DNA, 38 bp, Artificial Sequence
  Synthetic
gcacaggcagtccgcgatcctgtattcgcgtacctgcg

SEQ ID NO: 7391 - DNA, 41 bp, Artificial Sequence
  Synthetic
ttcaaccgcgatgtgtccgtagacgcacaactgggatacgg

SEQ ID NO: 7392 - DNA, 38 bp, Artificial Sequence
  Synthetic
cggtacatcacgctgcgctgccgatgccgacatgatgc

SEQ ID NO: 7393 - DNA, 40 bp, Artificial Sequence
  Synthetic
cggtacgcggccttggtagagttcatcggtcaatccacca

SEQ ID NO: 7394 - DNA, 40 bp, Artificial Sequence
  Synthetic
ctgcaggggctcgagtacgccggcaaaaacgtccacttga

SEQ ID NO: 7395 - DNA, 38 bp, Artificial Sequence
  Synthetic
cagtcgtacatcgcaaacacgccgatacggaagcggcg

SEQ ID NO: 7396 - DNA, 38 bp, Artificial Sequence
  Synthetic
cccctcgctgccgttgactggcggatttggaagggaaa

SEQ ID NO: 7397 - DNA, 34 bp, Artificial Sequence
  Synthetic
cagcggcaaatcggcagcgcgtccgcatcgatgc

SEQ ID NO: 7398 - DNA, 43 bp, Artificial Sequence
  Synthetic
cgtaaaaaccggcggcaaacctgttctactttcaatttttcgc

SEQ ID NO: 7399 - DNA, 40 bp, Artificial Sequence
  Synthetic
tttccagcgcggatattctggccgatgtcttgaccgcgct

SEQ ID NO: 7400 - DNA, 40 bp, Artificial Sequence
  Synthetic
aggatggggtgcatacggtagccatcgagccgctggtcta

SEQ ID NO: 7401 - DNA, 41 bp, Artificial Sequence
  Synthetic
ccgatacggtttggagccgttttccgcataagctcggaagc

SEQ ID NO: 7402 - DNA, 37 bp, Artificial Sequence
  Synthetic
tggttcgcaccgctttacgaacgtggcgatgtccagc

SEQ ID NO: 7403 - DNA, 39 bp, Artificial Sequence
  Synthetic
gcgaccataccaaacacccattgatggagcaaaggttgt

SEQ ID NO: 7404 - DNA, 40 bp, Artificial Sequence
  Synthetic
ggcaaagcaaaaacccccgggtaggtcactgccaaacacc

SEQ ID NO: 7405 - DNA, 39 bp, Artificial Sequence
  Synthetic
tttgcctgacccactgcctggcacagtcggacatagacg

SEQ ID NO: 7406 - DNA, 40 bp, Artificial Sequence
  Synthetic
cgaaatgattaaggcgggcgcgaaatcgtgttccgccgcc

SEQ ID NO: 7407 - DNA, 39 bp, Artificial Sequence
  Synthetic
acgttttaaacctcccccgccgaaatcggtcagctgccg

SEQ ID NO: 7408 - DNA, 35 bp, Artificial Sequence
  Synthetic
gccaccctgcaatcgctcgttcgggcagccacagc

SEQ ID NO: 7409 - DNA, 39 bp, Artificial Sequence
  Synthetic
tgcccaagctgatttcgccctttgcgcgaggaaaacagg

SEQ ID NO: 7410 - DNA, 38 bp, Artificial Sequence
  Synthetic
tcatcgaaatcaccgtccccgatcggtgcggatgaggc

SEQ ID NO: 7411 - DNA, 43 bp, Artificial Sequence
  Synthetic
tcgaaataccccaatcggaaccccatagagctttctacggttt

SEQ ID NO: 7412 - DNA, 36 bp, Artificial Sequence
  Synthetic
gcggcagggttgggttcgacgtgttgggtttcgccg

SEQ ID NO: 7413 - DNA, 39 bp, Artificial Sequence
  Synthetic
gtttcgcgcgcctcttgcacaccagcgaagacatcaaca

SEQ ID NO: 7414 - DNA, 36 bp, Artificial Sequence
  Synthetic
aaccgacttcccggcaaacggtcatttcgggcggcg

SEQ ID NO: 7415 - DNA, 38 bp, Artificial Sequence
  Synthetic
gcgtggacggcttcttcaaaggatggcggcgacttggg

SEQ ID NO: 7416 - DNA, 35 bp, Artificial Sequence
  Synthetic
acggcggcgtttttgctgccgttgcgccaataccg

SEQ ID NO: 7417 - DNA, 40 bp, Artificial Sequence
  Synthetic
atgttgtcggcaagctcgcgcacaaaatcccgccctcaaa

SEQ ID NO: 7418 - DNA, 34 bp, Artificial Sequence
  Synthetic
ctttggcgggcgcggtttccgcattgctggcagc

SEQ ID NO: 7419 - DNA, 40 bp, Artificial Sequence
  Synthetic
ttccatacggacgttgtgcgcggcgaaaccctgacctaca

SEQ ID NO: 7420 - DNA, 38 bp, Artificial Sequence
  Synthetic
atcggaagcttgtgcggattcgttgcggcggaagaggc

SEQ ID NO: 7421 - DNA, 39 bp, Artificial Sequence
  Synthetic
acactgggcgagtttgacgactagtagtcgtgccggtcg

SEQ ID NO: 7422 - DNA, 39 bp, Artificial Sequence
  Synthetic
aaacctgcccgccgtcattcggattaaccctttgctcgg

SEQ ID NO: 7423 - DNA, 36 bp, Artificial Sequence
  Synthetic
cttgccgatatgcttgccgcgcccaagccgtgtacg

SEQ ID NO: 7424 - DNA, 34 bp, Artificial Sequence
  Synthetic
gctgctgcaacgcgggttcagccgtagcgttgcg

SEQ ID NO: 7425 - DNA, 37 bp, Artificial Sequence
  Synthetic
ggctgcctgccgacatcctgcatcggcaggcggattt

SEQ ID NO: 7426 - DNA, 40 bp, Artificial Sequence
  Synthetic
aaaaccctgcccatccccagcgatgacgcttttgccgttt

SEQ ID NO: 7427 - DNA, 42 bp, Artificial Sequence
  Synthetic
atgtcaaacgcctctcctccgcccaagaccatacgttcggcg

SEQ ID NO: 7428 - DNA, 37 bp, Artificial Sequence
  Synthetic
cggcgatgatggtgttttcggagggtttgcaggcgca

SEQ ID NO: 7429 - DNA, 37 bp, Artificial Sequence
  Synthetic
ggctggcgactctgctgcacggagagggtcagcgaag

SEQ ID NO: 7430 - DNA, 39 bp, Artificial Sequence
  Synthetic
cacgactgaaccgatgccgttggggttgggtgtggaaat

SEQ ID NO: 7431 - DNA, 39 bp, Artificial Sequence
  Synthetic
cgtcgatttcgcctgcggcacaacttgttcggcgttgac

SEQ ID NO: 7432 - DNA, 42 bp, Artificial Sequence
  Synthetic
ggtggtgtccgaaatgtttgcgccttcctcacgaccagactg

SEQ ID NO: 7433 - DNA, 40 bp, Artificial Sequence
  Synthetic
taatagaggcccgccgcaaagacgggtttcatcctgttgg

SEQ ID NO: 7434 - DNA, 39 bp, Artificial Sequence
  Synthetic
acggcatttgtcatcactggccctgctgtcgctgctggt

SEQ ID NO: 7435 - DNA, 40 bp, Artificial Sequence
  Synthetic
ttacccatcgcaccgacaaacacggcgtggaatggtcttt

SEQ ID NO: 7436 - DNA, 42 bp, Artificial Sequence
  Synthetic
ttgaggccgtctgaaacttcgcggtgaaaatggaagcggtca

SEQ ID NO: 7437 - DNA, 40 bp, Artificial Sequence
  Synthetic
cacgcagaaggtcagcaccataccgttaccgccaaaaacc

SEQ ID NO: 7438 - DNA, 37 bp, Artificial Sequence
  Synthetic
gcccatgtgctgcggttgtgaaagacgcgctggatgc

SEQ ID NO: 7439 - DNA, 38 bp, Artificial Sequence
  Synthetic
ggcggcggtatttatgtccgtcgatgccgaagccgtca

SEQ ID NO: 7440 - DNA, 39 bp, Artificial Sequence
  Synthetic
aaaaccgctcaaaccgcccttcgacaaatcaagcctcgg

SEQ ID NO: 7441 - DNA, 39 bp, Artificial Sequence
  Synthetic
ggtcaacgcaggcggttcgcttgagtccttgaaccagcg

SEQ ID NO: 7442 - DNA, 40 bp, Artificial Sequence
  Synthetic
ccaacacacccaagccacacaggggttttgaaggcggttt

SEQ ID NO: 7443 - DNA, 39 bp, Artificial Sequence
  Synthetic
attcggtgactacggctggatgcaggacaagcagggctg

SEQ ID NO: 7444 - DNA, 36 bp, Artificial Sequence
  Synthetic
caccaacctcaccggctcaatggattcccgcctgcg

SEQ ID NO: 7445 - DNA, 39 bp, Artificial Sequence
  Synthetic
gttccgccacaaacaactgggggtaacttggtgcagggc

SEQ ID NO: 7446 - DNA, 37 bp, Artificial Sequence
  Synthetic
ggcttcccaagtacaggcctctggtcttcgggcgagg

SEQ ID NO: 7447 - DNA, 38 bp, Artificial Sequence
  Synthetic
ggacgtgccgccgatgttatttccaccggattcaccaa

SEQ ID NO: 7448 - DNA, 37 bp, Artificial Sequence
  Synthetic
ccagaagcgtttgcctgtggcagcgccgatgcctacg

SEQ ID NO: 7449 - DNA, 38 bp, Artificial Sequence
  Synthetic
gagggtgaggatttcgtcgtggctgcaacttcgccccg

SEQ ID NO: 7450 - DNA, 37 bp, Artificial Sequence
  Synthetic
ggtcagacgctcgacggtgtaatcgccgccgtcaaag

SEQ ID NO: 7451 - DNA, 37 bp, Artificial Sequence
  Synthetic
gcgtgggcgtatccgtcgttcgcggtagatggtcagc

SEQ ID NO: 7452 - DNA, 35 bp, Artificial Sequence
  Synthetic
gcgcggcaggcatcattcggcgtgggggttgaact

SEQ ID NO: 7453 - DNA, 37 bp, Artificial Sequence
  Synthetic
agcgtgttcaatggcggcgccacttgtttgggcgtgc

SEQ ID NO: 7454 - DNA, 38 bp, Artificial Sequence
  Synthetic
gcacgctcgcgctcttggaggatgacttcgtcgagcga

SEQ ID NO: 7455 - DNA, 37 bp, Artificial Sequence
  Synthetic
gtgccgactgttttgccgacgaaaccgtccgccacgc

SEQ ID NO: 7456 - DNA, 39 bp, Artificial Sequence
  Synthetic
ttccgacaaaatccggctcacagtttgccgtatcgggcg

SEQ ID NO: 7457 - DNA, 35 bp, Artificial Sequence
  Synthetic
cgaagccgacgaacgcaaggttgcggacgcgcgtt

SEQ ID NO: 7458 - DNA, 36 bp, Artificial Sequence
  Synthetic
aaacagccgttgaccgcaacctgcacgttccgcgct

SEQ ID NO: 7459 - DNA, 38 bp, Artificial Sequence
  Synthetic
gacaaactccgcacgtccgcgtgcctgttcccgatgga

SEQ ID NO: 7460 - DNA, 39 bp, Artificial Sequence
  Synthetic
cggcacgcctttcagacgggagatacggtgcggattccg

SEQ ID NO: 7461 - DNA, 37 bp, Artificial Sequence
  Synthetic
cgaaagcagccacgtcgcctcgatgccgcggattacg

SEQ ID NO: 7462 - DNA, 41 bp, Artificial Sequence
  Synthetic
ctgaacgaaaaacgcgccgagaggacgacgttcacatccaa

SEQ ID NO: 7463 - DNA, 38 bp, Artificial Sequence
  Synthetic
acgtggccaaaccgcaccgttttccgctgtctgaacgg

SEQ ID NO: 7464 - DNA, 40 bp, Artificial Sequence
  Synthetic
catcgccacacccgttcagatcataaatcagtgcgtcgcc

SEQ ID NO: 7465 - DNA, 36 bp, Artificial Sequence
  Synthetic
accgcacaaaccggcggagcccatgccttcaatgcg

SEQ ID NO: 7466 - DNA, 35 bp, Artificial Sequence
  Synthetic
cgtgatcgacggaggtgcgacagcttcgggcaggg

SEQ ID NO: 7467 - DNA, 38 bp, Artificial Sequence
  Synthetic
ttggaaaactacgaaggcggcccaaacgtccgccgagc

SEQ ID NO: 7468 - DNA, 40 bp, Artificial Sequence
  Synthetic
cccgaacctcgattacgccggaggttttcagacggcatcg

SEQ ID NO: 7469 - DNA, 38 bp, Artificial Sequence
  Synthetic
atccgccctctttgctgcgccggcgtttatcaggtctt

SEQ ID NO: 7470 - DNA, 41 bp, Artificial Sequence
  Synthetic
gtcgtcgttttgcccacaccggacatgagtgcgaacatcct

SEQ ID NO: 7471 - DNA, 38 bp, Artificial Sequence
  Synthetic
gccattgccgccgccaaaagcatgaaacgccacatcag

SEQ ID NO: 7472 - DNA, 38 bp, Artificial Sequence
  Synthetic
aaaagccgcagccacctcgcatcatggaggggctgatg

SEQ ID NO: 7473 - DNA, 35 bp, Artificial Sequence
  Synthetic
tgctcgaccgccacttcacgttgatgagggcggcg

SEQ ID NO: 7474 - DNA, 39 bp, Artificial Sequence
  Synthetic
caggaaatttccgccctcgtcagttcgtgggcatccagc

SEQ ID NO: 7475 - DNA, 39 bp, Artificial Sequence
  Synthetic
caaacttgggactgaacccggctcagcatgggcatcggc

SEQ ID NO: 7476 - DNA, 35 bp, Artificial Sequence
  Synthetic
aggcgctcggcaaacacaatgcgccttcccagctc

SEQ ID NO: 7477 - DNA, 40 bp, Artificial Sequence
  Synthetic
gcgacacctacaacgacacacaagaaaccggtggcgtaca

SEQ ID NO: 7478 - DNA, 40 bp, Artificial Sequence
  Synthetic
atcgccgacaaaaccaccatcgaggtgtttgccgctttcg

SEQ ID NO: 7479 - DNA, 38 bp, Artificial Sequence
  Synthetic
ccgggcgcggtattctggagccgtatttggtggccatg

SEQ ID NO: 7480 - DNA, 39 bp, Artificial Sequence
  Synthetic
ggacgacgtacgcgccgaagcggtaaatcaagccctgtt

SEQ ID NO: 7481 - DNA, 38 bp, Artificial Sequence
  Synthetic
cgacggcggcgagattgtcgatcaaatcctgcaacacg

SEQ ID NO: 7482 - DNA, 43 bp, Artificial Sequence
  Synthetic
accaataccgtaaatagcctgaagttgcaggggtaaatatccc

SEQ ID NO: 7483 - DNA, 43 bp, Artificial Sequence
  Synthetic
aaatgtcttccactgtcaagcctgtctaagttgcatactcctg

SEQ ID NO: 7484 - DNA, 42 bp, Artificial Sequence
  Synthetic
cgacagcagctttgatttcaggatgcaaccaaatgacgttta

SEQ ID NO: 7485 - DNA, 39 bp, Artificial Sequence
  Synthetic
cgccgcatattttcagacggaatccccaagcaatcaatg

SEQ ID NO: 7486 - DNA, 35 bp, Artificial Sequence
  Synthetic
ccccttcagacggcatcgcatcggcgtgcctgtcg

SEQ ID NO: 7487 - DNA, 40 bp, Artificial Sequence
  Synthetic
gagttcgcggttttcaacgcgactttattgcgacccacgg

SEQ ID NO: 7488 - DNA, 40 bp, Artificial Sequence
  Synthetic
gtaaccagactgtacgggccgctgcaccacttggttgacg

SEQ ID NO: 7489 - DNA, 40 bp, Artificial Sequence
  Synthetic
gggaatcagaagcggtagcgctggaaaacacccgcttcaa

SEQ ID NO: 7490 - DNA, 38 bp, Artificial Sequence
  Synthetic
gccaggccggcggtaatcacaggttacgctggtggtcg

SEQ ID NO: 7491 - DNA, 37 bp, Artificial Sequence
  Synthetic
atatgccccgttccgtcggcgtatcggcgcggcttct

SEQ ID NO: 7492 - DNA, 37 bp, Artificial Sequence
  Synthetic
gcgcgtatcagcacggtgacccgaagacaacggcaac

SEQ ID NO: 7493 - DNA, 39 bp, Artificial Sequence
  Synthetic
tggtcgaaaccgccatttccgcggtgtcttccggcattt

SEQ ID NO: 7494 - DNA, 40 bp, Artificial Sequence
  Synthetic
cgctgaacgccaataccgcccaggtcttggaaatcggggt

SEQ ID NO: 7495 - DNA, 39 bp, Artificial Sequence
  Synthetic
cggcgcgtatccgtttgaaacctctttttccgcagccgc

SEQ ID NO: 7496 - DNA, 36 bp, Artificial Sequence
  Synthetic
acggcgttgaacgaagtcgatggtcgccggaatgca

SEQ ID NO: 7497 - DNA, 35 bp, Artificial Sequence
  Synthetic
gcgtgggcgtgaactaccggtctgccgcccattcg

SEQ ID NO: 7498 - DNA, 41 bp, Artificial Sequence
  Synthetic
aattgttggaatccggcttgtttgaccttttctcaggagca

SEQ ID NO: 7499 - DNA, 37 bp, Artificial Sequence
  Synthetic
cgcgcgggtcttggacgaatccatcaggacggcttgg

SEQ ID NO: 7500 - DNA, 37 bp, Artificial Sequence
  Synthetic
tttgaccaactcggcaagcggtgtttccctgcgcggc

SEQ ID NO: 7501 - DNA, 35 bp, Artificial Sequence
  Synthetic
gcaccagttcgcccgcgatgctcatcgccatcggc

SEQ ID NO: 7502 - DNA, 37 bp, Artificial Sequence
  Synthetic
cgcccgtggcttctttacggcttttggacgacggcgc

SEQ ID NO: 7503 - DNA, 41 bp, Artificial Sequence
  Synthetic
aacgccgccatttccatatcggggtattgccgtgccgtatt

SEQ ID NO: 7504 - DNA, 39 bp, Artificial Sequence
  Synthetic
gcacttctaactccccgcccatttgcattgcgaactgcc

SEQ ID NO: 7505 - DNA, 45 bp, Artificial Sequence
  Synthetic
tttgcaaaggtctcagaatgccgcatatctgaaaagtgtattccg

SEQ ID NO: 7506 - DNA, 41 bp, Artificial Sequence
  Synthetic
agcgtaccgaccgacaatccgcgtgcaaaaatatccgcacc

SEQ ID NO: 7507 - DNA, 37 bp, Artificial Sequence
  Synthetic
cgtattccccgccggagagaacggcggtcagcgattc

SEQ ID NO: 7508 - DNA, 36 bp, Artificial Sequence
  Synthetic
aatacgcgatgcagctcgccggtgttggcgtggagc

SEQ ID NO: 7509 - DNA, 39 bp, Artificial Sequence
  Synthetic
aagctcgccatgcccttcgcggttgtccaaatcgaccag

SEQ ID NO: 7510 - DNA, 41 bp, Artificial Sequence
  Synthetic
ttccaaatcatcctgccccaccgagtgcttcgtaggcgttg

SEQ ID NO: 7511 - DNA, 38 bp, Artificial Sequence
  Synthetic
tgagccgccttctcgacaaccgctgtgtcggagttggc

SEQ ID NO: 7512 - DNA, 36 bp, Artificial Sequence
  Synthetic
attccgccatgccgtccggcttcgacgatggtgcag

SEQ ID NO: 7513 - DNA, 40 bp, Artificial Sequence
  Synthetic
cggcgtaatcgtcggctcgcccagagtttggtttcgacgg

SEQ ID NO: 7514 - DNA, 40 bp, Artificial Sequence
  Synthetic
cgcataccgcagcgaaatgcaaggtggaactgtgcggtaa

SEQ ID NO: 7515 - DNA, 37 bp, Artificial Sequence
  Synthetic
gcagcagcggaacacaaagcagttgccgggcgatgag

SEQ ID NO: 7516 - DNA, 39 bp, Artificial Sequence
  Synthetic
cggttccctaaggcgcccacgcaggcagtacaaatggta

SEQ ID NO: 7517 - DNA, 39 bp, Artificial Sequence
  Synthetic
tgcagaccggcaagctgttattcttgtttgccgccttcg

SEQ ID NO: 7518 - DNA, 35 bp, Artificial Sequence
  Synthetic
gcgggcgaactcgacgcttatcgccaccatcgggc

SEQ ID NO: 7519 - DNA, 39 bp, Artificial Sequence
  Synthetic
atgattttggacatcggcccgaaccggcggctttaagca

SEQ ID NO: 7520 - DNA, 40 bp, Artificial Sequence
  Synthetic
ggttggcgcagaagctgtttgcactacttctcgctgcacg

SEQ ID NO: 7521 - DNA, 40 bp, Artificial Sequence
  Synthetic
agacgacctgattattgcccgctctaccacggcgcagaag

SEQ ID NO: 7522 - DNA, 40 bp, Artificial Sequence
  Synthetic
aagggtttccaacaggctgctgtctgttcgagttggcaca

SEQ ID NO: 7523 - DNA, 39 bp, Artificial Sequence
  Synthetic
cgccgacctgttcgcaaatcgacagtatctggcgcgcct

SEQ ID NO: 7524 - DNA, 43 bp, Artificial Sequence
  Synthetic
aaatgccgtctgaacacattgccataagccgcaatatcaagtt

SEQ ID NO: 7525 - DNA, 38 bp, Artificial Sequence
  Synthetic
cgggctgccgtttaccatagtttcaacagatacgccgc

SEQ ID NO: 7526 - DNA, 43 bp, Artificial Sequence
  Synthetic
gttcaagtttcggctattgcaaatgataaaccaaatctgcggt

SEQ ID NO: 7527 - DNA, 41 bp, Artificial Sequence
  Synthetic
ccgcaacacaagggtatgatttgaagtaaaggctgcaattg

SEQ ID NO: 7528 - DNA, 39 bp, Artificial Sequence
  Synthetic
ccgcagttttgccctgtcctgtaaaaacctgccccaccc

SEQ ID NO: 7529 - DNA, 37 bp, Artificial Sequence
  Synthetic
tatcgacatcgggcacgctggaagggacggcggaact

SEQ ID NO: 7530 - DNA, 38 bp, Artificial Sequence
  Synthetic
gtaatcctgccgccgagcgcgatttgggcatcggcaac

SEQ ID NO: 7531 - DNA, 35 bp, Artificial Sequence
  Synthetic
ccgggcaatacggcatcgccctacgggcacaacgc

SEQ ID NO: 7532 - DNA, 38 bp, Artificial Sequence
  Synthetic
gcatcgggcggcttgtgtagacatccgttcgctcgatt

SEQ ID NO: 7533 - DNA, 40 bp, Artificial Sequence
  Synthetic
cgagatagccttgcgcggtcgtgttcgacaccgtcaacat

SEQ ID NO: 7534 - DNA, 40 bp, Artificial Sequence
  Synthetic
ggtacagcccgaagcgcaaagcagtatgtttcctcggctg

SEQ ID NO: 7535 - DNA, 38 bp, Artificial Sequence
  Synthetic
ggcagaggtgcggattagcgcgacggcaaaatcgggac

SEQ ID NO: 7536 - DNA, 38 bp, Artificial Sequence
  Synthetic
ttttccggccttctgcgagaaaggtatgtgcgcgaccg

SEQ ID NO: 7537 - DNA, 35 bp, Artificial Sequence
  Synthetic
agatgaggaggcagcgggccttctccggcggttgc

SEQ ID NO: 7538 - DNA, 43 bp, Artificial Sequence
  Synthetic
ggcatattaacaacatcaaccctgcttgtagctgcaatgaacg

SEQ ID NO: 7539 - DNA, 39 bp, Artificial Sequence
  Synthetic
cgatggggaggtttggaagctagtctgccaccctatccg

SEQ ID NO: 7540 - DNA, 39 bp, Artificial Sequence
  Synthetic
cgtaacctacgccgcccagctctatgatggcgggcatag

SEQ ID NO: 7541 - DNA, 36 bp, Artificial Sequence
  Synthetic
cggcatcttgtccgacggccaacacaccgacagccc

SEQ ID NO: 7542 - DNA, 35 bp, Artificial Sequence
  Synthetic
ggtaggaacgggcggtggtgcgcgcaaaccgatga

SEQ ID NO: 7543 - DNA, 36 bp, Artificial Sequence
  Synthetic
gcggatgggggacgttgagcgacggcggcaaaatcg

SEQ ID NO: 7544 - DNA, 37 bp, Artificial Sequence
  Synthetic
gcaaaggcggcttgggcaaattgttttggggcgcggt

SEQ ID NO: 7545 - DNA, 38 bp, Artificial Sequence
  Synthetic
tgattaccgccgtctccgccatgcagggtggtgaaggg

SEQ ID NO: 7546 - DNA, 39 bp, Artificial Sequence
  Synthetic
ctatcacgcaccggtctgctggcgggattgacggtttcg

SEQ ID NO: 7547 - DNA, 42 bp, Artificial Sequence
  Synthetic
ggcaggcgtatgcgaaagatgtcaagttcgggcgtaaccatc

SEQ ID NO: 7548 - DNA, 38 bp, Artificial Sequence
  Synthetic
ccatgcccagtttgcggatgcgcccgccaaagttaccg

SEQ ID NO: 7549 - DNA, 38 bp, Artificial Sequence
  Synthetic
gccggaagcggcttggtacggcctgttccaaaacgatt

SEQ ID NO: 7550 - DNA, 38 bp, Artificial Sequence
  Synthetic
catcggcaagattttcggtcgcaattgctgctggcgcg

SEQ ID NO: 7551 - DNA, 38 bp, Artificial Sequence
  Synthetic
gcagcagatgccggcgcatacagccgccaatagccgtc

SEQ ID NO: 7552 - DNA, 38 bp, Artificial Sequence
  Synthetic
gcctgttgcggcacttgctgatttgcgtttccaaaccc

SEQ ID NO: 7553 - DNA, 37 bp, Artificial Sequence
  Synthetic
cgaagcggcgggattcggaacttgagccggctgttcc

SEQ ID NO: 7554 - DNA, 40 bp, Artificial Sequence
  Synthetic
ttgtcgaacactttgccgaagcaaccgtcatacgcgacac

SEQ ID NO: 7555 - DNA, 38 bp, Artificial Sequence
  Synthetic
aacaaccgtccgatttggtgcgcccgaatccgcgctca

SEQ ID NO: 7556 - DNA, 38 bp, Artificial Sequence
  Synthetic
gcaatacgccgtcaaaaccccacgggcttgggtttgcc

SEQ ID NO: 7557 - DNA, 36 bp, Artificial Sequence
  Synthetic
gacagggcgcggtcgagttcgccggtttgcgtttgg

SEQ ID NO: 7558 - DNA, 39 bp, Artificial Sequence
  Synthetic
gcggttttcgcgccgtagcagacctgcaagcccaatacg

SEQ ID NO: 7559 - DNA, 39 bp, Artificial Sequence
  Synthetic
tcatcgtgagcgtgttcagacgtgggcaggcagagcatt

SEQ ID NO: 7560 - DNA, 35 bp, Artificial Sequence
  Synthetic
ggcatgacggcggacagttgcccgccgtttcagac

SEQ ID NO: 7561 - DNA, 40 bp, Artificial Sequence
  Synthetic
atttcggcaatcgataccgccgctccttcatcttccgccg

SEQ ID NO: 7562 - DNA, 38 bp, Artificial Sequence
  Synthetic
gcaaacacgccgccgacatgtttggcgatgacggtaac

SEQ ID NO: 7563 - DNA, 39 bp, Artificial Sequence
  Synthetic
cgaactttccggcggtcagaaccggattcaggcacaggg

SEQ ID NO: 7564 - DNA, 40 bp, Artificial Sequence
  Synthetic
gtcgaattcgtcctgaccgaggggtcgactttgccggaac

SEQ ID NO: 7565 - DNA, 40 bp, Artificial Sequence
  Synthetic
gttggcgatgctggtggtggagtggaaaaggacgaaccga

SEQ ID NO: 7566 - DNA, 35 bp, Artificial Sequence
  Synthetic
ccgcgtccgattccacgcttatggtcgtgccgccc

SEQ ID NO: 7567 - DNA, 37 bp, Artificial Sequence
  Synthetic
ggttcgcccgcttccagcacatcgtcggctgcacaca

SEQ ID NO: 7568 - DNA, 34 bp, Artificial Sequence
  Synthetic
tggcagccctctcgcctgaatggcgcggcggtaa

SEQ ID NO: 7569 - DNA, 40 bp, Artificial Sequence
  Synthetic
accttggttgccgcgactttcagtttggcatcagggtctt

SEQ ID NO: 7570 - DNA, 36 bp, Artificial Sequence
  Synthetic
aacggcgtggcgcaaggtcattttgccccgatgcgg

SEQ ID NO: 7571 - DNA, 40 bp, Artificial Sequence
  Synthetic
tttggcagaggcgctcaaagatgcttctcaatccggcaac

SEQ ID NO: 7572 - DNA, 37 bp, Artificial Sequence
  Synthetic
ccggcatcggcgatctcatctaacccaagccgacgcg

SEQ ID NO: 7573 - DNA, 42 bp, Artificial Sequence
  Synthetic
gtgccgtagtggttttcgagcagccaaacgggttttccttac

SEQ ID NO: 7574 - DNA, 39 bp, Artificial Sequence
  Synthetic
ggaagggcggcttcttctgccctttatatacgcggccgg

SEQ ID NO: 7575 - DNA, 39 bp, Artificial Sequence
  Synthetic
atgcgctgaaaacacccccgatggcgtagaacggtgtga

SEQ ID NO: 7576 - DNA, 47 bp, Artificial Sequence
  Synthetic
ggcatcgggaacttaatcaggggtttcagaccttttcctaattcaat

SEQ ID NO: 7577 - DNA, 37 bp, Artificial Sequence
  Synthetic
gcccgaagatttggtgtgccgtttcctgccctgccgc

SEQ ID NO: 7578 - DNA, 38 bp, Artificial Sequence
  Synthetic
atgagtatcgtgctgcacggcgtcaggtgggcgcaacc

SEQ ID NO: 7579 - DNA, 35 bp, Artificial Sequence
  Synthetic
ggccagccgtccgcattcaactgggaggcaggctg

SEQ ID NO: 7580 - DNA, 40 bp, Artificial Sequence
  Synthetic
cgacaacgccctgagcaagggcttaagcggaattggtcgc

SEQ ID NO: 7581 - DNA, 38 bp, Artificial Sequence
  Synthetic
tcgtctttggcggcgtcggcgtgaaaacggttcggtaa

SEQ ID NO: 7582 - DNA, 36 bp, Artificial Sequence
  Synthetic
gcgaggtaggcggtcagcacgaacgcctgcacgaag

SEQ ID NO: 7583 - DNA, 37 bp, Artificial Sequence
  Synthetic
cgtcggtgttgacggcaatgccggcctcaaacgcctc

SEQ ID NO: 7584 - DNA, 36 bp, Artificial Sequence
  Synthetic
gccgccggcattgtcgatagcccttgtccgcatcag

SEQ ID NO: 7585 - DNA, 38 bp, Artificial Sequence
  Synthetic
cggaaggattgcaggcttttgggccgcacctgtccatg

SEQ ID NO: 7586 - DNA, 36 bp, Artificial Sequence
  Synthetic
tcaaacagagcccgacgtgggcggcagccaaaaccc

SEQ ID NO: 7587 - DNA, 36 bp, Artificial Sequence
  Synthetic
gcgtgaaggtcgccaaaggcccgccgttgtgcgaaa

SEQ ID NO: 7588 - DNA, 47 bp, Artificial Sequence
  Synthetic
cgttttcctgatgttccgtcttgataataaaaattctggcaaccatc

SEQ ID NO: 7589 - DNA, 37 bp, Artificial Sequence
  Synthetic
cgggctgtccgtccgtatcgaatcccgaacccgaccc

SEQ ID NO: 7590 - DNA, 37 bp, Artificial Sequence
  Synthetic
attcatcgcggcaggttgacggaacgacgccggcaac

SEQ ID NO: 7591 - DNA, 38 bp, Artificial Sequence
  Synthetic
caggcctcaacccatcctgcgttttcctggatggcggc

SEQ ID NO: 7592 - DNA, 38 bp, Artificial Sequence
  Synthetic
aagctccctgccgtggattttgactgacccgccgcttc

SEQ ID NO: 7593 - DNA, 38 bp, Artificial Sequence
  Synthetic
cggggacgcggatttcagacgcccttaccgcccatcaa

SEQ ID NO: 7594 - DNA, 39 bp, Artificial Sequence
  Synthetic
gttccgcgccgatgatgcgatcctcaactggtcgctcaa

SEQ ID NO: 7595 - DNA, 39 bp, Artificial Sequence
  Synthetic
tgatgttgacggcgcagtggcagcaccacaaaccagacc

SEQ ID NO: 7596 - DNA, 38 bp, Artificial Sequence
  Synthetic
gatgacgggcgcgacgtgtttggaaaaacaccgcccga

SEQ ID NO: 7597 - DNA, 38 bp, Artificial Sequence
  Synthetic
aaagacggcttcatgcgtgcgtcttccaaccctccgcc

SEQ ID NO: 7598 - DNA, 36 bp, Artificial Sequence
  Synthetic
gaagcccagtccgacgacgtaagctcgccgttgccg

SEQ ID NO: 7599 - DNA, 39 bp, Artificial Sequence
  Synthetic
cgtatggcgaggcggtcgacttgggctacctgcaccata

SEQ ID NO: 7600 - DNA, 38 bp, Artificial Sequence
  Synthetic
gcgaaattttgccgcctactgccatcttcgtcggcggc

SEQ ID NO: 7601 - DNA, 40 bp, Artificial Sequence
  Synthetic
gcctgcctgaaaggttcggacaccggtatggaaacactgc

SEQ ID NO: 7602 - DNA, 39 bp, Artificial Sequence
  Synthetic
gacgatgccgcgctgctgtatggttgccgagattgtcct

SEQ ID NO: 7603 - DNA, 36 bp, Artificial Sequence
  Synthetic
gtagccgcgtttgagggcgcaacaggcgcaaaacgg

SEQ ID NO: 7604 - DNA, 36 bp, Artificial Sequence
  Synthetic
tcgccttcggcatagggacactgcggcaagaccacc

SEQ ID NO: 7605 - DNA, 41 bp, Artificial Sequence
  Synthetic
cccgcgccggtaatcagaatcgttggaaaaaaccgtggacg

SEQ ID NO: 7606 - DNA, 41 bp, Artificial Sequence
  Synthetic
actttgccgagcatatagccgctgattttgggtctgccgac

SEQ ID NO: 7607 - DNA, 39 bp, Artificial Sequence
  Synthetic
cgcgaagggcagtacgtccgtcatgctgcccatcgtatt

SEQ ID NO: 7608 - DNA, 38 bp, Artificial Sequence
  Synthetic
atgccgtatcacgttccccctccgccgccaaagtcaga

SEQ ID NO: 7609 - DNA, 35 bp, Artificial Sequence
  Synthetic
gacgccgcctacgcactcaacggcattcacgcccg

SEQ ID NO: 7610 - DNA, 38 bp, Artificial Sequence
  Synthetic
acaccttggctcgttccaaaggcaataagacgggacat

SEQ ID NO: 7611 - DNA, 38 bp, Artificial Sequence
  Synthetic
atcaggtaggcaaacaccgccatgctgctggggcggta

SEQ ID NO: 7612 - DNA, 39 bp, Artificial Sequence
  Synthetic
ccaaggcgaggacggtgcaccccattttggagacaccct

SEQ ID NO: 7613 - DNA, 38 bp, Artificial Sequence
  Synthetic
cgtcatacaggcgcgggctgaacactggagcttcagcg

SEQ ID NO: 7614 - DNA, 37 bp, Artificial Sequence
  Synthetic
ttccgcgctgcaacacgctcatgcagtcggtcgtcag

SEQ ID NO: 7615 - DNA, 35 bp, Artificial Sequence
  Synthetic
ccgttaccggggttctgcgaccggctcgaaccagc

SEQ ID NO: 7616 - DNA, 39 bp, Artificial Sequence
  Synthetic
acctgaacgccttgtcctccaggtaaacacgacgcaggc

SEQ ID NO: 7617 - DNA, 35 bp, Artificial Sequence
  Synthetic
gttggcgggttggatgggcttccctctgaccggcc

SEQ ID NO: 7618 - DNA, 34 bp, Artificial Sequence
  Synthetic
gccgcatttcaaagcggcggcgcagtgccgaaca

SEQ ID NO: 7619 - DNA, 39 bp, Artificial Sequence
  Synthetic
cgaacctgccgatgccgtattgcatcggcaactcggcac

SEQ ID NO: 7620 - DNA, 35 bp, Artificial Sequence
  Synthetic
gtttgttggcggtaggcgcaagcggcatccgggac

SEQ ID NO: 7621 - DNA, 38 bp, Artificial Sequence
  Synthetic
cgcgcgttccgaacccaagatccgaaatacaccaccgc

SEQ ID NO: 7622 - DNA, 37 bp, Artificial Sequence
  Synthetic
gatgccggaaccgacaccgccgcatccgtttgaagcc

SEQ ID NO: 7623 - DNA, 40 bp, Artificial Sequence
  Synthetic
cgccttcaaaccccaagccggctttatacgggcagcatcg

SEQ ID NO: 7624 - DNA, 36 bp, Artificial Sequence
  Synthetic
gcgcggcgttcgtcttgtaccgaaccgatgaaaggc

SEQ ID NO: 7625 - DNA, 35 bp, Artificial Sequence
  Synthetic
gcggggaggccgtctgaattttgccgactgcgccg

SEQ ID NO: 7626 - DNA, 37 bp, Artificial Sequence
  Synthetic
cgctcttcaatcagcgtgcccgcgctacggcaaccct

SEQ ID NO: 7627 - DNA, 34 bp, Artificial Sequence
  Synthetic
ggcatgcgccgcattgtgtctgcggcggttttgc

SEQ ID NO: 7628 - DNA, 36 bp, Artificial Sequence
  Synthetic
tggcccggcgtgttttcccggcggtatagacggcag

SEQ ID NO: 7629 - DNA, 38 bp, Artificial Sequence
  Synthetic
cctgggctttgctgatgacgcgggtgcgtggcttttcg

SEQ ID NO: 7630 - DNA, 35 bp, Artificial Sequence
  Synthetic
ggcggccagcagcttgtctgctcaggcggaatggc

SEQ ID NO: 7631 - DNA, 35 bp, Artificial Sequence
  Synthetic
gttgcgcgcgtctgtggtgcaacgatgcctggagg

SEQ ID NO: 7632 - DNA, 42 bp, Artificial Sequence
  Synthetic
agtcatcgtcttcatcgtcgccttgccggtgctttgaatcag

SEQ ID NO: 7633 - DNA, 37 bp, Artificial Sequence
  Synthetic
ccagccgccgcctttcctttcggcgacaacctcttga

SEQ ID NO: 7634 - DNA, 35 bp, Artificial Sequence
  Synthetic
gccgtctgaacgcgaccgtcattcgaccagcgcgg

SEQ ID NO: 7635 - DNA, 41 bp, Artificial Sequence
  Synthetic
tcggtttgattcctaccggcgacaaaatacccaaggcggcg

SEQ ID NO: 7636 - DNA, 40 bp, Artificial Sequence
  Synthetic
cctgctgaaaaaagccgatgccttcgtcctgttgcagcag

SEQ ID NO: 7637 - DNA, 38 bp, Artificial Sequence
  Synthetic
gtcgccgtcagccattattgcccccaaacggtgcagtc

SEQ ID NO: 7638 - DNA, 39 bp, Artificial Sequence
  Synthetic
ttgccgcttctgatcgattgccagccgactgttcctgcc

SEQ ID NO: 7639 - DNA, 38 bp, Artificial Sequence
  Synthetic
taccgcgaacgcatgagggcccgaccgcttcatctgcg

SEQ ID NO: 7640 - DNA, 38 bp, Artificial Sequence
  Synthetic
agggcgcgggtcatatcggcggggcattaccgtcaact

SEQ ID NO: 7641 - DNA, 35 bp, Artificial Sequence
  Synthetic
ggcaatggcgacgcgttggcccatcggatcgaacg

SEQ ID NO: 7642 - DNA, 40 bp, Artificial Sequence
  Synthetic
ggcgaggaacatcgtctgcacaaatgtacgcccccatcaa

SEQ ID NO: 7643 - DNA, 38 bp, Artificial Sequence
  Synthetic
ggcgatgaaggcggcaagagccctgattgccattttcg

SEQ ID NO: 7644 - DNA, 36 bp, Artificial Sequence
  Synthetic
gcagccatggtgcgtccgaactcgcccggacaagtc

SEQ ID NO: 7645 - DNA, 41 bp, Artificial Sequence
  Synthetic
catgagttgtgccagttccgccgtccgccggaaattcgaca

SEQ ID NO: 7646 - DNA, 38 bp, Artificial Sequence
  Synthetic
tggagacaacatgtagcgcaccatatctcgcacacagc

SEQ ID NO: 7647 - DNA, 46 bp, Artificial Sequence
  Synthetic
gacagttggtgtcctaattgtaacaaatggcaaaagatgtagcaag

SEQ ID NO: 7648 - DNA, 46 bp, Artificial Sequence
  Synthetic
aaaggaggttattgtttgaggacactgaacattatggttttcagct

SEQ ID NO: 7649 - DNA, 48 bp, Artificial Sequence
  Synthetic
acagctgacgttaattagccacccccattgaatcattttagaaagttc

SEQ ID NO: 7650 - DNA, 45 bp, Artificial Sequence
  Synthetic
atcccttgcgaaatctaaatatgcagcaaattgatcagagcttgt

SEQ ID NO: 7651 - DNA, 44 bp, Artificial Sequence
  Synthetic
tttggagtgtgcattacaaaaatgacagacctcctagaagagct

SEQ ID NO: 7652 - DNA, 42 bp, Artificial Sequence
  Synthetic
aacctaaacttgggtcccctggtgtttcttcttgtgtaaccc

SEQ ID NO: 7653 - DNA, 42 bp, Artificial Sequence
  Synthetic
tattgcagtgattgatacaccaggacactgcgtctattgtgg

SEQ ID NO: 7654 - DNA, 43 bp, Artificial Sequence
  Synthetic
acaagacaggttttaaatgtcaccggtgtcaaaggcgggattt

SEQ ID NO: 7655 - DNA, 47 bp, Artificial Sequence
  Synthetic
accaccagcatttaatgtaaaagtgtctgttacaggatgatacacta

SEQ ID NO: 7656 - DNA, 44 bp, Artificial Sequence
  Synthetic
agtaggggttcaaattgatagaggtcgatccagtaaagggtgac

SEQ ID NO: 7657 - DNA, 43 bp, Artificial Sequence
  Synthetic
aaggagatagtttacctacagacccgaggagtaccatcagctg

SEQ ID NO: 7658 - DNA, 49 bp, Artificial Sequence
  Synthetic
acttgatgagtgggaattagcattttatctgtaagtatcttccaaaccc

SEQ ID NO: 7659 - DNA, 47 bp, Artificial Sequence
  Synthetic
gacctatgtgtaagtgaccaatagcaggaaacagaatgattcaacat

SEQ ID NO: 7660 - DNA, 50 bp, Artificial Sequence
  Synthetic
aaatcgaaacaaacaaatttgcagcgaaaatctgaatacatgaagcatac

SEQ ID NO: 7661 - DNA, 44 bp, Artificial Sequence
  Synthetic
cgagattggagtgacaaggagagtggatgtgtgtattctcagat

SEQ ID NO: 7662 - DNA, 39 bp, Artificial Sequence
  Synthetic
cggtccaaattcctgctgatgtattccctccccttcgtg

SEQ ID NO: 7663 - DNA, 43 bp, Artificial Sequence
  Synthetic
aaagtgggcacttggtgagaatgtctctacagttgtcaaagtc

SEQ ID NO: 7664 - DNA, 48 bp, Artificial Sequence
  Synthetic
aggaattacttcacagcagaggtatacccccttcattatatattctgt

SEQ ID NO: 7665 - DNA, 42 bp, Artificial Sequence
  Synthetic
gcatggagttttctctcactgacaggacacagtacttctccc

SEQ ID NO: 7666 - DNA, 43 bp, Artificial Sequence
  Synthetic
tgagaataaatcagaaacatggcccctgcagaccttcccaatg

SEQ ID NO: 7667 - DNA, 38 bp, Artificial Sequence
  Synthetic
agcgataggaggggatgctaggctagccccgctgctct

SEQ ID NO: 7668 - DNA, 37 bp, Artificial Sequence
  Synthetic
tgggatgctcctcccgattcctcccgccattcctggg

SEQ ID NO: 7669 - DNA, 38 bp, Artificial Sequence
  Synthetic
tccttcggatgcccaggtcgtttcctcttcgggtcggc

SEQ ID NO: 7670 - DNA, 36 bp, Artificial Sequence
  Synthetic
cgctcccctcgttccacctaagaatagccggcccgc

SEQ ID NO: 7671 - DNA, 39 bp, Artificial Sequence
  Synthetic
aaggcctcttcctaggtccggaaggatggagagggggct

SEQ ID NO: 7672 - DNA, 39 bp, Artificial Sequence
  Synthetic
agagaacgacccagaacgctacacactgtacctgcaaat

SEQ ID NO: 7673 - DNA, 42 bp, Artificial Sequence
  Synthetic
attggggccagaagaaaaacaaagccctgctatttcgtgaaa

SEQ ID NO: 7674 - DNA, 43 bp, Artificial Sequence
  Synthetic
ttggactatgaacaatttgacagcttcttgtccagcttgtctg

SEQ ID NO: 7675 - DNA, 43 bp, Artificial Sequence
  Synthetic
ggggtgtacagggtggttttcattgtctgtttcatcatctgat

SEQ ID NO: 7676 - DNA, 40 bp, Artificial Sequence
  Synthetic
actaggtagtcagaacagccctgtattctgctgactgtcg

SEQ ID NO: 7677 - DNA, 38 bp, Artificial Sequence
  Synthetic
ggaggacgcggacaaagaaatattttctcctggcacgc

SEQ ID NO: 7678 - DNA, 42 bp, Artificial Sequence
  Synthetic
acagaagcttggacaatgcgaacaatgtttaggttctgtcat

SEQ ID NO: 7679 - DNA, 39 bp, Artificial Sequence
  Synthetic
tggactttaaacaagaggcggaccacacacatgtacagc

SEQ ID NO: 7680 - DNA, 39 bp, Artificial Sequence
  Synthetic
ccactgtcaccacagctgccggcctccacttgtactgtg

SEQ ID NO: 7681 - DNA, 41 bp, Artificial Sequence
  Synthetic
acctacatttagtggtggcaatggatgtccaacacagcagg

SEQ ID NO: 7682 - DNA, 44 bp, Artificial Sequence
  Synthetic
cgcaaaggtactgtacgctatagttccactacgtgttttcatag

SEQ ID NO: 7683 - DNA, 47 bp, Artificial Sequence
  Synthetic
taccagttccaagatatgcctccgtaacattggtagtggaagtatta

SEQ ID NO: 7684 - DNA, 38 bp, Artificial Sequence
  Synthetic
tttcagatggctttgtggcgttgacaacccgagacaca

SEQ ID NO: 7685 - DNA, 39 bp, Artificial Sequence
  Synthetic
tggattgcctgatccacagtacttcaacaccaacacagg

SEQ ID NO: 7686 - DNA, 41 bp, Artificial Sequence
  Synthetic
gggattgcccccccttagaagtatcaatcatatcgccatcc

SEQ ID NO: 7687 - DNA, 38 bp, Artificial Sequence
  Synthetic
gggatgctatacccaccactagaagatgtagggggctc

SEQ ID NO: 7688 - DNA, 46 bp, Artificial Sequence
  Synthetic
acaactgtatgtaatgtaaaggcgtaacacataaccatgcatacat

SEQ ID NO: 7689 - DNA, 40 bp, Artificial Sequence
  Synthetic
ccaccttagtatgtaggcggcggggccatccaagtcaagc

SEQ ID NO: 7690 - DNA, 38 bp, Artificial Sequence
  Synthetic
ttgcgaggggatctgggagtgcgcaggtacaggacttg

SEQ ID NO: 7691 - DNA, 42 bp, Artificial Sequence
  Synthetic
tggagtcaactgggctactggtcaggccaaagatagcagaca

SEQ ID NO: 7692 - DNA, 40 bp, Artificial Sequence
  Synthetic
acacccttccaattggactggccacaggtcacaagagcgc

SEQ ID NO: 7693 - DNA, 43 bp, Artificial Sequence
  Synthetic
cgaggggatgtatggttaaattcaaatagtgcagtacgatggc

SEQ ID NO: 7694 - DNA, 39 bp, Artificial Sequence
  Synthetic
gtaccccacctgtggtacgtcctgtggctaggtctttca

SEQ ID NO: 7695 - DNA, 42 bp, Artificial Sequence
  Synthetic
tggagggctgacaataccaccttgagcaaagaagccaaaacg

SEQ ID NO: 7696 - DNA, 48 bp, Artificial Sequence
  Synthetic
gttagggcccatagaatgttggtcactaagaggaaaaacttaagaaca

SEQ ID NO: 7697 - DNA, 38 bp, Artificial Sequence
  Synthetic
cgccagatgggtgggccattgccacgttcagagagaca

SEQ ID NO: 7698 - DNA, 40 bp, Artificial Sequence
  Synthetic
gtcccttactcggtgctcttgcaccaatgaccccagtcgt

SEQ ID NO: 7699 - DNA, 43 bp, Artificial Sequence
  Synthetic
tcttacatgcaggagaagtatgaggtcgcgtgcatgtactttg

SEQ ID NO: 7700 - DNA, 48 bp, Artificial Sequence
  Synthetic
acatgccaacataactgagattcaatcttcagattttcctccttaatc

SEQ ID NO: 7701 - DNA, 38 bp, Artificial Sequence
  Synthetic
caacctgggttacctgcgatatgaaggttcggggttga

SEQ ID NO: 7702 - DNA, 43 bp, Artificial Sequence
  Synthetic
cctcatgcagctacaatccttgggattgtcaggtaaagtgact

SEQ ID NO: 7703 - DNA, 42 bp, Artificial Sequence
  Synthetic
gtctactccgcgttcaatccggccctgctgttgtcaaagcaa

SEQ ID NO: 7704 - DNA, 47 bp, Artificial Sequence
  Synthetic
ggactagtcttgtcgtcaattatggtgtgatctcccattttctcata

SEQ ID NO: 7705 - DNA, 40 bp, Artificial Sequence
  Synthetic
ccatgccgatgcccctgttgtgcacatccaattgcagtga

SEQ ID NO: 7706 - DNA, 39 bp, Artificial Sequence
  Synthetic
caactcgggccatcactagtgttctaagctccgcatccc

SEQ ID NO: 7707 - DNA, 41 bp, Artificial Sequence
  Synthetic
ttgcagaagtgtgtcgaggcaagacctcctcctttggaact

SEQ ID NO: 7708 - DNA, 42 bp, Artificial Sequence
  Synthetic
aactcagtgaccaacaccgagcgtcctccagcgtataactgc

SEQ ID NO: 7709 - DNA, 41 bp, Artificial Sequence
  Synthetic
tgcagacaaacaagcaatgcgttcttgtggtgcacccatca

SEQ ID NO: 7710 - DNA, 41 bp, Artificial Sequence
  Synthetic
gcatcattgctggtgtgcacggatctcagcgttggtgtagc

SEQ ID NO: 7711 - DNA, 43 bp, Artificial Sequence
  Synthetic
attgtgatgtttactccccggaacttctgcaatcttctctgtg

SEQ ID NO: 7712 - DNA, 40 bp, Artificial Sequence
  Synthetic
tggtctgaaggggatgacgtcctcctcacccacccgagac

SEQ ID NO: 7713 - DNA, 46 bp, Artificial Sequence
  Synthetic
gaattcaactcccccccaaacgatacactatctctgttatgtttct

SEQ ID NO: 7714 - DNA, 39 bp, Artificial Sequence
  Synthetic
tggggacatctgggtgacaaccaagggcaaattggtaac

SEQ ID NO: 7715 - DNA, 43 bp, Artificial Sequence
  Synthetic
aacgggggatgataaaaatgcaaatactatctacaagcctccc

SEQ ID NO: 7716 - DNA, 42 bp, Artificial Sequence
  Synthetic
atcctggtgtcagatgtgtcttgtttatatctacgatgggcc

SEQ ID NO: 7717 - DNA, 42 bp, Artificial Sequence
  Synthetic
aatgacgtgtggatgggaagatcaatgactttgaaggtttca

SEQ ID NO: 7718 - DNA, 38 bp, Artificial Sequence
  Synthetic
agaagtcagtggcgaggttttgatatcaggttgtgccc

SEQ ID NO: 7719 - DNA, 40 bp, Artificial Sequence
  Synthetic
ggacagctttcctttgtgtgcttagttaggtctgccatgg

SEQ ID NO: 7720 - DNA, 43 bp, Artificial Sequence
  Synthetic
ggaattccctggcgttttacagctctgatattgctttattgca

SEQ ID NO: 7721 - DNA, 49 bp, Artificial Sequence
  Synthetic
agctgatactcagataagtgtaccccacagcttttctattactacatct

SEQ ID NO: 7722 - DNA, 48 bp, Artificial Sequence
  Synthetic
ttgcttgttggcaatatatggatgtcaatagatacagcattaccatct

SEQ ID NO: 7723 - DNA, 40 bp, Artificial Sequence
  Synthetic
gaagcgtcgacgagctgcagcctgatggggctgatgatga

SEQ ID NO: 7724 - DNA, 47 bp, Artificial Sequence
  Synthetic
ctcttggaagagttcagcgactgaccttttaaaattaggatgaatgg

SEQ ID NO: 7725 - DNA, 38 bp, Artificial Sequence
  Synthetic
ccggaaggtgcaccaacaaatgggccttgtaactgatg

SEQ ID NO: 7726 - DNA, 50 bp, Artificial Sequence
  Synthetic
ttcaactacagaaacctcagtttgcttccaagtctactaaatctgactaa

SEQ ID NO: 7727 - DNA, 41 bp, Artificial Sequence
  Synthetic
atcctccagaacaaacagacgatctgaacctgtttgggatc

SEQ ID NO: 7728 - DNA, 43 bp, Artificial Sequence
  Synthetic
tggcctgatcttataaaaatggagctgctcccgttttgtgaaa

SEQ ID NO: 7729 - DNA, 40 bp, Artificial Sequence
  Synthetic
acaacatgtgcagacaaactgaagccagtaacaaaagcgg

SEQ ID NO: 7730 - DNA, 43 bp, Artificial Sequence
  Synthetic
aaatggaacgtgttaccctggaactaaaaagtgtcctgagttc

SEQ ID NO: 7731 - DNA, 45 bp, Artificial Sequence
  Synthetic
tgtggggcatacatcacccagtgtcgtttcttatgtacaaatttg

SEQ ID NO: 7732 - DNA, 41 bp, Artificial Sequence
  Synthetic
ggagggagccatggaagaatattgcactacacaattaccac

SEQ ID NO: 7733 - DNA, 46 bp, Artificial Sequence
  Synthetic
tggtttccagcattcaaatgatcaagccttttgagttgaatcccta

SEQ ID NO: 7734 - DNA, 43 bp, Artificial Sequence
  Synthetic
ctatataacaaggtgaagagggcacctcgaaacagcctttccc

SEQ ID NO: 7735 - DNA, 39 bp, Artificial Sequence
  Synthetic
aaacccgctcaatgcccggcactactcggctagcagtct

SEQ ID NO: 7736 - DNA, 36 bp, Artificial Sequence
  Synthetic
gcaggggccctaaattgggttccacggggttgcgac

SEQ ID NO: 7737 - DNA, 36 bp, Artificial Sequence
  Synthetic
cgagcttcggagcagtcacgaaggcagcccctcctg

SEQ ID NO: 7738 - DNA, 39 bp, Artificial Sequence
  Synthetic
gggcggtactgttggtcaaggtacgaactgcaactgccg

SEQ ID NO: 7739 - DNA, 40 bp, Artificial Sequence
  Synthetic
gatgacaagccgtattgctggcactggaccgcagacatcc

SEQ ID NO: 7740 - DNA, 39 bp, Artificial Sequence
  Synthetic
ggccaacaggcaacaacagcacccacatctggtgtaggt

SEQ ID NO: 7741 - DNA, 40 bp, Artificial Sequence
  Synthetic
cttcacacctacgcccgctcgccgtagaggtattgggtgt

SEQ ID NO: 7742 - DNA, 42 bp, Artificial Sequence
  Synthetic
gcttggcttggcatgtcaagggacggactaagagtagtggcc

SEQ ID NO: 7743 - DNA, 42 bp, Artificial Sequence
  Synthetic
cgtgacgctgtcatcatgctcacccagtatcccgaagaggat

SEQ ID NO: 7744 - DNA, 42 bp, Artificial Sequence
  Synthetic
ggagacgaaggtcatcacgtgggctgataccggaagaacagc

SEQ ID NO: 7745 - DNA, 42 bp, Artificial Sequence
  Synthetic
cggttctaagacccttgctggccccaccaggtctttgtctac

SEQ ID NO: 7746 - DNA, 38 bp, Artificial Sequence
  Synthetic
gtgtgcacgcggggtgttgtggtctccaggttttcgac

SEQ ID NO: 7747 - DNA, 39 bp, Artificial Sequence
  Synthetic
taggactgtcaccaccggagccgtcggcgaagaacttgc

SEQ ID NO: 7748 - DNA, 38 bp, Artificial Sequence
  Synthetic
agaggtctagacgtcgccgtgtcatgagcgcgtcagtg

SEQ ID NO: 7749 - DNA, 42 bp, Artificial Sequence
  Synthetic
accggtatgtttcgtctggggaactcacagagcaccacagag

SEQ ID NO: 7750 - DNA, 38 bp, Artificial Sequence
  Synthetic
gctgggggccgttcagaatggtctgcggacatgcaagc

SEQ ID NO: 7751 - DNA, 35 bp, Artificial Sequence
  Synthetic
tctaggagggtgggtggccaacgacgaacgcggtg

SEQ ID NO: 7752 - DNA, 39 bp, Artificial Sequence
  Synthetic
caggcgagggggctgtacagtatgattgccccgggaagc

SEQ ID NO: 7753 - DNA, 40 bp, Artificial Sequence
  Synthetic
catgccagaaggggtacaagggcagatatcgtcgctccgc

SEQ ID NO: 7754 - DNA, 40 bp, Artificial Sequence
  Synthetic
gaggattcaccgcttcgcgcccacggagaaagtaacctcc

SEQ ID NO: 7755 - DNA, 40 bp, Artificial Sequence
  Synthetic
acaaggccaccacccagatgcatgcactgtctccatagca

SEQ ID NO: 7756 - DNA, 40 bp, Artificial Sequence
  Synthetic
ttccgcggaggaaaaggaagcccggccatgacttgggaca

SEQ ID NO: 7757 - DNA, 41 bp, Artificial Sequence
  Synthetic
gctcatcaccccttgctctgctggcgtaataaggtgttgct

SEQ ID NO: 7758 - DNA, 42 bp, Artificial Sequence
  Synthetic
tcgctctctcgacaagaaagcctcggcaatggggtatcagag

SEQ ID NO: 7759 - DNA, 40 bp, Artificial Sequence
  Synthetic
gagagccaggggacacacgaggagtacctggtcatagcct

SEQ ID NO: 7760 - DNA, 42 bp, Artificial Sequence
  Synthetic
ctacagagccaggaacagctggagatccagcggagtaacaga

SEQ ID NO: 7761 - DNA, 40 bp, Artificial Sequence
  Synthetic
actgggcggtgaagacaaaacgggacaagtccagccggtc

SEQ ID NO: 7762 - DNA, 41 bp, Artificial Sequence
  Synthetic
cgagtaactcgtccctcttctgtgatgatcgactgcaacac

SEQ ID NO: 7763 - DNA, 39 bp, Artificial Sequence
  Synthetic
gcgtactgccccagcttgaaggccgtgattggtgcttaa

SEQ ID NO: 7764 - DNA, 44 bp, Artificial Sequence
  Synthetic
gtgttgaaaagaaaaagactgaggggagatgcaacagggtacac

SEQ ID NO: 7765 - DNA, 44 bp, Artificial Sequence
  Synthetic
ccatactggcattactggtgacacgactcagtatctcaaggaga

SEQ ID NO: 7766 - DNA, 39 bp, Artificial Sequence
  Synthetic
ccactgtgtggttttccctcatttgctgcatcaagtgtg

SEQ ID NO: 7767 - DNA, 44 bp, Artificial Sequence
  Synthetic
tgtacaacagacttctcagtggttaggcctgagtttttcaacag

SEQ ID NO: 7768 - DNA, 40 bp, Artificial Sequence
  Synthetic
gaagtcttcatcgctcaaagcagagtagttgcagctgctc

SEQ ID NO: 7769 - DNA, 45 bp, Artificial Sequence
  Synthetic
tactggctacaaacaatgtctttcgtcttctccaaaggttacacc

SEQ ID NO: 7770 - DNA, 43 bp, Artificial Sequence
  Synthetic
tgatgaaacctgtgaacatgagtaccaccaaattccagaggga

SEQ ID NO: 7771 - DNA, 39 bp, Artificial Sequence
  Synthetic
gaaacatggtggtggtgtagcccttttgcatggcaccat

SEQ ID NO: 7772 - DNA, 39 bp, Artificial Sequence
  Synthetic
gtgcagacggttcgtacacaccatgacaacctgctcata

SEQ ID NO: 7773 - DNA, 44 bp, Artificial Sequence
  Synthetic
ctagtggtgatatcacttgtgttgtgagagcatctcagtagtgc

SEQ ID NO: 7774 - DNA, 41 bp, Artificial Sequence
  Synthetic
cataatggcaaccatccaacgttagtcaacgatgccctctt

SEQ ID NO: 7775 - DNA, 45 bp, Artificial Sequence
  Synthetic
aagacatctgaggagcactttgtctgaataggaccaatctctgta

SEQ ID NO: 7776 - DNA, 44 bp, Artificial Sequence
  Synthetic
cttgatgagagttttcttggtaggtaccaccaacttgaggaaat

SEQ ID NO: 7777 - DNA, 42 bp, Artificial Sequence
  Synthetic
ttaacgggtgtagaagctgtgacacacacatggaatggaaac

SEQ ID NO: 7778 - DNA, 47 bp, Artificial Sequence
  Synthetic
aaggaaacatcttacactacaaccaattttggttcaatctctgtgta

SEQ ID NO: 7779 - DNA, 46 bp, Artificial Sequence
  Synthetic
agacactattcagcgagtttcaagaggttaatgtgccaaacaattg

SEQ ID NO: 7780 - DNA, 47 bp, Artificial Sequence
  Synthetic
aacacaagagttaggtcatgaggatcttaatggtaatgcttgtgttt

SEQ ID NO: 7781 - DNA, 44 bp, Artificial Sequence
  Synthetic
tgcagcatttgtttaagtggattaggaaatcgtcacctgaatgg

SEQ ID NO: 7782 - DNA, 44 bp, Artificial Sequence
  Synthetic
tggaagagctatgttcatatcatggttgcgcttatagcacatca

SEQ ID NO: 7783 - DNA, 43 bp, Artificial Sequence
  Synthetic
agtgttgctgtgaaaaatggcgggatgtctctcataggtcttt

SEQ ID NO: 7784 - DNA, 42 bp, Artificial Sequence
  Synthetic
tacagctcacagcgagttagcacacgaatgtagaaaggacac

SEQ ID NO: 7785 - DNA, 43 bp, Artificial Sequence
  Synthetic
aattcgtagtgctgccaagaagtgtctagttgtagcacaagtt

SEQ ID NO: 7786 - DNA, 40 bp, Artificial Sequence
  Synthetic
tttagccagcgtggtggttctgatagcagctactacaggg

SEQ ID NO: 7787 - DNA, 42 bp, Artificial Sequence
  Synthetic
cactcgttatgtgcttatggatggctaacagaaccctccagg

SEQ ID NO: 7788 - DNA, 43 bp, Artificial Sequence
  Synthetic
tattgccatattggtgacttgtgcactcaccaaaaacacgtct

SEQ ID NO: 7789 - DNA, 45 bp, Artificial Sequence
  Synthetic
agacactgttgccacttacacaccactgaaatacttgtacttgtt

SEQ ID NO: 7790 - DNA, 42 bp, Artificial Sequence
  Synthetic
aggaaaatggcattcccgtcagttccacaggttacttgtacc

SEQ ID NO: 7791 - DNA, 44 bp, Artificial Sequence
  Synthetic
atccaacctggtcaaacattttcacactgataaacaccagatgg

SEQ ID NO: 7792 - DNA, 43 bp, Artificial Sequence
  Synthetic
tgacatattgggacctctttctgcctttcaaagcagcacacat

SEQ ID NO: 7793 - DNA, 41 bp, Artificial Sequence
  Synthetic
gtttacgagaatgctttcttgcccaagcagcatagcacatg

SEQ ID NO: 7794 - DNA, 43 bp, Artificial Sequence
  Synthetic
gctagagctatagtgtttgtgtgtctgtaaggtgttgccagta

SEQ ID NO: 7795 - DNA, 44 bp, Artificial Sequence
  Synthetic
aaaccatgtatcaaggttgctactgtaccacagatgtgcacttt

SEQ ID NO: 7796 - DNA, 40 bp, Artificial Sequence
  Synthetic
gcgaggaaatgctcgataaccaagcggcatatgatggtaa

SEQ ID NO: 7797 - DNA, 45 bp, Artificial Sequence
  Synthetic
acaatgctcttcactatgcttaggcgcattgttgataatgttgtt

SEQ ID NO: 7798 - DNA, 43 bp, Artificial Sequence
  Synthetic
cggctggtaccacacaaacagaattgttatagtaggcaagtgc

SEQ ID NO: 7799 - DNA, 47 bp, Artificial Sequence
  Synthetic
ttcaactgtgctttccttctgtgtaggtaatccttatatgctttagc

SEQ ID NO: 7800 - DNA, 40 bp, Artificial Sequence
  Synthetic
agaaacacagtctgtaccgtctgactgcatcaagggttcg

SEQ ID NO: 7801 - DNA, 46 bp, Artificial Sequence
  Synthetic
cgtcagcgtctaactaaatacacattaccctcatcaaaatgacgta

SEQ ID NO: 7802 - DNA, 43 bp, Artificial Sequence
  Synthetic
aatcaggatcttaatgggaactggtcaataggaactccgcagc

SEQ ID NO: 7803 - DNA, 44 bp, Artificial Sequence
  Synthetic
tctactgtgtttccacctacaagtcaacaaaaggaacaccatct

SEQ ID NO: 7804 - DNA, 48 bp, Artificial Sequence
  Synthetic
agacttttatgactttgctgtgtctgaagtgttttagttcaacagaac

SEQ ID NO: 7805 - DNA, 41 bp, Artificial Sequence
  Synthetic
ttgaagtcaatagccgccactccgtaaaacttgcttgttcc

SEQ ID NO: 7806 - DNA, 42 bp, Artificial Sequence
  Synthetic
agtgtgcgcaagtattaagtgagatgatgttccacctggttt

SEQ ID NO: 7807 - DNA, 47 bp, Artificial Sequence
  Synthetic
tgtgtgctataacagtaactatgcgactgccttaaagttcttaatgc

SEQ ID NO: 7808 - DNA, 47 bp, Artificial Sequence
  Synthetic
acatgatgagcttactggccacgtgttatcattagttagcattacgg

SEQ ID NO: 7809 - DNA, 43 bp, Artificial Sequence
  Synthetic
aatgccccaggttgtgatgtgcaataatagctcatacctccta

SEQ ID NO: 7810 - DNA, 39 bp, Artificial Sequence
  Synthetic
tggtattgccactgtacgcgaacctcccatgaaagatgc

SEQ ID NO: 7811 - DNA, 43 bp, Artificial Sequence
  Synthetic
atgttgcaaattatcaaaaggtcggcttaccagtaccaggtgg

SEQ ID NO: 7812 - DNA, 41 bp, Artificial Sequence
  Synthetic
agacttcgtgcaaaacactacgcctttagtcagcaatgtgc

SEQ ID NO: 7813 - DNA, 49 bp, Artificial Sequence
  Synthetic
acagacctcaaataggcgttgtaaggagataaaaacagcttttctccaa

SEQ ID NO: 7814 - DNA, 46 bp, Artificial Sequence
  Synthetic
atgtggctacattacaagcagaaatgaagaccagtaatgatcttac

SEQ ID NO: 7815 - DNA, 41 bp, Artificial Sequence
  Synthetic
tagagggctgtcatgcaactcctgtagaaaatcctagctgg

SEQ ID NO: 7816 - DNA, 46 bp, Artificial Sequence
  Synthetic
tgaagtactttgtcaagattggacctgaagtagaaaagcaagttgc

SEQ ID NO: 7817 - DNA, 44 bp, Artificial Sequence
  Synthetic
ttgctgataagtttccagttcttcaattctacttcagcctgagg

SEQ ID NO: 7818 - DNA, 45 bp, Artificial Sequence
  Synthetic
atgtgaataagcatgcattccacagtaaaagaaaggcaattgctt

SEQ ID NO: 7819 - DNA, 43 bp, Artificial Sequence
  Synthetic
aaaggacactttgatggacacgacctttgtgtaaacagcatta

SEQ ID NO: 7820 - DNA, 46 bp, Artificial Sequence
  Synthetic
ttgatggtagagtggaaggacagtgttattaaaacaccattacggg

SEQ ID NO: 7821 - DNA, 41 bp, Artificial Sequence
  Synthetic
gctatgccttcgaacacatcgtaatgaagaccgccaagttg

SEQ ID NO: 7822 - DNA, 43 bp, Artificial Sequence
  Synthetic
gtaaggatggacatgttgaaaccttgttaggcatcgcaacacc

SEQ ID NO: 7823 - DNA, 43 bp, Artificial Sequence
  Synthetic
ctgtgcaacagtacatacggcctagggtcatacatatcgctaa

SEQ ID NO: 7824 - DNA, 45 bp, Artificial Sequence
  Synthetic
tggctataccatgcatgctaactggaagacaactggataggattt

SEQ ID NO: 7825 - DNA, 50 bp, Artificial Sequence
  Synthetic
tgcactttcgagtacatatctgatgctcgtaagtgtttaaaattacctga

SEQ ID NO: 7826 - DNA, 43 bp, Artificial Sequence
  Synthetic
aaatggtacaatcacagatgctgtcagagcatttgagttcagc

SEQ ID NO: 7827 - DNA, 45 bp, Artificial Sequence
  Synthetic
atgcagattcttttgtagtcaaggggcaataacaccagtttgtcc

SEQ ID NO: 7828 - DNA, 46 bp, Artificial Sequence
  Synthetic
tatggtttttacaccactactggcaccggtgcatttaaaagttcaa

SEQ ID NO: 7829 - DNA, 45 bp, Artificial Sequence
  Synthetic
tcaagatgttaactgcactgatgtcagtagaatatatgcgccaag

SEQ ID NO: 7830 - DNA, 44 bp, Artificial Sequence
  Synthetic
acagaagtaatgcctgtttctatgggtagaatctccgcagatgt

SEQ ID NO: 7831 - DNA, 43 bp, Artificial Sequence
  Synthetic
taatgctagagatctcatttgtgcgatcagtgagcagaggtgg

SEQ ID NO: 7832 - DNA, 43 bp, Artificial Sequence
  Synthetic
gcaagctgcaagacgttgttgctaagttgtttaacaagtgtgt

SEQ ID NO: 7833 - DNA, 41 bp, Artificial Sequence
  Synthetic
acatgtcacgtatgtgccatccgagggaagtatgctttgcc

SEQ ID NO: 7834 - DNA, 45 bp, Artificial Sequence
  Synthetic
catcaccagatgttgatcttggcttttgaatgttgacgacagaag

SEQ ID NO: 7835 - DNA, 43 bp, Artificial Sequence
  Synthetic
gtggttcttgctgcaagtttgtaatttgacacccttgagaact

SEQ ID NO: 7836 - DNA, 43 bp, Artificial Sequence
  Synthetic
attcacatcttttgcttgtcgctatcaaggcatagaggtacaa

SEQ ID NO: 7837 - DNA, 45 bp, Artificial Sequence
  Synthetic
cgaagtttactaccagcttgagttgtagcattttcaataccagtg

SEQ ID NO: 7838 - DNA, 44 bp, Artificial Sequence
  Synthetic
agtcacactagccatccttactgcacgttaacaatattgcagca

SEQ ID NO: 7839 - DNA, 45 bp, Artificial Sequence
  Synthetic
taaagcttgttttcctctggctcattaattctgtagacagcagca

SEQ ID NO: 7840 - DNA, 42 bp, Artificial Sequence
  Synthetic
actgtggctacatcacgaacgcgcaaaacctgaatcagtgcc

SEQ ID NO: 7841 - DNA, 40 bp, Artificial Sequence
  Synthetic
agtgtgttagaggtacgactgtttgccctcgtatgttcct

SEQ ID NO: 7842 - DNA, 44 bp, Artificial Sequence
  Synthetic
gcttgaagatccttgtaaggtacaacctttcctagagcacaaag

SEQ ID NO: 7843 - DNA, 39 bp, Artificial Sequence
  Synthetic
agcgccgaccccaaggtttactccttgccatgctgagtg

SEQ ID NO: 7844 - DNA, 40 bp, Artificial Sequence
  Synthetic
acaatgctgccaccgtgctatctgcgtagaagccttttgg

SEQ ID NO: 7845 - DNA, 41 bp, Artificial Sequence
  Synthetic
gctgaggcatctaaaaagccttgagtgacgttgtactgttt

SEQ ID NO: 7846 - DNA, 46 bp, Artificial Sequence
  Synthetic
aagcacattgacgcatacaaaaccagtctttttctttttgtccttt

SEQ ID NO: 7847 - DNA, 43 bp, Artificial Sequence
  Synthetic
tcaatgtgtaacattagggaggacttaccctcgatcgtactcc

SEQ ID NO: 7848 - DNA, 43 bp, Artificial Sequence
  Synthetic
accaataggtgacaatcatccagacatatcctcattgaccggg

SEQ ID NO: 7849 - DNA, 42 bp, Artificial Sequence
  Synthetic
ttgacaaggtgtgaagagccgcaaggttagccacattcaggg

SEQ ID NO: 7850 - DNA, 46 bp, Artificial Sequence
  Synthetic
gttgggacacactccacacaaagctgcgtctttaaaataattgatg

SEQ ID NO: 7851 - DNA, 44 bp, Artificial Sequence
  Synthetic
cagacagactaatacagataacccgacaccataagcaacaactg

SEQ ID NO: 7852 - DNA, 48 bp, Artificial Sequence
  Synthetic
ttaccattttctagggagatctggactgatgaaacttgctagaattac

SEQ ID NO: 7853 - DNA, 49 bp, Artificial Sequence
  Synthetic
ggtaacttacctatttatccccaccgtaaaataagggtagctgaattgt

SEQ ID NO: 7854 - DNA, 43 bp, Artificial Sequence
  Synthetic
taccagttatgttaacacctggatcaaacgctgatggggattg

SEQ ID NO: 7855 - DNA, 43 bp, Artificial Sequence
  Synthetic
ttagccactactctcataggagaacaaagcgcagactaccagt

SEQ ID NO: 7856 - DNA, 42 bp, Artificial Sequence
  Synthetic
agtccaccgcctcactagttggtgtagtgaatctaaaatggc

SEQ ID NO: 7857 - DNA, 42 bp, Artificial Sequence
  Synthetic
ttaaatgaagttcttgtggtgccatttccgcagcatccaatg

SEQ ID NO: 7858 - DNA, 43 bp, Artificial Sequence
  Synthetic
aaatgcatctgtgttctggcagctcataaaagggattgtgaat

SEQ ID NO: 7859 - DNA, 41 bp, Artificial Sequence
  Synthetic
ttgcctatcaacacacacactcaatctgagttgtggcctca

SEQ ID NO: 7860 - DNA, 46 bp, Artificial Sequence
  Synthetic
tccctaattgtgattgcactgaatgccaatcatgtgcagtaactct

SEQ ID NO: 7861 - DNA, 41 bp, Artificial Sequence
  Synthetic
ctgaggagcaagggttatctgacgaagcctacaccaaagac

SEQ ID NO: 7862 - DNA, 45 bp, Artificial Sequence
  Synthetic
ggctccagcttagctatgtacatcacgcttcagtaaatttcttga

SEQ ID NO: 7863 - DNA, 46 bp, Artificial Sequence
  Synthetic
ttgatgggtatgatcaacagagtgtcttcaccactaggattttgca

SEQ ID NO: 7864 - DNA, 45 bp, Artificial Sequence
  Synthetic
ttaccagcaatggcaagaaggttttgccatctaaaagatactctt

SEQ ID NO: 7865 - DNA, 41 bp, Artificial Sequence
  Synthetic
gggaacctaaacccaaaagcagacaaactcttcctctgggc

SEQ ID NO: 7866 - DNA, 46 bp, Artificial Sequence
  Synthetic
ccatgagggtgttaagctagagatctgatgtctttaaacttctcat

SEQ ID NO: 7867 - DNA, 46 bp, Artificial Sequence
  Synthetic
ttcttggtatacatgttggtggcaaataagatttgagaagcattgc

SEQ ID NO: 7868 - DNA, 41 bp, Artificial Sequence
  Synthetic
tggttcagcagtagggtgtgattctccatctagcatgagag

SEQ ID NO: 7869 - DNA, 42 bp, Artificial Sequence
  Synthetic
cgccactctttccttatacaccggtttttggtccatctgatg

SEQ ID NO: 7870 - DNA, 39 bp, Artificial Sequence
  Synthetic
tctgccattcgcattttgcacacccagaacaaagcaaat

SEQ ID NO: 7871 - DNA, 45 bp, Artificial Sequence
  Synthetic
agactctctaaattcaaatgtggcgaaaatggaaagcacttctgc

SEQ ID NO: 7872 - DNA, 47 bp, Artificial Sequence
  Synthetic
gtatgcaacaaatcatattgccacctgtttgctcagatttaacatct

SEQ ID NO: 7873 - DNA, 49 bp, Artificial Sequence
  Synthetic
actgggatgcagttagaaaagaaagcaaacctaaattagaatatccttc

SEQ ID NO: 7874 - DNA, 41 bp, Artificial Sequence
  Synthetic
ctagctcctcacggacttttttctatgtggtgttcgaggtg

SEQ ID NO: 7875 - DNA, 45 bp, Artificial Sequence
  Synthetic
aaacagaaacatcaaaggtgctagttgggtaaagtcacagtttct

SEQ ID NO: 7876 - DNA, 42 bp, Artificial Sequence
  Synthetic
gttccattagttgaaggtacccctttctccccctactcctgg

SEQ ID NO: 7877 - DNA, 42 bp, Artificial Sequence
  Synthetic
cctgaatttttggtacagccttcctacatctgggtcaaaggc

SEQ ID NO: 7878 - DNA, 50 bp, Artificial Sequence
  Synthetic
tgtaggtgatggactttttgtagcactcaactggtaaattatttggtagt

SEQ ID NO: 7879 - DNA, 43 bp, Artificial Sequence
  Synthetic
tggtctggagattaatagggctgcctgtagaaccaacacctaa

SEQ ID NO: 7880 - DNA, 48 bp, Artificial Sequence
  Synthetic
ttactcatgcaggaactataggtgagtctctagtatcatccacctttc

SEQ ID NO: 7881 - DNA, 41 bp, Artificial Sequence
  Synthetic
agttggcttttattcctcctgcggcacatagttgccaaaga

SEQ ID NO: 7882 - DNA, 43 bp, Artificial Sequence
  Synthetic
cccatggggttggtataaatacagagttgtccagatgtccagc

SEQ ID NO: 7883 - DNA, 42 bp, Artificial Sequence
  Synthetic
aatttgctggcttcagaagagtcgatttgttggctcctcctc

SEQ ID NO: 7884 - DNA, 46 bp, Artificial Sequence
  Synthetic
attgtggaagaagcagattgtgttgctttgttcaaataagtcatct

SEQ ID NO: 7885 - DNA, 41 bp, Artificial Sequence
  Synthetic
ggcagcagtacacatttctcctcaattccactgtcctgaaa

SEQ ID NO: 7886 - DNA, 48 bp, Artificial Sequence
  Synthetic
tcctagcactttatgaaaaaggagcctttctacttagttcccaatgtt

SEQ ID NO: 7887 - DNA, 40 bp, Artificial Sequence
  Synthetic
agaagtccttctccgctgaaacggtgaggattctctatgc

SEQ ID NO: 7888 - DNA, 40 bp, Artificial Sequence
  Synthetic
gcccactgcaccaactcctgattgtgcgacggaactgatc

SEQ ID NO: 7889 - DNA, 40 bp, Artificial Sequence
  Synthetic
tccctcagttgtgcctttgctccagtgtctgtaatgggaa

SEQ ID NO: 7890 - DNA, 44 bp, Artificial Sequence
  Synthetic
cccagacttcattagacagccttaatgtatatgtcacgtcatcg

SEQ ID NO: 7891 - DNA, 39 bp, Artificial Sequence
  Synthetic
tggtacaatttgcgcgggaacaggctgtaaatacgaccg

SEQ ID NO: 7892 - DNA, 48 bp, Artificial Sequence
  Synthetic
gctgaaaaattacactgttggttcggttttttatccattccaaagcag

SEQ ID NO: 7893 - DNA, 45 bp, Artificial Sequence
  Synthetic
tgaagcatttgaaatagcagaaggctcagggtttaggtacatgac

SEQ ID NO: 7894 - DNA, 43 bp, Artificial Sequence
  Synthetic
tgaatggaatgggaaagggagacaatgttgttttgcagctctt

SEQ ID NO: 7895 - DNA, 39 bp, Artificial Sequence
  Synthetic
gtggagaacgccagaatgctccaattccaccaaccattc

SEQ ID NO: 7896 - DNA, 40 bp, Artificial Sequence
  Synthetic
gatcaggagaatttggcgtcaaatgtgagtgagaccagca

SEQ ID NO: 7897 - DNA, 39 bp, Artificial Sequence
  Synthetic
tcctgagaggatcagtggccccatatccactggccacgg

SEQ ID NO: 7898 - DNA, 45 bp, Artificial Sequence
  Synthetic
cccaaggggacaactatctactagccattgtttccatgttctcat

SEQ ID NO: 7899 - DNA, 48 bp, Artificial Sequence
  Synthetic
ctgctggttttgaagtttataacgccaatcattaggtcttcttcgaaa

SEQ ID NO: 7900 - DNA, 45 bp, Artificial Sequence
  Synthetic
cctgggcttggaaaaacccagcatttggattttctaatagtacag

SEQ ID NO: 7901 - DNA, 45 bp, Artificial Sequence
  Synthetic
aatgacagttattcccatcgaagaaatttctttgacggtaacacc

SEQ ID NO: 7902 - DNA, 44 bp, Artificial Sequence
  Synthetic
ggaaattatcccgatacagaccgtattgaaaacaacctccgtct

SEQ ID NO: 7903 - DNA, 45 bp, Artificial Sequence
  Synthetic
cagtgtactaactgtcagcatgtgagactttcatggttgcagtac

SEQ ID NO: 7904 - DNA, 46 bp, Artificial Sequence
  Synthetic
tgatcccaatgttggtatggtagaaggtgtaatcaattctgtcaat

SEQ ID NO: 7905 - DNA, 46 bp, Artificial Sequence
  Synthetic
ttaaacctgttttggaagatgggaacctttaacaacttttgcttca

SEQ ID NO: 7906 - DNA, 47 bp, Artificial Sequence
  Synthetic
tcaggcgttgataaattaaccagagtgctgtaaaataggttccaagg

SEQ ID NO: 7907 - DNA, 48 bp, Artificial Sequence
  Synthetic
tcaagaaccttgacgttacctttacataaaagtacttcctatctgtgc

SEQ ID NO: 7908 - DNA, 42 bp, Artificial Sequence
  Synthetic
ccatgtgatgggccaattcactctgtcaagagttaacgaaat

SEQ ID NO: 7909 - DNA, 46 bp, Artificial Sequence
  Synthetic
atggttccttattcaaagatggggtcgtaaaatggaaactgaagca

SEQ ID NO: 7910 - DNA, 45 bp, Artificial Sequence
  Synthetic
atcaattaggagatgccacaacaagtttgagaggtaagataaggc

SEQ ID NO: 7911 - DNA, 41 bp, Artificial Sequence
  Synthetic
tgagagaggctagaacaacttccgacggtttagtggaggtc

SEQ ID NO: 7912 - DNA, 50 bp, Artificial Sequence
  Synthetic
aaggcagagttgatctcttaggagagattttattaacacccactacacta

SEQ ID NO: 7913 - DNA, 39 bp, Artificial Sequence
  Synthetic
tcatgtgatgcgataaccaccgggcgtctagttggacta

SEQ ID NO: 7914 - DNA, 45 bp, Artificial Sequence
  Synthetic
tttagctgataccggtcttaaaagtgcatgtaacacattcccaaa

SEQ ID NO: 7915 - DNA, 44 bp, Artificial Sequence
  Synthetic
gataccatgcttaaagatgggttgattcggctgttatacccatg

SEQ ID NO: 7916 - DNA, 41 bp, Artificial Sequence
  Synthetic
tcaaagatgaggggacagtaactataaaattgccgctgctc

SEQ ID NO: 7917 - DNA, 44 bp, Artificial Sequence
  Synthetic
tttgggtcacccgattggagcatttctgctaataaggtgactaa

SEQ ID NO: 7918 - DNA, 42 bp, Artificial Sequence
  Synthetic
tgacaaaggcacaaaagacttaactttttccaacaccgcgat

SEQ ID NO: 7919 - DNA, 40 bp, Artificial Sequence
  Synthetic
ctaactgtgtagcctgcttgcatttgcttttcggtgatgc

SEQ ID NO: 7920 - DNA, 46 bp, Artificial Sequence
  Synthetic
gacttgtccctttgatagaggtgcaccaatacatacaaagaccaaa

SEQ ID NO: 7921 - DNA, 50 bp, Artificial Sequence
  Synthetic
accggcttttttagaataaccaacacagttataattacatgcttaaaggc

SEQ ID NO: 7922 - DNA, 43 bp, Artificial Sequence
  Synthetic
tttgtcaacaaatttgggttcggtgttaataacgccaatagcc

SEQ ID NO: 7923 - DNA, 40 bp, Artificial Sequence
  Synthetic
aacggcaatcgcatgcttaggccttattttttgcagcaag

SEQ ID NO: 7924 - DNA, 47 bp, Artificial Sequence
  Synthetic
tggctcagaagctacaaaaacccgccattagtcaaaatataatccaa

SEQ ID NO: 7925 - DNA, 50 bp, Artificial Sequence
  Synthetic
aatcagatgctctttacgttgttgacaacttctttaaaatctacttcacc

SEQ ID NO: 7926 - DNA, 45 bp, Artificial Sequence
  Synthetic
attgacttactcagatggttcagacctgaactcacccttgtcaaa

SEQ ID NO: 7927 - DNA, 43 bp, Artificial Sequence
  Synthetic
caagctattcagtttgcttttgacctttggcatcttgacctgc

SEQ ID NO: 7928 - DNA, 44 bp, Artificial Sequence
  Synthetic
attaccctgttgaccaagcaaacacagattgtttgaaagactgg

SEQ ID NO: 7929 - DNA, 45 bp, Artificial Sequence
  Synthetic
acgtaaccctaaatcaaatgaacctaaaagtggtgtcatcaaaca

SEQ ID NO: 7930 - DNA, 46 bp, Artificial Sequence
  Synthetic
acgatcggttacagaaatcaagtcagtgtcaccgtattttacagta

SEQ ID NO: 7931 - DNA, 41 bp, Artificial Sequence
  Synthetic
tctgccacctctcaaccgactgttgggacatcagatggtgt

SEQ ID NO: 7932 - DNA, 39 bp, Artificial Sequence
  Synthetic
ggcttcaaccacaaacagcagcctggacggtaaccacta

SEQ ID NO: 7933 - DNA, 44 bp, Artificial Sequence
  Synthetic
tcatgttcatgtctcctttaatgctaaaaactcacgcctaaacg

SEQ ID NO: 7934 - DNA, 43 bp, Artificial Sequence
  Synthetic
aaggggtagatcagaaatcagctcgaataaggaaaacagctgc

SEQ ID NO: 7935 - DNA, 43 bp, Artificial Sequence
  Synthetic
tcgtttgattcacaagagaggaaagactgtttaccgagcgtat

SEQ ID NO: 7936 - DNA, 46 bp, Artificial Sequence
  Synthetic
tattgcttacctagaatcacacgacccacctgaatatcagtgactt

SEQ ID NO: 7937 - DNA, 45 bp, Artificial Sequence
  Synthetic
tcatcctaaagtgttttaccaggactgttttatggttgctgtagc

SEQ ID NO: 7938 - DNA, 43 bp, Artificial Sequence
  Synthetic
acaagaaaattgaggagtgtacaggtcaacaggtaccccaagg

SEQ ID NO: 7939 - DNA, 42 bp, Artificial Sequence
  Synthetic
ttgggggacaacagaagacttaagaatatggccgttgacaaa

SEQ ID NO: 7940 - DNA, 41 bp, Artificial Sequence
  Synthetic
gtgaaagccagttgacctatgttaaaatcagccgccttagt

SEQ ID NO: 7941 - DNA, 42 bp, Artificial Sequence
  Synthetic
gaacagcggaatgcacgtattaattgccaacaaatctctgta

SEQ ID NO: 7942 - DNA, 40 bp, Artificial Sequence
  Synthetic
ttttcggcggttcagaagttaaatctggtagggccgtaaa

SEQ ID NO: 7943 - DNA, 46 bp, Artificial Sequence
  Synthetic
agtcactttcattttagtgggatcatctcacaagtacctcaatcag

SEQ ID NO: 7944 - DNA, 44 bp, Artificial Sequence
  Synthetic
gcccaaggcagtaatcatttcaatcacttcacaggattcgtaaa

SEQ ID NO: 7945 - DNA, 41 bp, Artificial Sequence
  Synthetic
ttgtcctagttgtacgaggagagttcaatactggccaggct

SEQ ID NO: 7946 - DNA, 45 bp, Artificial Sequence
  Synthetic
tgaagtggttacagcattagaatcacctacagtagaaccaggaaa

SEQ ID NO: 7947 - DNA, 43 bp, Artificial Sequence
  Synthetic
acagaagtgaactcttgtcttgaactcgagtttgatgccacag

SEQ ID NO: 7948 - DNA, 47 bp, Artificial Sequence
  Synthetic
ttttggatcgtgaagtaacgcaaagacgtattcttaactgtcttgaa

SEQ ID NO: 7949 - DNA, 47 bp, Artificial Sequence
  Synthetic
caggctattgctgatgaattagacgaccagtctgtaaactagacaaa

SEQ ID NO: 7950 - DNA, 43 bp, Artificial Sequence
  Synthetic
tctttgactgctatgggagaagcacaggtgcttctaaggtaac

SEQ ID NO: 7951 - DNA, 47 bp, Artificial Sequence
  Synthetic
cgtaaacgtaaatcagaagcagctagttctaattgtgagaactgttt

SEQ ID NO: 7952 - DNA, 46 bp, Artificial Sequence
  Synthetic
ataacggctcctaaaaagctaccttgaaaacatcactcaattgtca

SEQ ID NO: 7953 - DNA, 43 bp, Artificial Sequence
  Synthetic
agcgttaatattgtcgatgtcattgaaagcccgagataatgcc

SEQ ID NO: 7954 - DNA, 40 bp, Artificial Sequence
  Synthetic
gcagtacttgctagccaacacgcatcctcatgaagtgtca

SEQ ID NO: 7955 - DNA, 44 bp, Artificial Sequence
  Synthetic
ctttcgaaatcgtatcatgtttcccacgtcctgaaaaggcaata

SEQ ID NO: 7956 - DNA, 43 bp, Artificial Sequence
  Synthetic
tgatggtgacgatgctggaccgacaacaaaatctttaagcaat

SEQ ID NO: 7957 - DNA, 43 bp, Artificial Sequence
  Synthetic
atgcattaaggattcaagataggcacaagattgctgacggctt

SEQ ID NO: 7958 - DNA, 46 bp, Artificial Sequence
  Synthetic
tcaagcggctctagaagtactagaatttcctctattccatttttcg

SEQ ID NO: 7959 - DNA, 48 bp, Artificial Sequence
  Synthetic
atttgctgttacatgtgattgatgcttaaaaccactttttcttgctca

SEQ ID NO: 7960 - DNA, 45 bp, Artificial Sequence
  Synthetic
tacacgtttgaccaagaaatagaggtcaagtctccattgctgttt

SEQ ID NO: 7961 - DNA, 44 bp, Artificial Sequence
  Synthetic
actgaccaaccatcttttgaggaccataagcttttccagacaaa

SEQ ID NO: 7962 - DNA, 48 bp, Artificial Sequence
  Synthetic
gctcttagccaaacattttctggttgtaaatcataaattctcgttggg

SEQ ID NO: 7963 - DNA, 50 bp, Artificial Sequence
  Synthetic
ttaccaggatttttatcaagtcggtccataaatatcaagatctgtctgtt

SEQ ID NO: 7964 - DNA, 44 bp, Artificial Sequence
  Synthetic
cagaagccttaaaagcagcgggaccatttttaattttgccaaag

SEQ ID NO: 7965 - DNA, 48 bp, Artificial Sequence
  Synthetic
tcttgctcaatcatgtatcagctcgaacattttcaaatatagtggcgg

SEQ ID NO: 7966 - DNA, 42 bp, Artificial Sequence
  Synthetic
attaccaatccagtagccattgagatcaatacggccatagcg

SEQ ID NO: 7967 - DNA, 45 bp, Artificial Sequence
  Synthetic
cccttcgcttagaattagcggataaagcttggtcaaaaaacttgg

SEQ ID NO: 7968 - DNA, 41 bp, Artificial Sequence
  Synthetic
acttgtctcaactgcatgatcctcgaattcttggcacagct

SEQ ID NO: 7969 - DNA, 42 bp, Artificial Sequence
  Synthetic
acgggttgctaaaatgtatgcggccgtaaactcctctttagg

SEQ ID NO: 7970 - DNA, 42 bp, Artificial Sequence
  Synthetic
catgaccatgcgaggcatcactttccttatataagcctctgg

SEQ ID NO: 7971 - DNA, 38 bp, Artificial Sequence
  Synthetic
tcatcgacgttggtggagaattcatcggtagcgcttac

SEQ ID NO: 7972 - DNA, 45 bp, Artificial Sequence
  Synthetic
tctaggcaatagagcacaagcatcaacccaaatattgttttttgg

SEQ ID NO: 7973 - DNA, 47 bp, Artificial Sequence
  Synthetic
ccagttgatgtgaggacttatggattctgttcttctttaaaggctcc

SEQ ID NO: 7974 - DNA, 41 bp, Artificial Sequence
  Synthetic
agctttttaacgaatttccgcctatcggtgggttttccttt

SEQ ID NO: 7975 - DNA, 48 bp, Artificial Sequence
  Synthetic
ggtcgtgtgaggcatgaaaaatgctccaaatagcaagatatcaatgtc

SEQ ID NO: 7976 - DNA, 42 bp, Artificial Sequence
  Synthetic
aatcactacgagctatcacgcacaaaacaagccaaggcatat

SEQ ID NO: 7977 - DNA, 41 bp, Artificial Sequence
  Synthetic
tatccgctaaggtgcttacccagccatatccctagctgaaa

SEQ ID NO: 7978 - DNA, 43 bp, Artificial Sequence
  Synthetic
atcggattggtggtgtggaatctgccacattaatcataaaacc

SEQ ID NO: 7979 - DNA, 45 bp, Artificial Sequence
  Synthetic
aagagccccacaaccacagagttaccaactttattagaacctgta

SEQ ID NO: 7980 - DNA, 40 bp, Artificial Sequence
  Synthetic
aagactagggcaagggaccatctgtcttgacaatgggtat

SEQ ID NO: 7981 - DNA, 40 bp, Artificial Sequence
  Synthetic
cgcccgcagactgtctgttgggggtctgtgtcttgtttgt

SEQ ID NO: 7982 - DNA, 43 bp, Artificial Sequence
  Synthetic
aaatggtaaccaaaaaggatcctgtgtgtaaaaaatgcggccg

SEQ ID NO: 7983 - DNA, 48 bp, Artificial Sequence
  Synthetic
ttttccatcatgagatttgaccactaacattgttacacatatgggata

SEQ ID NO: 7984 - DNA, 41 bp, Artificial Sequence
  Synthetic
aaatggcacctggtgtttgtgcaaagtcaagagcaagactc

SEQ ID NO: 7985 - DNA, 43 bp, Artificial Sequence
  Synthetic
catcactatttccaatttggacagcgtggtggttcaggtacag

SEQ ID NO: 7986 - DNA, 44 bp, Artificial Sequence
  Synthetic
gattggggcaaagtaatgacgttgagcttagagaggaagacttt

SEQ ID NO: 7987 - DNA, 48 bp, Artificial Sequence
  Synthetic
ctttgatcaagttggatttaggtgcctaaaagataagcgtcaagaagg

SEQ ID NO: 7988 - DNA, 44 bp, Artificial Sequence
  Synthetic
ggatacccgtgatgccaatattgatgttctggtgaaggaatgtt

SEQ ID NO: 7989 - DNA, 42 bp, Artificial Sequence
  Synthetic
accagcatcatttctccagagtacaaacaggtctcttgagaa

SEQ ID NO: 7990 - DNA, 48 bp, Artificial Sequence
  Synthetic
ttccagcaattttatagaggctgtccttatgaagaccaactgactttc

SEQ ID NO: 7991 - DNA, 39 bp, Artificial Sequence
  Synthetic
aaagggcttgtcctccatacaacgtgaccatcccagaaa

SEQ ID NO: 7992 - DNA, 40 bp, Artificial Sequence
  Synthetic
ggaaacgagcatagttgagcaaaccaaaccatcgaagttg

SEQ ID NO: 7993 - DNA, 43 bp, Artificial Sequence
  Synthetic
tggaatgttaatcaaagtgtcacgctcaatgtcggcaaccatg

SEQ ID NO: 7994 - DNA, 47 bp, Artificial Sequence
  Synthetic
acagactctgttaaaaaagcatcgtcttacagctcgtagacctatag

SEQ ID NO: 7995 - DNA, 44 bp, Artificial Sequence
  Synthetic
acacttgactttcaattgttcgaaacggtatgtctattgcagct

SEQ ID NO: 7996 - DNA, 47 bp, Artificial Sequence
  Synthetic
ttgctgtcatcataccaatacgatgctacggtactatatggggctaa

SEQ ID NO: 7997 - DNA, 42 bp, Artificial Sequence
  Synthetic
accactcgaatactagttacttgcatgggagcacagattgtc

SEQ ID NO: 7998 - DNA, 41 bp, Artificial Sequence
  Synthetic
caacctgtgttgttccttttgcctgctcaggttaagtcagc

SEQ ID NO: 7999 - DNA, 46 bp, Artificial Sequence
  Synthetic
gctttttgagcttgagtacgcatcaagaggatattttagaagcttg

SEQ ID NO: 8000 - DNA, 41 bp, Artificial Sequence
  Synthetic
atcaaccgtaacaaagttcaccagcaacgattactgacgct

SEQ ID NO: 8001 - DNA, 43 bp, Artificial Sequence
  Synthetic
agacattttttcgcccttaccagcatgctccatataaggctat

SEQ ID NO: 8002 - DNA, 40 bp, Artificial Sequence
  Synthetic
tgaccctggatgagtgaagcatcaatcatttggtggcaaa

SEQ ID NO: 8003 - DNA, 42 bp, Artificial Sequence
  Synthetic
ggtacagcacgccagatgatgatcaatcactcttacccattt

SEQ ID NO: 8004 - DNA, 45 bp, Artificial Sequence
  Synthetic
atggtcaccaaggataaccaattcagtacattgtgacagaacacc

SEQ ID NO: 8005 - DNA, 46 bp, Artificial Sequence
  Synthetic
tgtcatggtattcaatttcagcctcaacctgtttattggtcatggt

SEQ ID NO: 8006 - DNA, 41 bp, Artificial Sequence
  Synthetic
gattccttgcttagccaagactccttatgtacctggttggg

SEQ ID NO: 8007 - DNA, 43 bp, Artificial Sequence
  Synthetic
aactccttttaaacaaacttgcgaccacgagctttcgtccttt

SEQ ID NO: 8008 - DNA, 45 bp, Artificial Sequence
  Synthetic
ggctcagtcgtagaatcagattgttgatgaaagcaataaggagtt

SEQ ID NO: 8009 - DNA, 46 bp, Artificial Sequence
  Synthetic
actaagaagcaattgaatagcctgcagacttcttctcagtgtcatt

SEQ ID NO: 8010 - DNA, 38 bp, Artificial Sequence
  Synthetic
cccttgaccaacggaccatagataagcgtgaggtcggt

SEQ ID NO: 8011 - DNA, 42 bp, Artificial Sequence
  Synthetic
ctgtgttcggcatgggtacatgggttatgaaaatagcacatt

SEQ ID NO: 8012 - DNA, 41 bp, Artificial Sequence
  Synthetic
tctcaaatttcctacgcccgcgctgggttcagaacgtcgtg

SEQ ID NO: 8013 - DNA, 42 bp, Artificial Sequence
  Synthetic
cctgctcgagttgtagctctcgggttccctcagattggttgg

SEQ ID NO: 8014 - DNA, 41 bp, Artificial Sequence
  Synthetic
aagtcagcaccccttctcccggcctcaggtgatcgagagaa

SEQ ID NO: 8015 - DNA, 44 bp, Artificial Sequence
  Synthetic
ttccaatcgtccggtttagttagcgccaacaggttgatattcct

SEQ ID NO: 8016 - DNA, 45 bp, Artificial Sequence
  Synthetic
actcgactagtgagctattacgcgacaactaggatgttagcttag

SEQ ID NO: 8017 - DNA, 42 bp, Artificial Sequence
  Synthetic
cacctttccctcacggtactggggaccatctcccaaccctaa

SEQ ID NO: 8018 - DNA, 41 bp, Artificial Sequence
  Synthetic
gaaaggaggtgatccagccgcgatgattggggtgaagtcgt

SEQ ID NO: 8019 - DNA, 40 bp, Artificial Sequence
  Synthetic
catcggcttcggcattagctgacggactttctgaagaaga

SEQ ID NO: 8020 - DNA, 44 bp, Artificial Sequence
  Synthetic
tgctgttgagaagacttgtgattttcactaaattgatcgaccgc

SEQ ID NO: 8021 - DNA, 39 bp, Artificial Sequence
  Synthetic
tctgaaagggcttgacgaacttttgacgatctcactcgc

SEQ ID NO: 8022 - DNA, 44 bp, Artificial Sequence
  Synthetic
gatacgtcaaatgtaccaccaccggataagactgacaaggatga

SEQ ID NO: 8023 - DNA, 40 bp, Artificial Sequence
  Synthetic
ttgccttctgggttagcaatgaactcagcagtagcagttc

SEQ ID NO: 8024 - DNA, 38 bp, Artificial Sequence
  Synthetic
cttagcagacgctcgtgcaagaacatccagccgatagc

SEQ ID NO: 8025 - DNA, 39 bp, Artificial Sequence
  Synthetic
tagcgttgaagttgttgacgtgagctcatgcagaaatgc

SEQ ID NO: 8026 - DNA, 47 bp, Artificial Sequence
  Synthetic
atcaataggaccaatcaaactcaggtgtgtcagttttaactcacaaa

SEQ ID NO: 8027 - DNA, 44 bp, Artificial Sequence
  Synthetic
actgtcactggcttagattcatctgttcagcttagcaaccatga

SEQ ID NO: 8028 - DNA, 43 bp, Artificial Sequence
  Synthetic
attacgaatagtggcgctactagaaactcatgaaccagtaggg

SEQ ID NO: 8029 - DNA, 47 bp, Artificial Sequence
  Synthetic
acttctcatcaatggcttacctatgtcaatgcattgatgattctgag

SEQ ID NO: 8030 - DNA, 43 bp, Artificial Sequence
  Synthetic
aaaagcactaattctccttcgtccttatagccagacttgcggt

SEQ ID NO: 8031 - DNA, 45 bp, Artificial Sequence
  Synthetic
tggtcaccaccattcaaaaactctttggagtgtcataactttcca

SEQ ID NO: 8032 - DNA, 45 bp, Artificial Sequence
  Synthetic
atgtctccatcaatacaccgttaaaactcaacttgaaagcctaga

SEQ ID NO: 8033 - DNA, 48 bp, Artificial Sequence
  Synthetic
ctatcactgaaaatgacaatgcgtcagtcttctagatttttggtcatt

SEQ ID NO: 8034 - DNA, 49 bp, Artificial Sequence
  Synthetic
aaacctcagcacattattcaagctccgtaatgttttctactttcaaaga

SEQ ID NO: 8035 - DNA, 46 bp, Artificial Sequence
  Synthetic
ttgcatctgtacaggtctatagtgacatctgataacccaacctcac

SEQ ID NO: 8036 - DNA, 40 bp, Artificial Sequence
  Synthetic
gctatggctgactcactagcttcataggctttgggttctt

SEQ ID NO: 8037 - DNA, 44 bp, Artificial Sequence
  Synthetic
cttaaaagggcactaggaaaggaaacaaaaccgtcaaagcgata

SEQ ID NO: 8038 - DNA, 44 bp, Artificial Sequence
  Synthetic
attggcgaacttttccaaatggttctttaagggttgctagcttt

SEQ ID NO: 8039 - DNA, 41 bp, Artificial Sequence
  Synthetic
ccttgcccataaagccaagattgtcaatcgtgtctttgttg

SEQ ID NO: 8040 - DNA, 43 bp, Artificial Sequence
  Synthetic
atccgtcgctttatgttgtaattgtgaacatggctatgcggtg

SEQ ID NO: 8041 - DNA, 43 bp, Artificial Sequence
  Synthetic
ggacaaccgtttttttaaaaggttggttgggattcgggattgg

SEQ ID NO: 8042 - DNA, 43 bp, Artificial Sequence
  Synthetic
cctttgccaaacacgagcaatcggtatagataaagtccacgta

SEQ ID NO: 8043 - DNA, 43 bp, Artificial Sequence
  Synthetic
gtatgagatggctgaggtcaagggaaaacagcctgatagtctg

SEQ ID NO: 8044 - DNA, 46 bp, Artificial Sequence
  Synthetic
aaaagtcccgctaatgaatcccgcaaaacatataccttacacaaag

SEQ ID NO: 8045 - DNA, 47 bp, Artificial Sequence
  Synthetic
atcaactcctgattgattacctgtttacgctcaaaatggtatttcag

SEQ ID NO: 8046 - DNA, 46 bp, Artificial Sequence
  Synthetic
cctgctaagtcgggattgaagtctaacgtatatggctatacactag

SEQ ID NO: 8047 - DNA, 43 bp, Artificial Sequence
  Synthetic
ccacctaaagctacccccaactatggtaaaacatttgggttag

SEQ ID NO: 8048 - DNA, 40 bp, Artificial Sequence
  Synthetic
attcacacgaccaatcagacctacggtagctctgctcaag

SEQ ID NO: 8049 - DNA, 41 bp, Artificial Sequence
  Synthetic
gtggtacgcccctacctgtcgagaggggagaagagctcaac

SEQ ID NO: 8050 - DNA, 36 bp, Artificial Sequence
  Synthetic
cagggcgccctgctactgacataatgccggcagcgt

SEQ ID NO: 8051 - DNA, 40 bp, Artificial Sequence
  Synthetic
gggtttataccacccgcgcttatgtgactatcaggcgccc

SEQ ID NO: 8052 - DNA, 38 bp, Artificial Sequence
  Synthetic
tacaccccttacccgaaggccaatgcccgcccgcacta

SEQ ID NO: 8053 - DNA, 40 bp, Artificial Sequence
  Synthetic
cggtggttgtggcctcctatttatgccttgcgtccgaatc

SEQ ID NO: 8054 - DNA, 41 bp, Artificial Sequence
  Synthetic
tgcttcgatcgtgaatacgcctacatcctttacgcacagcc

SEQ ID NO: 8055 - DNA, 38 bp, Artificial Sequence
  Synthetic
tctcacggacgccttccatcacagccagttttgcgccg

SEQ ID NO: 8056 - DNA, 37 bp, Artificial Sequence
  Synthetic
ggggccgatttccccgaggtaagaagcccgcagaccc

SEQ ID NO: 8057 - DNA, 39 bp, Artificial Sequence
  Synthetic
cggccaacgcccaacacaacgtcgaaggcctctggaaag

SEQ ID NO: 8058 - DNA, 41 bp, Artificial Sequence
  Synthetic
tataggcaggagacggctgctcttcgggagggacttggtat

SEQ ID NO: 8059 - DNA, 41 bp, Artificial Sequence
  Synthetic
ggtttccctgttatgaccccgcaatcaccagcctcttgccc

SEQ ID NO: 8060 - DNA, 38 bp, Artificial Sequence
  Synthetic
cgatgcccccgagatgtgtgttcgaggtggtcatcccg

SEQ ID NO: 8061 - DNA, 39 bp, Artificial Sequence
  Synthetic
tcgaggtgcgagctgtggtgggtgtaaagcttaccctgc

SEQ ID NO: 8062 - DNA, 40 bp, Artificial Sequence
  Synthetic
agcttgccgaattggttgaggcagttgagaaccgcagtgc

SEQ ID NO: 8063 - DNA, 38 bp, Artificial Sequence
  Synthetic
ggtgttgcaggctccccaagtagcagtgtaccgggctc

SEQ ID NO: 8064 - DNA, 39 bp, Artificial Sequence
  Synthetic
gcttgctagtcgcctgtggtcgagagcctccccaggaac

SEQ ID NO: 8065 - DNA, 41 bp, Artificial Sequence
  Synthetic
tgcggtcgcaggtttgaaagcggccaggtgtactccttcag

SEQ ID NO: 8066 - DNA, 39 bp, Artificial Sequence
  Synthetic
ctctccaccatgcccccacttgtcgggtacgacggcaac

SEQ ID NO: 8067 - DNA, 38 bp, Artificial Sequence
  Synthetic
ttccatcacttccaccgacgtgacgacgagctctgcgg

SEQ ID NO: 8068 - DNA, 40 bp, Artificial Sequence
  Synthetic
tgacccctggtaacacgaacacttgatcttgtgcggggct

SEQ ID NO: 8069 - DNA, 42 bp, Artificial Sequence
  Synthetic
gcccagtcgcagagtgctatggaatgattgtcgcctcctcag

SEQ ID NO: 8070 - DNA, 44 bp, Artificial Sequence
  Synthetic
tctgtgggtctggtgggatgagcatagtagtataggtagaaaca

SEQ ID NO: 8071 - DNA, 46 bp, Artificial Sequence
  Synthetic
tttctgtgtctaagcactggtgggaacaccacttaaatatcaatgt

SEQ ID NO: 8072 - DNA, 50 bp, Artificial Sequence
  Synthetic
tgattatgtcattgcattgactggtgggtctatcagaaaaaggtaaaatt

SEQ ID NO: 8073 - DNA, 42 bp, Artificial Sequence
  Synthetic
ttctgagagttggagtgttggtaaagtttcttagcaggtgtg

SEQ ID NO: 8074 - DNA, 46 bp, Artificial Sequence
  Synthetic
actggtgttattgacattagtgctaccaaggtttattgtttgtcaa

SEQ ID NO: 8075 - DNA, 47 bp, Artificial Sequence
  Synthetic
acaagcttttttctatagtggtggtatcaccagtaaaaacaggatca

SEQ ID NO: 8076 - DNA, 48 bp, Artificial Sequence
  Synthetic
ttctgcattgataattgtggtgagcggttattactctgcaagatagca

SEQ ID NO: 8077 - DNA, 48 bp, Artificial Sequence
  Synthetic
tgaaactgtctgtagtgtcgcataaccactaataactacatatggaac

SEQ ID NO: 8078 - DNA, 48 bp, Artificial Sequence
  Synthetic
tgatgaagagggtggttatgatgtcattactaataggccattgtgaaa

SEQ ID NO: 8079 - DNA, 46 bp, Artificial Sequence
  Synthetic
agcttgttagtatgaaaggtactggaagcatcaatgtcaataggtg

SEQ ID NO: 8080 - DNA, 42 bp, Artificial Sequence
  Synthetic
tttgactttgttgtcaatgctgctaatagcacgtgcaacacc

SEQ ID NO: 8081 - DNA, 47 bp, Artificial Sequence
  Synthetic
aacttgtgttattgccaatgttccaagtcaaacttgaaagaagcttt

SEQ ID NO: 8082 - DNA, 45 bp, Artificial Sequence
  Synthetic
gaagttgactgggttgctttttacgctttacatccaaagaagcaa

SEQ ID NO: 8083 - DNA, 44 bp, Artificial Sequence
  Synthetic
gtgatgttggtttttgtccacaccaacacgtccattaacaaact

SEQ ID NO: 8084 - DNA, 49 bp, Artificial Sequence
  Synthetic
tgtcctatagttgttggtgtttcaggagtctttcctaccaaatatacat

SEQ ID NO: 8085 - DNA, 47 bp, Artificial Sequence
  Synthetic
tgatgacggttacatttgtggtggatgaactaaagattgagagtaca

SEQ ID NO: 8086 - DNA, 45 bp, Artificial Sequence
  Synthetic
agctacaattccaccttacaatctgtctctcaacacaaccagatg

SEQ ID NO: 8087 - DNA, 44 bp, Artificial Sequence
  Synthetic
cataatggtgtcttcttgggagttaccttaatacgcaacacaga

SEQ ID NO: 8088 - DNA, 39 bp, Artificial Sequence
  Synthetic
tgcaagttgagagtgccaacgcagcatacaaaaaggcaa

SEQ ID NO: 8089 - DNA, 40 bp, Artificial Sequence
  Synthetic
tgcaccacatggaccttttggtcaccaccaataccaagta

SEQ ID NO: 8090 - DNA, 44 bp, Artificial Sequence
  Synthetic
cgcaaagtctgaatttgatcatgagtgagtagcagcttgttcag

SEQ ID NO: 8091 - DNA, 47 bp, Artificial Sequence
  Synthetic
tgaaactttgacatggcctcttatcgcttaagtttaccaggcataat

SEQ ID NO: 8092 - DNA, 45 bp, Artificial Sequence
  Synthetic
ttaactgcttgtgctttttctgttgtgcaccatgtttaacagctt

SEQ ID NO: 8093 - DNA, 45 bp, Artificial Sequence
  Synthetic
gggtgtgcttgtgaccgtaccttgctcgtttaaataagaaatgtc

SEQ ID NO: 8094 - DNA, 45 bp, Artificial Sequence
  Synthetic
tacttggaaagatggcagagtcagcatagaccaagtccatcatag

SEQ ID NO: 8095 - DNA, 45 bp, Artificial Sequence
  Synthetic
tgctctatgcgatgcgatggcttggttatctaatgttaaaacacc

SEQ ID NO: 8096 - DNA, 42 bp, Artificial Sequence
  Synthetic
actgaacttttgcaatttgtcaccttgatcaacgagtgctgg

SEQ ID NO: 8097 - DNA, 45 bp, Artificial Sequence
  Synthetic
agaactgttggtggtgtttctcatgtttttgatggtattgtcttg

SEQ ID NO: 8098 - DNA, 44 bp, Artificial Sequence
  Synthetic
tggcacaagttttaacagaagttgttcgtaccacctggcttaaa

SEQ ID NO: 8099 - DNA, 46 bp, Artificial Sequence
  Synthetic
atttgccttacccagatcctagttgtcttaacaacatcatcaacaa

SEQ ID NO: 8100 - DNA, 44 bp, Artificial Sequence
  Synthetic
ttgtggttcacaaactgtacttcgacatgatcatatgcgcattt

SEQ ID NO: 8101 - DNA, 45 bp, Artificial Sequence
  Synthetic
gtcagtgatgcatatgctaatttggggaggaccctgtattgtagt

SEQ ID NO: 8102 - DNA, 45 bp, Artificial Sequence
  Synthetic
tgttcctttacaggttggtttttcagacacacaaccttcagtttg

SEQ ID NO: 8103 - DNA, 38 bp, Artificial Sequence
  Synthetic
ttgagccaaaaccaccacactaacagcatcaccagagg

SEQ ID NO: 8104 - DNA, 46 bp, Artificial Sequence
  Synthetic
tggtcaacttgatggtctttgttacacaattgaaaattctggatac

SEQ ID NO: 8105 - DNA, 46 bp, Artificial Sequence
  Synthetic
aattgtttgcaaaacgaaaaatgggacaacaccgagatttttgaga

SEQ ID NO: 8106 - DNA, 44 bp, Artificial Sequence
  Synthetic
taaccacttgtccactttttatccaggcatagcataaccacact

SEQ ID NO: 8107 - DNA, 48 bp, Artificial Sequence
  Synthetic
cacctggtacaactgttttaaaacgtgcatcactaacataatcattga

SEQ ID NO: 8108 - DNA, 41 bp, Artificial Sequence
  Synthetic
gttacgggtttattgccaactcaagaaaccattggctgagt

SEQ ID NO: 8109 - DNA, 43 bp, Artificial Sequence
  Synthetic
ttcctgtgtttttagtgttgtcaacacacggccattatgtgtg

SEQ ID NO: 8110 - DNA, 47 bp, Artificial Sequence
  Synthetic
atcaaccactccgtttaacttgttggcattaaaataaacaaaaccag

SEQ ID NO: 8111 - DNA, 48 bp, Artificial Sequence
  Synthetic
gcacttttgtgggtattttaccaccccattaatataaaactggccagt

SEQ ID NO: 8112 - DNA, 44 bp, Artificial Sequence
  Synthetic
atgttgcactccccatttattatcacaccaaaagatgcagttgc

SEQ ID NO: 8113 - DNA, 46 bp, Artificial Sequence
  Synthetic
atcaacaaagcattattggtgccgtaactgtagtaagttttgcaag

SEQ ID NO: 8114 - DNA, 50 bp, Artificial Sequence
  Synthetic
aagttgttacatctggtttgggtactagaaagacctttagtacaagactt

SEQ ID NO: 8115 - DNA, 44 bp, Artificial Sequence
  Synthetic
atgaccggcttgattcaattcaaaaacaaatgcattcaaagctg

SEQ ID NO: 8116 - DNA, 45 bp, Artificial Sequence
  Synthetic
aatggtgtctttcgtgtaacttccgcacaaaatcagacaaaacag

SEQ ID NO: 8117 - DNA, 41 bp, Artificial Sequence
  Synthetic
ctacaggttgttgtggttgttgcccacaatcacaacagcct

SEQ ID NO: 8118 - DNA, 46 bp, Artificial Sequence
  Synthetic
atgtccatttacgtaactggaacttgcaacacaactataaaaagcg

SEQ ID NO: 8119 - DNA, 43 bp, Artificial Sequence
  Synthetic
cacttcttagtggtgtacttcttgtactgacccacttgaacac

SEQ ID NO: 8120 - DNA, 43 bp, Artificial Sequence
  Synthetic
tcctccttcattttacatgcctctaagattcctgggaatgacc

SEQ ID NO: 8121 - DNA, 44 bp, Artificial Sequence
  Synthetic
tttggaaccaaagttctctattgctgagcgatcctcaaactcaa

SEQ ID NO: 8122 - DNA, 42 bp, Artificial Sequence
  Synthetic
agttcttctggtacttccactccttatcagccctgggttgag

SEQ ID NO: 8123 - DNA, 49 bp, Artificial Sequence
  Synthetic
agtgggtgataatgttcagattaccaggttcttattatccttagctaca

SEQ ID NO: 8124 - DNA, 45 bp, Artificial Sequence
  Synthetic
ttggacagacctttattgcaaattgttttcagcaacactcagttt

SEQ ID NO: 8125 - DNA, 43 bp, Artificial Sequence
  Synthetic
atctgatttattagacgaggcgcgattcttgcttgtggaacaa

SEQ ID NO: 8126 - DNA, 44 bp, Artificial Sequence
  Synthetic
tgtggagattgggttttggcagcaataattcttttacactgtca

SEQ ID NO: 8127 - DNA, 42 bp, Artificial Sequence
  Synthetic
acaactttggagtggattgcacgggactttcggaatctaact

SEQ ID NO: 8128 - DNA, 44 bp, Artificial Sequence
  Synthetic
aatggggtaatgagaattggattgcctttgccttctcctgtgag

SEQ ID NO: 8129 - DNA, 45 bp, Artificial Sequence
  Synthetic
taaccctgataatcagacaaggcacatcgtccccattttgataat

SEQ ID NO: 8130 - DNA, 41 bp, Artificial Sequence
  Synthetic
tcgacgtccatcgactacaccgtctttgtcggacctgcgag

SEQ ID NO: 8131 - DNA, 43 bp, Artificial Sequence
  Synthetic
agagagttgctttgcccagaacttccattaattttaagaccca

SEQ ID NO: 8132 - DNA, 42 bp, Artificial Sequence
  Synthetic
aatattgcaatatggcagtctgggttcttcctccagagcctc

SEQ ID NO: 8133 - DNA, 46 bp, Artificial Sequence
  Synthetic
tgcaggttattgcagaaattcaccagattctccttcatttgttgaa

SEQ ID NO: 8134 - DNA, 43 bp, Artificial Sequence
  Synthetic
ttaaacttaggccttgaaacagacatcagcaattggtgtgctg

SEQ ID NO: 8135 - DNA, 41 bp, Artificial Sequence
  Synthetic
ctgagcaagcccacattttcgctgaacttttgccaaggcgg

SEQ ID NO: 8136 - DNA, 49 bp, Artificial Sequence
  Synthetic
taggtgacacagcatttatacaaggggtgtttctaaagagataacttct

SEQ ID NO: 8137 - DNA, 46 bp, Artificial Sequence
  Synthetic
atctgaacgtctactgctggtcacttttggtatagttacagtttga

SEQ ID NO: 8138 - DNA, 42 bp, Artificial Sequence
  Synthetic
tactgcttttgatgcaaaacagacagtgttcacctgaagcag

SEQ ID NO: 8139 - DNA, 43 bp, Artificial Sequence
  Synthetic
atcagaatgaaccatgaagcctatgatacatttgctcgcgacg

SEQ ID NO: 8140 - DNA, 45 bp, Artificial Sequence
  Synthetic
ccagaataatggcatttgctggatcctctggtattatctccaact

SEQ ID NO: 8141 - DNA, 43 bp, Artificial Sequence
  Synthetic
aatccctacccctaaaatctgtttgcgggtgcggtgttaatag

SEQ ID NO: 8142 - DNA, 38 bp, Artificial Sequence
  Synthetic
cgcggttaggacttgtttcagttttaggtgcttggcag

SEQ ID NO: 8143 - DNA, 42 bp, Artificial Sequence
  Synthetic
tttgtgtgaaacctgtgctgctccatcagtacctttgtgatc

SEQ ID NO: 8144 - DNA, 44 bp, Artificial Sequence
  Synthetic
ggaattgttccaccaacaggaaagttgtgaaggactctgaaagt

SEQ ID NO: 8145 - DNA, 41 bp, Artificial Sequence
  Synthetic
ctgatgttacggagagtcaaaccgaagtaccaagtcgcctc

SEQ ID NO: 8146 - DNA, 49 bp, Artificial Sequence
  Synthetic
acaaacacaagtagggcaaacagaatctgtatgttcattatcataagcc

SEQ ID NO: 8147 - DNA, 45 bp, Artificial Sequence
  Synthetic
acgatgcaacgtcacaatgttgatataggattaccatctaatgca

SEQ ID NO: 8148 - DNA, 42 bp, Artificial Sequence
  Synthetic
tttcactatgctcgacaaaatggtagctgccagtgtaggtat

SEQ ID NO: 8149 - DNA, 40 bp, Artificial Sequence
  Synthetic
atctggtggaaggcttggatatatcctccaactcgaacac

SEQ ID NO: 8150 - DNA, 42 bp, Artificial Sequence
  Synthetic
gggtgacccaaaatgaaggccttaatgaaggtgaatcaacac

SEQ ID NO: 8151 - DNA, 42 bp, Artificial Sequence
  Synthetic
tgtagcagagaccgattttaccaaaatcgagtaggacgttcc

SEQ ID NO: 8152 - DNA, 42 bp, Artificial Sequence
  Synthetic
acaacagacaaaatgtgggctttcacatccaaccataaacac

SEQ ID NO: 8153 - DNA, 49 bp, Artificial Sequence
  Synthetic
atccagactacattaaaatggcgcccttctggaaaaaaagaataaggaa

SEQ ID NO: 8154 - DNA, 40 bp, Artificial Sequence
  Synthetic
gtggttctctcgtatccacagagttttgaccttgggcctg

SEQ ID NO: 8155 - DNA, 42 bp, Artificial Sequence
  Synthetic
aacatctcagacaagttgtagcatcagaaaatcagcagctgc

SEQ ID NO: 8156 - DNA, 42 bp, Artificial Sequence
  Synthetic
actttgaagcaggaattctggagtctgtgtaggcggtcttga

SEQ ID NO: 8157 - DNA, 43 bp, Artificial Sequence
  Synthetic
actgtgtgaaaaatccctcaactagtggggttggagggtaatc

SEQ ID NO: 8158 - DNA, 43 bp, Artificial Sequence
  Synthetic
aatggagacaagtccttatcaactccaacaagccctccattct

SEQ ID NO: 8159 - DNA, 48 bp, Artificial Sequence
  Synthetic
tatcccaatttggtcaagagcacctactcaagagataaagttcttccg

SEQ ID NO: 8160 - DNA, 42 bp, Artificial Sequence
  Synthetic
tttcccttttccctttcctattcctaagaaccctgaacctgc

SEQ ID NO: 8161 - DNA, 45 bp, Artificial Sequence
  Synthetic
tctctttgatcttccacaaggggtatccaaggcatctcttcatag

SEQ ID NO: 8162 - DNA, 44 bp, Artificial Sequence
  Synthetic
agtgactggtgcttcttattttacttgatccaacctcagctgta

SEQ ID NO: 8163 - DNA, 43 bp, Artificial Sequence
  Synthetic
tcaagttcagataaaccctacaccttcaccaggaaccatagca

SEQ ID NO: 8164 - DNA, 49 bp, Artificial Sequence
  Synthetic
aatattgggacaggaacttcagctctccaaatctgtaaatctagctaaa

SEQ ID NO: 8165 - DNA, 45 bp, Artificial Sequence
  Synthetic
cttggacatctattccaactttggcgttgaccaactgagtctgaa

SEQ ID NO: 8166 - DNA, 46 bp, Artificial Sequence
  Synthetic
tttctggaatcacattaaagcaagctgcactcctgtaatatccatt

SEQ ID NO: 8167 - DNA, 42 bp, Artificial Sequence
  Synthetic
ttgcttcccatgtcagagtgaaggagcaaaacattccaagtt

SEQ ID NO: 8168 - DNA, 46 bp, Artificial Sequence
  Synthetic
ttgaggatccagttttagcaaagaatgatgtatgtctggattctcc

SEQ ID NO: 8169 - DNA, 42 bp, Artificial Sequence
  Synthetic
tagagggcctttagatctgacaatacctactggagtgaacca

SEQ ID NO: 8170 - DNA, 42 bp, Artificial Sequence
  Synthetic
agaagttgggaaacaaagactcaagggggtggaagtacttca

SEQ ID NO: 8171 - DNA, 42 bp, Artificial Sequence
  Synthetic
caggcagaagtgtgtggactcaatctaatcagtctcccagta

SEQ ID NO: 8172 - DNA, 44 bp, Artificial Sequence
  Synthetic
tggtcagatttttgtcagttagtgtcctacccttctcctcaaga

SEQ ID NO: 8173 - DNA, 38 bp, Artificial Sequence
  Synthetic
gcagttggcattcttggagtttgcgggagaaatgctta

SEQ ID NO: 8174 - DNA, 43 bp, Artificial Sequence
  Synthetic
gagagaagaatggatgtgtgagatgacaagcagccaatcatct

SEQ ID NO: 8175 - DNA, 45 bp, Artificial Sequence
  Synthetic
tccatgttgctggaggaaattctttggaacatttcttgagtaacc

SEQ ID NO: 8176 - DNA, 47 bp, Artificial Sequence
  Synthetic
agaaccagaggattataaagaggctctaactgagtcttacccactat

SEQ ID NO: 8177 - DNA, 45 bp, Artificial Sequence
  Synthetic
ggagttcatccaagattggctcagaacaattttccatcatgacag

SEQ ID NO: 8178 - DNA, 47 bp, Artificial Sequence
  Synthetic
tgctattggcatagatcctgatagacatctccgaatcttatcattgt

SEQ ID NO: 8179 - DNA, 41 bp, Artificial Sequence
  Synthetic
ggcaccatgcagtaccaaacacttcaatttggtcattcgtg

SEQ ID NO: 8180 - DNA, 42 bp, Artificial Sequence
  Synthetic
cctacagcaactgttacccttatgttaaactccagtgtgccg

SEQ ID NO: 8181 - DNA, 42 bp, Artificial Sequence
  Synthetic
cgggtacggacaatgaccaagagactgtgattcttcctgatg

SEQ ID NO: 8182 - DNA, 42 bp, Artificial Sequence
  Synthetic
atgagatcagatgcacccattggttgtcattgggaatgcttc

SEQ ID NO: 8183 - DNA, 39 bp, Artificial Sequence
  Synthetic
ttgggagggaatggtagacggtgtcctgttccctcagaa

SEQ ID NO: 8184 - DNA, 43 bp, Artificial Sequence
  Synthetic
ttcttgtggccctggagaacagtttgttcatttctgagtcagt

SEQ ID NO: 8185 - DNA, 43 bp, Artificial Sequence
  Synthetic
atggatttcctttgccatatcatgtcaggcccacatgatgaac

SEQ ID NO: 8186 - DNA, 42 bp, Artificial Sequence
  Synthetic
aaagacagtgcagcaacttagaaacaggctaacaacaggtct

SEQ ID NO: 8187 - DNA, 44 bp, Artificial Sequence
  Synthetic
aatctcgcagtggcagtttacaaataatctaacagtcgcaaaca

SEQ ID NO: 8188 - DNA, 42 bp, Artificial Sequence
  Synthetic
cattgtgacgaagagttgacagatccacctctgctactgtag

SEQ ID NO: 8189 - DNA, 48 bp, Artificial Sequence
  Synthetic
aattggttttctcttgaagcagactttcttcaaacagcttttccaaat

SEQ ID NO: 8190 - DNA, 42 bp, Artificial Sequence
  Synthetic
cctcgtttggaagcaataccttgtcctgttccataaatagcc

SEQ ID NO: 8191 - DNA, 44 bp, Artificial Sequence
  Synthetic
actgggtcgtaactgcatatgggtaacagttgcttacatccttc

SEQ ID NO: 8192 - DNA, 46 bp, Artificial Sequence
  Synthetic
caaggtaatacacgcataggtagagttccctctgatcttctgaaac

SEQ ID NO: 8193 - DNA, 46 bp, Artificial Sequence
  Synthetic
ccaaattttaaagtatggcagcacccctttgcctgtactaataccc

SEQ ID NO: 8194 - DNA, 39 bp, Artificial Sequence
  Synthetic
tgtccctcttacagacacaggcctcagcaatggtctcaa

SEQ ID NO: 8195 - DNA, 42 bp, Artificial Sequence
  Synthetic
taagcactattgacacagaaccctagcatccccagaatgttc

SEQ ID NO: 8196 - DNA, 39 bp, Artificial Sequence
  Synthetic
tgtcaacaacgggtaaggtctgtaggagtccgtgctttg

SEQ ID NO: 8197 - DNA, 43 bp, Artificial Sequence
  Synthetic
gatcctaacagatttgctctagctgaacagcccataccaaacg

SEQ ID NO: 8198 - DNA, 48 bp, Artificial Sequence
  Synthetic
ccttaccttgtgtagaaaatcctcccatgtccccatcttcaataatag

SEQ ID NO: 8199 - DNA, 49 bp, Artificial Sequence
  Synthetic
tgggtcagtaggagacagtattcccagcctttaaataataatggttgtc

SEQ ID NO: 8200 - DNA, 47 bp, Artificial Sequence
  Synthetic
ttaagcaacatgagtgcgactctttctattattattggttcacacgg

SEQ ID NO: 8201 - DNA, 42 bp, Artificial Sequence
  Synthetic
gtggggacatttgggtgacgaattgataacacttgccaggat

SEQ ID NO: 8202 - DNA, 44 bp, Artificial Sequence
  Synthetic
ctggggatgataaaaatgcaactgaccaatactgtccataagcc

SEQ ID NO: 8203 - DNA, 43 bp, Artificial Sequence
  Synthetic
tcctgacgtcagatgtatctgcatatgtctatgacgggcctat

SEQ ID NO: 8204 - DNA, 44 bp, Artificial Sequence
  Synthetic
agaacgatcagcaaggatttacgcgatttggaattaggtgtgga

SEQ ID NO: 8205 - DNA, 39 bp, Artificial Sequence
  Synthetic
ttccacgcgacagatccgtctaggatcacgagccaaggg

SEQ ID NO: 8206 - DNA, 36 bp, Artificial Sequence
  Synthetic
acagagctggtcctgacggatgggcgcgtctctctg

SEQ ID NO: 8207 - DNA, 38 bp, Artificial Sequence
  Synthetic
gctgatcctaacggaaggaggcatgcgccacacggagg

SEQ ID NO: 8208 - DNA, 36 bp, Artificial Sequence
  Synthetic
cctcccacgcgcgcctataaactgtgccctgttgcg

SEQ ID NO: 8209 - DNA, 37 bp, Artificial Sequence
  Synthetic
acaagacgagggctgcaacgctggtccggcagctcta

SEQ ID NO: 8210 - DNA, 38 bp, Artificial Sequence
  Synthetic
cggaggagagagaacggccgtacaccctctctcgcgcc

SEQ ID NO: 8211 - DNA, 38 bp, Artificial Sequence
  Synthetic
ggccaaggcaacggcacgatgacgacgtcctggctttc

SEQ ID NO: 8212 - DNA, 38 bp, Artificial Sequence
  Synthetic
cgatacagcgcgtcgtcgaactgctggtcggagagtgc

SEQ ID NO: 8213 - DNA, 43 bp, Artificial Sequence
  Synthetic
gttctcggacgggtcccttaatacttacttgagtgatggagtt

SEQ ID NO: 8214 - DNA, 47 bp, Artificial Sequence
  Synthetic
gcacgttgtctatccaatcgtaaagacctattctttgtattgggaaa

SEQ ID NO: 8215 - DNA, 41 bp, Artificial Sequence
  Synthetic
cgctttcctccgcatgtacaatgttgttcaacattcgcaag

SEQ ID NO: 8216 - DNA, 45 bp, Artificial Sequence
  Synthetic
ttttacacagtgtcgaaatcaccaaccggcttaactatacagttt

SEQ ID NO: 8217 - DNA, 40 bp, Artificial Sequence
  Synthetic
aacctgacctcgataaagcacttctcggcagtttgtttca

SEQ ID NO: 8218 - DNA, 42 bp, Artificial Sequence
  Synthetic
aatgacaaaacgtgctctctctggtgactatgagcagaccga

SEQ ID NO: 8219 - DNA, 46 bp, Artificial Sequence
  Synthetic
gttgcctgagttttcggtattcgaagttaacctgtgtttttaacga

SEQ ID NO: 8220 - DNA, 45 bp, Artificial Sequence
  Synthetic
ggttttgaagaagaagatgggatgttcaacgcctggaaaaaaatt

SEQ ID NO: 8221 - DNA, 43 bp, Artificial Sequence
  Synthetic
aacgattggattttcaaagtttccattggagaccgttgaacat

SEQ ID NO: 8222 - DNA, 44 bp, Artificial Sequence
  Synthetic
cgaaaatagttccgcctgtttctactcagaatacggtagcattt

SEQ ID NO: 8223 - DNA, 43 bp, Artificial Sequence
  Synthetic
ggtcaagcgaagataacattctttctaacgtagtgttgccgga

SEQ ID NO: 8224 - DNA, 42 bp, Artificial Sequence
  Synthetic
cattcgactcacatcattgaagcttaactttttcaccacgcc

SEQ ID NO: 8225 - DNA, 45 bp, Artificial Sequence
  Synthetic
aggttagattcggaaaccatagctagtgcaagttaagcagtttac

SEQ ID NO: 8226 - DNA, 39 bp, Artificial Sequence
  Synthetic
ggctccgcccatgatttcattaaaaaaacggccaacctc

SEQ ID NO: 8227 - DNA, 40 bp, Artificial Sequence
  Synthetic
gagtcgcttctagactcgcctgtttgagctgaagatggtg

SEQ ID NO: 8228 - DNA, 41 bp, Artificial Sequence
  Synthetic
tatgggcgcaaagtgctgtaaggtgttttcggttttcttac

SEQ ID NO: 8229 - DNA, 42 bp, Artificial Sequence
  Synthetic
ttggaagcatacgtttgtggcgtaagataacaggtaccgtgt

SEQ ID NO: 8230 - DNA, 44 bp, Artificial Sequence
  Synthetic
tttgcttttactgcagagcgtaatacctgtttataaactccgaa

SEQ ID NO: 8231 - DNA, 39 bp, Artificial Sequence
  Synthetic
tcggagagcgttgtggattgtgaaatgctacacggacac

SEQ ID NO: 8232 - DNA, 39 bp, Artificial Sequence
  Synthetic
acgacgtgctgcaaggccggcccgtctttagaaagagcg

SEQ ID NO: 8233 - DNA, 41 bp, Artificial Sequence
  Synthetic
cagaccgctgctggacgaacttggagagaaacgcgaaggga

SEQ ID NO: 8234 - DNA, 38 bp, Artificial Sequence
  Synthetic
acatctgttcgacgtgatcgcctctgacacaggccgcc

SEQ ID NO: 8235 - DNA, 42 bp, Artificial Sequence
  Synthetic
ttgggtggtcttgactttggcggacagatcttgccggtatcg

SEQ ID NO: 8236 - DNA, 41 bp, Artificial Sequence
  Synthetic
ccctcttccctttaaccccacgcaccctgtgtgtgactgtc

SEQ ID NO: 8237 - DNA, 43 bp, Artificial Sequence
  Synthetic
acaaagggattggctgatgattacagttccatgctattcccca

SEQ ID NO: 8238 - DNA, 47 bp, Artificial Sequence
  Synthetic
aactgaggaatatatctgttccagctgtctatgtaacttctcatccc

SEQ ID NO: 8239 - DNA, 44 bp, Artificial Sequence
  Synthetic
taatgcctttctcctcatgtctgatcttggactttccttcagtc

SEQ ID NO: 8240 - DNA, 50 bp, Artificial Sequence
  Synthetic
agaagtagcaatagatgacgaaacgactctacatttattgggtattttgg

SEQ ID NO: 8241 - DNA, 46 bp, Artificial Sequence
  Synthetic
tttgtgagtggaagagaaaaaccttggattttgtttgtaccattca

SEQ ID NO: 8242 - DNA, 46 bp, Artificial Sequence
  Synthetic
ggaaggcaaactagtaaaagggtccataatgcatcaaacatttggt

SEQ ID NO: 8243 - DNA, 45 bp, Artificial Sequence
  Synthetic
agaagacaagcataacgggaaacgcaatgttacatttacccaaat

SEQ ID NO: 8244 - DNA, 46 bp, Artificial Sequence
  Synthetic
tcatcgattatgaggagctaagagaggggaatatctcaaacctttc

SEQ ID NO: 8245 - DNA, 43 bp, Artificial Sequence
  Synthetic
tgcagatgcatatgtttttgtggtattgctatttccggcttga

SEQ ID NO: 8246 - DNA, 48 bp, Artificial Sequence
  Synthetic
attgcaatacaacttgtcaaacaccatgtatattctgaaatgggaggc

SEQ ID NO: 8247 - DNA, 46 bp, Artificial Sequence
  Synthetic
caccatcaaaatgagcaggggtctttgttagtaatctcgtcaatgg

SEQ ID NO: 8248 - DNA, 39 bp, Artificial Sequence
  Synthetic
cctacaagcgccaggagggtggagatagagccggccttg

SEQ ID NO: 8249 - DNA, 38 bp, Artificial Sequence
  Synthetic
ctcggagtcccagcgcgtttctgtcgctgcgttccatg

SEQ ID NO: 8250 - DNA, 36 bp, Artificial Sequence
  Synthetic
cacctccctgtggcgcatcagagcaggagcaggctc

SEQ ID NO: 8251 - DNA, 39 bp, Artificial Sequence
  Synthetic
tatccgtcctccctgggcacgatctggccctcaggtgac

SEQ ID NO: 8252 - DNA, 35 bp, Artificial Sequence
  Synthetic
ccgtccaccgtccctctcaggcgttcgggggactt

SEQ ID NO: 8253 - DNA, 42 bp, Artificial Sequence
  Synthetic
gaagacctagagctgccggacccacgtcgaacagatgtctga

SEQ ID NO: 8254 - DNA, 40 bp, Artificial Sequence
  Synthetic
gtgattctgggaaacgtgcccagacgatcacccaagccgt

SEQ ID NO: 8255 - DNA, 37 bp, Artificial Sequence
  Synthetic
gccctcctgggtacggcaactctcgtgccgttgcctt

SEQ ID NO: 8256 - DNA, 39 bp, Artificial Sequence
  Synthetic
gccgtgcttccagagaccgagtttaacggcgtgttcgac

SEQ ID NO: 8257 - DNA, 38 bp, Artificial Sequence
  Synthetic
caactcggcctgcgtgatcccgtgggggcagaactgag

SEQ ID NO: 8258 - DNA, 38 bp, Artificial Sequence
  Synthetic
aagccatgacggtacacagggtaagatacggcgtcctg

SEQ ID NO: 8259 - DNA, 47 bp, Artificial Sequence
  Synthetic
ttaaccgtttcttctgccagttaggcttatgctatatgaacagactg

SEQ ID NO: 8260 - DNA, 42 bp, Artificial Sequence
  Synthetic
tctccgaacatgatcagaactcgtgtttaagggggttcgttt

SEQ ID NO: 8261 - DNA, 42 bp, Artificial Sequence
  Synthetic
acgaaaacttttaacttcgacggaaatcttacttgtcgggcg

SEQ ID NO: 8262 - DNA, 39 bp, Artificial Sequence
  Synthetic
actgcaaatcgttccgtcgtggtctcgacttcgtgaatg

SEQ ID NO: 8263 - DNA, 43 bp, Artificial Sequence
  Synthetic
agcaaagcaataacgaaccttgttctcgttttttgctgtgaaa

SEQ ID NO: 8264 - DNA, 39 bp, Artificial Sequence
  Synthetic
tatcgtcgagctgtacagacgtatcgtcctccgcaagtt

SEQ ID NO: 8265 - DNA, 45 bp, Artificial Sequence
  Synthetic
taccttcaaaaatacgtaaacccctctgtaacagggagaagtttg

SEQ ID NO: 8266 - DNA, 42 bp, Artificial Sequence
  Synthetic
acaaacttgcaagcctgagctttcatttgctcttccatatgt

SEQ ID NO: 8267 - DNA, 39 bp, Artificial Sequence
  Synthetic
ggtaggtcgcgacttgttgattacttgtccaaaggtcga

SEQ ID NO: 8268 - DNA, 43 bp, Artificial Sequence
  Synthetic
caaccctgatgtaataaattccgtgatccaaccgcagattgtc

SEQ ID NO: 8269 - DNA, 42 bp, Artificial Sequence
  Synthetic
tcgggagaaaatagatcaagggctaattcggtttttaggcgc

SEQ ID NO: 8270 - DNA, 47 bp, Artificial Sequence
  Synthetic
taattcgcttaagattggcagtggaagttttgtagatatgggcttag

SEQ ID NO: 8271 - DNA, 39 bp, Artificial Sequence
  Synthetic
cgtctgttgttaggaccggtttagtcgttggtgtcccat

SEQ ID NO: 8272 - DNA, 49 bp, Artificial Sequence
  Synthetic
tcttcgcatacgtaagaaactacgcttttttaatgaagctgaacaactc

SEQ ID NO: 8273 - DNA, 43 bp, Artificial Sequence
  Synthetic
gcaaagcataaattcttctggcgttttcagttcaaacgcagac

SEQ ID NO: 8274 - DNA, 46 bp, Artificial Sequence
  Synthetic
tcatggttccgtcttccaagtcgttagtaaatataacagtaggaga

SEQ ID NO: 8275 - DNA, 42 bp, Artificial Sequence
  Synthetic
ccagatccgggttatagcgacaaagatctacactctttgctc

SEQ ID NO: 8276 - DNA, 42 bp, Artificial Sequence
  Synthetic
ctctctcctgtgtcgatcgcaataaacttatgctgaaccgag

SEQ ID NO: 8277 - DNA, 38 bp, Artificial Sequence
  Synthetic
atgtgtgacgtccgcatcattaacgacgttgtccacca

SEQ ID NO: 8278 - DNA, 38 bp, Artificial Sequence
  Synthetic
tgctcctacaagcgccaggatagagccggccttggaac

SEQ ID NO: 8279 - DNA, 37 bp, Artificial Sequence
  Synthetic
ggtggccgtgtacgcacctcgtcactcgaggaaacgc

SEQ ID NO: 8280 - DNA, 40 bp, Artificial Sequence
  Synthetic
atcgaccgactcctgctatccgggtgactccgcagactgg

SEQ ID NO: 8281 - DNA, 35 bp, Artificial Sequence
  Synthetic
gcggttctgccagggcgttagggtgacgacggacc

SEQ ID NO: 8282 - DNA, 36 bp, Artificial Sequence
  Synthetic
gggaccccgtggcgtatgatcgttccgcacatacgc

SEQ ID NO: 8283 - DNA, 38 bp, Artificial Sequence
  Synthetic
acattccatggggccaaagaatacaactggcaagtgca

SEQ ID NO: 8284 - DNA, 48 bp, Artificial Sequence
  Synthetic
ttaaatacggactgaaaggagggccgatattcttccctcatagacttt

SEQ ID NO: 8285 - DNA, 42 bp, Artificial Sequence
  Synthetic
ctccgccgagatcaaaagtccttgtttcccaacaagagtggc

SEQ ID NO: 8286 - DNA, 46 bp, Artificial Sequence
  Synthetic
aggcgatcatggaaaagaacatagtagcccttagtagtatcaaggt

SEQ ID NO: 8287 - DNA, 43 bp, Artificial Sequence
  Synthetic
gggagaccttcactacctccagaatttctgtcccaattgctct

SEQ ID NO: 8288 - DNA, 40 bp, Artificial Sequence
  Synthetic
ggccactatgtctgcacgttttgcactggtcacataattc

SEQ ID NO: 8289 - DNA, 44 bp, Artificial Sequence
  Synthetic
agaagtgagaataagatgctgcaacaatgtggttggttttttcc

SEQ ID NO: 8290 - DNA, 42 bp, Artificial Sequence
  Synthetic
cacgcaacaggacttgcaagcagtgacaaaatacacaatgtg

SEQ ID NO: 8291 - DNA, 43 bp, Artificial Sequence
  Synthetic
atgtggggtctgggtgttcacatcttctgaaactacatcacct

SEQ ID NO: 8292 - DNA, 46 bp, Artificial Sequence
  Synthetic
caggtggtagagctgtttaaatgccactccaaaaagttccttaaac

SEQ ID NO: 8293 - DNA, 49 bp, Artificial Sequence
  Synthetic
gcttgccaaaatgttaaatgtaccagaactttgtaatttaggtggttgt

SEQ ID NO: 8294 - DNA, 50 bp, Artificial Sequence
  Synthetic
tgcacaaatagcagatatagatgcacacaatctctaacatatttagcttg

SEQ ID NO: 8295 - DNA, 41 bp, Artificial Sequence
  Synthetic
gcaaacagctacagcaccatatgcccatttgtcttgctgta

SEQ ID NO: 8296 - DNA, 46 bp, Artificial Sequence
  Synthetic
tacaggacacaagtcaagaactatgttctactgtctttcctccttt

SEQ ID NO: 8297 - DNA, 45 bp, Artificial Sequence
  Synthetic
gcacgctcgcctgatattgaacttccagttgtattataggtgtag

SEQ ID NO: 8298 - DNA, 45 bp, Artificial Sequence
  Synthetic
aaccccatatttactgatccttcgggatacgaccactagcctcta

SEQ ID NO: 8299 - DNA, 47 bp, Artificial Sequence
  Synthetic
tcaccttctatacctgccatatctgtctgaaatagtatgcaggattc

SEQ ID NO: 8300 - DNA, 45 bp, Artificial Sequence
  Synthetic
tacgcttgcccgaccctaatggtttcagaattaaataaagacgtg

SEQ ID NO: 8301 - DNA, 46 bp, Artificial Sequence
  Synthetic
acaccgtgcaatgcttctaaatcactttttaattctagtacaggac

SEQ ID NO: 8302 - DNA, 44 bp, Artificial Sequence
  Synthetic
tgtgtgtgatactcccttgcaacaacacatacatacattccaga

SEQ ID NO: 8303 - DNA, 49 bp, Artificial Sequence
  Synthetic
atacgcttccaaacttgcttttaggccaaactgctattagctaaatgtt

SEQ ID NO: 8304 - DNA, 40 bp, Artificial Sequence
  Synthetic
cattgcaccagctatgtgaagtgaacacacagccaagttg

SEQ ID NO: 8305 - DNA, 47 bp, Artificial Sequence
  Synthetic
taaggtgctacagatgtcaacatcccgtttcttatagtcacagtgta

SEQ ID NO: 8306 - DNA, 42 bp, Artificial Sequence
  Synthetic
ctcagaggatgaggatgaggatgatgttgttcgtcccgtcta

SEQ ID NO: 8307 - DNA, 41 bp, Artificial Sequence
  Synthetic
gtaatcagcaaacagtgtgccgccggcacttctgtatcaat

SEQ ID NO: 8308 - DNA, 42 bp, Artificial Sequence
  Synthetic
tgccactgcaacaaatacaagatacaatatagcttggcctgc

SEQ ID NO: 8309 - DNA, 47 bp, Artificial Sequence
  Synthetic
gcatttgacaatgaagtaaccgatgtgtgcattactgtctacatctg

SEQ ID NO: 8310 - DNA, 46 bp, Artificial Sequence
  Synthetic
cctaaggtatcaaggggtcgagacaattatgttttggtgtaccttg

SEQ ID NO: 8311 - DNA, 42 bp, Artificial Sequence
  Synthetic
atttggataacgacgaagacaagggaattttctcctggcacg

SEQ ID NO: 8312 - DNA, 40 bp, Artificial Sequence
  Synthetic
acaaactttaaagacgaggccatcccatatgcacttccca

SEQ ID NO: 8313 - DNA, 41 bp, Artificial Sequence
  Synthetic
actgactccaccacacagtccattccttgcgacacactctg

SEQ ID NO: 8314 - DNA, 44 bp, Artificial Sequence
  Synthetic
agatgaaacccaacgccaaaaattgtaccagtgatacactaggg

SEQ ID NO: 8315 - DNA, 38 bp, Artificial Sequence
  Synthetic
tttgctgctttgtgtgcctgaaacacagaggcagactg

SEQ ID NO: 8316 - DNA, 42 bp, Artificial Sequence
  Synthetic
ccaacatctggggttcatagttatattgcctgtaccctgaac

SEQ ID NO: 8317 - DNA, 42 bp, Artificial Sequence
  Synthetic
agacattgtggctttacacagaccgcctactaaaacgcacac

SEQ ID NO: 8318 - DNA, 43 bp, Artificial Sequence
  Synthetic
acgtaggcgtcgtaaacgtattctaggaggcagataaaccttg

SEQ ID NO: 8319 - DNA, 41 bp, Artificial Sequence
  Synthetic
acagatatgtgaaaagtgcagctgtgggtcctgcttttcag

SEQ ID NO: 8320 - DNA, 41 bp, Artificial Sequence
  Synthetic
ctgcataccttagtgcttttgggagaacgtatgctgcaagc

SEQ ID NO: 8321 - DNA, 39 bp, Artificial Sequence
  Synthetic
ggcaactctccaggttgtctgcatatcaacatcaaccgg

SEQ ID NO: 8322 - DNA, 40 bp, Artificial Sequence
  Synthetic
ctgcctgcgcacctctcatgggactcaaagtgagcacacg

SEQ ID NO: 8323 - DNA, 46 bp, Artificial Sequence
  Synthetic
tgtggctattcagacaggattatgcgcatttgctacatcttgagat

SEQ ID NO: 8324 - DNA, 40 bp, Artificial Sequence
  Synthetic
aactccaggatctgggcaattctaccagggtagtgcacaa

SEQ ID NO: 8325 - DNA, 43 bp, Artificial Sequence
  Synthetic
acaactttaattggggagattgcaaaactaaatcgcagactgc

SEQ ID NO: 8326 - DNA, 47 bp, Artificial Sequence
  Synthetic
tctcttgttgtaccatgggtgacatggagtatttattatctgcagtt

SEQ ID NO: 8327 - DNA, 47 bp, Artificial Sequence
  Synthetic
tggaaaatcacactacaggaaatggggttatttctgagtcaaacctg

SEQ ID NO: 8328 - DNA, 46 bp, Artificial Sequence
  Synthetic
ggacagccatttcctagattttcttttgtctccatcatatccatca

SEQ ID NO: 8329 - DNA, 50 bp, Artificial Sequence
  Synthetic
aggaacaaggcataactgattacatgttctttaacactatctacaaaacc

SEQ ID NO: 8330 - DNA, 48 bp, Artificial Sequence
  Synthetic
aaaagttttgcaaatggacccaattatttcttaagccatgaatcagac

SEQ ID NO: 8331 - DNA, 39 bp, Artificial Sequence
  Synthetic
ggtggtggatgtcatgtctgctatagctggtggtggtgg

SEQ ID NO: 8332 - DNA, 44 bp, Artificial Sequence
  Synthetic
aacgatttatgagtcaaaaggttggaatagttgtaccactcccg

SEQ ID NO: 8333 - DNA, 44 bp, Artificial Sequence
  Synthetic
tatgcgaaaaacttgattgttgtgtctctccaagtacctctcac

SEQ ID NO: 8334 - DNA, 50 bp, Artificial Sequence
  Synthetic
agatgatgaagttgatgcagaagagccacagttacttgattattgtacaa

SEQ ID NO: 8335 - DNA, 48 bp, Artificial Sequence
  Synthetic
acaggtaacaactagtggattttcatctctactctttgcactcttaaa

SEQ ID NO: 8336 - DNA, 44 bp, Artificial Sequence
  Synthetic
aaatgcgtaatatgtcaatggcagaccctctgttttacaacgat

SEQ ID NO: 8337 - DNA, 48 bp, Artificial Sequence
  Synthetic
agatgtaaaagcagaacaatcgttgtgttaggaaactgtatacattgt

SEQ ID NO: 8338 - DNA, 47 bp, Artificial Sequence
  Synthetic
atttggaggcttaaagacacaagtttaaaacagtattttggctctgt

SEQ ID NO: 8339 - DNA, 40 bp, Artificial Sequence
  Synthetic
aaccttcgacgacgacaaggagtccgtcgtttggctcctc

SEQ ID NO: 8340 - DNA, 43 bp, Artificial Sequence
  Synthetic
gaggagctatataaacaatgtgccagcccatgtatcaccttct

SEQ ID NO: 8341 - DNA, 45 bp, Artificial Sequence
  Synthetic
cagatgagtctgcagtactagatgtccacatctaaagcaaaccgt

SEQ ID NO: 8342 - DNA, 43 bp, Artificial Sequence
  Synthetic
accttcctattttacaaccgataccaattgtagctcgctcacc

SEQ ID NO: 8343 - DNA, 45 bp, Artificial Sequence
  Synthetic
ttcagatgacttttacttgcatcctacagccatctgcaaaaaatt

SEQ ID NO: 8344 - DNA, 44 bp, Artificial Sequence
  Synthetic
gaggacgatactggtgatcacatgaacacttgattctgtttagg

SEQ ID NO: 8345 - DNA, 38 bp, Artificial Sequence
  Synthetic
caacaccgagtggctcactgtctttgcaaccaaaacgg

SEQ ID NO: 8346 - DNA, 43 bp, Artificial Sequence
  Synthetic
ttctgggacgttgatttaacagagaaatcgtctgcccaaagac

SEQ ID NO: 8347 - DNA, 41 bp, Artificial Sequence
  Synthetic
ggctgcctgcccctctttgagcacacgagactcttcacacc

SEQ ID NO: 8348 - DNA, 39 bp, Artificial Sequence
  Synthetic
tactgtttgacaccatgggcgtgagttttcatgcgagcc

SEQ ID NO: 8349 - DNA, 50 bp, Artificial Sequence
  Synthetic
aggcttaaacaaattactatcgggacagtatagagtttagtgtatcttgt

SEQ ID NO: 8350 - DNA, 43 bp, Artificial Sequence
  Synthetic
accatcatgcattgggtaggtgaattttgtggcattacattgg

SEQ ID NO: 8351 - DNA, 50 bp, Artificial Sequence
  Synthetic
aacatcactatattcccacaccagcggtacacaattaatgtatggtacaa

SEQ ID NO: 8352 - DNA, 47 bp, Artificial Sequence
  Synthetic
tggatctcaacaatttctcacaactgacactaaagtctggtagaaga

SEQ ID NO: 8353 - DNA, 49 bp, Artificial Sequence
  Synthetic
actttgcaaattggtcaggtagtatctgtactaaagctatcacaaacac

SEQ ID NO: 8354 - DNA, 38 bp, Artificial Sequence
  Synthetic
ccaacccagtggtccacaacatggtggttgaagatgcc

SEQ ID NO: 8355 - DNA, 44 bp, Artificial Sequence
  Synthetic
tttgacatggaagttactgttgtcaccaggtggtacaaacatga

SEQ ID NO: 8356 - DNA, 46 bp, Artificial Sequence
  Synthetic
tgctgtgtatggtatcacatctacagtgtcttccatagctctgaag

SEQ ID NO: 8357 - DNA, 38 bp, Artificial Sequence
  Synthetic
aaactgcaggcccaagtgattaagtgcgcattcctgta

SEQ ID NO: 8358 - DNA, 45 bp, Artificial Sequence
  Synthetic
tggtatcagatagaggaaacctgttacaatgtccttcaccaatca

SEQ ID NO: 8359 - DNA, 47 bp, Artificial Sequence
  Synthetic
ggtttcactgacacacttaaagaccgccatttaactacctttgaagt

SEQ ID NO: 8360 - DNA, 38 bp, Artificial Sequence
  Synthetic
ccaagccgacaaggtgatggatgccaatccactcaagg

SEQ ID NO: 8361 - DNA, 41 bp, Artificial Sequence
  Synthetic
atggatgatctgggccaaaacgacaccatctgacagaacat

SEQ ID NO: 8362 - DNA, 44 bp, Artificial Sequence
  Synthetic
tcaagtaggcttgctagatactgcgtggtggcttactacagttc

SEQ ID NO: 8363 - DNA, 44 bp, Artificial Sequence
  Synthetic
agaccctaaagtcattcaatactgctcaattgagccatggactg

SEQ ID NO: 8364 - DNA, 44 bp, Artificial Sequence
  Synthetic
ccttgcaaggtcctgaacatggtaatgatatggcagtttcttct

SEQ ID NO: 8365 - DNA, 49 bp, Artificial Sequence
  Synthetic
atacatgtgggtggaaatggtaggtcagcaaaatatttcctaagtagtg

SEQ ID NO: 8366 - DNA, 43 bp, Artificial Sequence
  Synthetic
tgaatgagtacatagaaacagccggttctgggttgatgtcaag

SEQ ID NO: 8367 - DNA, 43 bp, Artificial Sequence
  Synthetic
actttcctaaaggatgaactccgctccacaatcctggtcttac

SEQ ID NO: 8368 - DNA, 42 bp, Artificial Sequence
  Synthetic
agatggagaactcattgcttttgacgctttaaaccacactgg

SEQ ID NO: 8369 - DNA, 44 bp, Artificial Sequence
  Synthetic
atgagtcaatcagatggactaaggaacaaacacaacgaatggac

SEQ ID NO: 8370 - DNA, 43 bp, Artificial Sequence
  Synthetic
aaccctgctctcagaatgaaatgttctcttgtctgctgtgatt

SEQ ID NO: 8371 - DNA, 48 bp, Artificial Sequence
  Synthetic
caagtacagtccattatccaaaggtcatgttttaacctttcaaccttc

SEQ ID NO: 8372 - DNA, 44 bp, Artificial Sequence
  Synthetic
gtaaaattgctcctttaatggtggcgaaatctggttttgcggac

SEQ ID NO: 8373 - DNA, 43 bp, Artificial Sequence
  Synthetic
ggcggagagcaacagctatccttactatcaactgaatcagcct

SEQ ID NO: 8374 - DNA, 46 bp, Artificial Sequence
  Synthetic
cacttccaaaaagatgcaaaagtgccatccccatgacattgtcaat

SEQ ID NO: 8375 - DNA, 41 bp, Artificial Sequence
  Synthetic
cagggaacagagaagttgacaatcaggaccgttgatttccc

SEQ ID NO: 8376 - DNA, 40 bp, Artificial Sequence
  Synthetic
ggaaacggccgattttcccacttacttgcaaccgcccaaa

SEQ ID NO: 8377 - DNA, 44 bp, Artificial Sequence
  Synthetic
ggtgtttatgttacacatcagctgaggcactcaagagtagtctc

SEQ ID NO: 8378 - DNA, 41 bp, Artificial Sequence
  Synthetic
atgattcttcaggctgacatagctaggtataggcggcagag

SEQ ID NO: 8379 - DNA, 43 bp, Artificial Sequence
  Synthetic
ggagacccaaatgcttcctgcttactgtaaataaagctgaagc

SEQ ID NO: 8380 - DNA, 39 bp, Artificial Sequence
  Synthetic
ccaggaactaggcgcagctgccttgcatgcgtcacacat

SEQ ID NO: 8381 - DNA, 48 bp, Artificial Sequence
  Synthetic
actggtttggaactcctctatctctttcaaattcctcgctataatcct

SEQ ID NO: 8382 - DNA, 41 bp, Artificial Sequence
  Synthetic
gcttttacagccagcagcgtcgcctccctcatttcttcctc

SEQ ID NO: 8383 - DNA, 41 bp, Artificial Sequence
  Synthetic
aacatgcctgctacatctcgggaggctgacttgtccagagt

SEQ ID NO: 8384 - DNA, 42 bp, Artificial Sequence
  Synthetic
ctgctcttccctagaaacgggcgtgcagccctttaccacatt

SEQ ID NO: 8385 - DNA, 40 bp, Artificial Sequence
  Synthetic
acgatgagaccaagtccagggtgctgcatcctggtgtgtc

SEQ ID NO: 8386 - DNA, 37 bp, Artificial Sequence
  Synthetic
gaccatgacctacgcgaccgttgtcatggcggctgcg

SEQ ID NO: 8387 - DNA, 40 bp, Artificial Sequence
  Synthetic
ggggtggaggtagcaccactcccctgctatgactggatca

SEQ ID NO: 8388 - DNA, 42 bp, Artificial Sequence
  Synthetic
ggaccaccaggacaatgtagccgcattcccttccaagttgca

SEQ ID NO: 8389 - DNA, 38 bp, Artificial Sequence
  Synthetic
gggccgtagatgaccccgagacggcagttgcatctcct

SEQ ID NO: 8390 - DNA, 39 bp, Artificial Sequence
  Synthetic
ttgggacgactgcgactgtaggaggacatgacgctggcc

SEQ ID NO: 8391 - DNA, 36 bp, Artificial Sequence
  Synthetic
tttgggcgcgagaaagaccgtgcgagaccgtctgcg

SEQ ID NO: 8392 - DNA, 41 bp, Artificial Sequence
  Synthetic
cgtccacgccaagacaaaggaggaccccctggtggaaaacg

SEQ ID NO: 8393 - DNA, 41 bp, Artificial Sequence
  Synthetic
ccctgccgcaatgctttttaggtgccaccaagcttgacaat

SEQ ID NO: 8394 - DNA, 37 bp, Artificial Sequence
  Synthetic
ccagcctcggttatgcagggactaacgagcccctgcg

SEQ ID NO: 8395 - DNA, 36 bp, Artificial Sequence
  Synthetic
acaactcatgcgagggtgccctttcgcgccgagcag

SEQ ID NO: 8396 - DNA, 38 bp, Artificial Sequence
  Synthetic
gaggtgtgcgtcagggcaaatgcgacgactcggacttt

SEQ ID NO: 8397 - DNA, 40 bp, Artificial Sequence
  Synthetic
aagctcctcgtaggtgaggtccttcaggagtgggcactgg

SEQ ID NO: 8398 - DNA, 42 bp, Artificial Sequence
  Synthetic
accagcatgaaggggacaagctgcggctctttgttacctacg

SEQ ID NO: 8399 - DNA, 38 bp, Artificial Sequence
  Synthetic
gccctggctggtggttttcatctccgtcctcgaggagc

SEQ ID NO: 8400 - DNA, 38 bp, Artificial Sequence
  Synthetic
gcgtcattgacggcggcctctaccaggacaactcgggc

SEQ ID NO: 8401 - DNA, 36 bp, Artificial Sequence
  Synthetic
cgcaggcgctgaaaaaggtagtgcgccgctggatca

SEQ ID NO: 8402 - DNA, 38 bp, Artificial Sequence
  Synthetic
cgggagacggtcgacgaagccaccgaaaccatgcgtcg

SEQ ID NO: 8403 - DNA, 42 bp, Artificial Sequence
  Synthetic
aggaaagcgtctagccaatcgccgcaattctaacagcgtcca

SEQ ID NO: 8404 - DNA, 39 bp, Artificial Sequence
  Synthetic
cgacgcgctcggcaaggattgttgacatggacgacttcc

SEQ ID NO: 8405 - DNA, 38 bp, Artificial Sequence
  Synthetic
gtagccgtagaggtagcgggactctggaaccgcgtccg

SEQ ID NO: 8406 - DNA, 37 bp, Artificial Sequence
  Synthetic
ggctaaagccgcgactaacgtggcggctatcgggctt

SEQ ID NO: 8407 - DNA, 37 bp, Artificial Sequence
  Synthetic
gcatcccgtcctgcgccaaatttgtacagcgccggcg

SEQ ID NO: 8408 - DNA, 35 bp, Artificial Sequence
  Synthetic
tgattgcgcgcgaggaggttgcacgatggcctccg

SEQ ID NO: 8409 - DNA, 36 bp, Artificial Sequence
  Synthetic
cgcatggcgctcaaggtgcacggccttgtggatgcg

SEQ ID NO: 8410 - DNA, 34 bp, Artificial Sequence
  Synthetic
taagggcggcgctgcaaagttgcatcgcggcctc

SEQ ID NO: 8411 - DNA, 37 bp, Artificial Sequence
  Synthetic
acgaacgtgcagtccaacctgtgaaccgctcgcgctg

SEQ ID NO: 8412 - DNA, 39 bp, Artificial Sequence
  Synthetic
cggtcaacggtgagcagcttggtgaagggtgcgatcagc

SEQ ID NO: 8413 - DNA, 37 bp, Artificial Sequence
  Synthetic
cactgtcggccgaggaagaaagccccctcctgcatca

SEQ ID NO: 8414 - DNA, 39 bp, Artificial Sequence
  Synthetic
ccgccagggttctacacgggcccacagaaacccgtcgtt

SEQ ID NO: 8415 - DNA, 37 bp, Artificial Sequence
  Synthetic
gcctggtgtgggacgacgatcccgcccaagtccaaca

SEQ ID NO: 8416 - DNA, 41 bp, Artificial Sequence
  Synthetic
accctggaggttccgtttgtgcaatgctgtttctgccctcc

SEQ ID NO: 8417 - DNA, 40 bp, Artificial Sequence
  Synthetic
gatgccgggggtctacacctacggctctcggtgaagtcca

SEQ ID NO: 8418 - DNA, 43 bp, Artificial Sequence
  Synthetic
gcaagaggagatagcagtgtcccaatctctagctccttctcag

SEQ ID NO: 8419 - DNA, 42 bp, Artificial Sequence
  Synthetic
tcagcaactaccccgtggttggggcgagatcgttgtaaaagc

SEQ ID NO: 8420 - DNA, 39 bp, Artificial Sequence
  Synthetic
cgcgtgctctccagtcgcatgttattgctgggcgagatg

SEQ ID NO: 8421 - DNA, 35 bp, Artificial Sequence
  Synthetic
aactacacccccgcccccttagtcgcgcgcgtcag

SEQ ID NO: 8422 - DNA, 37 bp, Artificial Sequence
  Synthetic
cgtgtactgggtgcgcgagatcagggacgaggaggac

SEQ ID NO: 8423 - DNA, 40 bp, Artificial Sequence
  Synthetic
cggcacggcggtggtgtttaatagctacgcttgctcctga

SEQ ID NO: 8424 - DNA, 37 bp, Artificial Sequence
  Synthetic
aaatggatgtggagcccgaggtccacggtctgcacgc

SEQ ID NO: 8425 - DNA, 40 bp, Artificial Sequence
  Synthetic
ccaggaggcgaagatggggctggaaggatgcaacacgtag

SEQ ID NO: 8426 - DNA, 36 bp, Artificial Sequence
  Synthetic
caggagaggcatggcaggcaggaacccgccactcag

SEQ ID NO: 8427 - DNA, 38 bp, Artificial Sequence
  Synthetic
gaacgggggcgccttcaatttaggtccggagcgttgag

SEQ ID NO: 8428 - DNA, 37 bp, Artificial Sequence
  Synthetic
cctgacgcggaggagacgaaagggcctcctcgtacga

SEQ ID NO: 8429 - DNA, 40 bp, Artificial Sequence
  Synthetic
gagcacgctgcacagtatcgtcttaatagcatcggcggcg

SEQ ID NO: 8430 - DNA, 39 bp, Artificial Sequence
  Synthetic
cacccacgatgtgaccacggagatccacgggcacaaagc

SEQ ID NO: 8431 - DNA, 43 bp, Artificial Sequence
  Synthetic
aagggtctgcaaattggtgttgttcgtttgcatagataggctc

SEQ ID NO: 8432 - DNA, 39 bp, Artificial Sequence
  Synthetic
gaactctgcggtggacagttttccacaccgtgattctca

SEQ ID NO: 8433 - DNA, 42 bp, Artificial Sequence
  Synthetic
cctacgagtacatgaacgggcgcgccaatgttaacgtaagcg

SEQ ID NO: 8434 - DNA, 35 bp, Artificial Sequence
  Synthetic
gcgcctccgtccgctttgatgtgcgccatggggaa

SEQ ID NO: 8435 - DNA, 40 bp, Artificial Sequence
  Synthetic
aacgtggcccaatgcaacatggccctggtagccaatgttg

SEQ ID NO: 8436 - DNA, 35 bp, Artificial Sequence
  Synthetic
cagccctaccccgccaacttgggtgacggagggca

SEQ ID NO: 8437 - DNA, 35 bp, Artificial Sequence
  Synthetic
ggcaacgccaccacctaagctcgcgcacaatggcc

SEQ ID NO: 8438 - DNA, 40 bp, Artificial Sequence
  Synthetic
ttcgagtacgaggccatgttgctgctcgaggctgagacag

SEQ ID NO: 8439 - DNA, 38 bp, Artificial Sequence
  Synthetic
tccggcgcaaccaggaggaagcgaaagtagggggagtg

SEQ ID NO: 8440 - DNA, 38 bp, Artificial Sequence
  Synthetic
gtctcgctccacatgcgccgcggtcccaactgcgattt

SEQ ID NO: 8441 - DNA, 40 bp, Artificial Sequence
  Synthetic
ctgcttaaaagcttgctgggccttagcgggaaaagctgcg

SEQ ID NO: 8442 - DNA, 35 bp, Artificial Sequence
  Synthetic
tggccttccacctcggcaaactgggagtgcaccgg

SEQ ID NO: 8443 - DNA, 40 bp, Artificial Sequence
  Synthetic
tggtatccatgcccttctcccatctgaacgtgtgcaaccc

SEQ ID NO: 8444 - DNA, 36 bp, Artificial Sequence
  Synthetic
ccggagcccacccgctgataaaaggagcccctcgcc

SEQ ID NO: 8445 - DNA, 41 bp, Artificial Sequence
  Synthetic
acagaaggaaaccaacgctgggagcagcacatcctcctgtc

SEQ ID NO: 8446 - DNA, 40 bp, Artificial Sequence
  Synthetic
ctcacccattttgcctaccccggatccatgatgcgacgca

SEQ ID NO: 8447 - DNA, 39 bp, Artificial Sequence
  Synthetic
cgtggagctaaccaacctggtcagcacagtctgccccag

SEQ ID NO: 8448 - DNA, 39 bp, Artificial Sequence
  Synthetic
gccttggacctggccgaaatctcataaagtcgggcagcc

SEQ ID NO: 8449 - DNA, 35 bp, Artificial Sequence
  Synthetic
gccactgccgctgcaacctggagctgggggttgca

SEQ ID NO: 8450 - DNA, 40 bp, Artificial Sequence
  Synthetic
ctcgcccaattgcacgccatccaggtagacccctttaccc

SEQ ID NO: 8451 - DNA, 40 bp, Artificial Sequence
  Synthetic
gggatcgagtaaagggtgacggtgtgggccctccatgatc

SEQ ID NO: 8452 - DNA, 40 bp, Artificial Sequence
  Synthetic
aaatcggtctctgcgctcgcgctgcagctgatcttcgttt

SEQ ID NO: 8453 - DNA, 40 bp, Artificial Sequence
  Synthetic
gtccgcccagacccgacttaagttgtatgcctttgcctcg

SEQ ID NO: 8454 - DNA, 40 bp, Artificial Sequence
  Synthetic
taccccgacgagttcataccgattcagtcgtagccgtcga

SEQ ID NO: 8455 - DNA, 41 bp, Artificial Sequence
  Synthetic
atccagtgtcgtcataatcgcaaaagttcacctgttcctgg

SEQ ID NO: 8456 - DNA, 44 bp, Artificial Sequence
  Synthetic
ggggtgtactgtcatgccactactgtacatataacactcctctc

SEQ ID NO: 8457 - DNA, 42 bp, Artificial Sequence
  Synthetic
ctgctggtaggggctctaatgagcaatttttccttctgctca

SEQ ID NO: 8458 - DNA, 48 bp, Artificial Sequence
  Synthetic
taatgctgacaagtctcatgaaaggtctacttttcccttactgtcatg

SEQ ID NO: 8459 - DNA, 43 bp, Artificial Sequence
  Synthetic
atcaacaaataaccttcagccaacattgccatttggaggtcca

SEQ ID NO: 8460 - DNA, 43 bp, Artificial Sequence
  Synthetic
acaagttgcagaaactgatcaaaacatcactcccaccacgatt

SEQ ID NO: 8461 - DNA, 42 bp, Artificial Sequence
  Synthetic
ttgctgcaaagccagaaaaaaatcggctgaggattcccgatt

SEQ ID NO: 8462 - DNA, 42 bp, Artificial Sequence
  Synthetic
tcctgcagcttatcgactggtgtgtattcgggactgtggtga

SEQ ID NO: 8463 - DNA, 38 bp, Artificial Sequence
  Synthetic
ctggaactctgttggggcataactgatttctgcgggga

SEQ ID NO: 8464 - DNA, 41 bp, Artificial Sequence
  Synthetic
cgaaaccagcggctgtatccagcaaagggtcttaaggaggg

SEQ ID NO: 8465 - DNA, 46 bp, Artificial Sequence
  Synthetic
tggaaatgtctcactcaaggttggcaaaggtggttcagtattaact

SEQ ID NO: 8466 - DNA, 44 bp, Artificial Sequence
  Synthetic
agaagataaacgcaccctatggaatcctgatcaattctgcaatt

SEQ ID NO: 8467 - DNA, 41 bp, Artificial Sequence
  Synthetic
ggaaagccacatcaaccagcgtattcacatccagtttcctg

SEQ ID NO: 8468 - DNA, 38 bp, Artificial Sequence
  Synthetic
gtgcgggaactggacttgggaatcaccgacccccgttt

SEQ ID NO: 8469 - DNA, 42 bp, Artificial Sequence
  Synthetic
atgttgggaatgatggaacccacagtgtgtttataaggggca

SEQ ID NO: 8470 - DNA, 45 bp, Artificial Sequence
  Synthetic
tggaaactcttgcagcaggggcagattatcataatgtaagttctg

SEQ ID NO: 8471 - DNA, 40 bp, Artificial Sequence
  Synthetic
gcggaggcaggattggaagaacctgcgtgacttgcacttt

SEQ ID NO: 8472 - DNA, 42 bp, Artificial Sequence
  Synthetic
tccgcacatgtggaaaagctgtttctattatgaaggtttgcc

SEQ ID NO: 8473 - DNA, 45 bp, Artificial Sequence
  Synthetic
atcctgtaaatacgtcactaggacctctactaaccatgcttcagc

SEQ ID NO: 8474 - DNA, 40 bp, Artificial Sequence
  Synthetic
actgggttagtatgcccgtgtgtactcgttcctactggat

SEQ ID NO: 8475 - DNA, 41 bp, Artificial Sequence
  Synthetic
aatgacggaaggtgtaaaaacccggaagtgtgtttgcgaaa

SEQ ID NO: 8476 - DNA, 42 bp, Artificial Sequence
  Synthetic
agtctggcggaggagcaattatagggcctaatgtgaagacag

SEQ ID NO: 8477 - DNA, 49 bp, Artificial Sequence
  Synthetic
agttcaagtttggatagtgttggtgcttctaatctattgaagaatcctt

SEQ ID NO: 8478 - DNA, 42 bp, Artificial Sequence
  Synthetic
caatgggcgttgctgtggtaccatgtccaaatatgttcttcc

SEQ ID NO: 8479 - DNA, 43 bp, Artificial Sequence
  Synthetic
aatgacagcaatgaaagatggatgatcttctgcaccacgaatc

SEQ ID NO: 8480 - DNA, 44 bp, Artificial Sequence
  Synthetic
tgatgatgctacagcggctgcttctattgtccaagtatcctgtt

SEQ ID NO: 8481 - DNA, 39 bp, Artificial Sequence
  Synthetic
acagaagctggctccatggtatatcgtcggctttgcatg

SEQ ID NO: 8482 - DNA, 42 bp, Artificial Sequence
  Synthetic
aaggtatacacagggcctctagtgcccatattctcaggtaga

SEQ ID NO: 8483 - DNA, 38 bp, Artificial Sequence
  Synthetic
tccagagcttgaagatgccgttacgcttgatggtcgtc

SEQ ID NO: 8484 - DNA, 44 bp, Artificial Sequence
  Synthetic
cactccaaagaacaaccacaacctggactttttgtgttgttgtt

SEQ ID NO: 8485 - DNA, 43 bp, Artificial Sequence
  Synthetic
aaagacaaggtttgacccctctctctcttatcaagtcaggctt

SEQ ID NO: 8486 - DNA, 45 bp, Artificial Sequence
  Synthetic
cctctcaaaacaggtcctgacaatctcctaccttgactattctga

SEQ ID NO: 8487 - DNA, 44 bp, Artificial Sequence
  Synthetic
tctactaccatggtccagccgctagagctactttattggcatta

SEQ ID NO: 8488 - DNA, 43 bp, Artificial Sequence
  Synthetic
tatcagtgaatctgctggttacactaacggggaggattccttt

SEQ ID NO: 8489 - DNA, 43 bp, Artificial Sequence
  Synthetic
ccacatatgaatctagtcatctgggttggaacacagcatcgac

SEQ ID NO: 8490 - DNA, 48 bp, Artificial Sequence
  Synthetic
aagcagagagaaaaacaacaacacattgcttttgttcttgtttgtgat

SEQ ID NO: 8491 - DNA, 42 bp, Artificial Sequence
  Synthetic
tgtcattggtaccatagcactaggtcagctaatgcaatgccc

SEQ ID NO: 8492 - DNA, 50 bp, Artificial Sequence
  Synthetic
aagggaactgtgatagatgttgattcctggtatttctgataaaattggta

SEQ ID NO: 8493 - DNA, 46 bp, Artificial Sequence
  Synthetic
ttgacctataccaattgcggtttcccttttattggcatatagttct

SEQ ID NO: 8494 - DNA, 46 bp, Artificial Sequence
  Synthetic
aacctataaggcaacagcatccccaatatgaactatttgttttccc

SEQ ID NO: 8495 - DNA, 50 bp, Artificial Sequence
  Synthetic
tctcattattacctggaccaagtctgataatgaaggtagtctaacacatc

SEQ ID NO: 8496 - DNA, 43 bp, Artificial Sequence
  Synthetic
acaaggggttatcagttatgctccccttcactcgagtagtctg

SEQ ID NO: 8497 - DNA, 43 bp, Artificial Sequence
  Synthetic
gtggcttaacaactccgctctgattaacattggtacatctgtt

SEQ ID NO: 8498 - DNA, 43 bp, Artificial Sequence
  Synthetic
ccaacctgcaaataggatcattagagacaggacttcatgaggc

SEQ ID NO: 8499 - DNA, 50 bp, Artificial Sequence
  Synthetic
tcaacatgctaagactcaagaatgtgagtgatacatgatgtagtagtgta

SEQ ID NO: 8500 - DNA, 49 bp, Artificial Sequence
  Synthetic
agagttactcagactggatatcccatcagagactgaaaaaatggatctt

SEQ ID NO: 8501 - DNA, 49 bp, Artificial Sequence
  Synthetic
gaattatgggagcttatcgactcttagtgataaaggttctagtagtgat

SEQ ID NO: 8502 - DNA, 45 bp, Artificial Sequence
  Synthetic
tggtaaagggagaaattgacctactatcttggaacacctgagaca

SEQ ID NO: 8503 - DNA, 44 bp, Artificial Sequence
  Synthetic
gtgacatccagagttcctgtcagtgatttcttcatagacgtgag

SEQ ID NO: 8504 - DNA, 46 bp, Artificial Sequence
  Synthetic
ttgtcagaaatataggtgatccagcacctgctttgatgaatctctt

SEQ ID NO: 8505 - DNA, 45 bp, Artificial Sequence
  Synthetic
agaaactccagacccgttagaatttacatatttctgagccttcaa

SEQ ID NO: 8506 - DNA, 46 bp, Artificial Sequence
  Synthetic
ttgaagttactcacccctgtatcggtagcagtatctctcaatctgt

SEQ ID NO: 8507 - DNA, 46 bp, Artificial Sequence
  Synthetic
aaagacacatcacatgcagtccccagaatcgtttgaatattttagg

SEQ ID NO: 8508 - DNA, 43 bp, Artificial Sequence
  Synthetic
ctgctgaggttcaacacaatatacccccttaacccccagaagg

SEQ ID NO: 8509 - DNA, 39 bp, Artificial Sequence
  Synthetic
atctcggagaaggtgcaggtgttcatgcagggtcctaat

SEQ ID NO: 8510 - DNA, 41 bp, Artificial Sequence
  Synthetic
ccatacagccatgggacaggattgatgtgttctgttgactg

SEQ ID NO: 8511 - DNA, 39 bp, Artificial Sequence
  Synthetic
gtcgtcagacctatgactggatatagtgttggctagcgc

SEQ ID NO: 8512 - DNA, 50 bp, Artificial Sequence
  Synthetic
aaatggtcacacaacgaacaataggttatcagatagcttctcttgttcaa

SEQ ID NO: 8513 - DNA, 46 bp, Artificial Sequence
  Synthetic
atgactaattcacaagacacagagcctcattccatttggtgttgtc

SEQ ID NO: 8514 - DNA, 45 bp, Artificial Sequence
  Synthetic
gcatgaagctccgaacacaaggttgattcattaaagtatttcagg

SEQ ID NO: 8515 - DNA, 40 bp, Artificial Sequence
  Synthetic
ccaatcctctgatgacttcgccctgcttgtattccctcat

SEQ ID NO: 8516 - DNA, 40 bp, Artificial Sequence
  Synthetic
atgagcattggggtaacagtgagttgaagagccatttggg

SEQ ID NO: 8517 - DNA, 45 bp, Artificial Sequence
  Synthetic
gtaatcccctgaatccatttgtcacattaccacagcattgtttac

SEQ ID NO: 8518 - DNA, 38 bp, Artificial Sequence
  Synthetic
tcgtacaggagaccagttggaatccgagccctagacac

SEQ ID NO: 8519 - DNA, 44 bp, Artificial Sequence
  Synthetic
aggactacgaggtggactttgagcaattcttctgttgttaattc

SEQ ID NO: 8520 - DNA, 40 bp, Artificial Sequence
  Synthetic
atacggtgccatgcatgcagcgcctgtacctgatgctcct

SEQ ID NO: 8521 - DNA, 40 bp, Artificial Sequence
  Synthetic
ttgttgaacaagcacagcaggctgcaccaccagcctaact

SEQ ID NO: 8522 - DNA, 43 bp, Artificial Sequence
  Synthetic
agtgataagtcaatatgtggggacttttacagcctctgccaca

SEQ ID NO: 8523 - DNA, 40 bp, Artificial Sequence
  Synthetic
ccaccaaagattagaagcgcacgtttcgccatacacctcg

SEQ ID NO: 8524 - DNA, 44 bp, Artificial Sequence
  Synthetic
ccttcttggccagtaactgccatgcttacacattgtaattgcat

SEQ ID NO: 8525 - DNA, 44 bp, Artificial Sequence
  Synthetic
tgagcctactaaattttctgggaggaccaaaaatggctgcttga

SEQ ID NO: 8526 - DNA, 42 bp, Artificial Sequence
  Synthetic
gcaacaagcttgaggaccaaataacattgcattttccaaacg

SEQ ID NO: 8527 - DNA, 42 bp, Artificial Sequence
  Synthetic
tgtggaatacgcagccacaacaaatttaactgttagtctgcg

SEQ ID NO: 8528 - DNA, 43 bp, Artificial Sequence
  Synthetic
acatgcaagtgttgtggtatatggacatatgagcagcagtgta

SEQ ID NO: 8529 - DNA, 40 bp, Artificial Sequence
  Synthetic
gtggatattggccctgtgtccctagagggatcggcagcac

SEQ ID NO: 8530 - DNA, 40 bp, Artificial Sequence
  Synthetic
accttgccggccatgtcatttgtgcattgggatttcctca

SEQ ID NO: 8531 - DNA, 42 bp, Artificial Sequence
  Synthetic
atgctgaccctgaggtgttggagccctgtactgtaagtgtgg

SEQ ID NO: 8532 - DNA, 41 bp, Artificial Sequence
  Synthetic
cgtcgtaaacgtgtaccctattctataccttgccgtcacca

SEQ ID NO: 8533 - DNA, 40 bp, Artificial Sequence
  Synthetic
tatccccaaggtgtctggctattagggtcaggaagctgta

SEQ ID NO: 8534 - DNA, 43 bp, Artificial Sequence
  Synthetic
gtttacgcagggaacaaatgttttaataagagtcaggcagtgc

SEQ ID NO: 8535 - DNA, 43 bp, Artificial Sequence
  Synthetic
aattgtttgtaaccgttgtggatacgggggatgtagcagtaca

SEQ ID NO: 8536 - DNA, 41 bp, Artificial Sequence
  Synthetic
gcccaaggaggatcgctatggtggaaaacttgtctcgtaaa

SEQ ID NO: 8537 - DNA, 43 bp, Artificial Sequence
  Synthetic
gttgttttgtattgtgctgtactggtcatacaaaccaggcacc

SEQ ID NO: 8538 - DNA, 42 bp, Artificial Sequence
  Synthetic
gttccttgtgttcgggtagccacaacaaaaaaggcgggagac

SEQ ID NO: 8539 - DNA, 44 bp, Artificial Sequence
  Synthetic
tttgtgctgactactttcccttaaagtttcctggctagaaaagt

SEQ ID NO: 8540 - DNA, 41 bp, Artificial Sequence
  Synthetic
aacatgtttacaaggtgggacgtgggtttggacaggacttt

SEQ ID NO: 8541 - DNA, 40 bp, Artificial Sequence
  Synthetic
acctccaacaaagcctgaagaggctgttcacagttggtat

SEQ ID NO: 8542 - DNA, 37 bp, Artificial Sequence
  Synthetic
aacctgactcacgctcagggcatgggggatgcggagg

SEQ ID NO: 8543 - DNA, 38 bp, Artificial Sequence
  Synthetic
cgaccgcgccattccattggtaggggccaatgggaggc

SEQ ID NO: 8544 - DNA, 41 bp, Artificial Sequence
  Synthetic
atcacccgaaaactagaggacattgactttcaaacaacccg

SEQ ID NO: 8545 - DNA, 42 bp, Artificial Sequence
  Synthetic
agttggcctaactcaccaaaaacttctaagtaagcgccccaa

SEQ ID NO: 8546 - DNA, 35 bp, Artificial Sequence
  Synthetic
tgcgtggtctccggtgcctacccgctgaacccacc

SEQ ID NO: 8547 - DNA, 38 bp, Artificial Sequence
  Synthetic
tgggtgggtgtacgtaggttccattcagcggccccgtg

SEQ ID NO: 8548 - DNA, 41 bp, Artificial Sequence
  Synthetic
gagatgctgctgtgtgaggcagccccaccttatcgttcaag

SEQ ID NO: 8549 - DNA, 40 bp, Artificial Sequence
  Synthetic
tggaagcctgctcagggatttcccgccttctgccatggta

SEQ ID NO: 8550 - DNA, 38 bp, Artificial Sequence
  Synthetic
acgtgggctgggcggatctgccccccttggtagatgtt

SEQ ID NO: 8551 - DNA, 40 bp, Artificial Sequence
  Synthetic
tctcccggattcactgccatctgtttcgggcgaacgtgag

SEQ ID NO: 8552 - DNA, 42 bp, Artificial Sequence
  Synthetic
ctcttcgcctacgcacaagtggctacggatcatgctctcacc

SEQ ID NO: 8553 - DNA, 37 bp, Artificial Sequence
  Synthetic
accagtgtcgccagtgcctcaggagaacgcattcggc

SEQ ID NO: 8554 - DNA, 39 bp, Artificial Sequence
  Synthetic
ccgagctcgggactctggtacccgttcccttttcagcgc

SEQ ID NO: 8555 - DNA, 40 bp, Artificial Sequence
  Synthetic
actggatgtgggcaaaggatgtacttatggcagcctttgt

SEQ ID NO: 8556 - DNA, 36 bp, Artificial Sequence
  Synthetic
tggcgatctgggagttggcggtccggacggccttga

SEQ ID NO: 8557 - DNA, 40 bp, Artificial Sequence
  Synthetic
tagaggctgccgatgcctgaggtcacatctcacgcatacg

SEQ ID NO: 8558 - DNA, 37 bp, Artificial Sequence
  Synthetic
atgggagaggcaccactctgtatacccccacacggcg

SEQ ID NO: 8559 - DNA, 36 bp, Artificial Sequence
  Synthetic
gcaatgccagcgcggggtatgcaggagtggacgctg

SEQ ID NO: 8560 - DNA, 39 bp, Artificial Sequence
  Synthetic
tcgggcgaagagcttccggcgttgaatctctacacggca

SEQ ID NO: 8561 - DNA, 37 bp, Artificial Sequence
  Synthetic
cggacagtgtcgcgctgcacgctggcaattgacctgc

SEQ ID NO: 8562 - DNA, 35 bp, Artificial Sequence
  Synthetic
gcgctgggcggttgaggttggctcctcagggtgct

SEQ ID NO: 8563 - DNA, 39 bp, Artificial Sequence
  Synthetic
ccctggctgaactcaccgacagcccccagttggattccg

SEQ ID NO: 8564 - DNA, 38 bp, Artificial Sequence
  Synthetic
ggccaccatcccgtgacaggcgtccccgtggatacctg

SEQ ID NO: 8565 - DNA, 40 bp, Artificial Sequence
  Synthetic
ggtatccacacggagcaggcccgctattacaatgttggcg

SEQ ID NO: 8566 - DNA, 39 bp, Artificial Sequence
  Synthetic
ctccagcggcccaaagggacggaattggagtctccggat

SEQ ID NO: 8567 - DNA, 39 bp, Artificial Sequence
  Synthetic
accagccaccagacgagcacggactggtccatgtgttcc

SEQ ID NO: 8568 - DNA, 40 bp, Artificial Sequence
  Synthetic
cggttgaaggagcccacgttattccaagcaggggtttagc

SEQ ID NO: 8569 - DNA, 41 bp, Artificial Sequence
  Synthetic
cgtcgcctataccgcatctgcgctttggagaacccctttgg

SEQ ID NO: 8570 - DNA, 38 bp, Artificial Sequence
  Synthetic
agagacacaagcccccccggggcgccattactcgaatg

SEQ ID NO: 8571 - DNA, 36 bp, Artificial Sequence
  Synthetic
cgcaccgtagcccgcgaaatgcagtgtcccaacccg

SEQ ID NO: 8572 - DNA, 36 bp, Artificial Sequence
  Synthetic
gcagcactacgtggcgggaacgccatgcttgggtca

SEQ ID NO: 8573 - DNA, 39 bp, Artificial Sequence
  Synthetic
aaaagctcagggcatccgcgcagtcgaacagggtgttgg

SEQ ID NO: 8574 - DNA, 41 bp, Artificial Sequence
  Synthetic
atcctgctgctcctgctcatccgagcagcagcaggatgagc

SEQ ID NO: 8575 - DNA, 42 bp, Artificial Sequence
  Synthetic
cggtggaggtaaaggtgttgcgagtcctactttaccggtggc

SEQ ID NO: 8576 - DNA, 42 bp, Artificial Sequence
  Synthetic
gtgtacctggggcacctcaaccaacccgctcgaacttatggt

SEQ ID NO: 8577 - DNA, 42 bp, Artificial Sequence
  Synthetic
atctggatcccttgacctcggctggaggtccttcccttcaac

SEQ ID NO: 8578 - DNA, 36 bp, Artificial Sequence
  Synthetic
ttccttgcaggcgaagaggctaactggcgccgtggc

SEQ ID NO: 8579 - DNA, 35 bp, Artificial Sequence
  Synthetic
gacgagtgcagcaccaggtaacaggctggcgtggg

SEQ ID NO: 8580 - DNA, 34 bp, Artificial Sequence
  Synthetic
accgcgttgtcggagctgtgagcccacggacgga

SEQ ID NO: 8581 - DNA, 43 bp, Artificial Sequence
  Synthetic
agctagaggatttgcgattgctatatgtcagcctctgataacg

SEQ ID NO: 8582 - DNA, 38 bp, Artificial Sequence
  Synthetic
agacgctgactctagtgtgccctcctcctcggtcccgt

SEQ ID NO: 8583 - DNA, 40 bp, Artificial Sequence
  Synthetic
ccggtggaggatcaggaggacctgactgtggagtgtgtac

SEQ ID NO: 8584 - DNA, 48 bp, Artificial Sequence
  Synthetic
atggattgttagacagacgttggtaggtcatatgcatactgtaccata

SEQ ID NO: 8585 - DNA, 41 bp, Artificial Sequence
  Synthetic
agtgttctatggacctgcagactaggaactgcaacaagctc

SEQ ID NO: 8586 - DNA, 48 bp, Artificial Sequence
  Synthetic
gaggaggacagatggaaatatttgcgcaaaaggaaatggattcttaaa

SEQ ID NO: 8587 - DNA, 41 bp, Artificial Sequence
  Synthetic
aggccatagaggtacagctggccatgcctccgtgctatagg

SEQ ID NO: 8588 - DNA, 37 bp, Artificial Sequence
  Synthetic
gtatccccagtcccagccccacaacgcttgggtgggc

SEQ ID NO: 8589 - DNA, 47 bp, Artificial Sequence
  Synthetic
gatagcattgccagggtatatgtcttgaaatgtattggaccatatgt

SEQ ID NO: 8590 - DNA, 42 bp, Artificial Sequence
  Synthetic
cacacctaacacccccacttgcagcaaatacaaaaaaaacac

SEQ ID NO: 8591 - DNA, 42 bp, Artificial Sequence
  Synthetic
gccgtcttggatatcacccccttggctcagtgtatagtgggt

SEQ ID NO: 8592 - DNA, 38 bp, Artificial Sequence
  Synthetic
ttgatgagttacccgccgcctagatgcggaggtggcag

SEQ ID NO: 8593 - DNA, 40 bp, Artificial Sequence
  Synthetic
atgtctatgtcacgcggactaacccacagtgagaagccta

SEQ ID NO: 8594 - DNA, 43 bp, Artificial Sequence
  Synthetic
atcctgattatctgaagatggctgcatttgttccctacgcagc

SEQ ID NO: 8595 - DNA, 40 bp, Artificial Sequence
  Synthetic
atggatccccagttgttagaggctgtaaactggcagacgg

SEQ ID NO: 8596 - DNA, 38 bp, Artificial Sequence
  Synthetic
cttgtgtgtagcccccagttttaagctgggttggcaac

SEQ ID NO: 8597 - DNA, 47 bp, Artificial Sequence
  Synthetic
ccttcaattggcagatctaaaacgaggactcaaagctaatactgaat

SEQ ID NO: 8598 - DNA, 43 bp, Artificial Sequence
  Synthetic
gccagggtgtgtaaggagttccaaatgattctttaaactttgc

SEQ ID NO: 8599 - DNA, 42 bp, Artificial Sequence
  Synthetic
tgcatgttggcagttcatggaactgaaatgtcattaccatct

SEQ ID NO: 8600 - DNA, 46 bp, Artificial Sequence
  Synthetic
agcaaaacaagctataatgatggccttttctctgccaaattcagaa

SEQ ID NO: 8601 - DNA, 41 bp, Artificial Sequence
  Synthetic
gacgagggggaagtcgaaggaccgatatctgcgttttccgt

SEQ ID NO: 8602 - DNA, 38 bp, Artificial Sequence
  Synthetic
tggcatagggacaggcaaagcacttccacctcccaaag

SEQ ID NO: 8603 - DNA, 44 bp, Artificial Sequence
  Synthetic
gtagtggtagtaatactcctgcagtgctgcacttctagtactgc

SEQ ID NO: 8604 - DNA, 47 bp, Artificial Sequence
  Synthetic
aactagaaagaccaaggttctctgatagttcctaatctgctaagcct

SEQ ID NO: 8605 - DNA, 46 bp, Artificial Sequence
  Synthetic
attaccagcaataataacaccaggctcattggaagcaaaatcatct

SEQ ID NO: 8606 - DNA, 44 bp, Artificial Sequence
  Synthetic
gtagtgatcgccttctaacagttgagccttagtcctactgtcag

SEQ ID NO: 8607 - DNA, 47 bp, Artificial Sequence
  Synthetic
tttcagggtagtactgatagcagactactattaaaagctgggtttgt

SEQ ID NO: 8608 - DNA, 44 bp, Artificial Sequence
  Synthetic
gtttacagcacgataggtcctcatcaaaatatcaggccacttac

SEQ ID NO: 8609 - DNA, 45 bp, Artificial Sequence
  Synthetic
gtttactttcctactcctagtggctgtaagggcgatttaggatca

SEQ ID NO: 8610 - DNA, 50 bp, Artificial Sequence
  Synthetic
attgtctcagacatctcttggaaggggttattcctttgtttaacaatcct

SEQ ID NO: 8611 - DNA, 40 bp, Artificial Sequence
  Synthetic
gtgtgttactgactcacagggtcaaaagcagggtggagtg

SEQ ID NO: 8612 - DNA, 45 bp, Artificial Sequence
  Synthetic
ggatactttagagcgccttgtacagggagaattacccctcattct

SEQ ID NO: 8613 - DNA, 45 bp, Artificial Sequence
  Synthetic
tagacgatgatgtggatgaagttgattcacagtcctcagttaact

SEQ ID NO: 8614 - DNA, 39 bp, Artificial Sequence
  Synthetic
gagccgagctctgaaaccaagtaaaagcaagcgacatgc

SEQ ID NO: 8615 - DNA, 48 bp, Artificial Sequence
  Synthetic
agcagactcatttgatctatcacaatctgaatcttctgtaaatccatt

SEQ ID NO: 8616 - DNA, 41 bp, Artificial Sequence
  Synthetic
actgctgcagaagttggaagcatgtaagtcgcgagagaccc

SEQ ID NO: 8617 - DNA, 44 bp, Artificial Sequence
  Synthetic
aaaagggtgtacgtattgctttggacgtcttttattggcttgca

SEQ ID NO: 8618 - DNA, 38 bp, Artificial Sequence
  Synthetic
tgggcttggcattggaacagctacagtgccacctagtg

SEQ ID NO: 8619 - DNA, 39 bp, Artificial Sequence
  Synthetic
tatcagaggtcacaggggttggctatcagcagtaccacc

SEQ ID NO: 8620 - DNA, 48 bp, Artificial Sequence
  Synthetic
actcatgtgggttatacagaagacatcttctaattcaaattcactcct

SEQ ID NO: 8621 - DNA, 47 bp, Artificial Sequence
  Synthetic
atgatttggcagagattggggaggcctatttaaaattcttacatcag

SEQ ID NO: 8622 - DNA, 49 bp, Artificial Sequence
  Synthetic
cctgatggagttctggtagatgaccgttttctttttcgagaatacaaac

SEQ ID NO: 8623 - DNA, 48 bp, Artificial Sequence
  Synthetic
ttaagcacagaccaaaataccgtttctaaataccctgaattgattacc

SEQ ID NO: 8624 - DNA, 47 bp, Artificial Sequence
  Synthetic
atggattaatcagtgaccaaaaggacaattgattttgtttgggatca

SEQ ID NO: 8625 - DNA, 41 bp, Artificial Sequence
  Synthetic
ttgactagcagcgaatcaaacatatttgcaccctgagctct

SEQ ID NO: 8626 - DNA, 44 bp, Artificial Sequence
  Synthetic
tctgcatttttgttaccccaccgatatgttttgaagtgccaaat

SEQ ID NO: 8627 - DNA, 50 bp, Artificial Sequence
  Synthetic
atcactatatgtgtcagcctcattggatgaaaattttagcaatacatccg

SEQ ID NO: 8628 - DNA, 44 bp, Artificial Sequence
  Synthetic
actcagctcccttgataataagagaagcaaagtgtctgcattct

SEQ ID NO: 8629 - DNA, 49 bp, Artificial Sequence
  Synthetic
aatggacatatatcggagttgatgggcttctccatattttattttgacc

SEQ ID NO: 8630 - DNA, 39 bp, Artificial Sequence
  Synthetic
cactgaagagtgcacatgcggtctctacaggcacattct

SEQ ID NO: 8631 - DNA, 40 bp, Artificial Sequence
  Synthetic
ggcatcaaaggaggattcgtcctcgttcgggagtaccatc

SEQ ID NO: 8632 - DNA, 41 bp, Artificial Sequence
  Synthetic
acagccatttactgtttgatgggtatcaacgcctgtgacag

SEQ ID NO: 8633 - DNA, 47 bp, Artificial Sequence
  Synthetic
aacagatatacatgtaaccgcttgctcctgtctgtattctttccaag

SEQ ID NO: 8634 - DNA, 39 bp, Artificial Sequence
  Synthetic
attgacctgcaatgctacgaggcctccaactcttgttca

SEQ ID NO: 8635 - DNA, 41 bp, Artificial Sequence
  Synthetic
gtgtcgtgaagaaattcggaatgtcgctacacccttctttg

SEQ ID NO: 8636 - DNA, 45 bp, Artificial Sequence
  Synthetic
cggagcaagtacaaaagttaaaacggtgggctaagttgttgaact

SEQ ID NO: 8637 - DNA, 45 bp, Artificial Sequence
  Synthetic
acaatgggcctatgatagcgatcactatttgccattttagcataa

SEQ ID NO: 8638 - DNA, 41 bp, Artificial Sequence
  Synthetic
aattagagctcagtgacccagaattgaaacgagcgttgagt

SEQ ID NO: 8639 - DNA, 42 bp, Artificial Sequence
  Synthetic
tggcagtatctgaaaccaaagcggagacttttgcaagctttg

SEQ ID NO: 8640 - DNA, 41 bp, Artificial Sequence
  Synthetic
gttaccttcgctgatgatgctggttgttaatgcggacttca

SEQ ID NO: 8641 - DNA, 37 bp, Artificial Sequence
  Synthetic
caccagcaccacagcaaccactgtggctgtggctgtg

SEQ ID NO: 8642 - DNA, 41 bp, Artificial Sequence
  Synthetic
caacctccagagattccagccctacttctccctcccctccc

SEQ ID NO: 8643 - DNA, 47 bp, Artificial Sequence
  Synthetic
gatcctccagtaatacttttgcgacgcttcttatctctgtatctgta

SEQ ID NO: 8644 - DNA, 42 bp, Artificial Sequence
  Synthetic
tagaggaacctacaccaccaagctacagcttgtgtgatgttg

SEQ ID NO: 8645 - DNA, 41 bp, Artificial Sequence
  Synthetic
gctgtagaagaacctccagacagtaaagagggcggcttaat

SEQ ID NO: 8646 - DNA, 44 bp, Artificial Sequence
  Synthetic
gatgctactattgtccaaggccggcagttcctgaacatttaaat

SEQ ID NO: 8647 - DNA, 48 bp, Artificial Sequence
  Synthetic
atcctgaacgaaggaattatccagagaattattacagttggcaaatcg

SEQ ID NO: 8648 - DNA, 47 bp, Artificial Sequence
  Synthetic
acattcagaggacagacatctactcaaaatatggatgtcctacagtt

SEQ ID NO: 8649 - DNA, 49 bp, Artificial Sequence
  Synthetic
acaacaggacatccattgtttaacatcctgtctatcatctttagaagtt

SEQ ID NO: 8650 - DNA, 42 bp, Artificial Sequence
  Synthetic
attacctgcagcaagtcaacagacggtagggaaatagatgga

SEQ ID NO: 8651 - DNA, 43 bp, Artificial Sequence
  Synthetic
cagaaaaactgtctttggatttggagttgtagcccagcttgaa

SEQ ID NO: 8652 - DNA, 45 bp, Artificial Sequence
  Synthetic
tttcagtgtgattttcaatcggctctccttcttccgtaaaagctc

SEQ ID NO: 8653 - DNA, 47 bp, Artificial Sequence
  Synthetic
tttcctgggaaaataaaagtggtgccttcttgcattgatttcctttc

SEQ ID NO: 8654 - DNA, 46 bp, Artificial Sequence
  Synthetic
gctggtacaacaattctatttctgctgctcattacaaaagccttct

SEQ ID NO: 8655 - DNA, 43 bp, Artificial Sequence
  Synthetic
attgtcaccttatagagttgacagcaccacagaaagcctgact

SEQ ID NO: 8656 - DNA, 41 bp, Artificial Sequence
  Synthetic
tgctcttagtcctcgtttggattttgctgctgattgttctg

SEQ ID NO: 8657 - DNA, 39 bp, Artificial Sequence
  Synthetic
atctgaacagtggacgtttgcaaacagtttctgggtggc

SEQ ID NO: 8658 - DNA, 43 bp, Artificial Sequence
  Synthetic
tgacaatgaacaaattttgccctttcctcttgggtgtcagaaa

SEQ ID NO: 8659 - DNA, 41 bp, Artificial Sequence
  Synthetic
cacaccactgagcctagtttgacaaacacattgacatcagc

SEQ ID NO: 8660 - DNA, 42 bp, Artificial Sequence
  Synthetic
atcccgcctttgatgctgatgtcctccatttgaccttgtgct

SEQ ID NO: 8661 - DNA, 47 bp, Artificial Sequence
  Synthetic
tctcagttcattaccaatgcttcagaaggtccaataggtatagtagg

SEQ ID NO: 8662 - DNA, 44 bp, Artificial Sequence
  Synthetic
atacattcgcctatacaagatggctgtagcaaaattaactgccc

SEQ ID NO: 8663 - DNA, 45 bp, Artificial Sequence
  Synthetic
aggatgtgaatggtgatcacagacctaaatttaagtctggtggtg

SEQ ID NO: 8664 - DNA, 41 bp, Artificial Sequence
  Synthetic
tcaacagaagccacctgcagctgacaaatcaactgtccaaa

SEQ ID NO: 8665 - DNA, 41 bp, Artificial Sequence
  Synthetic
tttcagcaactattggtttccgatgaaaattctcccggcag

SEQ ID NO: 8666 - DNA, 47 bp, Artificial Sequence
  Synthetic
atgcccaagttacagaggattcaggctgttaatatactttcgcttta

SEQ ID NO: 8667 - DNA, 46 bp, Artificial Sequence
  Synthetic
tctaacaatgcggtggttgaaaattttagcaagaataacagctctt

SEQ ID NO: 8668 - DNA, 48 bp, Artificial Sequence
  Synthetic
gaactttcaaagatggtacaatgggtctgctaataatgcatagtgaaa

SEQ ID NO: 8669 - DNA, 43 bp, Artificial Sequence
  Synthetic
cttccgcgacatggtttatcggaacctttcactaagaggacat

SEQ ID NO: 8670 - DNA, 42 bp, Artificial Sequence
  Synthetic
tggtggaggaacagtttctaggcttggttttggaagggattc

SEQ ID NO: 8671 - DNA, 46 bp, Artificial Sequence
  Synthetic
tgagcatcctgcagtaataaatgttggcaaagtttgtacatcaagt

SEQ ID NO: 8672 - DNA, 40 bp, Artificial Sequence
  Synthetic
ttttacagtgagaccgaaagcgtgcatagaagccctttgg

SEQ ID NO: 8673 - DNA, 50 bp, Artificial Sequence
  Synthetic
ttaccagaacaaaatgaaaacagggcctacaataaatatctgagtttgct

SEQ ID NO: 8674 - DNA, 46 bp, Artificial Sequence
  Synthetic
agatgctgtttgtaaatggcctggcaaagaaaaacaattcattacc

SEQ ID NO: 8675 - DNA, 43 bp, Artificial Sequence
  Synthetic
tcgcatataaatgtgatgaacccaggtggaggaacaaaagcta

SEQ ID NO: 8676 - DNA, 44 bp, Artificial Sequence
  Synthetic
ggtcaaattccttttccccaccatgtttggaatgatactgacag

SEQ ID NO: 8677 - DNA, 44 bp, Artificial Sequence
  Synthetic
cgcttttgttgctggctgtcaatcttaaacacattccataaccg

SEQ ID NO: 8678 - DNA, 39 bp, Artificial Sequence
  Synthetic
tagagggcattggagagggtaatagtaggttcctggccc

SEQ ID NO: 8679 - DNA, 43 bp, Artificial Sequence
  Synthetic
gctcgaagaattatcattcgtttgctagtgggatctgccatgg

SEQ ID NO: 8680 - DNA, 43 bp, Artificial Sequence
  Synthetic
gtagtgagctgggtaaagatggcggcccttgtattactctgta

SEQ ID NO: 8681 - DNA, 45 bp, Artificial Sequence
  Synthetic
tggtacagtgggcatatgataatgactaacgccaattctgcatat

SEQ ID NO: 8682 - DNA, 42 bp, Artificial Sequence
  Synthetic
ggcccagcagaaagttccatccgggctcgaggtactagcaac

SEQ ID NO: 8683 - DNA, 46 bp, Artificial Sequence
  Synthetic
aaaaggtcctgcaaatcccctagctagcatatttctgattacatct

SEQ ID NO: 8684 - DNA, 43 bp, Artificial Sequence
  Synthetic
acgcgtattacctgaagggacggtggtcctatagggtctatag

SEQ ID NO: 8685 - DNA, 46 bp, Artificial Sequence
  Synthetic
atatatctcctgcacaaccagcctaatgtgaaccaattgatatggt

SEQ ID NO: 8686 - DNA, 38 bp, Artificial Sequence
  Synthetic
cagtgccacggctaacacaaagttgttggcacctgttg

SEQ ID NO: 8687 - DNA, 41 bp, Artificial Sequence
  Synthetic
accttcattaggggaacattgggaatctcctggctgtttgg

SEQ ID NO: 8688 - DNA, 46 bp, Artificial Sequence
  Synthetic
tacggtgaccaggtatttttctttgtctagcccaaaaatgtctagc

SEQ ID NO: 8689 - DNA, 45 bp, Artificial Sequence
  Synthetic
tcaaactggtttactggagcgttcacagttttctttcttacagta

SEQ ID NO: 8690 - DNA, 41 bp, Artificial Sequence
  Synthetic
atccggacctcatgccagataaaagagtaaagccgtccaaa

SEQ ID NO: 8691 - DNA, 41 bp, Artificial Sequence
  Synthetic
tgactgactcaaacgttcttggaccgttttcgttgcaagta

SEQ ID NO: 8692 - DNA, 40 bp, Artificial Sequence
  Synthetic
gatcgccagaatgcaactgatctcccaattccatcaatca

SEQ ID NO: 8693 - DNA, 42 bp, Artificial Sequence
  Synthetic
tcagttgctcacaaatcttgcccctctttttcgaagtcgtac

SEQ ID NO: 8694 - DNA, 42 bp, Artificial Sequence
  Synthetic
aaaagtatctccgcgggggatgttctcatttgaagcaatttg

SEQ ID NO: 8695 - DNA, 40 bp, Artificial Sequence
  Synthetic
aatacggagggaaggacttcagggttttgcaccttccatc

SEQ ID NO: 8696 - DNA, 44 bp, Artificial Sequence
  Synthetic
aatttgaaaatacaggcgagcgccgatgtttcttgtacctcaca

SEQ ID NO: 8697 - DNA, 41 bp, Artificial Sequence
  Synthetic
gagcaattgaacagctcagaggattgtctagcttgctgtgg

SEQ ID NO: 8698 - DNA, 43 bp, Artificial Sequence
  Synthetic
aaaacgaaagtatttaggcagtccgttttactccttcccggca

SEQ ID NO: 8699 - DNA, 39 bp, Artificial Sequence
  Synthetic
acgccaccacagcaaatacaaacacagctttgcctgtac

SEQ ID NO: 8700 - DNA, 45 bp, Artificial Sequence
  Synthetic
aacagatgacagtgacattgcactgtgcattactatctacatctg

SEQ ID NO: 8701 - DNA, 41 bp, Artificial Sequence
  Synthetic
ttttacgaggcacaccaaaacaactttcctgtgtttggtgg

SEQ ID NO: 8702 - DNA, 41 bp, Artificial Sequence
  Synthetic
attgtcccgactctgtgtctagcgacaacagtttcaacagg

SEQ ID NO: 8703 - DNA, 40 bp, Artificial Sequence
  Synthetic
tttgtgtgcctgtgtgtctgaacaggtagaaaacaacgag

SEQ ID NO: 8704 - DNA, 39 bp, Artificial Sequence
  Synthetic
gtgtactatggtcgcccaccacgtttgatacagctgagt

SEQ ID NO: 8705 - DNA, 45 bp, Artificial Sequence
  Synthetic
tccacaaactggggaggtatctcataactatgtacaccagatgtg

SEQ ID NO: 8706 - DNA, 42 bp, Artificial Sequence
  Synthetic
ttgtggctttacacagacctgccaagcctactaaaacgcaca

SEQ ID NO: 8707 - DNA, 43 bp, Artificial Sequence
  Synthetic
aacatgttccctattttcttgcagaggtgtaggaggcaggtaa

SEQ ID NO: 8708 - DNA, 41 bp, Artificial Sequence
  Synthetic
ttcccaaggtgtctgcatttcaacttattgggatcgggcaa

SEQ ID NO: 8709 - DNA, 48 bp, Artificial Sequence
  Synthetic
catgactatatctgcaaccacacaaacatactgtttaatttggcttga

SEQ ID NO: 8710 - DNA, 43 bp, Artificial Sequence
  Synthetic
aaaagccttgctataacctgtcaattagctagtgggtcctctt

SEQ ID NO: 8711 - DNA, 45 bp, Artificial Sequence
  Synthetic
cggcggtgattgtttgtgtccatacaaaaacatacattcatgcac

SEQ ID NO: 8712 - DNA, 41 bp, Artificial Sequence
  Synthetic
tggttgttgcacaccactgtgcataaaatggacactactgt

SEQ ID NO: 8713 - DNA, 43 bp, Artificial Sequence
  Synthetic
tgcaaacatctgcaacacaatgaagacacatagttggctacca

SEQ ID NO: 8714 - DNA, 42 bp, Artificial Sequence
  Synthetic
aacggccatacaagctaccaacagtccaattctatttcatgt

SEQ ID NO: 8715 - DNA, 44 bp, Artificial Sequence
  Synthetic
ctcagaggatgaggatgaaacagacattctgtaccaggcttgct

SEQ ID NO: 8716 - DNA, 39 bp, Artificial Sequence
  Synthetic
ggaggtgttcgggatggtttattgcatcccctgttttcc

SEQ ID NO: 8717 - DNA, 48 bp, Artificial Sequence
  Synthetic
aatggtacagtgggcatttgataatcctcagatgctaataatgcatat

SEQ ID NO: 8718 - DNA, 49 bp, Artificial Sequence
  Synthetic
aatgcattagatggcaatcctatgtgatgttattagtaatggaggacat

SEQ ID NO: 8719 - DNA, 42 bp, Artificial Sequence
  Synthetic
acaaagacgtggtcaaaactagattgcacagtgtctccatca

SEQ ID NO: 8720 - DNA, 47 bp, Artificial Sequence
  Synthetic
tccaaagggcataatgcaattgaattctgtgttatagcttgattcat

SEQ ID NO: 8721 - DNA, 44 bp, Artificial Sequence
  Synthetic
atggtagcattggggtattttttggcacatatcctgtacgaccc

SEQ ID NO: 8722 - DNA, 45 bp, Artificial Sequence
  Synthetic
aacaacatctgtggacagtacaccagatacttgtgtagtgtcact

SEQ ID NO: 8723 - DNA, 45 bp, Artificial Sequence
  Synthetic
gctagaaaaactggcatacgtgtcacttctagtaaacatagtggc

SEQ ID NO: 8724 - DNA, 47 bp, Artificial Sequence
  Synthetic
gacctactgaggcaaaggtataccgttacatactcttcagtgcttac

SEQ ID NO: 8725 - DNA, 41 bp, Artificial Sequence
  Synthetic
gcacaccatgtggtacccaagtggtgttctttaattcaagc

SEQ ID NO: 8726 - DNA, 41 bp, Artificial Sequence
  Synthetic
aggtactgtaggcgatgctattccacaactggatggcgatg

SEQ ID NO: 8727 - DNA, 41 bp, Artificial Sequence
  Synthetic
aacatgttttggtctgtttgtgcaatccaagttgcctgcag

SEQ ID NO: 8728 - DNA, 42 bp, Artificial Sequence
  Synthetic
aagaacgttactgttacacatgccatcgcagagcttcccatt

SEQ ID NO: 8729 - DNA, 41 bp, Artificial Sequence
  Synthetic
gttacccaggggatttcaacgaaatggtttgttctgctcaa

SEQ ID NO: 8730 - DNA, 40 bp, Artificial Sequence
  Synthetic
gatgcggcagagcagacaaatgatgttccaacggaaatgt

SEQ ID NO: 8731 - DNA, 46 bp, Artificial Sequence
  Synthetic
agtgaattggaatatggtaactgcatggcatactagagtttatcgc

SEQ ID NO: 8732 - DNA, 43 bp, Artificial Sequence
  Synthetic
ggtaccaccatagcaatgagcagtgactccatctattgccttt

SEQ ID NO: 8733 - DNA, 45 bp, Artificial Sequence
  Synthetic
ttcatgactcaaatgtcaagaacctcctttgcattatccctaagc

SEQ ID NO: 8734 - DNA, 46 bp, Artificial Sequence
  Synthetic
actgtcaatttattcaacagtggcgaaagatagaccagctaccatg

SEQ ID NO: 8735 - DNA, 39 bp, Artificial Sequence
  Synthetic
gagaacgccagaatgccactcgtccaattccaccaatca

SEQ ID NO: 8736 - DNA, 42 bp, Artificial Sequence
  Synthetic
taaacggaaagtggatgagagaacccattattagcttggcgc

SEQ ID NO: 8737 - DNA, 44 bp, Artificial Sequence
  Synthetic
ggtcaggatgatcaaacgtggaattcttgtttttcgtccattct

SEQ ID NO: 8738 - DNA, 45 bp, Artificial Sequence
  Synthetic
ggaagctttccactagaggagttcacttgattccatagtctccat

SEQ ID NO: 8739 - DNA, 38 bp, Artificial Sequence
  Synthetic
cagcaggacgagcaagctttaggttttgtgacactgcc

SEQ ID NO: 8740 - DNA, 40 bp, Artificial Sequence
  Synthetic
agttgcgtgtatcgtcccaacctagtccactgtcctcaaa

SEQ ID NO: 8741 - DNA, 48 bp, Artificial Sequence
  Synthetic
ttcagttttatgctgcaaaatgtcggtacatgcaatacattacacaat

SEQ ID NO: 8742 - DNA, 49 bp, Artificial Sequence
  Synthetic
agggctaatagatgatgcaacatttagtccattcctcatatatacatcc

SEQ ID NO: 8743 - DNA, 38 bp, Artificial Sequence
  Synthetic
accgtttcgatgctgtgcaacatctatgtctgtgcggc

SEQ ID NO: 8744 - DNA, 43 bp, Artificial Sequence
  Synthetic
acgttatggaccgctatttattaccctgcagatacctgtccac

SEQ ID NO: 8745 - DNA, 43 bp, Artificial Sequence
  Synthetic
aagacgaggctagggatccggtttcattctatacctccaacat

SEQ ID NO: 8746 - DNA, 44 bp, Artificial Sequence
  Synthetic
gctggtgctgaggtgtttgttgtctaaaggtatagattcaccta

SEQ ID NO: 8747 - DNA, 41 bp, Artificial Sequence
  Synthetic
gcatctgctaacattaatggcaggggccaacaagtgtatga

SEQ ID NO: 8748 - DNA, 45 bp, Artificial Sequence
  Synthetic
atttgcatccaagtcacagacgctgcaaaacattaaaaaccagac

SEQ ID NO: 8749 - DNA, 40 bp, Artificial Sequence
  Synthetic
caccccttgtaaaggtgaacacgacaggtgcctttaggag

SEQ ID NO: 8750 - DNA, 47 bp, Artificial Sequence
  Synthetic
gtccttagcatctagtgactccccataatacagcattattagcaccc

SEQ ID NO: 8751 - DNA, 43 bp, Artificial Sequence
  Synthetic
ttttgggtggttgatttatcagacaaaaagcgcctaccaagag

SEQ ID NO: 8752 - DNA, 43 bp, Artificial Sequence
  Synthetic
gtattactcatgtgttttgcaacgtactgtaaaagcaccgctc

SEQ ID NO: 8753 - DNA, 20 bp, Artificial Sequence
  Synthetic
atctttgtcacccgatttgg

SEQ ID NO: 8754 - DNA, 25 bp, Artificial Sequence
  Synthetic
tgcagtagctttatacttttttcag

SEQ ID NO: 8755 - DNA, 23 bp, Artificial Sequence
  Synthetic
taattagatttttgaagggcagt

SEQ ID NO: 8756 - DNA, 25 bp, Artificial Sequence
  Synthetic
gactattgaatctttatgaaagtgg

SEQ ID NO: 8757 - DNA, 20 bp, Artificial Sequence
  Synthetic
atacctagctcacacaggcc

SEQ ID NO: 8758 - DNA, 19 bp, Artificial Sequence
  Synthetic
aggagaaccaacgtccacc

SEQ ID NO: 8759 - DNA, 19 bp, Artificial Sequence
  Synthetic
caactgtgtttagatgggc

SEQ ID NO: 8760 - DNA, 24 bp, Artificial Sequence
  Synthetic
atacactttatacaacccgtgtag

SEQ ID NO: 8761 - DNA, 21 bp, Artificial Sequence
  Synthetic
cgcgcaattttatttggctat

SEQ ID NO: 8762 - DNA, 25 bp, Artificial Sequence
  Synthetic
ctgcacatttttattatgatgtgtc

SEQ ID NO: 8763 - DNA, 19 bp, Artificial Sequence
  Synthetic
cctgaaaaggaacgtttgg

SEQ ID NO: 8764 - DNA, 23 bp, Artificial Sequence
  Synthetic
tattccagacatatgttagccag

SEQ ID NO: 8765 - DNA, 25 bp, Artificial Sequence
  Synthetic
cagataccttttatctaaagcaact

SEQ ID NO: 8766 - DNA, 22 bp, Artificial Sequence
  Synthetic
ctatgtgagcaataatctgact

SEQ ID NO: 8767 - DNA, 22 bp, Artificial Sequence
  Synthetic
ggattgtgcagaaaaaattgac

SEQ ID NO: 8768 - DNA, 21 bp, Artificial Sequence
  Synthetic
cagagcaagtgttagattcac

SEQ ID NO: 8769 - DNA, 25 bp, Artificial Sequence
  Synthetic
catatctaacctaatagatgatgga

SEQ ID NO: 8770 - DNA, 22 bp, Artificial Sequence
  Synthetic
gcatagtagattacagtgcttt

SEQ ID NO: 8771 - DNA, 20 bp, Artificial Sequence
  Synthetic
actacaagggactcctccac

SEQ ID NO: 8772 - DNA, 19 bp, Artificial Sequence
  Synthetic
agaggaggaagggaattgg

SEQ ID NO: 8773 - DNA, 25 bp, Artificial Sequence
  Synthetic
gttaagtagtgtgatatatcttggt

SEQ ID NO: 8774 - DNA, 25 bp, Artificial Sequence
  Synthetic
ggtcctatagaaactccttctatag

SEQ ID NO: 8775 - DNA, 25 bp, Artificial Sequence
  Synthetic
cttcagatatcaatgtttttgtgga

SEQ ID NO: 8776 - DNA, 19 bp, Artificial Sequence
  Synthetic
gatttgaaaatcccgcctt

SEQ ID NO: 8777 - DNA, 23 bp, Artificial Sequence
  Synthetic
gtatcttacccacaacaaaatgt

SEQ ID NO: 8778 - DNA, 23 bp, Artificial Sequence
  Synthetic
acggatgaatatgttaaaggaac

SEQ ID NO: 8779 - DNA, 24 bp, Artificial Sequence
  Synthetic
ctggacatcctttgtataacaaac

SEQ ID NO: 8780 - DNA, 20 bp, Artificial Sequence
  Synthetic
ccatttgaaccaacatctga

SEQ ID NO: 8781 - DNA, 18 bp, Artificial Sequence
  Synthetic
cccttacggggcgacact

SEQ ID NO: 8782 - DNA, 19 bp, Artificial Sequence
  Synthetic
tgcaccatgagcacgaatc

SEQ ID NO: 8783 - DNA, 15 bp, Artificial Sequence
  Synthetic
gcaccgctcgcgaaa

SEQ ID NO: 8784 - DNA, 18 bp, Artificial Sequence
  Synthetic
tcaccaatgactgcccca

SEQ ID NO: 8785 - DNA, 17 bp, Artificial Sequence
  Synthetic
ttcgatctacccgggcc

SEQ ID NO: 8786 - DNA, 18 bp, Artificial Sequence
  Synthetic
acatcaaccggaccgctt

SEQ ID NO: 8787 - DNA, 18 bp, Artificial Sequence
  Synthetic
cgcaaggcagttggtttg

SEQ ID NO: 8788 - DNA, 19 bp, Artificial Sequence
  Synthetic
acataggctcgatgcagcg

SEQ ID NO: 8789 - DNA, 18 bp, Artificial Sequence
  Synthetic
gatctgcgcctgcctttg

SEQ ID NO: 8790 - DNA, 20 bp, Artificial Sequence
  Synthetic
ttagttaccttgggaccgca

SEQ ID NO: 8791 - DNA, 17 bp, Artificial Sequence
  Synthetic
gccgcgctgctcactat

SEQ ID NO: 8792 - DNA, 17 bp, Artificial Sequence
  Synthetic
gacccgcggtctcatct

SEQ ID NO: 8793 - DNA, 20 bp, Artificial Sequence
  Synthetic
tcttaggaggaagggtgacg

SEQ ID NO: 8794 - DNA, 18 bp, Artificial Sequence
  Synthetic
gccagggctacaaagtgc

SEQ ID NO: 8795 - DNA, 18 bp, Artificial Sequence
  Synthetic
ccaccccaacatcgagga

SEQ ID NO: 8796 - DNA, 18 bp, Artificial Sequence
  Synthetic
gtggcggttacccagact

SEQ ID NO: 8797 - DNA, 18 bp, Artificial Sequence
  Synthetic
cgtggccgcatattgcat

SEQ ID NO: 8798 - DNA, 20 bp, Artificial Sequence
  Synthetic
tacctagctgggctatccac

SEQ ID NO: 8799 - DNA, 19 bp, Artificial Sequence
  Synthetic
ggtccctagcacagaggat

SEQ ID NO: 8800 - DNA, 18 bp, Artificial Sequence
  Synthetic
gaggtgtgggactgggtt

SEQ ID NO: 8801 - DNA, 19 bp, Artificial Sequence
  Synthetic
cggagtacgtcgagatcct

SEQ ID NO: 8802 - DNA, 20 bp, Artificial Sequence
  Synthetic
gtggagaattggaaggaccc

SEQ ID NO: 8803 - DNA, 20 bp, Artificial Sequence
  Synthetic
tctcagtagaggaagctgct

SEQ ID NO: 8804 - DNA, 19 bp, Artificial Sequence
  Synthetic
gtccaaacggactcccatg

SEQ ID NO: 8805 - DNA, 20 bp, Artificial Sequence
  Synthetic
tgacgtgctacatcaaagcc

SEQ ID NO: 8806 - DNA, 16 bp, Artificial Sequence
  Synthetic
gggcagggctcgcata

SEQ ID NO: 8807 - DNA, 21 bp, Artificial Sequence
  Synthetic
tggcacatgaaatactgattg

SEQ ID NO: 8808 - DNA, 19 bp, Artificial Sequence
  Synthetic
gcgacatgctgaataaagc

SEQ ID NO: 8809 - DNA, 20 bp, Artificial Sequence
  Synthetic
atacaggcagcaatttcaac

SEQ ID NO: 8810 - DNA, 20 bp, Artificial Sequence
  Synthetic
aattggattgtgttctggag

SEQ ID NO: 8811 - DNA, 25 bp, Artificial Sequence
  Synthetic
tcagaggatttgtattagtagttga

SEQ ID NO: 8812 - DNA, 25 bp, Artificial Sequence
  Synthetic
ggatttgtatctaattttgcaatgg

SEQ ID NO: 8813 - DNA, 22 bp, Artificial Sequence
  Synthetic
gctatgggaaaacactaaagga

SEQ ID NO: 8814 - DNA, 21 bp, Artificial Sequence
  Synthetic
ggaactcatagttggagaacc

SEQ ID NO: 8815 - DNA, 21 bp, Artificial Sequence
  Synthetic
caggggttataccatagacaa

SEQ ID NO: 8816 - DNA, 18 bp, Artificial Sequence
  Synthetic
ggatggctccttggaaat

SEQ ID NO: 8817 - DNA, 22 bp, Artificial Sequence
  Synthetic
gtaaaccatcattcttcaggaa

SEQ ID NO: 8818 - DNA, 21 bp, Artificial Sequence
  Synthetic
gaatggaattctcttggaccc

SEQ ID NO: 8819 - DNA, 21 bp, Artificial Sequence
  Synthetic
atcggagaaattggtcttagc

SEQ ID NO: 8820 - DNA, 25 bp, Artificial Sequence
  Synthetic
aaacttgacagaagataaaaatggg

SEQ ID NO: 8821 - DNA, 20 bp, Artificial Sequence
  Synthetic
catagttcaaatggagcctg

SEQ ID NO: 8822 - DNA, 23 bp, Artificial Sequence
  Synthetic
tatagcggcattagtaataacca

SEQ ID NO: 8823 - DNA, 25 bp, Artificial Sequence
  Synthetic
ttctaccatatattgaacaacccaa

SEQ ID NO: 8824 - DNA, 25 bp, Artificial Sequence
  Synthetic
ttaagtgaaatactaggaatgcttc

SEQ ID NO: 8825 - DNA, 25 bp, Artificial Sequence
  Synthetic
tgatagtgacaatgatctatcactt

SEQ ID NO: 8826 - DNA, 18 bp, Artificial Sequence
  Synthetic
ggtgcccatgttccaatc

SEQ ID NO: 8827 - DNA, 25 bp, Artificial Sequence
  Synthetic
catcagtgtcagaaataaagatctg

SEQ ID NO: 8828 - DNA, 21 bp, Artificial Sequence
  Synthetic
ccatcataatcaccaaccctc

SEQ ID NO: 8829 - DNA, 23 bp, Artificial Sequence
  Synthetic
ttaagactaacaataacgttggg

SEQ ID NO: 8830 - DNA, 22 bp, Artificial Sequence
  Synthetic
caacaacaaccaaaatacaacc

SEQ ID NO: 8831 - DNA, 20 bp, Artificial Sequence
  Synthetic
tcaacaccaccaaaacaaac

SEQ ID NO: 8832 - DNA, 22 bp, Artificial Sequence
  Synthetic
cgtattattgcaaaaagccatg

SEQ ID NO: 8833 - DNA, 20 bp, Artificial Sequence
  Synthetic
ctgtatctaaggtcctgcac

SEQ ID NO: 8834 - DNA, 22 bp, Artificial Sequence
  Synthetic
ctatgtacaaccaacacaaagg

SEQ ID NO: 8835 - DNA, 22 bp, Artificial Sequence
  Synthetic
tgttatcattaattgccgttgg

SEQ ID NO: 8836 - DNA, 24 bp, Artificial Sequence
  Synthetic
taagtctatggataaaagcatcga

SEQ ID NO: 8837 - DNA, 25 bp, Artificial Sequence
  Synthetic
gaatgtgatttatacaactgtgtag

SEQ ID NO: 8838 - DNA, 23 bp, Artificial Sequence
  Synthetic
tctgagagacaagctaaaattac

SEQ ID NO: 8839 - DNA, 25 bp, Artificial Sequence
  Synthetic
ggtgtatgcatctatagataacaag

SEQ ID NO: 8840 - DNA, 18 bp, Artificial Sequence
  Synthetic
ggcgacactccaccatga

SEQ ID NO: 8841 - DNA, 19 bp, Artificial Sequence
  Synthetic
tgcaccatgagcacgaatc

SEQ ID NO: 8842 - DNA, 19 bp, Artificial Sequence
  Synthetic
cgtaggtcgcgcaatttgg

SEQ ID NO: 8843 - DNA, 20 bp, Artificial Sequence
  Synthetic
cgagtattgtgtacgaggcg

SEQ ID NO: 8844 - DNA, 19 bp, Artificial Sequence
  Synthetic
ataacgggtcatcgcatgg

SEQ ID NO: 8845 - DNA, 18 bp, Artificial Sequence
  Synthetic
gctggttagcagggctct

SEQ ID NO: 8846 - DNA, 18 bp, Artificial Sequence
  Synthetic
tacctacagctggggtgc

SEQ ID NO: 8847 - DNA, 18 bp, Artificial Sequence
  Synthetic
gtacgtgggaggggtcga

SEQ ID NO: 8848 - DNA, 20 bp, Artificial Sequence
  Synthetic
actcatatcccaagcggagg

SEQ ID NO: 8849 - DNA, 19 bp, Artificial Sequence
  Synthetic
cgcgatgccgtcatcttac

SEQ ID NO: 8850 - DNA, 20 bp, Artificial Sequence
  Synthetic
aaccatctcacccctcttcg

SEQ ID NO: 8851 - DNA, 19 bp, Artificial Sequence
  Synthetic
ggtgaggtccagatcgtgt

SEQ ID NO: 8852 - DNA, 16 bp, Artificial Sequence
  Synthetic
gggggtccgctgttgt

SEQ ID NO: 8853 - DNA, 18 bp, Artificial Sequence
  Synthetic
aaggcccatggggttgat

SEQ ID NO: 8854 - DNA, 18 bp, Artificial Sequence
  Synthetic
caaggctatccccctcga

SEQ ID NO: 8855 - DNA, 18 bp, Artificial Sequence
  Synthetic
tctccaggactcaacgcc

SEQ ID NO: 8856 - DNA, 16 bp, Artificial Sequence
  Synthetic
caagccaccgtgtgcg

SEQ ID NO: 8857 - DNA, 20 bp, Artificial Sequence
  Synthetic
tgacagggaggttctctacc

SEQ ID NO: 8858 - DNA, 19 bp, Artificial Sequence
  Synthetic
actggccaaaccctcctct

SEQ ID NO: 8859 - DNA, 16 bp, Artificial Sequence
  Synthetic
cgagggggcagtgcaa

SEQ ID NO: 8860 - DNA, 18 bp, Artificial Sequence
  Synthetic
tataggggggtctggcga

SEQ ID NO: 8861 - DNA, 20 bp, Artificial Sequence
  Synthetic
ttcacagaattggacggggt

SEQ ID NO: 8862 - DNA, 19 bp, Artificial Sequence
  Synthetic
aggctaacctcctgtggag

SEQ ID NO: 8863 - DNA, 20 bp, Artificial Sequence
  Synthetic
gtggtcctcaccgaatcaac

SEQ ID NO: 8864 - DNA, 20 bp, Artificial Sequence
  Synthetic
aaaaactgcccatcaacgca

SEQ ID NO: 8865 - DNA, 20 bp, Artificial Sequence
  Synthetic
gacactaccatcatggccaa

SEQ ID NO: 8866 - DNA, 19 bp, Artificial Sequence
  Synthetic
gacatccgtacggaggagg

SEQ ID NO: 8867 - DNA, 18 bp, Artificial Sequence
  Synthetic
gaccccccacaaccagaa

SEQ ID NO: 8868 - DNA, 20 bp, Artificial Sequence
  Synthetic
gcctgctactccatagaacc

SEQ ID NO: 8869 - DNA, 22 bp, Artificial Sequence
  Synthetic
aggtactgatccaaaatggaag

SEQ ID NO: 8870 - DNA, 21 bp, Artificial Sequence
  Synthetic
ttgaaataatcgaagggaggg

SEQ ID NO: 8871 - DNA, 21 bp, Artificial Sequence
  Synthetic
atgaaaaaggcataaacccca

SEQ ID NO: 8872 - DNA, 19 bp, Artificial Sequence
  Synthetic
gaattcaacaaggcatgcg

SEQ ID NO: 8873 - DNA, 21 bp, Artificial Sequence
  Synthetic
aaggaagacggaaaactaacc

SEQ ID NO: 8874 - DNA, 18 bp, Artificial Sequence
  Synthetic
gcatggaaatgaggcgat

SEQ ID NO: 8875 - DNA, 21 bp, Artificial Sequence
  Synthetic
gcgatacctaactgacatgac

SEQ ID NO: 8876 - DNA, 20 bp, Artificial Sequence
  Synthetic
ttgaggatgtcaaaaatgca

SEQ ID NO: 8877 - DNA, 25 bp, Artificial Sequence
  Synthetic
catgatttataaaataagggaggga

SEQ ID NO: 8878 - DNA, 19 bp, Artificial Sequence
  Synthetic
tacattgctggaagccata

SEQ ID NO: 8879 - DNA, 18 bp, Artificial Sequence
  Synthetic
acctgtgcttcacgacta

SEQ ID NO: 8880 - DNA, 20 bp, Artificial Sequence
  Synthetic
agatgtagaggcagtgcaac

SEQ ID NO: 8881 - DNA, 22 bp, Artificial Sequence
  Synthetic
ccaaaatagctatgctagacga

SEQ ID NO: 8882 - DNA, 25 bp, Artificial Sequence
  Synthetic
ggaaatcattctttaaaaggtcatg

SEQ ID NO: 8883 - DNA, 18 bp, Artificial Sequence
  Synthetic
cacttgctgtgtcaaagg

SEQ ID NO: 8884 - DNA, 18 bp, Artificial Sequence
  Synthetic
atggggagggatggacta

SEQ ID NO: 8885 - DNA, 18 bp, Artificial Sequence
  Synthetic
cgttacagcaagtgcctg

SEQ ID NO: 8886 - DNA, 18 bp, Artificial Sequence
  Synthetic
taactgcctcatcgccat

SEQ ID NO: 8887 - DNA, 25 bp, Artificial Sequence
  Synthetic
gtgatatggtagatataggatttgg

SEQ ID NO: 8888 - DNA, 23 bp, Artificial Sequence
  Synthetic
cttgacagttctatttatgctgc

SEQ ID NO: 8889 - DNA, 23 bp, Artificial Sequence
  Synthetic
ttatgtaccataacccttacagc

SEQ ID NO: 8890 - DNA, 19 bp, Artificial Sequence
  Synthetic
ggctcgcatctctccttca

SEQ ID NO: 8891 - DNA, 17 bp, Artificial Sequence
  Synthetic
cgactgactgccggctt

SEQ ID NO: 8892 - DNA, 20 bp, Artificial Sequence
  Synthetic
agaaacaccggtctggatct

SEQ ID NO: 8893 - DNA, 20 bp, Artificial Sequence
  Synthetic
aagcaagaagtctcccaagc

SEQ ID NO: 8894 - DNA, 20 bp, Artificial Sequence
  Synthetic
tgtccaagccaacaatccac

SEQ ID NO: 8895 - DNA, 20 bp, Artificial Sequence
  Synthetic
ctaggagatatgttgcgggc

SEQ ID NO: 8896 - DNA, 20 bp, Artificial Sequence
  Synthetic
taccaaaaacaactgggcca

SEQ ID NO: 8897 - DNA, 18 bp, Artificial Sequence
  Synthetic
gcaacacttggtccggaa

SEQ ID NO: 8898 - DNA, 20 bp, Artificial Sequence
  Synthetic
cccacagcagtgtaactacg

SEQ ID NO: 8899 - DNA, 20 bp, Artificial Sequence
  Synthetic
tatgatgcagtccccaaggt

SEQ ID NO: 8900 - DNA, 20 bp, Artificial Sequence
  Synthetic
aggggctattatgctgaccc

SEQ ID NO: 8901 - DNA, 20 bp, Artificial Sequence
  Synthetic
cattaccttcggacccttgc

SEQ ID NO: 8902 - DNA, 20 bp, Artificial Sequence
  Synthetic
gctatttcctctttgctcca

SEQ ID NO: 8903 - DNA, 20 bp, Artificial Sequence
  Synthetic
tcctggtcttaatagccgcc

SEQ ID NO: 8904 - DNA, 18 bp, Artificial Sequence
  Synthetic
cttccagttctgccccct

SEQ ID NO: 8905 - DNA, 19 bp, Artificial Sequence
  Synthetic
gcggaggctattattcagc

SEQ ID NO: 8906 - DNA, 20 bp, Artificial Sequence
  Synthetic
agctatagtctcctccccct

SEQ ID NO: 8907 - DNA, 18 bp, Artificial Sequence
  Synthetic
cgcgtcagatacccccat

SEQ ID NO: 8908 - DNA, 16 bp, Artificial Sequence
  Synthetic
gcgaagtcagcggcct

SEQ ID NO: 8909 - DNA, 20 bp, Artificial Sequence
  Synthetic
agcacagtttcctcctcctc

SEQ ID NO: 8910 - DNA, 18 bp, Artificial Sequence
  Synthetic
ctactggccacctgtcca

SEQ ID NO: 8911 - DNA, 18 bp, Artificial Sequence
  Synthetic
cttccgttccactcaacc

SEQ ID NO: 8912 - DNA, 18 bp, Artificial Sequence
  Synthetic
gaaggtcagggcccagaa

SEQ ID NO: 8913 - DNA, 18 bp, Artificial Sequence
  Synthetic
catggcacgcatacggct

SEQ ID NO: 8914 - DNA, 25 bp, Artificial Sequence
  Synthetic
tatggaaagaataaaagaactacgg

SEQ ID NO: 8915 - DNA, 20 bp, Artificial Sequence
  Synthetic
gagtaaaatgagtgatgccg

SEQ ID NO: 8916 - DNA, 23 bp, Artificial Sequence
  Synthetic
gtaatcatggaagttgttttccc

SEQ ID NO: 8917 - DNA, 23 bp, Artificial Sequence
  Synthetic
aagtgaggaatgatgatgttgat

SEQ ID NO: 8918 - DNA, 20 bp, Artificial Sequence
  Synthetic
gcgggttcacatttaagaga

SEQ ID NO: 8919 - DNA, 22 bp, Artificial Sequence
  Synthetic
gcatgataaaagcagttagagg

SEQ ID NO: 8920 - DNA, 19 bp, Artificial Sequence
  Synthetic
gagagggtagtggtaagca

SEQ ID NO: 8921 - DNA, 20 bp, Artificial Sequence
  Synthetic
tggaatttgagccatttcag

SEQ ID NO: 8922 - DNA, 21 bp, Artificial Sequence
  Synthetic
caacaagaccactaagagact

SEQ ID NO: 8923 - DNA, 19 bp, Artificial Sequence
  Synthetic
cgttacctaaccgacatga

SEQ ID NO: 8924 - DNA, 21 bp, Artificial Sequence
  Synthetic
gaaatttcaccattgccttct

SEQ ID NO: 8925 - DNA, 24 bp, Artificial Sequence
  Synthetic
ccgactctacttttcctaaaaatt

SEQ ID NO: 8926 - DNA, 19 bp, Artificial Sequence
  Synthetic
cagactgtgttctagaggc

SEQ ID NO: 8927 - DNA, 22 bp, Artificial Sequence
  Synthetic
gataacaacccactttcaaaga

SEQ ID NO: 8928 - DNA, 25 bp, Artificial Sequence
  Synthetic
tcgtatactttgttgaaactttagc

SEQ ID NO: 8929 - DNA, 18 bp, Artificial Sequence
  Synthetic
aaacatcctgagcatggc

SEQ ID NO: 8930 - DNA, 22 bp, Artificial Sequence
  Synthetic
agtctcgatactgaatcttgga

SEQ ID NO: 8931 - DNA, 18 bp, Artificial Sequence
  Synthetic
ctacccagctttggagtg

SEQ ID NO: 8932 - DNA, 16 bp, Artificial Sequence
  Synthetic
gcgacttcgacgccga

SEQ ID NO: 8933 - DNA, 16 bp, Artificial Sequence
  Synthetic
ggcgtcagcacctggt

SEQ ID NO: 8934 - DNA, 16 bp, Artificial Sequence
  Synthetic
catgctacggctcggc

SEQ ID NO: 8935 - DNA, 20 bp, Artificial Sequence
  Synthetic
cccaaggataaacgtccctg

SEQ ID NO: 8936 - DNA, 19 bp, Artificial Sequence
  Synthetic
cccaggaccagcctacgag

SEQ ID NO: 8937 - DNA, 21 bp, Artificial Sequence
  Synthetic
acactacgtcttatacagctt

SEQ ID NO: 8938 - DNA, 18 bp, Artificial Sequence
  Synthetic
cgacgtccctgattccct

SEQ ID NO: 8939 - DNA, 18 bp, Artificial Sequence
  Synthetic
tcgaggaggacgagtggc

SEQ ID NO: 8940 - DNA, 18 bp, Artificial Sequence
  Synthetic
cccctccggatccaccat

SEQ ID NO: 8941 - DNA, 18 bp, Artificial Sequence
  Synthetic
ttacacaacgacgccagc

SEQ ID NO: 8942 - DNA, 16 bp, Artificial Sequence
  Synthetic
ccgacgtgcacgacct

SEQ ID NO: 8943 - DNA, 16 bp, Artificial Sequence
  Synthetic
tgcgaggaggacgagc

SEQ ID NO: 8944 - DNA, 18 bp, Artificial Sequence
  Synthetic
cctgacctccctctgcca

SEQ ID NO: 8945 - DNA, 19 bp, Artificial Sequence
  Synthetic
tgagtccttgagtgacggt

SEQ ID NO: 8946 - DNA, 16 bp, Artificial Sequence
  Synthetic
cgcagcaagtgaccgc

SEQ ID NO: 8947 - DNA, 19 bp, Artificial Sequence
  Synthetic
gcttaaccaacgacgaggt

SEQ ID NO: 8948 - DNA, 18 bp, Artificial Sequence
  Synthetic
tgtcctcggtgaagcgaa

SEQ ID NO: 8949 - DNA, 18 bp, Artificial Sequence
  Synthetic
gatgagttcgcgctcctc

SEQ ID NO: 8950 - DNA, 19 bp, Artificial Sequence
  Synthetic
attctccccctccgtctcg

SEQ ID NO: 8951 - DNA, 18 bp, Artificial Sequence
  Synthetic
agttcggcttcttgctcg

SEQ ID NO: 8952 - DNA, 17 bp, Artificial Sequence
  Synthetic
actatcgtctgccggcg

SEQ ID NO: 8953 - DNA, 16 bp, Artificial Sequence
  Synthetic
gtgctgcaaccgctca

SEQ ID NO: 8954 - DNA, 17 bp, Artificial Sequence
  Synthetic
tccttctgtcaccgcgt

SEQ ID NO: 8955 - DNA, 16 bp, Artificial Sequence
  Synthetic
gggctggccttggtca

SEQ ID NO: 8956 - DNA, 18 bp, Artificial Sequence
  Synthetic
caaaggcgatgggttccg

SEQ ID NO: 8957 - DNA, 17 bp, Artificial Sequence
  Synthetic
ctgcagacggctgtgtc

SEQ ID NO: 8958 - DNA, 19 bp, Artificial Sequence
  Synthetic
ctgctcgagatgttgaccc

SEQ ID NO: 8959 - DNA, 16 bp, Artificial Sequence
  Synthetic
gcaacagccgcgacgt

SEQ ID NO: 8960 - DNA, 17 bp, Artificial Sequence
  Synthetic
gcgaacaccctccacgt

SEQ ID NO: 8961 - DNA, 18 bp, Artificial Sequence
  Synthetic
ccgacaggctctccacgt

SEQ ID NO: 8962 - DNA, 20 bp, Artificial Sequence
  Synthetic
ggaattttcccttcgcggat

SEQ ID NO: 8963 - DNA, 16 bp, Artificial Sequence
  Synthetic
acgtgggagcgcacct

SEQ ID NO: 8964 - DNA, 19 bp, Artificial Sequence
  Synthetic
ttcatcttcgcacgcgatg

SEQ ID NO: 8965 - DNA, 20 bp, Artificial Sequence
  Synthetic
acgcgtgttgttacccactt

SEQ ID NO: 8966 - DNA, 19 bp, Artificial Sequence
  Synthetic
gcgacggcgaactaaccag

SEQ ID NO: 8967 - DNA, 15 bp, Artificial Sequence
  Synthetic
gtcgcgcgccaacat

SEQ ID NO: 8968 - DNA, 19 bp, Artificial Sequence
  Synthetic
ccacgtcgttttggatcgc

SEQ ID NO: 8969 - DNA, 16 bp, Artificial Sequence
  Synthetic
ctcgaacacggtgccg

SEQ ID NO: 8970 - DNA, 16 bp, Artificial Sequence
  Synthetic
ccgtgtgcaagccagc

SEQ ID NO: 8971 - DNA, 16 bp, Artificial Sequence
  Synthetic
cgcaaaaacacgccgc

SEQ ID NO: 8972 - DNA, 18 bp, Artificial Sequence
  Synthetic
gaatgtcgtcagccaggc

SEQ ID NO: 8973 - DNA, 18 bp, Artificial Sequence
  Synthetic
tgcacgaacagctggacc

SEQ ID NO: 8974 - DNA, 20 bp, Artificial Sequence
  Synthetic
aggtcaatacggactacgcg

SEQ ID NO: 8975 - DNA, 16 bp, Artificial Sequence
  Synthetic
cgactccgcatgacgc

SEQ ID NO: 8976 - DNA, 16 bp, Artificial Sequence
  Synthetic
tctcgcggcccttcaa

SEQ ID NO: 8977 - DNA, 17 bp, Artificial Sequence
  Synthetic
tgatccgcacagctccg

SEQ ID NO: 8978 - DNA, 18 bp, Artificial Sequence
  Synthetic
ggcctcatcaccagcatc

SEQ ID NO: 8979 - DNA, 16 bp, Artificial Sequence
  Synthetic
gctcggcgctgacact

SEQ ID NO: 8980 - DNA, 20 bp, Artificial Sequence
  Synthetic
cgagatgctctccaccatcc

SEQ ID NO: 8981 - DNA, 16 bp, Artificial Sequence
  Synthetic
caacgcgacgagcagc

SEQ ID NO: 8982 - DNA, 16 bp, Artificial Sequence
  Synthetic
gcacggtgcgctggat

SEQ ID NO: 8983 - DNA, 18 bp, Artificial Sequence
  Synthetic
cctgctgcacaatgtggc

SEQ ID NO: 8984 - DNA, 16 bp, Artificial Sequence
  Synthetic
cgaagagacggcgcag

SEQ ID NO: 8985 - DNA, 16 bp, Artificial Sequence
  Synthetic
ccaacgacgtcgacgc

SEQ ID NO: 8986 - DNA, 16 bp, Artificial Sequence
  Synthetic
accgctcgtaccagcc

SEQ ID NO: 8987 - DNA, 18 bp, Artificial Sequence
  Synthetic
cccctcctcctcgtctca

SEQ ID NO: 8988 - DNA, 19 bp, Artificial Sequence
  Synthetic
cggatcttcggctacctcg

SEQ ID NO: 8989 - DNA, 17 bp, Artificial Sequence
  Synthetic
ccacctcgggctcaaac

SEQ ID NO: 8990 - DNA, 16 bp, Artificial Sequence
  Synthetic
ggacggcgcagattgc

SEQ ID NO: 8991 - DNA, 16 bp, Artificial Sequence
  Synthetic
gcgcacgttcacctcg

SEQ ID NO: 8992 - DNA, 18 bp, Artificial Sequence
  Synthetic
tgttgatgatgcgacgcc

SEQ ID NO: 8993 - DNA, 16 bp, Artificial Sequence
  Synthetic
ctcctgcaacgcggca

SEQ ID NO: 8994 - DNA, 16 bp, Artificial Sequence
  Synthetic
cgtcgcggctgctctt

SEQ ID NO: 8995 - DNA, 16 bp, Artificial Sequence
  Synthetic
gcacaacgccgccaga

SEQ ID NO: 8996 - DNA, 17 bp, Artificial Sequence
  Synthetic
tttcgtgagcaccccgc

SEQ ID NO: 8997 - DNA, 16 bp, Artificial Sequence
  Synthetic
cggaccaccaaaggcg

SEQ ID NO: 8998 - DNA, 18 bp, Artificial Sequence
  Synthetic
acgcgttttccacccttt

SEQ ID NO: 8999 - DNA, 18 bp, Artificial Sequence
  Synthetic
gcgcattaccaccgagtc

SEQ ID NO: 9000 - DNA, 19 bp, Artificial Sequence
  Synthetic
ggttcctccagccaatcga

SEQ ID NO: 9001 - DNA, 18 bp, Artificial Sequence
  Synthetic
gctcgtcccggtaatcga

SEQ ID NO: 9002 - DNA, 16 bp, Artificial Sequence
  Synthetic
tcggtcagggcctcgt

SEQ ID NO: 9003 - DNA, 17 bp, Artificial Sequence
  Synthetic
cagctcggtggaaagcc

SEQ ID NO: 9004 - DNA, 16 bp, Artificial Sequence
  Synthetic
ccgaggaaacgggggt

SEQ ID NO: 9005 - DNA, 16 bp, Artificial Sequence
  Synthetic
gtgtggggacgacgct

SEQ ID NO: 9006 - DNA, 19 bp, Artificial Sequence
  Synthetic
tgtctgctagtcgcctacg

SEQ ID NO: 9007 - DNA, 16 bp, Artificial Sequence
  Synthetic
gcgactcgcccgatct

SEQ ID NO: 9008 - DNA, 20 bp, Artificial Sequence
  Synthetic
tgattggcgcaagtaaagga

SEQ ID NO: 9009 - DNA, 16 bp, Artificial Sequence
  Synthetic
ggctttctcgcccgct

SEQ ID NO: 9010 - DNA, 16 bp, Artificial Sequence
  Synthetic
cttccagcgtcgccgt

SEQ ID NO: 9011 - DNA, 17 bp, Artificial Sequence
  Synthetic
ggcacgtcactttgcgg

SEQ ID NO: 9012 - DNA, 18 bp, Artificial Sequence
  Synthetic
atgggagcgttacgacgg

SEQ ID NO: 9013 - DNA, 17 bp, Artificial Sequence
  Synthetic
gtgccacgaggggatga

SEQ ID NO: 9014 - DNA, 20 bp, Artificial Sequence
  Synthetic
tgagagtccaaaacccacgg

SEQ ID NO: 9015 - DNA, 16 bp, Artificial Sequence
  Synthetic
ctaacgggcacgcggt

SEQ ID NO: 9016 - DNA, 20 bp, Artificial Sequence
  Synthetic
tcgtgcggagatttgttctc

SEQ ID NO: 9017 - DNA, 18 bp, Artificial Sequence
  Synthetic
agacgtcgggctctttcc

SEQ ID NO: 9018 - DNA, 19 bp, Artificial Sequence
  Synthetic
gttcagcatcttgagcggc

SEQ ID NO: 9019 - DNA, 20 bp, Artificial Sequence
  Synthetic
aagcttacagtcttgcggtt

SEQ ID NO: 9020 - DNA, 18 bp, Artificial Sequence
  Synthetic
aaggcccgtaaaagcggc

SEQ ID NO: 9021 - DNA, 16 bp, Artificial Sequence
  Synthetic
gagaggcgcgccgaaa

SEQ ID NO: 9022 - DNA, 16 bp, Artificial Sequence
  Synthetic
ccagccgcatcagcag

SEQ ID NO: 9023 - DNA, 15 bp, Artificial Sequence
  Synthetic
aggtggcgtcgcgaa

SEQ ID NO: 9024 - DNA, 15 bp, Artificial Sequence
  Synthetic
tgacgttgcgccgct

SEQ ID NO: 9025 - DNA, 18 bp, Artificial Sequence
  Synthetic
ggccactacctgtacgcc

SEQ ID NO: 9026 - DNA, 20 bp, Artificial Sequence
  Synthetic
cgcggtaaaaatgcggtatg

SEQ ID NO: 9027 - DNA, 19 bp, Artificial Sequence
  Synthetic
ggcctcgaacatctcctcg

SEQ ID NO: 9028 - DNA, 17 bp, Artificial Sequence
  Synthetic
ttgcggctctctaccgt

SEQ ID NO: 9029 - DNA, 18 bp, Artificial Sequence
  Synthetic
cgctgctctacgtgcacc

SEQ ID NO: 9030 - DNA, 17 bp, Artificial Sequence
  Synthetic
aggacgtcgcggctatc

SEQ ID NO: 9031 - DNA, 18 bp, Artificial Sequence
  Synthetic
ggtacggggagagatggc

SEQ ID NO: 9032 - DNA, 16 bp, Artificial Sequence
  Synthetic
cgcggcccatgaggta

SEQ ID NO: 9033 - DNA, 18 bp, Artificial Sequence
  Synthetic
catgttggccgtcttgcg

SEQ ID NO: 9034 - DNA, 18 bp, Artificial Sequence
  Synthetic
cttggaactggtcgcgtc

SEQ ID NO: 9035 - DNA, 19 bp, Artificial Sequence
  Synthetic
acgaagctctctatccggt

SEQ ID NO: 9036 - DNA, 17 bp, Artificial Sequence
  Synthetic
gttgtagtcgcggtggc

SEQ ID NO: 9037 - DNA, 18 bp, Artificial Sequence
  Synthetic
cgtagcgctcctggatct

SEQ ID NO: 9038 - DNA, 16 bp, Artificial Sequence
  Synthetic
ggcgccgtcactcgtt

SEQ ID NO: 9039 - DNA, 18 bp, Artificial Sequence
  Synthetic
ttttccgcatgcgttcga

SEQ ID NO: 9040 - DNA, 16 bp, Artificial Sequence
  Synthetic
actgctcgcaccgtct

SEQ ID NO: 9041 - DNA, 16 bp, Artificial Sequence
  Synthetic
gcggtctggacgaggt

SEQ ID NO: 9042 - DNA, 15 bp, Artificial Sequence
  Synthetic
ttcggcgcaccacca

SEQ ID NO: 9043 - DNA, 16 bp, Artificial Sequence
  Synthetic
ctctgggtcgccaggt

SEQ ID NO: 9044 - DNA, 16 bp, Artificial Sequence
  Synthetic
tttggaggccgcaccg

SEQ ID NO: 9045 - DNA, 20 bp, Artificial Sequence
  Synthetic
attgcgtcgcggttactacg

SEQ ID NO: 9046 - DNA, 18 bp, Artificial Sequence
  Synthetic
cggactgtggtcgactgt

SEQ ID NO: 9047 - DNA, 20 bp, Artificial Sequence
  Synthetic
tccacgcatgaaataacggt

SEQ ID NO: 9048 - DNA, 16 bp, Artificial Sequence
  Synthetic
ctgcggtactcggcca

SEQ ID NO: 9049 - DNA, 16 bp, Artificial Sequence
  Synthetic
ttgagctcgtggcggc

SEQ ID NO: 9050 - DNA, 16 bp, Artificial Sequence
  Synthetic
gctctggcgcaacgag

SEQ ID NO: 9051 - DNA, 17 bp, Artificial Sequence
  Synthetic
gcacgaggagaccacca

SEQ ID NO: 9052 - DNA, 17 bp, Artificial Sequence
  Synthetic
gtcatcgacgagtgcgg

SEQ ID NO: 9053 - DNA, 18 bp, Artificial Sequence
  Synthetic
cggattcttctcagggcg

SEQ ID NO: 9054 - DNA, 18 bp, Artificial Sequence
  Synthetic
cgtcaagccacctagcct

SEQ ID NO: 9055 - DNA, 19 bp, Artificial Sequence
  Synthetic
tgtcagatcagctcgcaga

SEQ ID NO: 9056 - DNA, 16 bp, Artificial Sequence
  Synthetic
atgcgctcgggttcct

SEQ ID NO: 9057 - DNA, 16 bp, Artificial Sequence
  Synthetic
tcccggcgctctgaca

SEQ ID NO: 9058 - DNA, 16 bp, Artificial Sequence
  Synthetic
cggcacaggtcgtcca

SEQ ID NO: 9059 - DNA, 16 bp, Artificial Sequence
  Synthetic
gactttctcggcggcg

SEQ ID NO: 9060 - DNA, 19 bp, Artificial Sequence
  Synthetic
tgacggtgttactcgtggt

SEQ ID NO: 9061 - DNA, 17 bp, Artificial Sequence
  Synthetic
ctttcttggtggcgccc

SEQ ID NO: 9062 - DNA, 16 bp, Artificial Sequence
  Synthetic
acggcgcttgtggtgc

SEQ ID NO: 9063 - DNA, 20 bp, Artificial Sequence
  Synthetic
acgacaggatcagacagacg

SEQ ID NO: 9064 - DNA, 18 bp, Artificial Sequence
  Synthetic
ttccatctgcgtcagcgg

SEQ ID NO: 9065 - DNA, 19 bp, Artificial Sequence
  Synthetic
atactgtcccagtcgcgac

SEQ ID NO: 9066 - DNA, 21 bp, Artificial Sequence
  Synthetic
taccgtgatgtaaaaacaaca

SEQ ID NO: 9067 - DNA, 20 bp, Artificial Sequence
  Synthetic
ctttttccttgtttgacggt

SEQ ID NO: 9068 - DNA, 18 bp, Artificial Sequence
  Synthetic
cggtacatcccgcagtcg

SEQ ID NO: 9069 - DNA, 19 bp, Artificial Sequence
  Synthetic
cgtgggaacgacagaaacg

SEQ ID NO: 9070 - DNA, 18 bp, Artificial Sequence
  Synthetic
ggtgaccgtcctctgtcc

SEQ ID NO: 9071 - DNA, 17 bp, Artificial Sequence
  Synthetic
ccattctggcagcagcg

SEQ ID NO: 9072 - DNA, 20 bp, Artificial Sequence
  Synthetic
ggacacgagagtcccacctt

SEQ ID NO: 9073 - DNA, 19 bp, Artificial Sequence
  Synthetic
gccaacgtcgaatgctacg

SEQ ID NO: 9074 - DNA, 16 bp, Artificial Sequence
  Synthetic
cctgggcgctgctgtt

SEQ ID NO: 9075 - DNA, 17 bp, Artificial Sequence
  Synthetic
caagtcccaggcggcta

SEQ ID NO: 9076 - DNA, 17 bp, Artificial Sequence
  Synthetic
aggggagcaacaaccgt

SEQ ID NO: 9077 - DNA, 15 bp, Artificial Sequence
  Synthetic
tcgcgccgcagagtt

SEQ ID NO: 9078 - DNA, 18 bp, Artificial Sequence
  Synthetic
ggccgttggagaattggt

SEQ ID NO: 9079 - DNA, 19 bp, Artificial Sequence
  Synthetic
agacggtgttcgatggaga

SEQ ID NO: 9080 - DNA, 16 bp, Artificial Sequence
  Synthetic
cacacggcccggaatg

SEQ ID NO: 9081 - DNA, 18 bp, Artificial Sequence
  Synthetic
agcacagttgacgaccac

SEQ ID NO: 9082 - DNA, 20 bp, Artificial Sequence
  Synthetic
aatttgggtcttttcacgcg

SEQ ID NO: 9083 - DNA, 18 bp, Artificial Sequence
  Synthetic
gttgcccgacatcctccc

SEQ ID NO: 9084 - DNA, 20 bp, Artificial Sequence
  Synthetic
ctttccgtaccgggatttcc

SEQ ID NO: 9085 - DNA, 20 bp, Artificial Sequence
  Synthetic
aacgtcaagagtcacgtcag

SEQ ID NO: 9086 - DNA, 20 bp, Artificial Sequence
  Synthetic
cacatcaacagaaaaccgag

SEQ ID NO: 9087 - DNA, 17 bp, Artificial Sequence
  Synthetic
tcgttaccccaggtgcc

SEQ ID NO: 9088 - DNA, 19 bp, Artificial Sequence
  Synthetic
cggaatcgtataccgggca

SEQ ID NO: 9089 - DNA, 16 bp, Artificial Sequence
  Synthetic
gttcccaagccacgcc

SEQ ID NO: 9090 - DNA, 16 bp, Artificial Sequence
  Synthetic
cgcgcccagaaccaac

SEQ ID NO: 9091 - DNA, 16 bp, Artificial Sequence
  Synthetic
ccacgcggcaacagtc

SEQ ID NO: 9092 - DNA, 16 bp, Artificial Sequence
  Synthetic
gggatgtgcgccagga

SEQ ID NO: 9093 - DNA, 17 bp, Artificial Sequence
  Synthetic
tgttgccgctgtcgaac

SEQ ID NO: 9094 - DNA, 16 bp, Artificial Sequence
  Synthetic
gcgctggccacgatca

SEQ ID NO: 9095 - DNA, 16 bp, Artificial Sequence
  Synthetic
gccataccgccagcct

SEQ ID NO: 9096 - DNA, 18 bp, Artificial Sequence
  Synthetic
cgcacaacgtcaccacta

SEQ ID NO: 9097 - DNA, 18 bp, Artificial Sequence
  Synthetic
tcccatctggtcgggttc

SEQ ID NO: 9098 - DNA, 16 bp, Artificial Sequence
  Synthetic
ggcggccagagaacgt

SEQ ID NO: 9099 - DNA, 18 bp, Artificial Sequence
  Synthetic
tttagcatttcggcgcgg

SEQ ID NO: 9100 - DNA, 19 bp, Artificial Sequence
  Synthetic
atggcgtccaggtgtatga

SEQ ID NO: 9101 - DNA, 18 bp, Artificial Sequence
  Synthetic
gtccagcagttggtcgcg

SEQ ID NO: 9102 - DNA, 20 bp, Artificial Sequence
  Synthetic
aaatcccgcaacacttgtcg

SEQ ID NO: 9103 - DNA, 19 bp, Artificial Sequence
  Synthetic
cgtgaagagccctcatcca

SEQ ID NO: 9104 - DNA, 18 bp, Artificial Sequence
  Synthetic
ggtcacacgctgcagttc

SEQ ID NO: 9105 - DNA, 16 bp, Artificial Sequence
  Synthetic
ccttctcgcgggccta

SEQ ID NO: 9106 - DNA, 20 bp, Artificial Sequence
  Synthetic
ttctacgggtatctgcagct

SEQ ID NO: 9107 - DNA, 16 bp, Artificial Sequence
  Synthetic
gcagacacgcacctgg

SEQ ID NO: 9108 - DNA, 16 bp, Artificial Sequence
  Synthetic
gcgcaccctcctaggt

SEQ ID NO: 9109 - DNA, 22 bp, Artificial Sequence
  Synthetic
aggtactgatccaaaatggaag

SEQ ID NO: 9110 - DNA, 20 bp, Artificial Sequence
  Synthetic
aattgaaggaagagaccgag

SEQ ID NO: 9111 - DNA, 25 bp, Artificial Sequence
  Synthetic
aagaataaaaaccagactattcacc

SEQ ID NO: 9112 - DNA, 23 bp, Artificial Sequence
  Synthetic
cccaaaaacaaagaacatgaaga

SEQ ID NO: 9113 - DNA, 21 bp, Artificial Sequence
  Synthetic
caacaaggcatgtgaattgac

SEQ ID NO: 9114 - DNA, 21 bp, Artificial Sequence
  Synthetic
aaggaagacaaacctgtatgg

SEQ ID NO: 9115 - DNA, 18 bp, Artificial Sequence
  Synthetic
ggggatggaaatgagacg

SEQ ID NO: 9116 - DNA, 18 bp, Artificial Sequence
  Synthetic
cgtctcaaggcaccaaac

SEQ ID NO: 9117 - DNA, 21 bp, Artificial Sequence
  Synthetic
aaaggaccctaagaaaactgg

SEQ ID NO: 9118 - DNA, 18 bp, Artificial Sequence
  Synthetic
gggatagggacaatggtg

SEQ ID NO: 9119 - DNA, 20 bp, Artificial Sequence
  Synthetic
accttagggtctcaagtttc

SEQ ID NO: 9120 - DNA, 20 bp, Artificial Sequence
  Synthetic
tttagacgccattttacacg

SEQ ID NO: 9121 - DNA, 19 bp, Artificial Sequence
  Synthetic
tctgccagctcattttcac

SEQ ID NO: 9122 - DNA, 20 bp, Artificial Sequence
  Synthetic
tattgggggcgaatgtatgc

SEQ ID NO: 9123 - DNA, 18 bp, Artificial Sequence
  Synthetic
cctcacccccgaaactag

SEQ ID NO: 9124 - DNA, 21 bp, Artificial Sequence
  Synthetic
ggtgttgctttgaatagttca

SEQ ID NO: 9125 - DNA, 19 bp, Artificial Sequence
  Synthetic
gcgagaaatcccacctgag

SEQ ID NO: 9126 - DNA, 18 bp, Artificial Sequence
  Synthetic
ggttagagccatgggagg

SEQ ID NO: 9127 - DNA, 23 bp, Artificial Sequence
  Synthetic
aactgtctgtaaaaaagtgtttg

SEQ ID NO: 9128 - DNA, 18 bp, Artificial Sequence
  Synthetic
gcggggtatgtttagacc

SEQ ID NO: 9129 - DNA, 20 bp, Artificial Sequence
  Synthetic
ccaggttaccatattgggcc

SEQ ID NO: 9130 - DNA, 23 bp, Artificial Sequence
  Synthetic
tgatacttgttttttctgacatg

SEQ ID NO: 9131 - DNA, 22 bp, Artificial Sequence
  Synthetic
cgaggtgacatgatatgaagtt

SEQ ID NO: 9132 - DNA, 20 bp, Artificial Sequence
  Synthetic
agatgggggaatcatgtcca

SEQ ID NO: 9133 - DNA, 19 bp, Artificial Sequence
  Synthetic
ccataggcatgtggtccag

SEQ ID NO: 9134 - DNA, 23 bp, Artificial Sequence
  Synthetic
ggcaaggtagcattttaacataa

SEQ ID NO: 9135 - DNA, 20 bp, Artificial Sequence
  Synthetic
acaaaaagactgtcagtgtc

SEQ ID NO: 9136 - DNA, 19 bp, Artificial Sequence
  Synthetic
cacaattttctggtggtgg

SEQ ID NO: 9137 - DNA, 18 bp, Artificial Sequence
  Synthetic
tttgtccctatcggcccg

SEQ ID NO: 9138 - DNA, 20 bp, Artificial Sequence
  Synthetic
taattttccagcgccacctg

SEQ ID NO: 9139 - DNA, 25 bp, Artificial Sequence
  Synthetic
ctcctttttttttccatagttcttg

SEQ ID NO: 9140 - DNA, 19 bp, Artificial Sequence
  Synthetic
gattgggaagggcaaaagt

SEQ ID NO: 9141 - DNA, 22 bp, Artificial Sequence
  Synthetic
aagatcagtagctaaggaggtt

SEQ ID NO: 9142 - DNA, 20 bp, Artificial Sequence
  Synthetic
caccagttggaagaatggct

SEQ ID NO: 9143 - DNA, 20 bp, Artificial Sequence
  Synthetic
tcgtcctcttcctcttctgc

SEQ ID NO: 9144 - DNA, 18 bp, Artificial Sequence
  Synthetic
tgagcccggggactaacc

SEQ ID NO: 9145 - DNA, 22 bp, Artificial Sequence
  Synthetic
cctgtcttaaaatctcctgaac

SEQ ID NO: 9146 - DNA, 20 bp, Artificial Sequence
  Synthetic
tttcttcctcgaccacaggt

SEQ ID NO: 9147 - DNA, 21 bp, Artificial Sequence
  Synthetic
ctttcaagaaaggcatctagc

SEQ ID NO: 9148 - DNA, 23 bp, Artificial Sequence
  Synthetic
gttgtaataaagctaaatctgcc

SEQ ID NO: 9149 - DNA, 18 bp, Artificial Sequence
  Synthetic
cagcacctggagcgagat

SEQ ID NO: 9150 - DNA, 20 bp, Artificial Sequence
  Synthetic
aaagttggtaagcgactccc

SEQ ID NO: 9151 - DNA, 16 bp, Artificial Sequence
  Synthetic
cgattgggcgcccact

SEQ ID NO: 9152 - DNA, 23 bp, Artificial Sequence
  Synthetic
aaaaagctttaataaccatgtgc

SEQ ID NO: 9153 - DNA, 20 bp, Artificial Sequence
  Synthetic
catagcttacaaagggcgct

SEQ ID NO: 9154 - DNA, 19 bp, Artificial Sequence
  Synthetic
ttttcggccattttggaag

SEQ ID NO: 9155 - DNA, 23 bp, Artificial Sequence
  Synthetic
gtggtcaggaagattatacaaac

SEQ ID NO: 9156 - DNA, 18 bp, Artificial Sequence
  Synthetic
gtccttctacgcttccaa

SEQ ID NO: 9157 - DNA, 20 bp, Artificial Sequence
  Synthetic
aacatatgcacaagagcggc

SEQ ID NO: 9158 - DNA, 25 bp, Artificial Sequence
  Synthetic
gtagtgcaaaataatgactattccc

SEQ ID NO: 9159 - DNA, 19 bp, Artificial Sequence
  Synthetic
gtaggaagacagcatggag

SEQ ID NO: 9160 - DNA, 22 bp, Artificial Sequence
  Synthetic
aggatcaaaacactgtaagagg

SEQ ID NO: 9161 - DNA, 20 bp, Artificial Sequence
  Synthetic
tgtccattttggtttcgcca

SEQ ID NO: 9162 - DNA, 16 bp, Artificial Sequence
  Synthetic
tcgccggcgtagacca

SEQ ID NO: 9163 - DNA, 20 bp, Artificial Sequence
  Synthetic
atggcccatcggataacctt

SEQ ID NO: 9164 - DNA, 18 bp, Artificial Sequence
  Synthetic
cggaagaaaagcgtggaa

SEQ ID NO: 9165 - DNA, 20 bp, Artificial Sequence
  Synthetic
tacatccttccattgtgccc

SEQ ID NO: 9166 - DNA, 20 bp, Artificial Sequence
  Synthetic
attgccaaccgtttagagcc

SEQ ID NO: 9167 - DNA, 20 bp, Artificial Sequence
  Synthetic
tcccatctgtgtatacgcct

SEQ ID NO: 9168 - DNA, 20 bp, Artificial Sequence
  Synthetic
acctactcctacaaggctcg

SEQ ID NO: 9169 - DNA, 18 bp, Artificial Sequence
  Synthetic
caaccaacgaacacggag

SEQ ID NO: 9170 - DNA, 21 bp, Artificial Sequence
  Synthetic
tgcaagacagaaatacagagc

SEQ ID NO: 9171 - DNA, 22 bp, Artificial Sequence
  Synthetic
taatttgcaggctaatttgtgg

SEQ ID NO: 9172 - DNA, 20 bp, Artificial Sequence
  Synthetic
gccatcagaaatttgttgct

SEQ ID NO: 9173 - DNA, 25 bp, Artificial Sequence
  Synthetic
ttactcgcctaaaaactaaagaaac

SEQ ID NO: 9174 - DNA, 21 bp, Artificial Sequence
  Synthetic
ctttagaaactttcagcccat

SEQ ID NO: 9175 - DNA, 19 bp, Artificial Sequence
  Synthetic
cgggtaacgctaccaccta

SEQ ID NO: 9176 - DNA, 18 bp, Artificial Sequence
  Synthetic
cactaaagaccgatgcgt

SEQ ID NO: 9177 - DNA, 20 bp, Artificial Sequence
  Synthetic
aaatcaaatggctcttcgcg

SEQ ID NO: 9178 - DNA, 19 bp, Artificial Sequence
  Synthetic
tgtttaaacattcgcagcg

SEQ ID NO: 9179 - DNA, 20 bp, Artificial Sequence
  Synthetic
tccaccaaatgctctttgcg

SEQ ID NO: 9180 - DNA, 23 bp, Artificial Sequence
  Synthetic
tacttttccattagcatagccat

SEQ ID NO: 9181 - DNA, 18 bp, Artificial Sequence
  Synthetic
gctacggctgtcatggag

SEQ ID NO: 9182 - DNA, 20 bp, Artificial Sequence
  Synthetic
aaatcctcgccttaacttct

SEQ ID NO: 9183 - DNA, 19 bp, Artificial Sequence
  Synthetic
ccggcagtaaatcttccgc

SEQ ID NO: 9184 - DNA, 18 bp, Artificial Sequence
  Synthetic
cagagattacgtgcgaga

SEQ ID NO: 9185 - DNA, 18 bp, Artificial Sequence
  Synthetic
accgttctttggtttgca

SEQ ID NO: 9186 - DNA, 18 bp, Artificial Sequence
  Synthetic
ccttgatccccaaaccgg

SEQ ID NO: 9187 - DNA, 20 bp, Artificial Sequence
  Synthetic
aatctcagaaagccaaccgt

SEQ ID NO: 9188 - DNA, 18 bp, Artificial Sequence
  Synthetic
agcagcaacaaggaaagt

SEQ ID NO: 9189 - DNA, 20 bp, Artificial Sequence
  Synthetic
atgaattggttaagcgccgg

SEQ ID NO: 9190 - DNA, 25 bp, Artificial Sequence
  Synthetic
ggaattgatacacacctcattaaat

SEQ ID NO: 9191 - DNA, 23 bp, Artificial Sequence
  Synthetic
aaactacacaaagaaaacatcac

SEQ ID NO: 9192 - DNA, 22 bp, Artificial Sequence
  Synthetic
tcgcagctcttattttattcct

SEQ ID NO: 9193 - DNA, 24 bp, Artificial Sequence
  Synthetic
aatgcatcattacttcaaagtacc

SEQ ID NO: 9194 - DNA, 22 bp, Artificial Sequence
  Synthetic
cagcctttatttatctgtgctg

SEQ ID NO: 9195 - DNA, 23 bp, Artificial Sequence
  Synthetic
ctgggtttatggaattatgtctg

SEQ ID NO: 9196 - DNA, 24 bp, Artificial Sequence
  Synthetic
gagttaattgatttacaaaccgtg

SEQ ID NO: 9197 - DNA, 23 bp, Artificial Sequence
  Synthetic
ttaccggaaatctgaaaatacat

SEQ ID NO: 9198 - DNA, 19 bp, Artificial Sequence
  Synthetic
ttacactcaagctagggga

SEQ ID NO: 9199 - DNA, 20 bp, Artificial Sequence
  Synthetic
tctcaccactgaaactccct

SEQ ID NO: 9200 - DNA, 23 bp, Artificial Sequence
  Synthetic
gtaacaagaataggggatggttt

SEQ ID NO: 9201 - DNA, 22 bp, Artificial Sequence
  Synthetic
taagtttagtgggtgttaaggg

SEQ ID NO: 9202 - DNA, 21 bp, Artificial Sequence
  Synthetic
tttaacattcatgtggtcagg

SEQ ID NO: 9203 - DNA, 19 bp, Artificial Sequence
  Synthetic
tgatggaaacgaatccctc

SEQ ID NO: 9204 - DNA, 20 bp, Artificial Sequence
  Synthetic
gttaacaacctcccgatacc

SEQ ID NO: 9205 - DNA, 19 bp, Artificial Sequence
  Synthetic
aggaatgcctcttacctca

SEQ ID NO: 9206 - DNA, 19 bp, Artificial Sequence
  Synthetic
cgacttacaggaggaggag

SEQ ID NO: 9207 - DNA, 22 bp, Artificial Sequence
  Synthetic
aaaagtctggatcttcaaacac

SEQ ID NO: 9208 - DNA, 20 bp, Artificial Sequence
  Synthetic
cctcaaaatctaagccatgc

SEQ ID NO: 9209 - DNA, 22 bp, Artificial Sequence
  Synthetic
aggaatatcaactgctatgtgc

SEQ ID NO: 9210 - DNA, 20 bp, Artificial Sequence
  Synthetic
aacggtcaagcacttctgtt

SEQ ID NO: 9211 - DNA, 19 bp, Artificial Sequence
  Synthetic
ataaggatgcggcaagctc

SEQ ID NO: 9212 - DNA, 20 bp, Artificial Sequence
  Synthetic
tggccaaaacatgttccacc

SEQ ID NO: 9213 - DNA, 19 bp, Artificial Sequence
  Synthetic
acaaaccctaccaatcacc

SEQ ID NO: 9214 - DNA, 18 bp, Artificial Sequence
  Synthetic
acgttgtgtgggatttgg

SEQ ID NO: 9215 - DNA, 24 bp, Artificial Sequence
  Synthetic
gacattgattgaaacgagatatgt

SEQ ID NO: 9216 - DNA, 18 bp, Artificial Sequence
  Synthetic
gatggagccgagaacagt

SEQ ID NO: 9217 - DNA, 25 bp, Artificial Sequence
  Synthetic
cccaaaacatattcaatatgacatc

SEQ ID NO: 9218 - DNA, 19 bp, Artificial Sequence
  Synthetic
tagcagacaaggtgactca

SEQ ID NO: 9219 - DNA, 22 bp, Artificial Sequence
  Synthetic
cacctgatcccaaatactttga

SEQ ID NO: 9220 - DNA, 21 bp, Artificial Sequence
  Synthetic
gccaggaaaagaaaaacagaa

SEQ ID NO: 9221 - DNA, 18 bp, Artificial Sequence
  Synthetic
aatacccacacatgccca

SEQ ID NO: 9222 - DNA, 20 bp, Artificial Sequence
  Synthetic
caaggtacaagatgttggtc

SEQ ID NO: 9223 - DNA, 21 bp, Artificial Sequence
  Synthetic
agctcctgcaaaaataaaagc

SEQ ID NO: 9224 - DNA, 23 bp, Artificial Sequence
  Synthetic
ctgaaaattgtagcatatggtga

SEQ ID NO: 9225 - DNA, 24 bp, Artificial Sequence
  Synthetic
cggaagagatacatataaaaaggg

SEQ ID NO: 9226 - DNA, 20 bp, Artificial Sequence
  Synthetic
ccacggttgcagatcttaat

SEQ ID NO: 9227 - DNA, 19 bp, Artificial Sequence
  Synthetic
gaaagctgacgttttgctg

SEQ ID NO: 9228 - DNA, 21 bp, Artificial Sequence
  Synthetic
gaggattgtgacaatgcacta

SEQ ID NO: 9229 - DNA, 23 bp, Artificial Sequence
  Synthetic
aaactgtacaaaagttgatgtgt

SEQ ID NO: 9230 - DNA, 21 bp, Artificial Sequence
  Synthetic
aaaagcttggcagacaattag

SEQ ID NO: 9231 - DNA, 25 bp, Artificial Sequence
  Synthetic
tatgatggcttatactttacagacc

SEQ ID NO: 9232 - DNA, 20 bp, Artificial Sequence
  Synthetic
ggaggaaaccgaggaaatcc

SEQ ID NO: 9233 - DNA, 18 bp, Artificial Sequence
  Synthetic
agctagggatccgcctat

SEQ ID NO: 9234 - DNA, 25 bp, Artificial Sequence
  Synthetic
gttccaaatctttatgcaaaatgtc

SEQ ID NO: 9235 - DNA, 22 bp, Artificial Sequence
  Synthetic
ctagtggtactttagtaaggcc

SEQ ID NO: 9236 - DNA, 19 bp, Artificial Sequence
  Synthetic
caatcatatctggcgagga

SEQ ID NO: 9237 - DNA, 22 bp, Artificial Sequence
  Synthetic
tagaaagccctccaaaaactag

SEQ ID NO: 9238 - DNA, 18 bp, Artificial Sequence
  Synthetic
ctatagggcgtccaaggt

SEQ ID NO: 9239 - DNA, 20 bp, Artificial Sequence
  Synthetic
gtgaaagatgtacaggaacc

SEQ ID NO: 9240 - DNA, 19 bp, Artificial Sequence
  Synthetic
tagtgctcctttggatgtc

SEQ ID NO: 9241 - DNA, 21 bp, Artificial Sequence
  Synthetic
tctaactgcagatgttatggc

SEQ ID NO: 9242 - DNA, 21 bp, Artificial Sequence
  Synthetic
tgcaaacgtgtatgtatctgt

SEQ ID NO: 9243 - DNA, 17 bp, Artificial Sequence
  Synthetic
attacccaggcagccga

SEQ ID NO: 9244 - DNA, 24 bp, Artificial Sequence
  Synthetic
caagcacaaattttccttaaatcc

SEQ ID NO: 9245 - DNA, 21 bp, Artificial Sequence
  Synthetic
tgcaatatgctagaagactgc

SEQ ID NO: 9246 - DNA, 20 bp, Artificial Sequence
  Synthetic
ggatacgtacgcaacagagc

SEQ ID NO: 9247 - DNA, 22 bp, Artificial Sequence
  Synthetic
cagaagcagaggattatggaaa

SEQ ID NO: 9248 - DNA, 20 bp, Artificial Sequence
  Synthetic
ggtaaaaccaacaggaaacg

SEQ ID NO: 9249 - DNA, 23 bp, Artificial Sequence
  Synthetic
tcaaaaattgttgaaactgtagc

SEQ ID NO: 9250 - DNA, 24 bp, Artificial Sequence
  Synthetic
gtatgttctttgatggagaatttg

SEQ ID NO: 9251 - DNA, 21 bp, Artificial Sequence
  Synthetic
ttcagaactagagcaaacaga

SEQ ID NO: 9252 - DNA, 23 bp, Artificial Sequence
  Synthetic
cgaaaacggttgtatataaacca

SEQ ID NO: 9253 - DNA, 18 bp, Artificial Sequence
  Synthetic
gcggctatccatatgcag

SEQ ID NO: 9254 - DNA, 21 bp, Artificial Sequence
  Synthetic
atggaagacatgttaccctaa

SEQ ID NO: 9255 - DNA, 19 bp, Artificial Sequence
  Synthetic
aagacctaacaacgatggc

SEQ ID NO: 9256 - DNA, 18 bp, Artificial Sequence
  Synthetic
cgactgtgcaggacctaa

SEQ ID NO: 9257 - DNA, 19 bp, Artificial Sequence
  Synthetic
gtcaggaaaaggacacagg

SEQ ID NO: 9258 - DNA, 21 bp, Artificial Sequence
  Synthetic
aacagttattgaacacgggtt

SEQ ID NO: 9259 - DNA, 25 bp, Artificial Sequence
  Synthetic
agtgtatgaactgtcaaatacaaac

SEQ ID NO: 9260 - DNA, 20 bp, Artificial Sequence
  Synthetic
gtagtgccaccattaaaggt

SEQ ID NO: 9261 - DNA, 18 bp, Artificial Sequence
  Synthetic
ctaggaaacgagcacgag

SEQ ID NO: 9262 - DNA, 18 bp, Artificial Sequence
  Synthetic
tcctcaaaggcaccacat

SEQ ID NO: 9263 - DNA, 24 bp, Artificial Sequence
  Synthetic
gcatttgttgtatgttttgttagc

SEQ ID NO: 9264 - DNA, 23 bp, Artificial Sequence
  Synthetic
attcctttagatacttttgtggt

SEQ ID NO: 9265 - DNA, 25 bp, Artificial Sequence
  Synthetic
cagatacatatttaacttccacacc

SEQ ID NO: 9266 - DNA, 19 bp, Artificial Sequence
  Synthetic
gcgacagcacagtatatgt

SEQ ID NO: 9267 - DNA, 21 bp, Artificial Sequence
  Synthetic
ccgcccttagaacttattacc

SEQ ID NO: 9268 - DNA, 24 bp, Artificial Sequence
  Synthetic
gtctgtagggagtagtatatatgt

SEQ ID NO: 9269 - DNA, 18 bp, Artificial Sequence
  Synthetic
caggtacacattgccctg

SEQ ID NO: 9270 - DNA, 18 bp, Artificial Sequence
  Synthetic
aagcgtctagccatggcg

SEQ ID NO: 9271 - DNA, 19 bp, Artificial Sequence
  Synthetic
caaacgtaacaccaaccgc

SEQ ID NO: 9272 - DNA, 20 bp, Artificial Sequence
  Synthetic
catcgataccctaacctgcg

SEQ ID NO: 9273 - DNA, 20 bp, Artificial Sequence
  Synthetic
cacatcatgcaccttccagg

SEQ ID NO: 9274 - DNA, 20 bp, Artificial Sequence
  Synthetic
tgaactggagtccaacaacc

SEQ ID NO: 9275 - DNA, 20 bp, Artificial Sequence
  Synthetic
actgggttcttggctagctt

SEQ ID NO: 9276 - DNA, 18 bp, Artificial Sequence
  Synthetic
tggggggagaacgagact

SEQ ID NO: 9277 - DNA, 18 bp, Artificial Sequence
  Synthetic
cggcggtatagagcatcg

SEQ ID NO: 9278 - DNA, 18 bp, Artificial Sequence
  Synthetic
ggtgcccaaggcttctgg

SEQ ID NO: 9279 - DNA, 19 bp, Artificial Sequence
  Synthetic
ggggattgtggtggatcca

SEQ ID NO: 9280 - DNA, 18 bp, Artificial Sequence
  Synthetic
gtggccctagagccagtt

SEQ ID NO: 9281 - DNA, 18 bp, Artificial Sequence
  Synthetic
ctggcagggacaccaatg

SEQ ID NO: 9282 - DNA, 16 bp, Artificial Sequence
  Synthetic
ggaggtccgctgctgt

SEQ ID NO: 9283 - DNA, 18 bp, Artificial Sequence
  Synthetic
ggccacactgggttttgg

SEQ ID NO: 9284 - DNA, 20 bp, Artificial Sequence
  Synthetic
tccaacatagaggaggtcgc

SEQ ID NO: 9285 - DNA, 20 bp, Artificial Sequence
  Synthetic
gacttcagcttggaccccac

SEQ ID NO: 9286 - DNA, 20 bp, Artificial Sequence
  Synthetic
ttcctatcccagaccaagca

SEQ ID NO: 9287 - DNA, 19 bp, Artificial Sequence
  Synthetic
ctgtctttcagtgggcagc

SEQ ID NO: 9288 - DNA, 20 bp, Artificial Sequence
  Synthetic
atctcgctggactgtctact

SEQ ID NO: 9289 - DNA, 20 bp, Artificial Sequence
  Synthetic
ttggtaaatttgctcccggc

SEQ ID NO: 9290 - DNA, 18 bp, Artificial Sequence
  Synthetic
gggattgggtcttgcacg

SEQ ID NO: 9291 - DNA, 20 bp, Artificial Sequence
  Synthetic
ttccattatgtcaccggggt

SEQ ID NO: 9292 - DNA, 19 bp, Artificial Sequence
  Synthetic
gagattggctcgagggtca

SEQ ID NO: 9293 - DNA, 20 bp, Artificial Sequence
  Synthetic
cacctcttaccgagacgtgg

SEQ ID NO: 9294 - DNA, 18 bp, Artificial Sequence
  Synthetic
ggtgacccggacttgaca

SEQ ID NO: 9295 - DNA, 20 bp, Artificial Sequence
  Synthetic
ttaccacagaggaagcttgc

SEQ ID NO: 9296 - DNA, 20 bp, Artificial Sequence
  Synthetic
atggcttccaatactcccca

SEQ ID NO: 9297 - DNA, 20 bp, Artificial Sequence
  Synthetic
tgacgtgctatctcaaagcc

SEQ ID NO: 9298 - DNA, 19 bp, Artificial Sequence
  Synthetic
cttatcgcccagggaggta

SEQ ID NO: 9299 - DNA, 19 bp, Artificial Sequence
  Synthetic
cgatccagtggttgtaagg

SEQ ID NO: 9300 - DNA, 23 bp, Artificial Sequence
  Synthetic
tcaatggacccatctaagtttac

SEQ ID NO: 9301 - DNA, 23 bp, Artificial Sequence
  Synthetic
cttctgtctgtaggttttacaca

SEQ ID NO: 9302 - DNA, 21 bp, Artificial Sequence
  Synthetic
acgcatacaaaagatgaggtt

SEQ ID NO: 9303 - DNA, 18 bp, Artificial Sequence
  Synthetic
tccacaggacaggagaga

SEQ ID NO: 9304 - DNA, 21 bp, Artificial Sequence
  Synthetic
gtgcatgtccagattttaagc

SEQ ID NO: 9305 - DNA, 19 bp, Artificial Sequence
  Synthetic
tcaagcaatttggtggtcc

SEQ ID NO: 9306 - DNA, 22 bp, Artificial Sequence
  Synthetic
caaaactcttgtcaagatcaga

SEQ ID NO: 9307 - DNA, 24 bp, Artificial Sequence
  Synthetic
cctatccaaatagagatttagcaa

SEQ ID NO: 9308 - DNA, 18 bp, Artificial Sequence
  Synthetic
ctgcggtgggattttgag

SEQ ID NO: 9309 - DNA, 23 bp, Artificial Sequence
  Synthetic
tttcagctttagtgatcatttgc

SEQ ID NO: 9310 - DNA, 23 bp, Artificial Sequence
  Synthetic
aaaagtaaacaaagaactgaacc

SEQ ID NO: 9311 - DNA, 20 bp, Artificial Sequence
  Synthetic
tcaaatggtttcttcagtgg

SEQ ID NO: 9312 - DNA, 18 bp, Artificial Sequence
  Synthetic
tggatgccactttggtag

SEQ ID NO: 9313 - DNA, 24 bp, Artificial Sequence
  Synthetic
tagagaaacaaggccaagtaatag

SEQ ID NO: 9314 - DNA, 25 bp, Artificial Sequence
  Synthetic
taaggatgaattaagaagtgttgac

SEQ ID NO: 9315 - DNA, 22 bp, Artificial Sequence
  Synthetic
cttacggtgatgatttgattgt

SEQ ID NO: 9316 - DNA, 20 bp, Artificial Sequence
  Synthetic
aagtcaatggctgagtcacc

SEQ ID NO: 9317 - DNA, 19 bp, Artificial Sequence
  Synthetic
gccacccgaacattcaacc

SEQ ID NO: 9318 - DNA, 18 bp, Artificial Sequence
  Synthetic
gacgtcctcgaagcctga

SEQ ID NO: 9319 - DNA, 18 bp, Artificial Sequence
  Synthetic
cagtgggggcagtgtcat

SEQ ID NO: 9320 - DNA, 19 bp, Artificial Sequence
  Synthetic
tgatccaaagtgggctgtg

SEQ ID NO: 9321 - DNA, 20 bp, Artificial Sequence
  Synthetic
atggagactctcttccctac

SEQ ID NO: 9322 - DNA, 23 bp, Artificial Sequence
  Synthetic
tattgtgtgaagaatcattgtca

SEQ ID NO: 9323 - DNA, 18 bp, Artificial Sequence
  Synthetic
tgcagcacttagtccaag

SEQ ID NO: 9324 - DNA, 18 bp, Artificial Sequence
  Synthetic
gtgagccaccaaaatgca

SEQ ID NO: 9325 - DNA, 21 bp, Artificial Sequence
  Synthetic
gggaaagtcgtatttctgttt

SEQ ID NO: 9326 - DNA, 20 bp, Artificial Sequence
  Synthetic
atcttcccttctgttgccag

SEQ ID NO: 9327 - DNA, 22 bp, Artificial Sequence
  Synthetic
ccagtaagagaagaagaagagg

SEQ ID NO: 9328 - DNA, 21 bp, Artificial Sequence
  Synthetic
tgggagagtattggtagcttt

SEQ ID NO: 9329 - DNA, 20 bp, Artificial Sequence
  Synthetic
cgttgttgaaggtgtttggg

SEQ ID NO: 9330 - DNA, 23 bp, Artificial Sequence
  Synthetic
ttgtaaatccagcttttaatggt

SEQ ID NO: 9331 - DNA, 19 bp, Artificial Sequence
  Synthetic
tttacaaatcccgcctttg

SEQ ID NO: 9332 - DNA, 18 bp, Artificial Sequence
  Synthetic
ggttggcactactggtca

SEQ ID NO: 9333 - DNA, 19 bp, Artificial Sequence
  Synthetic
ggacatgtgcgatattggg

SEQ ID NO: 9334 - DNA, 24 bp, Artificial Sequence
  Synthetic
tttagaacctgataacaatacacc

SEQ ID NO: 9335 - DNA, 18 bp, Artificial Sequence
  Synthetic
tacccccctctgaaaagc

SEQ ID NO: 9336 - DNA, 24 bp, Artificial Sequence
  Synthetic
ctaggtaagtacagtaaccgttat

SEQ ID NO: 9337 - DNA, 20 bp, Artificial Sequence
  Synthetic
ttaaggctcctggcatcact

SEQ ID NO: 9338 - DNA, 20 bp, Artificial Sequence
  Synthetic
tgccttgaaattggtgccca

SEQ ID NO: 9339 - DNA, 20 bp, Artificial Sequence
  Synthetic
atgtcaccatctgatgtcgc

SEQ ID NO: 9340 - DNA, 18 bp, Artificial Sequence
  Synthetic
cctctcgtcattgagcgg

SEQ ID NO: 9341 - DNA, 18 bp, Artificial Sequence
  Synthetic
ttgctgctcccgcctaat

SEQ ID NO: 9342 - DNA, 18 bp, Artificial Sequence
  Synthetic
ggccgtcagttggagttc

SEQ ID NO: 9343 - DNA, 19 bp, Artificial Sequence
  Synthetic
gaggcctatgaggggtctg

SEQ ID NO: 9344 - DNA, 19 bp, Artificial Sequence
  Synthetic
agactaatggcccagagcg

SEQ ID NO: 9345 - DNA, 16 bp, Artificial Sequence
  Synthetic
tggtgagccggctcct

SEQ ID NO: 9346 - DNA, 18 bp, Artificial Sequence
  Synthetic
cttttgtgatgcgcgacg

SEQ ID NO: 9347 - DNA, 18 bp, Artificial Sequence
  Synthetic
gcttgctgccagatggtt

SEQ ID NO: 9348 - DNA, 17 bp, Artificial Sequence
  Synthetic
ttgcgtaatgcctggcg

SEQ ID NO: 9349 - DNA, 18 bp, Artificial Sequence
  Synthetic
atgtgacccatcgctgcc

SEQ ID NO: 9350 - DNA, 18 bp, Artificial Sequence
  Synthetic
ccgagctcatgccattgt

SEQ ID NO: 9351 - DNA, 18 bp, Artificial Sequence
  Synthetic
gccattggccacgtacag

SEQ ID NO: 9352 - DNA, 20 bp, Artificial Sequence
  Synthetic
ttgtatgcaggtgttgtggt

SEQ ID NO: 9353 - DNA, 16 bp, Artificial Sequence
  Synthetic
ccttcgcccccgatgt

SEQ ID NO: 9354 - DNA, 16 bp, Artificial Sequence
  Synthetic
ccctcgggctgttgga

SEQ ID NO: 9355 - DNA, 19 bp, Artificial Sequence
  Synthetic
ccccttttctgtcctccga

SEQ ID NO: 9356 - DNA, 20 bp, Artificial Sequence
  Synthetic
aggtactactaaagccgggt

SEQ ID NO: 9357 - DNA, 18 bp, Artificial Sequence
  Synthetic
ttcagagggtccaaatcg

SEQ ID NO: 9358 - DNA, 19 bp, Artificial Sequence
  Synthetic
catcgccggttttacaaag

SEQ ID NO: 9359 - DNA, 23 bp, Artificial Sequence
  Synthetic
ccttagcgtgtgtaaatatctca

SEQ ID NO: 9360 - DNA, 19 bp, Artificial Sequence
  Synthetic
tacattaccaagcgaaggt

SEQ ID NO: 9361 - DNA, 21 bp, Artificial Sequence
  Synthetic
cccgaattttttttattgcct

SEQ ID NO: 9362 - DNA, 19 bp, Artificial Sequence
  Synthetic
tcttacaaacaatcccccg

SEQ ID NO: 9363 - DNA, 21 bp, Artificial Sequence
  Synthetic
agttcgacatacagtagatgc

SEQ ID NO: 9364 - DNA, 21 bp, Artificial Sequence
  Synthetic
gcaaaactggtgatacttagt

SEQ ID NO: 9365 - DNA, 22 bp, Artificial Sequence
  Synthetic
gccgactaacaattatacttgt

SEQ ID NO: 9366 - DNA, 19 bp, Artificial Sequence
  Synthetic
acaacggaatctgatcgta

SEQ ID NO: 9367 - DNA, 21 bp, Artificial Sequence
  Synthetic
tgtgtaaaggtagacaactga

SEQ ID NO: 9368 - DNA, 20 bp, Artificial Sequence
  Synthetic
tcacctaaaaacctgactca

SEQ ID NO: 9369 - DNA, 16 bp, Artificial Sequence
  Synthetic
ccccgtggtgtccgaa

SEQ ID NO: 9370 - DNA, 18 bp, Artificial Sequence
  Synthetic
ctcgtccacaaagtcggc

SEQ ID NO: 9371 - DNA, 16 bp, Artificial Sequence
  Synthetic
gccgctctcacagcct

SEQ ID NO: 9372 - DNA, 17 bp, Artificial Sequence
  Synthetic
ggcagggccaaaaacgc

SEQ ID NO: 9373 - DNA, 20 bp, Artificial Sequence
  Synthetic
cgagagcgtcagtattaagc

SEQ ID NO: 9374 - DNA, 20 bp, Artificial Sequence
  Synthetic
ataaaagacaccaaggaagc

SEQ ID NO: 9375 - DNA, 22 bp, Artificial Sequence
  Synthetic
gccatgcaaatgttaaaagaga

SEQ ID NO: 9376 - DNA, 22 bp, Artificial Sequence
  Synthetic
tagaccggttctataaaactct

SEQ ID NO: 9377 - DNA, 25 bp, Artificial Sequence
  Synthetic
accatacctagtataaacaatgaga

SEQ ID NO: 9378 - DNA, 22 bp, Artificial Sequence
  Synthetic
ttcctttggatgggttatgaac

SEQ ID NO: 9379 - DNA, 25 bp, Artificial Sequence
  Synthetic
gagccatttaaaaatctgaaaacag

SEQ ID NO: 9380 - DNA, 25 bp, Artificial Sequence
  Synthetic
gaacaagtagataaattagtcagtg

SEQ ID NO: 9381 - DNA, 21 bp, Artificial Sequence
  Synthetic
tatcctggtagcagttcatgt

SEQ ID NO: 9382 - DNA, 25 bp, Artificial Sequence
  Synthetic
gtaaaacaccatatgtatgtttcag

SEQ ID NO: 9383 - DNA, 25 bp, Artificial Sequence
  Synthetic
attactttgactgtttttcagactc

SEQ ID NO: 9384 - DNA, 20 bp, Artificial Sequence
  Synthetic
ttttcctaggatttggctcc

SEQ ID NO: 9385 - DNA, 18 bp, Artificial Sequence
  Synthetic
catgctccttgggatgtt

SEQ ID NO: 9386 - DNA, 23 bp, Artificial Sequence
  Synthetic
ctggttttgcgattctaaaatgt

SEQ ID NO: 9387 - DNA, 22 bp, Artificial Sequence
  Synthetic
taaacatgtggcagaaagtagg

SEQ ID NO: 9388 - DNA, 18 bp, Artificial Sequence
  Synthetic
gcaggaagcactatgggc

SEQ ID NO: 9389 - DNA, 19 bp, Artificial Sequence
  Synthetic
aagatgggtggcaagtggt

SEQ ID NO: 9390 - DNA, 19 bp, Artificial Sequence
  Synthetic
gagtggaggtttgacagcc

SEQ ID NO: 9391 - DNA, 16 bp, Artificial Sequence
  Synthetic
acgcctgggggatgct

SEQ ID NO: 9392 - DNA, 16 bp, Artificial Sequence
  Synthetic
tggctacgtacgcgct

SEQ ID NO: 9393 - DNA, 16 bp, Artificial Sequence
  Synthetic
gcagggccacggacat

SEQ ID NO: 9394 - DNA, 16 bp, Artificial Sequence
  Synthetic
gcggtggtctcaggct

SEQ ID NO: 9395 - DNA, 17 bp, Artificial Sequence
  Synthetic
cgcgacaggaaccggta

SEQ ID NO: 9396 - DNA, 19 bp, Artificial Sequence
  Synthetic
gtgagcacggggagggtaa

SEQ ID NO: 9397 - DNA, 16 bp, Artificial Sequence
  Synthetic
tcagaaacgcccccga

SEQ ID NO: 9398 - DNA, 19 bp, Artificial Sequence
  Synthetic
gccaacagtttccagcacc

SEQ ID NO: 9399 - DNA, 18 bp, Artificial Sequence
  Synthetic
ggctctccttgtttcgcc

SEQ ID NO: 9400 - DNA, 16 bp, Artificial Sequence
  Synthetic
ctccgcagctgccact

SEQ ID NO: 9401 - DNA, 18 bp, Artificial Sequence
  Synthetic
agggtaatggcgctgacg

SEQ ID NO: 9402 - DNA, 16 bp, Artificial Sequence
  Synthetic
gtcggccacgcgctta

SEQ ID NO: 9403 - DNA, 16 bp, Artificial Sequence
  Synthetic
cggccatggtgctgca

SEQ ID NO: 9404 - DNA, 17 bp, Artificial Sequence
  Synthetic
ccacgtggttgagcagc

SEQ ID NO: 9405 - DNA, 16 bp, Artificial Sequence
  Synthetic
gtgcggcggatcgaag

SEQ ID NO: 9406 - DNA, 20 bp, Artificial Sequence
  Synthetic
tgtccacgacgtcaaattcg

SEQ ID NO: 9407 - DNA, 16 bp, Artificial Sequence
  Synthetic
ctcggggccacgtaca

SEQ ID NO: 9408 - DNA, 16 bp, Artificial Sequence
  Synthetic
tgtcgtacgcggggaa

SEQ ID NO: 9409 - DNA, 16 bp, Artificial Sequence
  Synthetic
aggtcgctcgctgtcg

SEQ ID NO: 9410 - DNA, 17 bp, Artificial Sequence
  Synthetic
cccaacgcaacgcctac

SEQ ID NO: 9411 - DNA, 17 bp, Artificial Sequence
  Synthetic
gctggtttggctcgtcc

SEQ ID NO: 9412 - DNA, 18 bp, Artificial Sequence
  Synthetic
cgcaccaaaagcagaggg

SEQ ID NO: 9413 - DNA, 20 bp, Artificial Sequence
  Synthetic
atggtaaacgcaaagcctcc

SEQ ID NO: 9414 - DNA, 16 bp, Artificial Sequence
  Synthetic
gccgggttgaacagcc

SEQ ID NO: 9415 - DNA, 17 bp, Artificial Sequence
  Synthetic
gagcggccattgggttc

SEQ ID NO: 9416 - DNA, 16 bp, Artificial Sequence
  Synthetic
gcaggtggcggtgaga

SEQ ID NO: 9417 - DNA, 16 bp, Artificial Sequence
  Synthetic
ggacgaaggcgcggat

SEQ ID NO: 9418 - DNA, 20 bp, Artificial Sequence
  Synthetic
tcaaagaacgtggtgttggg

SEQ ID NO: 9419 - DNA, 19 bp, Artificial Sequence
  Synthetic
gaccttcatgaccgcgctg

SEQ ID NO: 9420 - DNA, 19 bp, Artificial Sequence
  Synthetic
aacaccattacggccctgg

SEQ ID NO: 9421 - DNA, 17 bp, Artificial Sequence
  Synthetic
ccttgatctcgtggcgc

SEQ ID NO: 9422 - DNA, 18 bp, Artificial Sequence
  Synthetic
ttgaaactcgctgacggc

SEQ ID NO: 9423 - DNA, 16 bp, Artificial Sequence
  Synthetic
tcgcgccgtagtccag

SEQ ID NO: 9424 - DNA, 16 bp, Artificial Sequence
  Synthetic
ggcggcgtctgggttt

SEQ ID NO: 9425 - DNA, 18 bp, Artificial Sequence
  Synthetic
ggggtttgtcaccttcgg

SEQ ID NO: 9426 - DNA, 19 bp, Artificial Sequence
  Synthetic
aagtggtggtccatgacgt

SEQ ID NO: 9427 - DNA, 17 bp, Artificial Sequence
  Synthetic
gagtacgtcctgcggct

SEQ ID NO: 9428 - DNA, 18 bp, Artificial Sequence
  Synthetic
ggactgtccctcggagac

SEQ ID NO: 9429 - DNA, 16 bp, Artificial Sequence
  Synthetic
cgggcggtctgggtta

SEQ ID NO: 9430 - DNA, 16 bp, Artificial Sequence
  Synthetic
actacgcgctcgctga

SEQ ID NO: 9431 - DNA, 16 bp, Artificial Sequence
  Synthetic
ggcatcgggctgtgca

SEQ ID NO: 9432 - DNA, 19 bp, Artificial Sequence
  Synthetic
atgatcgacagcacgctac

SEQ ID NO: 9433 - DNA, 16 bp, Artificial Sequence
  Synthetic
ctgcgcgctgtaagca

SEQ ID NO: 9434 - DNA, 18 bp, Artificial Sequence
  Synthetic
ctcccagtgccccgacat

SEQ ID NO: 9435 - DNA, 20 bp, Artificial Sequence
  Synthetic
ttgacgtatctgtgctccac

SEQ ID NO: 9436 - DNA, 18 bp, Artificial Sequence
  Synthetic
ggggatcggagtggctgt

SEQ ID NO: 9437 - DNA, 18 bp, Artificial Sequence
  Synthetic
gacccacccgttgatcgc

SEQ ID NO: 9438 - DNA, 16 bp, Artificial Sequence
  Synthetic
gcccagggcgatcctt

SEQ ID NO: 9439 - DNA, 16 bp, Artificial Sequence
  Synthetic
ggcgatggggacggaa

SEQ ID NO: 9440 - DNA, 17 bp, Artificial Sequence
  Synthetic
cggactccgtcgtgtgt

SEQ ID NO: 9441 - DNA, 18 bp, Artificial Sequence
  Synthetic
ttccactttcacgccccg

SEQ ID NO: 9442 - DNA, 19 bp, Artificial Sequence
  Synthetic
gaaccaaagcctctcgtgt

SEQ ID NO: 9443 - DNA, 17 bp, Artificial Sequence
  Synthetic
tgcttggaggccctctg

SEQ ID NO: 9444 - DNA, 20 bp, Artificial Sequence
  Synthetic
cgtgttcttgcaatacccct

SEQ ID NO: 9445 - DNA, 18 bp, Artificial Sequence
  Synthetic
catgacaacgacgcccct

SEQ ID NO: 9446 - DNA, 18 bp, Artificial Sequence
  Synthetic
gtcatccctgcatgcgtg

SEQ ID NO: 9447 - DNA, 17 bp, Artificial Sequence
  Synthetic
ggggtggtggtagtggt

SEQ ID NO: 9448 - DNA, 18 bp, Artificial Sequence
  Synthetic
cggtcacgcccactatca

SEQ ID NO: 9449 - DNA, 19 bp, Artificial Sequence
  Synthetic
gggctcatcgggaatctcg

SEQ ID NO: 9450 - DNA, 16 bp, Artificial Sequence
  Synthetic
ccgggtttcgtggcct

SEQ ID NO: 9451 - DNA, 17 bp, Artificial Sequence
  Synthetic
cctgctagttgtcgcgg

SEQ ID NO: 9452 - DNA, 16 bp, Artificial Sequence
  Synthetic
ttccagccccccagca

SEQ ID NO: 9453 - DNA, 17 bp, Artificial Sequence
  Synthetic
gcaacgcgcgactatgc

SEQ ID NO: 9454 - DNA, 17 bp, Artificial Sequence
  Synthetic
ggtcacaccctaagcgc

SEQ ID NO: 9455 - DNA, 20 bp, Artificial Sequence
  Synthetic
tttacgctttcgaccagagc

SEQ ID NO: 9456 - DNA, 19 bp, Artificial Sequence
  Synthetic
tctgtgcatagaattggcg

SEQ ID NO: 9457 - DNA, 18 bp, Artificial Sequence
  Synthetic
tccccacacccaggagaa

SEQ ID NO: 9458 - DNA, 18 bp, Artificial Sequence
  Synthetic
accaggccattcaaaagc

SEQ ID NO: 9459 - DNA, 18 bp, Artificial Sequence
  Synthetic
aaggacacgaaacatgcc

SEQ ID NO: 9460 - DNA, 24 bp, Artificial Sequence
  Synthetic
gtgaagaattgtagcataatggtt

SEQ ID NO: 9461 - DNA, 22 bp, Artificial Sequence
  Synthetic
caaatcatattttgccaatggt

SEQ ID NO: 9462 - DNA, 24 bp, Artificial Sequence
  Synthetic
cgtctcggacatttaagaaattag

SEQ ID NO: 9463 - DNA, 19 bp, Artificial Sequence
  Synthetic
ctgtcacctaccggctagg

SEQ ID NO: 9464 - DNA, 23 bp, Artificial Sequence
  Synthetic
agagaaaagttcctcaaatctgt

SEQ ID NO: 9465 - DNA, 20 bp, Artificial Sequence
  Synthetic
tgtaggggttttctttggcg

SEQ ID NO: 9466 - DNA, 18 bp, Artificial Sequence
  Synthetic
ctgaaagcggtggcacat

SEQ ID NO: 9467 - DNA, 20 bp, Artificial Sequence
  Synthetic
ttgaggatgatctgcagcag

SEQ ID NO: 9468 - DNA, 23 bp, Artificial Sequence
  Synthetic
ctattgagccaattgatgcaatt

SEQ ID NO: 9469 - DNA, 22 bp, Artificial Sequence
  Synthetic
agattttacttaccccctcaac

SEQ ID NO: 9470 - DNA, 18 bp, Artificial Sequence
  Synthetic
ctggtctggggtattcgt

SEQ ID NO: 9471 - DNA, 18 bp, Artificial Sequence
  Synthetic
aaaaccctccactgacca

SEQ ID NO: 9472 - DNA, 18 bp, Artificial Sequence
  Synthetic
ttgacactaccaggggaa

SEQ ID NO: 9473 - DNA, 21 bp, Artificial Sequence
  Synthetic
gtacatactgtccattgcaac

SEQ ID NO: 9474 - DNA, 18 bp, Artificial Sequence
  Synthetic
tccccaaacccaaagcgt

SEQ ID NO: 9475 - DNA, 25 bp, Artificial Sequence
  Synthetic
cctactttaggtgacataattttgg

SEQ ID NO: 9476 - DNA, 19 bp, Artificial Sequence
  Synthetic
agaggagtgtaacagagct

SEQ ID NO: 9477 - DNA, 20 bp, Artificial Sequence
  Synthetic
ctgataccagaagaagacca

SEQ ID NO: 9478 - DNA, 24 bp, Artificial Sequence
  Synthetic
atagagctagtagaaataaacgag

SEQ ID NO: 9479 - DNA, 23 bp, Artificial Sequence
  Synthetic
aagaacacgtgacttatacagac

SEQ ID NO: 9480 - DNA, 18 bp, Artificial Sequence
  Synthetic
tgtcagcagaattggcac

SEQ ID NO: 9481 - DNA, 20 bp, Artificial Sequence
  Synthetic
tttacagatggctttctggc

SEQ ID NO: 9482 - DNA, 23 bp, Artificial Sequence
  Synthetic
ccagatccaaataagtttgcttt

SEQ ID NO: 9483 - DNA, 23 bp, Artificial Sequence
  Synthetic
attgtaaatactttcgtgtgtct

SEQ ID NO: 9484 - DNA, 20 bp, Artificial Sequence
  Synthetic
taattcgttgctatggttgc

SEQ ID NO: 9485 - DNA, 18 bp, Artificial Sequence
  Synthetic
cctgaagaggaggagcaa

SEQ ID NO: 9486 - DNA, 20 bp, Artificial Sequence
  Synthetic
tatgttgtgactgaagctga

SEQ ID NO: 9487 - DNA, 21 bp, Artificial Sequence
  Synthetic
gtgaaggaaagagcaaaagac

SEQ ID NO: 9488 - DNA, 24 bp, Artificial Sequence
  Synthetic
taaacgttcaatgtctaatgtagc

SEQ ID NO: 9489 - DNA, 22 bp, Artificial Sequence
  Synthetic
gaaacattggtgtatttgcgta

SEQ ID NO: 9490 - DNA, 20 bp, Artificial Sequence
  Synthetic
ctagctacaccaaacggacc

SEQ ID NO: 9491 - DNA, 20 bp, Artificial Sequence
  Synthetic
agacgatcagtttcccctga

SEQ ID NO: 9492 - DNA, 23 bp, Artificial Sequence
  Synthetic
agttctgttaatcaaagaaacca

SEQ ID NO: 9493 - DNA, 25 bp, Artificial Sequence
  Synthetic
agtattatatacttaggtgggttgg

SEQ ID NO: 9494 - DNA, 18 bp, Artificial Sequence
  Synthetic
ggaacccgctattgtacc

SEQ ID NO: 9495 - DNA, 21 bp, Artificial Sequence
  Synthetic
actttcataaggacttctgca

SEQ ID NO: 9496 - DNA, 18 bp, Artificial Sequence
  Synthetic
ccatcacgtgctgttcaa

SEQ ID NO: 9497 - DNA, 20 bp, Artificial Sequence
  Synthetic
tatgatttaagccccatcgc

SEQ ID NO: 9498 - DNA, 19 bp, Artificial Sequence
  Synthetic
atcatgagcgtcttgtttg

SEQ ID NO: 9499 - DNA, 18 bp, Artificial Sequence
  Synthetic
cgaggaccagcaaaatgg

SEQ ID NO: 9500 - DNA, 22 bp, Artificial Sequence
  Synthetic
ttatgagctgtttacatcttgt

SEQ ID NO: 9501 - DNA, 19 bp, Artificial Sequence
  Synthetic
ttttggtacattgttggcg

SEQ ID NO: 9502 - DNA, 23 bp, Artificial Sequence
  Synthetic
tgtcttttctattgacaatagca

SEQ ID NO: 9503 - DNA, 21 bp, Artificial Sequence
  Synthetic
gaggaccattaggaaaaactc

SEQ ID NO: 9504 - DNA, 24 bp, Artificial Sequence
  Synthetic
caaaagaaaaaattcaccttgagc

SEQ ID NO: 9505 - DNA, 24 bp, Artificial Sequence
  Synthetic
caatgtattttcttggagtaaggc

SEQ ID NO: 9506 - DNA, 18 bp, Artificial Sequence
  Synthetic
cgtgttgtgtcccttgtt

SEQ ID NO: 9507 - DNA, 18 bp, Artificial Sequence
  Synthetic
aatgattgggaaggagcc

SEQ ID NO: 9508 - DNA, 21 bp, Artificial Sequence
  Synthetic
cagaggattgtaacacagcta

SEQ ID NO: 9509 - DNA, 23 bp, Artificial Sequence
  Synthetic
atcatttctcattgcattgaaac

SEQ ID NO: 9510 - DNA, 23 bp, Artificial Sequence
  Synthetic
cagttaaacctggtcttagaaga

SEQ ID NO: 9511 - DNA, 19 bp, Artificial Sequence
  Synthetic
actacaagaggcggtcagc

SEQ ID NO: 9512 - DNA, 18 bp, Artificial Sequence
  Synthetic
taaacgtgacactgctga

SEQ ID NO: 9513 - DNA, 23 bp, Artificial Sequence
  Synthetic
aatgaaacagcaatcttagacat

SEQ ID NO: 9514 - DNA, 18 bp, Artificial Sequence
  Synthetic
aaagatttcttgggcggg

SEQ ID NO: 9515 - DNA, 18 bp, Artificial Sequence
  Synthetic
tgggaacaaaaggagcga

SEQ ID NO: 9516 - DNA, 18 bp, Artificial Sequence
  Synthetic
gcaaacgcaaacgcaata

SEQ ID NO: 9517 - DNA, 18 bp, Artificial Sequence
  Synthetic
tcctaaggtgtctgcatg

SEQ ID NO: 9518 - DNA, 18 bp, Artificial Sequence
  Synthetic
cattcctgcagatggtga

SEQ ID NO: 9519 - DNA, 23 bp, Artificial Sequence
  Synthetic
cagacttccttaaaatggacaaa

SEQ ID NO: 9520 - DNA, 23 bp, Artificial Sequence
  Synthetic
gctcacttaaatgttatgaatcc

SEQ ID NO: 9521 - DNA, 20 bp, Artificial Sequence
  Synthetic
actcgaccttataagtgtgg

SEQ ID NO: 9522 - DNA, 20 bp, Artificial Sequence
  Synthetic
gttgctgtacatgttttgct

SEQ ID NO: 9523 - DNA, 18 bp, Artificial Sequence
  Synthetic
tcgcctgatattgaagca

SEQ ID NO: 9524 - DNA, 19 bp, Artificial Sequence
  Synthetic
gaagaagcagactgtgtgg

SEQ ID NO: 9525 - DNA, 24 bp, Artificial Sequence
  Synthetic
gtccaagaaaagattatttgagga

SEQ ID NO: 9526 - DNA, 18 bp, Artificial Sequence
  Synthetic
gagagacccagagccaaa

SEQ ID NO: 9527 - DNA, 25 bp, Artificial Sequence
  Synthetic
acaaatatttgggagtatactgtac

SEQ ID NO: 9528 - DNA, 19 bp, Artificial Sequence
  Synthetic
caggtgatgttgtgggttt

SEQ ID NO: 9529 - DNA, 25 bp, Artificial Sequence
  Synthetic
cagccaactaatatatatttttgcg

SEQ ID NO: 9530 - DNA, 24 bp, Artificial Sequence
  Synthetic
tccattaggaataggtattagtgg

SEQ ID NO: 9531 - DNA, 23 bp, Artificial Sequence
  Synthetic
ggaaaccctaaatctgaaaaagc

SEQ ID NO: 9532 - DNA, 25 bp, Artificial Sequence
  Synthetic
tcttgtacttgaatatcttttaggc

SEQ ID NO: 9533 - DNA, 21 bp, Artificial Sequence
  Synthetic
aggggtacttttccaaaatgt

SEQ ID NO: 9534 - DNA, 18 bp, Artificial Sequence
  Synthetic
ctcctacaatgacgccag

SEQ ID NO: 9535 - DNA, 22 bp, Artificial Sequence
  Synthetic
gcatttgttttgtattgcagaa

SEQ ID NO: 9536 - DNA, 20 bp, Artificial Sequence
  Synthetic
gcgttcgatcaggtggattt

SEQ ID NO: 9537 - DNA, 22 bp, Artificial Sequence
  Synthetic
ctggacaatctttttcaatgga

SEQ ID NO: 9538 - DNA, 25 bp, Artificial Sequence
  Synthetic
ttacacattagatagcaaaacatgg

SEQ ID NO: 9539 - DNA, 25 bp, Artificial Sequence
  Synthetic
gtttcagttaaatacaagtacacac

SEQ ID NO: 9540 - DNA, 21 bp, Artificial Sequence
  Synthetic
tccaatagctccacttaatgc

SEQ ID NO: 9541 - DNA, 24 bp, Artificial Sequence
  Synthetic
aacacaggaacaaatgataatgtc

SEQ ID NO: 9542 - DNA, 19 bp, Artificial Sequence
  Synthetic
tttagcatacactccccct

SEQ ID NO: 9543 - DNA, 22 bp, Artificial Sequence
  Synthetic
gcatttcaatggttcagaaaca

SEQ ID NO: 9544 - DNA, 22 bp, Artificial Sequence
  Synthetic
tattccagcaatctaacagtcc

SEQ ID NO: 9545 - DNA, 22 bp, Artificial Sequence
  Synthetic
cattcagagtggttaatgaaca

SEQ ID NO: 9546 - DNA, 20 bp, Artificial Sequence
  Synthetic
ttagtagccccttacccaaa

SEQ ID NO: 9547 - DNA, 18 bp, Artificial Sequence
  Synthetic
ggagactgtggtgggata

SEQ ID NO: 9548 - DNA, 25 bp, Artificial Sequence
  Synthetic
actcatagaatggatcaaaaacaag

SEQ ID NO: 9549 - DNA, 25 bp, Artificial Sequence
  Synthetic
aattacatgcagtttaagagtaagc

SEQ ID NO: 9550 - DNA, 23 bp, Artificial Sequence
  Synthetic
tggctagtttagacaataaagga

SEQ ID NO: 9551 - DNA, 25 bp, Artificial Sequence
  Synthetic
cttactcaggaaaaatatactcaca

SEQ ID NO: 9552 - DNA, 21 bp, Artificial Sequence
  Synthetic
catatcagaggatttggaagg

SEQ ID NO: 9553 - DNA, 22 bp, Artificial Sequence
  Synthetic
agcaatactttgtggagaaaca

SEQ ID NO: 9554 - DNA, 22 bp, Artificial Sequence
  Synthetic
aggtactgatccaaaatggaag

SEQ ID NO: 9555 - DNA, 21 bp, Artificial Sequence
  Synthetic
aagctgtctcaaatgtccaaa

SEQ ID NO: 9556 - DNA, 18 bp, Artificial Sequence
  Synthetic
gcatgcgaactgacagat

SEQ ID NO: 9557 - DNA, 25 bp, Artificial Sequence
  Synthetic
tgtatggtttcatcataaaaggaag

SEQ ID NO: 9558 - DNA, 19 bp, Artificial Sequence
  Synthetic
aatggggaatggagatgag

SEQ ID NO: 9559 - DNA, 25 bp, Artificial Sequence
  Synthetic
aaagaactaagagatttgatgtcac

SEQ ID NO: 9560 - DNA, 19 bp, Artificial Sequence
  Synthetic
aacagaaatggaccaacga

SEQ ID NO: 9561 - DNA, 18 bp, Artificial Sequence
  Synthetic
acgaagttggagccagaa

SEQ ID NO: 9562 - DNA, 23 bp, Artificial Sequence
  Synthetic
agaaatgatgatgttgatcagag

SEQ ID NO: 9563 - DNA, 20 bp, Artificial Sequence
  Synthetic
aaagggaagaagaagtgctc

SEQ ID NO: 9564 - DNA, 21 bp, Artificial Sequence
  Synthetic
tttgaactttgtcaacagagc

SEQ ID NO: 9565 - DNA, 18 bp, Artificial Sequence
  Synthetic
ttcttgagggtccgagac

SEQ ID NO: 9566 - DNA, 19 bp, Artificial Sequence
  Synthetic
tattccaacagatgcgtga

SEQ ID NO: 9567 - DNA, 20 bp, Artificial Sequence
  Synthetic
ctttgcatgatcttttggga

SEQ ID NO: 9568 - DNA, 24 bp, Artificial Sequence
  Synthetic
catggtttattgtaaatgaagcag

SEQ ID NO: 9569 - DNA, 21 bp, Artificial Sequence
  Synthetic
ggaagctgttaaaatttcacc

SEQ ID NO: 9570 - DNA, 20 bp, Artificial Sequence
  Synthetic
aacaaatctcccttcctgcc

SEQ ID NO: 9571 - DNA, 18 bp, Artificial Sequence
  Synthetic
agacagcggtggaatctc

SEQ ID NO: 9572 - DNA, 25 bp, Artificial Sequence
  Synthetic
ctcttgcagatattttattaaaggc

SEQ ID NO: 9573 - DNA, 21 bp, Artificial Sequence
  Synthetic
tgctgtaatagatgttcctgg

SEQ ID NO: 9574 - DNA, 23 bp, Artificial Sequence
  Synthetic
ctactataatagataacggggct

SEQ ID NO: 9575 - DNA, 24 bp, Artificial Sequence
  Synthetic
tgatgattatattgtaccgacgaa

SEQ ID NO: 9576 - DNA, 20 bp, Artificial Sequence
  Synthetic
tacagattgacagaggtggt

SEQ ID NO: 9577 - DNA, 18 bp, Artificial Sequence
  Synthetic
ggcgacactccaccatga

SEQ ID NO: 9578 - DNA, 20 bp, Artificial Sequence
  Synthetic
tgcaacatgagcacacttcc

SEQ ID NO: 9579 - DNA, 16 bp, Artificial Sequence
  Synthetic
tgtccacgctccagca

SEQ ID NO: 9580 - DNA, 18 bp, Artificial Sequence
  Synthetic
cacagaatggcgtgggac

SEQ ID NO: 9581 - DNA, 20 bp, Artificial Sequence
  Synthetic
caaactgggtttcttagcgc

SEQ ID NO: 9582 - DNA, 20 bp, Artificial Sequence
  Synthetic
acaactggggagaaaacgag

SEQ ID NO: 9583 - DNA, 20 bp, Artificial Sequence
  Synthetic
gaccgttgcgacttgtatga

SEQ ID NO: 9584 - DNA, 19 bp, Artificial Sequence
  Synthetic
tttggttgatgctgctcgt

SEQ ID NO: 9585 - DNA, 19 bp, Artificial Sequence
  Synthetic
cctctcagtgagtgggcga

SEQ ID NO: 9586 - DNA, 18 bp, Artificial Sequence
  Synthetic
gagggggaagtgcaggtt

SEQ ID NO: 9587 - DNA, 18 bp, Artificial Sequence
  Synthetic
ctcttcaggaggccccct

SEQ ID NO: 9588 - DNA, 19 bp, Artificial Sequence
  Synthetic
caggaccatcaccacaggg

SEQ ID NO: 9589 - DNA, 20 bp, Artificial Sequence
  Synthetic
agaaatgcgacgaactgtct

SEQ ID NO: 9590 - DNA, 18 bp, Artificial Sequence
  Synthetic
gtctcgagaagccaacgg

SEQ ID NO: 9591 - DNA, 18 bp, Artificial Sequence
  Synthetic
gtgtgtgccagagccaaa

SEQ ID NO: 9592 - DNA, 20 bp, Artificial Sequence
  Synthetic
ggtcctgtaccagcagtttg

SEQ ID NO: 9593 - DNA, 18 bp, Artificial Sequence
  Synthetic
cctcccagaccctgttgc

SEQ ID NO: 9594 - DNA, 19 bp, Artificial Sequence
  Synthetic
ctctgaaggcgctaaccag

SEQ ID NO: 9595 - DNA, 19 bp, Artificial Sequence
  Synthetic
ataggggagtttgggctgg

SEQ ID NO: 9596 - DNA, 18 bp, Artificial Sequence
  Synthetic
tcactgaggtggatggcg

SEQ ID NO: 9597 - DNA, 19 bp, Artificial Sequence
  Synthetic
caacatcacccgggttgag

SEQ ID NO: 9598 - DNA, 20 bp, Artificial Sequence
  Synthetic
cgagtctgctgtatcgcaag

SEQ ID NO: 9599 - DNA, 20 bp, Artificial Sequence
  Synthetic
atgccaccccaatacctacc

SEQ ID NO: 9600 - DNA, 20 bp, Artificial Sequence
  Synthetic
ttgccaactagaccctaccg

SEQ ID NO: 9601 - DNA, 18 bp, Artificial Sequence
  Synthetic
ccacagcccacatacgac

SEQ ID NO: 9602 - DNA, 19 bp, Artificial Sequence
  Synthetic
cactccactcgatctccct

SEQ ID NO: 9603 - DNA, 23 bp, Artificial Sequence
  Synthetic
tgattttcaaaaatgtctgacag

SEQ ID NO: 9604 - DNA, 19 bp, Artificial Sequence
  Synthetic
ggacagcaacttcaatgca

SEQ ID NO: 9605 - DNA, 18 bp, Artificial Sequence
  Synthetic
gcagcaagaagaaacggt

SEQ ID NO: 9606 - DNA, 22 bp, Artificial Sequence
  Synthetic
ttaagagcactagcaagaagag

SEQ ID NO: 9607 - DNA, 20 bp, Artificial Sequence
  Synthetic
caatagaggacaaggctcaa

SEQ ID NO: 9608 - DNA, 21 bp, Artificial Sequence
  Synthetic
aataaatttcaggtctggagc

SEQ ID NO: 9609 - DNA, 21 bp, Artificial Sequence
  Synthetic
atggatcctcagtttcctact

SEQ ID NO: 9610 - DNA, 25 bp, Artificial Sequence
  Synthetic
tgagtaatgaggaatcattagaaga

SEQ ID NO: 9611 - DNA, 18 bp, Artificial Sequence
  Synthetic
tgttgccgctttaagtcc

SEQ ID NO: 9612 - DNA, 25 bp, Artificial Sequence
  Synthetic
aatgtatgattatatctgaacctcc

SEQ ID NO: 9613 - DNA, 18 bp, Artificial Sequence
  Synthetic
gagagcagctctagatgg

SEQ ID NO: 9614 - DNA, 24 bp, Artificial Sequence
  Synthetic
gggaaactattagaaaagaaagtg

SEQ ID NO: 9615 - DNA, 21 bp, Artificial Sequence
  Synthetic
aagtggactataatgggctct

SEQ ID NO: 9616 - DNA, 22 bp, Artificial Sequence
  Synthetic
ccaaagacatagatcagttgaa

SEQ ID NO: 9617 - DNA, 18 bp, Artificial Sequence
  Synthetic
tgggtattggaaccggaa

SEQ ID NO: 9618 - DNA, 24 bp, Artificial Sequence
  Synthetic
tataggttcttttgaagagatacc

SEQ ID NO: 9619 - DNA, 21 bp, Artificial Sequence
  Synthetic
attaatgccacttggacagac

SEQ ID NO: 9620 - DNA, 25 bp, Artificial Sequence
  Synthetic
gagtttacaatacggatgaatatgt

SEQ ID NO: 9621 - DNA, 20 bp, Artificial Sequence
  Synthetic
gtgcaccactggatatcaat

SEQ ID NO: 9622 - DNA, 25 bp, Artificial Sequence
  Synthetic
accaggattataagtataaagctac

SEQ ID NO: 9623 - DNA, 21 bp, Artificial Sequence
  Synthetic
tggaacatagtactgtgaaca

SEQ ID NO: 9624 - DNA, 19 bp, Artificial Sequence
  Synthetic
gacgctttgtccaaaatgc

SEQ ID NO: 9625 - DNA, 19 bp, Artificial Sequence
  Synthetic
gcagatgcaacgattcaag

SEQ ID NO: 9626 - DNA, 19 bp, Artificial Sequence
  Synthetic
aggtaccaatggggaagag

SEQ ID NO: 9627 - DNA, 22 bp, Artificial Sequence
  Synthetic
tagaaaaacaaagtagagctgc

SEQ ID NO: 9628 - DNA, 20 bp, Artificial Sequence
  Synthetic
cgtggtccagattaagtttg

SEQ ID NO: 9629 - DNA, 25 bp, Artificial Sequence
  Synthetic
ctcacaatatagtaatgaaaagtgg

SEQ ID NO: 9630 - DNA, 25 bp, Artificial Sequence
  Synthetic
gtggaagaaactagttttattgatg

SEQ ID NO: 9631 - DNA, 19 bp, Artificial Sequence
  Synthetic
tacgaaaacgacgtaaacg

SEQ ID NO: 9632 - DNA, 20 bp, Artificial Sequence
  Synthetic
tacatttacctgaccccaat

SEQ ID NO: 9633 - DNA, 19 bp, Artificial Sequence
  Synthetic
ccacctataggggaacact

SEQ ID NO: 9634 - DNA, 20 bp, Artificial Sequence
  Synthetic
acgaagggaacaaatgtttg

SEQ ID NO: 9635 - DNA, 19 bp, Artificial Sequence
  Synthetic
ctccagcacctaaagaaga

SEQ ID NO: 9636 - DNA, 21 bp, Artificial Sequence
  Synthetic
ttttgtagcttcaaccgaatt

SEQ ID NO: 9637 - DNA, 23 bp, Artificial Sequence
  Synthetic
ataaaagcagacattttatgcac

SEQ ID NO: 9638 - DNA, 24 bp, Artificial Sequence
  Synthetic
accgttgtgtgatttgttaattag

SEQ ID NO: 9639 - DNA, 21 bp, Artificial Sequence
  Synthetic
caaccagagacaactgatctc

SEQ ID NO: 9640 - DNA, 19 bp, Artificial Sequence
  Synthetic
gaagactttgtgcgacagt

SEQ ID NO: 9641 - DNA, 18 bp, Artificial Sequence
  Synthetic
aacaatggcctggacagt

SEQ ID NO: 9642 - DNA, 19 bp, Artificial Sequence
  Synthetic
atctcctgacttggaagca

SEQ ID NO: 9643 - DNA, 18 bp, Artificial Sequence
  Synthetic
gactgactcaagctgggt

SEQ ID NO: 9644 - DNA, 25 bp, Artificial Sequence
  Synthetic
ggattcattataaaaggaagatctc

SEQ ID NO: 9645 - DNA, 19 bp, Artificial Sequence
  Synthetic
gccttcttcaatctctcca

SEQ ID NO: 9646 - DNA, 25 bp, Artificial Sequence
  Synthetic
gattcaatggataaggaagaaatgg

SEQ ID NO: 9647 - DNA, 21 bp, Artificial Sequence
  Synthetic
ttcgtgtattttgtagaagca

SEQ ID NO: 9648 - DNA, 21 bp, Artificial Sequence
  Synthetic
gaaatgtcttaagcattgctc

SEQ ID NO: 9649 - DNA, 23 bp, Artificial Sequence
  Synthetic
agtcttaggagtttcaattctga

SEQ ID NO: 9650 - DNA, 22 bp, Artificial Sequence
  Synthetic
ttcgtagctaacttcagtatgg

SEQ ID NO: 9651 - DNA, 19 bp, Artificial Sequence
  Synthetic
caggactgttggtttcaga

SEQ ID NO: 9652 - DNA, 21 bp, Artificial Sequence
  Synthetic
gttaacaactatcaggcgatt

SEQ ID NO: 9653 - DNA, 19 bp, Artificial Sequence
  Synthetic
ctggcgagataatttcgtg

SEQ ID NO: 9654 - DNA, 25 bp, Artificial Sequence
  Synthetic
gcagactctatataattaacaatgg

SEQ ID NO: 9655 - DNA, 18 bp, Artificial Sequence
  Synthetic
ctgctgttaggctcactg

SEQ ID NO: 9656 - DNA, 19 bp, Artificial Sequence
  Synthetic
ctgttccacttacaggagc

SEQ ID NO: 9657 - DNA, 18 bp, Artificial Sequence
  Synthetic
caggagcaggtagacatc

SEQ ID NO: 9658 - DNA, 22 bp, Artificial Sequence
  Synthetic
atttgatgaaaatggtcaaccg

SEQ ID NO: 9659 - DNA, 21 bp, Artificial Sequence
  Synthetic
ccgaaaaaagggaataatgcg

SEQ ID NO: 9660 - DNA, 16 bp, Artificial Sequence
  Synthetic
ccaacccagccaccca

SEQ ID NO: 9661 - DNA, 20 bp, Artificial Sequence
  Synthetic
tttagataaggtggtggtgc

SEQ ID NO: 9662 - DNA, 18 bp, Artificial Sequence
  Synthetic
cggcacctactactgatg

SEQ ID NO: 9663 - DNA, 19 bp, Artificial Sequence
  Synthetic
ctactgaaggtgagcttga

SEQ ID NO: 9664 - DNA, 20 bp, Artificial Sequence
  Synthetic
cagagccactataagtacca

SEQ ID NO: 9665 - DNA, 22 bp, Artificial Sequence
  Synthetic
atcctactgatcttgacattcc

SEQ ID NO: 9666 - DNA, 18 bp, Artificial Sequence
  Synthetic
cacccgctctatgaggtt

SEQ ID NO: 9667 - DNA, 22 bp, Artificial Sequence
  Synthetic
taataatacacatgcaactggt

SEQ ID NO: 9668 - DNA, 18 bp, Artificial Sequence
  Synthetic
cggagcagcttgatcaat

SEQ ID NO: 9669 - DNA, 19 bp, Artificial Sequence
  Synthetic
ggttacacacctgtacagt

SEQ ID NO: 9670 - DNA, 18 bp, Artificial Sequence
  Synthetic
cgtctcaaggcaccaaac

SEQ ID NO: 9671 - DNA, 18 bp, Artificial Sequence
  Synthetic
ctgcggtgaaaggagttg

SEQ ID NO: 9672 - DNA, 19 bp, Artificial Sequence
  Synthetic
cattttcctggcacggtca

SEQ ID NO: 9673 - DNA, 23 bp, Artificial Sequence
  Synthetic
gctgcatttgaagatttaagagt

SEQ ID NO: 9674 - DNA, 19 bp, Artificial Sequence
  Synthetic
tgggtgggctatatacagc

SEQ ID NO: 9675 - DNA, 18 bp, Artificial Sequence
  Synthetic
cttggtcagcaagtgcat

SEQ ID NO: 9676 - DNA, 21 bp, Artificial Sequence
  Synthetic
tcaatagagttgaatgcacct

SEQ ID NO: 9677 - DNA, 25 bp, Artificial Sequence
  Synthetic
agggattttcatataggtatggtaa

SEQ ID NO: 9678 - DNA, 18 bp, Artificial Sequence
  Synthetic
cgagtgggtatgcacaaa

SEQ ID NO: 9679 - DNA, 20 bp, Artificial Sequence
  Synthetic
tgcaaatcagaggattcgtg

SEQ ID NO: 9680 - DNA, 19 bp, Artificial Sequence
  Synthetic
caaggaaccaacctgaatg

SEQ ID NO: 9681 - DNA, 22 bp, Artificial Sequence
  Synthetic
gcatgttcaatatgctgagtac

SEQ ID NO: 9682 - DNA, 20 bp, Artificial Sequence
  Synthetic
gcttcttctaccgctatggg

SEQ ID NO: 9683 - DNA, 25 bp, Artificial Sequence
  Synthetic
tagtatataaaaaagggagtaaccg

SEQ ID NO: 9684 - DNA, 22 bp, Artificial Sequence
  Synthetic
ggtgtatagagacagtataccc

SEQ ID NO: 9685 - DNA, 18 bp, Artificial Sequence
  Synthetic
caacgacgcagagaaaca

SEQ ID NO: 9686 - DNA, 25 bp, Artificial Sequence
  Synthetic
tggtagattttattgatacacaagg

SEQ ID NO: 9687 - DNA, 21 bp, Artificial Sequence
  Synthetic
atatcagatagtggctatggc

SEQ ID NO: 9688 - DNA, 23 bp, Artificial Sequence
  Synthetic
cctttttaaaaagcaattgccaa

SEQ ID NO: 9689 - DNA, 23 bp, Artificial Sequence
  Synthetic
atagaccactatgaaaatgacag

SEQ ID NO: 9690 - DNA, 21 bp, Artificial Sequence
  Synthetic
ttaaaaaaggtggccaaacag

SEQ ID NO: 9691 - DNA, 19 bp, Artificial Sequence
  Synthetic
atgtgcagtaccagtgacg

SEQ ID NO: 9692 - DNA, 25 bp, Artificial Sequence
  Synthetic
ctacgcctataatacatttaaaagg

SEQ ID NO: 9693 - DNA, 23 bp, Artificial Sequence
  Synthetic
tattttgcttttgtgtatgcatg

SEQ ID NO: 9694 - DNA, 19 bp, Artificial Sequence
  Synthetic
tgagtttcttacacgtcca

SEQ ID NO: 9695 - DNA, 23 bp, Artificial Sequence
  Synthetic
accttccccagaatatattgaac

SEQ ID NO: 9696 - DNA, 18 bp, Artificial Sequence
  Synthetic
cgccacgtctaatgtttc

SEQ ID NO: 9697 - DNA, 25 bp, Artificial Sequence
  Synthetic
atcctgattatttacaaatgtctgc

SEQ ID NO: 9698 - DNA, 22 bp, Artificial Sequence
  Synthetic
tattggttacataaggcacagg

SEQ ID NO: 9699 - DNA, 19 bp, Artificial Sequence
  Synthetic
cgccctagtgagtaacaac

SEQ ID NO: 9700 - DNA, 18 bp, Artificial Sequence
  Synthetic
cgaaagcaggcaaaccat

SEQ ID NO: 9701 - DNA, 18 bp, Artificial Sequence
  Synthetic
ccaagtggttatgcccaa

SEQ ID NO: 9702 - DNA, 24 bp, Artificial Sequence
  Synthetic
aaataagggggtttgtatactttg

SEQ ID NO: 9703 - DNA, 25 bp, Artificial Sequence
  Synthetic
catgttcaatatgttaagcactgta

SEQ ID NO: 9704 - DNA, 24 bp, Artificial Sequence
  Synthetic
acaagttttttctatcgttatggg

SEQ ID NO: 9705 - DNA, 18 bp, Artificial Sequence
  Synthetic
cactcctggatccccaaa

SEQ ID NO: 9706 - DNA, 16 bp, Artificial Sequence
  Synthetic
ggtggaaggcccggaa

SEQ ID NO: 9707 - DNA, 19 bp, Artificial Sequence
  Synthetic
caacgccgcttaaaaccct

SEQ ID NO: 9708 - DNA, 20 bp, Artificial Sequence
  Synthetic
tgctggactctctacagacc

SEQ ID NO: 9709 - DNA, 19 bp, Artificial Sequence
  Synthetic
caacgcctcaatgttggct

SEQ ID NO: 9710 - DNA, 16 bp, Artificial Sequence
  Synthetic
ctgtggcgtgacggtg

SEQ ID NO: 9711 - DNA, 18 bp, Artificial Sequence
  Synthetic
ggggtggaaagcaaggtg

SEQ ID NO: 9712 - DNA, 20 bp, Artificial Sequence
  Synthetic
gtgtaattggccaacagtgc

SEQ ID NO: 9713 - DNA, 18 bp, Artificial Sequence
  Synthetic
atcatggggttggaccgt

SEQ ID NO: 9714 - DNA, 19 bp, Artificial Sequence
  Synthetic
gcacaggagtcttggttcg

SEQ ID NO: 9715 - DNA, 20 bp, Artificial Sequence
  Synthetic
aagcttaggtggtatcgcac

SEQ ID NO: 9716 - DNA, 19 bp, Artificial Sequence
  Synthetic
tttgagcacgctggacatg

SEQ ID NO: 9717 - DNA, 20 bp, Artificial Sequence
  Synthetic
ccatgggcacttgtgtgaat

SEQ ID NO: 9718 - DNA, 18 bp, Artificial Sequence
  Synthetic
ggtcgtctggctctccga

SEQ ID NO: 9719 - DNA, 20 bp, Artificial Sequence
  Synthetic
atcccagaaagtacctccgc

SEQ ID NO: 9720 - DNA, 20 bp, Artificial Sequence
  Synthetic
ttatggacacaggttgccag

SEQ ID NO: 9721 - DNA, 17 bp, Artificial Sequence
  Synthetic
gccagcaccagcagagt

SEQ ID NO: 9722 - DNA, 16 bp, Artificial Sequence
  Synthetic
ggtgtccagcggcaga

SEQ ID NO: 9723 - DNA, 19 bp, Artificial Sequence
  Synthetic
caaccccctgttgtaccag

SEQ ID NO: 9724 - DNA, 18 bp, Artificial Sequence
  Synthetic
ccagacgtgggaggccat

SEQ ID NO: 9725 - DNA, 18 bp, Artificial Sequence
  Synthetic
taacgcggcctctctcac

SEQ ID NO: 9726 - DNA, 20 bp, Artificial Sequence
  Synthetic
gtactgtgggacctccttga

SEQ ID NO: 9727 - DNA, 18 bp, Artificial Sequence
  Synthetic
ctcctcggggtcccaaga

SEQ ID NO: 9728 - DNA, 18 bp, Artificial Sequence
  Synthetic
gctgagcttcagtgtgcg

SEQ ID NO: 9729 - DNA, 20 bp, Artificial Sequence
  Synthetic
tatgacccagaagaccacct

SEQ ID NO: 9730 - DNA, 18 bp, Artificial Sequence
  Synthetic
tgggcagcgcttatctgt

SEQ ID NO: 9731 - DNA, 20 bp, Artificial Sequence
  Synthetic
catctatgagaacgacggca

SEQ ID NO: 9732 - DNA, 19 bp, Artificial Sequence
  Synthetic
gctctcgggaccatcttga

SEQ ID NO: 9733 - DNA, 20 bp, Artificial Sequence
  Synthetic
caccaacagaaactgacaga

SEQ ID NO: 9734 - DNA, 24 bp, Artificial Sequence
  Synthetic
tattgatatcaggtgtcaaacttg

SEQ ID NO: 9735 - DNA, 25 bp, Artificial Sequence
  Synthetic
tgtagtgatgtagaaaatgatttgg

SEQ ID NO: 9736 - DNA, 21 bp, Artificial Sequence
  Synthetic
gctgaagatgttactcctgag

SEQ ID NO: 9737 - DNA, 21 bp, Artificial Sequence
  Synthetic
gttgtctctgtatatgcagtg

SEQ ID NO: 9738 - DNA, 22 bp, Artificial Sequence
  Synthetic
gcccaacaaactatattaggtc

SEQ ID NO: 9739 - DNA, 24 bp, Artificial Sequence
  Synthetic
gcattaaaagaattcctacactca

SEQ ID NO: 9740 - DNA, 23 bp, Artificial Sequence
  Synthetic
tttgaatttccaaatccttttcc

SEQ ID NO: 9741 - DNA, 20 bp, Artificial Sequence
  Synthetic
actgtgtttgctcctgtcac

SEQ ID NO: 9742 - DNA, 18 bp, Artificial Sequence
  Synthetic
cacgtcgctcaccaagac

SEQ ID NO: 9743 - DNA, 18 bp, Artificial Sequence
  Synthetic
tctctcctggtgaagtgg

SEQ ID NO: 9744 - DNA, 25 bp, Artificial Sequence
  Synthetic
cattagcttttcttcctatactcaa

SEQ ID NO: 9745 - DNA, 19 bp, Artificial Sequence
  Synthetic
agttaaccccgtggaacct

SEQ ID NO: 9746 - DNA, 23 bp, Artificial Sequence
  Synthetic
caatccattgtttctaactcaac

SEQ ID NO: 9747 - DNA, 24 bp, Artificial Sequence
  Synthetic
ggtttgaaactacaagaaatggtt

SEQ ID NO: 9748 - DNA, 18 bp, Artificial Sequence
  Synthetic
tacggagtactggtcacc

SEQ ID NO: 9749 - DNA, 18 bp, Artificial Sequence
  Synthetic
gatgacattccacgtgca

SEQ ID NO: 9750 - DNA, 25 bp, Artificial Sequence
  Synthetic
tttagatcaatattccttaggcaga

SEQ ID NO: 9751 - DNA, 23 bp, Artificial Sequence
  Synthetic
ggctctgtttctataactattgc

SEQ ID NO: 9752 - DNA, 18 bp, Artificial Sequence
  Synthetic
ggtcaaaaccgcaatgtc

SEQ ID NO: 9753 - DNA, 18 bp, Artificial Sequence
  Synthetic
ggaaccaaacaagtgtgc

SEQ ID NO: 9754 - DNA, 25 bp, Artificial Sequence
  Synthetic
attcattagagaagggaaaattgtc

SEQ ID NO: 9755 - DNA, 19 bp, Artificial Sequence
  Synthetic
taataacgagagagggggc

SEQ ID NO: 9756 - DNA, 18 bp, Artificial Sequence
  Synthetic
ggcagaagcacagcattt

SEQ ID NO: 9757 - DNA, 21 bp, Artificial Sequence
  Synthetic
ccaaaagaaacaaaccccaac

SEQ ID NO: 9758 - DNA, 20 bp, Artificial Sequence
  Synthetic
gtgatgcagatgtcaaagga

SEQ ID NO: 9759 - DNA, 21 bp, Artificial Sequence
  Synthetic
caggtgagtacaagttcaaac

SEQ ID NO: 9760 - DNA, 23 bp, Artificial Sequence
  Synthetic
aaacgtttggactttatagagaa

SEQ ID NO: 9761 - DNA, 23 bp, Artificial Sequence
  Synthetic
ggagcaagtaccttataaagttg

SEQ ID NO: 9762 - DNA, 23 bp, Artificial Sequence
  Synthetic
tagatgaactatttgaaggcagt

SEQ ID NO: 9763 - DNA, 25 bp, Artificial Sequence
  Synthetic
ttaccagattggataaaaagacaga

SEQ ID NO: 9764 - DNA, 25 bp, Artificial Sequence
  Synthetic
catggcaaagttatttctatgatga

SEQ ID NO: 9765 - DNA, 18 bp, Artificial Sequence
  Synthetic
ctctaaaggaggacggct

SEQ ID NO: 9766 - DNA, 20 bp, Artificial Sequence
  Synthetic
agcacctcacaagacacctt

SEQ ID NO: 9767 - DNA, 22 bp, Artificial Sequence
  Synthetic
attgtaacactcactgaaacag

SEQ ID NO: 9768 - DNA, 20 bp, Artificial Sequence
  Synthetic
tccttttgcaacagtggaaa

SEQ ID NO: 9769 - DNA, 25 bp, Artificial Sequence
  Synthetic
tctagtaattctgatattccttcag

SEQ ID NO: 9770 - DNA, 25 bp, Artificial Sequence
  Synthetic
catccttattttgatgttatggatg

SEQ ID NO: 9771 - DNA, 18 bp, Artificial Sequence
  Synthetic
taggagcaacaggccatc

SEQ ID NO: 9772 - DNA, 24 bp, Artificial Sequence
  Synthetic
tggtgatatgtgtgaaataggatt

SEQ ID NO: 9773 - DNA, 24 bp, Artificial Sequence
  Synthetic
tattggaccgtattgttactacac

SEQ ID NO: 9774 - DNA, 24 bp, Artificial Sequence
  Synthetic
ccatacgaacagtatacattttgg

SEQ ID NO: 9775 - DNA, 18 bp, Artificial Sequence
  Synthetic
caaaagcaggcaaaccat

SEQ ID NO: 9776 - DNA, 21 bp, Artificial Sequence
  Synthetic
taatgagccaagtggatatgc

SEQ ID NO: 9777 - DNA, 23 bp, Artificial Sequence
  Synthetic
atcaggaaggctaatagatttcc

SEQ ID NO: 9778 - DNA, 21 bp, Artificial Sequence
  Synthetic
caaattagagggttcgtgtac

SEQ ID NO: 9779 - DNA, 20 bp, Artificial Sequence
  Synthetic
tggttcagaaacatcctgag

SEQ ID NO: 9780 - DNA, 22 bp, Artificial Sequence
  Synthetic
acatgctaagtacggttttagg

SEQ ID NO: 9781 - DNA, 18 bp, Artificial Sequence
  Synthetic
catggagcttcccagttt

SEQ ID NO: 9782 - DNA, 20 bp, Artificial Sequence
  Synthetic
aagaagctgtgggatcaaac

SEQ ID NO: 9783 - DNA, 21 bp, Artificial Sequence
  Synthetic
gaaccgctctattctaaacac

SEQ ID NO: 9784 - DNA, 23 bp, Artificial Sequence
  Synthetic
agttgccaacaattattagacat

SEQ ID NO: 9785 - DNA, 18 bp, Artificial Sequence
  Synthetic
gttacgaacatgaggggt

SEQ ID NO: 9786 - DNA, 21 bp, Artificial Sequence
  Synthetic
gacctggttacagtaaaacga

SEQ ID NO: 9787 - DNA, 25 bp, Artificial Sequence
  Synthetic
actggtgattcagtatactttaaac

SEQ ID NO: 9788 - DNA, 25 bp, Artificial Sequence
  Synthetic
caaaaatatgcagatctctatgagt

SEQ ID NO: 9789 - DNA, 18 bp, Artificial Sequence
  Synthetic
caagggggggattgcata

SEQ ID NO: 9790 - DNA, 18 bp, Artificial Sequence
  Synthetic
gtagatccctctgcagct

SEQ ID NO: 9791 - DNA, 24 bp, Artificial Sequence
  Synthetic
tttgaaacacagattaatcccttc

SEQ ID NO: 9792 - DNA, 22 bp, Artificial Sequence
  Synthetic
agattttttgagtcaaccttcc

SEQ ID NO: 9793 - DNA, 22 bp, Artificial Sequence
  Synthetic
ctggaaagttataccttccacc

SEQ ID NO: 9794 - DNA, 21 bp, Artificial Sequence
  Synthetic
ctcagatacagaacgtttggt

SEQ ID NO: 9795 - DNA, 24 bp, Artificial Sequence
  Synthetic
gacaaaaacagcttaaataatggc

SEQ ID NO: 9796 - DNA, 20 bp, Artificial Sequence
  Synthetic
actcaggatgcatggtaatc

SEQ ID NO: 9797 - DNA, 19 bp, Artificial Sequence
  Synthetic
tattttagccctgcgaagg

SEQ ID NO: 9798 - DNA, 18 bp, Artificial Sequence
  Synthetic
aaccgaaatcgcaccaca

SEQ ID NO: 9799 - DNA, 19 bp, Artificial Sequence
  Synthetic
tctctcaagacttggacga

SEQ ID NO: 9800 - DNA, 19 bp, Artificial Sequence
  Synthetic
tacaggttatcggcctttg

SEQ ID NO: 9801 - DNA, 24 bp, Artificial Sequence
  Synthetic
attatagatgtaactggtcctaga

SEQ ID NO: 9802 - DNA, 20 bp, Artificial Sequence
  Synthetic
ggacacttttaatgagccag

SEQ ID NO: 9803 - DNA, 23 bp, Artificial Sequence
  Synthetic
cagaaagtacatttgtagatgca

SEQ ID NO: 9804 - DNA, 25 bp, Artificial Sequence
  Synthetic
gtaggaccaagtattttaatcaatg

SEQ ID NO: 9805 - DNA, 25 bp, Artificial Sequence
  Synthetic
tgatttaactcaaacatctttaggc

SEQ ID NO: 9806 - DNA, 25 bp, Artificial Sequence
  Synthetic
aataaaggtctgatgaatacttgtg

SEQ ID NO: 9807 - DNA, 19 bp, Artificial Sequence
  Synthetic
atggacttgcagcaatcac

SEQ ID NO: 9808 - DNA, 19 bp, Artificial Sequence
  Synthetic
tcatgcctgctgatctact

SEQ ID NO: 9809 - DNA, 18 bp, Artificial Sequence
  Synthetic
tatgccactccaagtcca

SEQ ID NO: 9810 - DNA, 23 bp, Artificial Sequence
  Synthetic
tgttcaatactaactgtcaatga

SEQ ID NO: 9811 - DNA, 23 bp, Artificial Sequence
  Synthetic
aatactggaaaatcctactttgt

SEQ ID NO: 9812 - DNA, 18 bp, Artificial Sequence
  Synthetic
tgccaggcagttagaact

SEQ ID NO: 9813 - DNA, 25 bp, Artificial Sequence
  Synthetic
tgtattatatagatgactatgggga

SEQ ID NO: 9814 - DNA, 21 bp, Artificial Sequence
  Synthetic
atttgaacaggcatctacagt

SEQ ID NO: 9815 - DNA, 20 bp, Artificial Sequence
  Synthetic
tggtacgacctacaatacca

SEQ ID NO: 9816 - DNA, 23 bp, Artificial Sequence
  Synthetic
ctctgctcctaaacatagtactc

SEQ ID NO: 9817 - DNA, 22 bp, Artificial Sequence
  Synthetic
ttaacatctaatacacgcactc

SEQ ID NO: 9818 - DNA, 23 bp, Artificial Sequence
  Synthetic
ctgttggtcatccatatttcaat

SEQ ID NO: 9819 - DNA, 23 bp, Artificial Sequence
  Synthetic
taattttaaaaagttccagcagg

SEQ ID NO: 9820 - DNA, 22 bp, Artificial Sequence
  Synthetic
tggaagaaatagagtttgagct

SEQ ID NO: 9821 - DNA, 23 bp, Artificial Sequence
  Synthetic
tacctcagtgttacatgtttcag

SEQ ID NO: 9822 - DNA, 22 bp, Artificial Sequence
  Synthetic
aagtacagacaaactttgactc

SEQ ID NO: 9823 - DNA, 16 bp, Artificial Sequence
  Synthetic
ctcacgcgctacctgc

SEQ ID NO: 9824 - DNA, 16 bp, Artificial Sequence
  Synthetic
ccccggcctggtgttt

SEQ ID NO: 9825 - DNA, 19 bp, Artificial Sequence
  Synthetic
gcttgcgattctagcctcg

SEQ ID NO: 9826 - DNA, 16 bp, Artificial Sequence
  Synthetic
gaggtggtgcgggaca

SEQ ID NO: 9827 - DNA, 19 bp, Artificial Sequence
  Synthetic
gactcgacaaactcgctga

SEQ ID NO: 9828 - DNA, 19 bp, Artificial Sequence
  Synthetic
gtaagtgacgtcgttgcgg

SEQ ID NO: 9829 - DNA, 19 bp, Artificial Sequence
  Synthetic
aactccttgaccgacacga

SEQ ID NO: 9830 - DNA, 17 bp, Artificial Sequence
  Synthetic
cgtgagcacgttctcgc

SEQ ID NO: 9831 - DNA, 16 bp, Artificial Sequence
  Synthetic
cgttctgctgcaccgg

SEQ ID NO: 9832 - DNA, 19 bp, Artificial Sequence
  Synthetic
gttcgctgccttttcctcc

SEQ ID NO: 9833 - DNA, 16 bp, Artificial Sequence
  Synthetic
ccgggaaacgtctgcg

SEQ ID NO: 9834 - DNA, 19 bp, Artificial Sequence
  Synthetic
tacgttacagtggcccagt

SEQ ID NO: 9835 - DNA, 18 bp, Artificial Sequence
  Synthetic
aaccacgcggtattggcc

SEQ ID NO: 9836 - DNA, 18 bp, Artificial Sequence
  Synthetic
cgacaggagacgacgagc

SEQ ID NO: 9837 - DNA, 18 bp, Artificial Sequence
  Synthetic
cgtctgctcttggttgct

SEQ ID NO: 9838 - DNA, 18 bp, Artificial Sequence
  Synthetic
cgtcgtcggtgatgagga

SEQ ID NO: 9839 - DNA, 18 bp, Artificial Sequence
  Synthetic
ttcgggagaatggacgcc

SEQ ID NO: 9840 - DNA, 18 bp, Artificial Sequence
  Synthetic
tgaggcgtcagaaagtgc

SEQ ID NO: 9841 - DNA, 16 bp, Artificial Sequence
  Synthetic
gcgcacgggttggtgt

SEQ ID NO: 9842 - DNA, 20 bp, Artificial Sequence
  Synthetic
gttggacgtcaccgtatccc

SEQ ID NO: 9843 - DNA, 18 bp, Artificial Sequence
  Synthetic
cccacagagaagcgttgg

SEQ ID NO: 9844 - DNA, 20 bp, Artificial Sequence
  Synthetic
tgtcgcatcatctctaagcg

SEQ ID NO: 9845 - DNA, 17 bp, Artificial Sequence
  Synthetic
gctgttcggtggttggg

SEQ ID NO: 9846 - DNA, 15 bp, Artificial Sequence
  Synthetic
caaccgcagcgcctt

SEQ ID NO: 9847 - DNA, 18 bp, Artificial Sequence
  Synthetic
gaaccaaagacgagggcc

SEQ ID NO: 9848 - DNA, 19 bp, Artificial Sequence
  Synthetic
ggaccgccgatttgtttct

SEQ ID NO: 9849 - DNA, 20 bp, Artificial Sequence
  Synthetic
ataacctcaccgaaaccgtc

SEQ ID NO: 9850 - DNA, 16 bp, Artificial Sequence
  Synthetic
gagccagggccaaggt

SEQ ID NO: 9851 - DNA, 16 bp, Artificial Sequence
  Synthetic
aggtctggcagccctc

SEQ ID NO: 9852 - DNA, 16 bp, Artificial Sequence
  Synthetic
ccggggggcgcttaaa

SEQ ID NO: 9853 - DNA, 15 bp, Artificial Sequence
  Synthetic
tttcgtgccgggcca

SEQ ID NO: 9854 - DNA, 20 bp, Artificial Sequence
  Synthetic
gtcacgacgtacgagaccag

SEQ ID NO: 9855 - DNA, 16 bp, Artificial Sequence
  Synthetic
aggcggccgttgtcca

SEQ ID NO: 9856 - DNA, 19 bp, Artificial Sequence
  Synthetic
cccctcgttcatgtaggcc

SEQ ID NO: 9857 - DNA, 16 bp, Artificial Sequence
  Synthetic
cgtgtgcgcaggggat

SEQ ID NO: 9858 - DNA, 17 bp, Artificial Sequence
  Synthetic
tgtcggtgttcccccat

SEQ ID NO: 9859 - DNA, 16 bp, Artificial Sequence
  Synthetic
cgaaggcgcggatcag

SEQ ID NO: 9860 - DNA, 18 bp, Artificial Sequence
  Synthetic
aaagcctagcaggtcgga

SEQ ID NO: 9861 - DNA, 19 bp, Artificial Sequence
  Synthetic
gcaagcagcccataaacgc

SEQ ID NO: 9862 - DNA, 18 bp, Artificial Sequence
  Synthetic
cgtgttgatggcaggggt

SEQ ID NO: 9863 - DNA, 17 bp, Artificial Sequence
  Synthetic
taagaggatcgcggcgc

SEQ ID NO: 9864 - DNA, 18 bp, Artificial Sequence
  Synthetic
tgcccatttgacgctctg

SEQ ID NO: 9865 - DNA, 18 bp, Artificial Sequence
  Synthetic
cgcactatccaggaccgc

SEQ ID NO: 9866 - DNA, 20 bp, Artificial Sequence
  Synthetic
cttcttggccttgtgttccg

SEQ ID NO: 9867 - DNA, 19 bp, Artificial Sequence
  Synthetic
gtgtacacctccaggggga

SEQ ID NO: 9868 - DNA, 18 bp, Artificial Sequence
  Synthetic
cacgtggagacggccatc

SEQ ID NO: 9869 - DNA, 19 bp, Artificial Sequence
  Synthetic
ctgagaaggggctggtacg

SEQ ID NO: 9870 - DNA, 18 bp, Artificial Sequence
  Synthetic
ggttggtggtgaaggtgg

SEQ ID NO: 9871 - DNA, 17 bp, Artificial Sequence
  Synthetic
gctggttgcgttggagg

SEQ ID NO: 9872 - DNA, 18 bp, Artificial Sequence
  Synthetic
cgaccgtcagcgttttgg

SEQ ID NO: 9873 - DNA, 19 bp, Artificial Sequence
  Synthetic
gttcaccaccgtatgcagg

SEQ ID NO: 9874 - DNA, 20 bp, Artificial Sequence
  Synthetic
gacacggctaaaatccggca

SEQ ID NO: 9875 - DNA, 17 bp, Artificial Sequence
  Synthetic
gccagaagctcgatgcc

SEQ ID NO: 9876 - DNA, 16 bp, Artificial Sequence
  Synthetic
gcatctccgcggacca

SEQ ID NO: 9877 - DNA, 17 bp, Artificial Sequence
  Synthetic
caaggctcacgtgcgag

SEQ ID NO: 9878 - DNA, 18 bp, Artificial Sequence
  Synthetic
tcatctacggggacacgg

SEQ ID NO: 9879 - DNA, 19 bp, Artificial Sequence
  Synthetic
agcatccggtctatgagcc

SEQ ID NO: 9880 - DNA, 16 bp, Artificial Sequence
  Synthetic
acgtcctcgtcgagcg

SEQ ID NO: 9881 - DNA, 16 bp, Artificial Sequence
  Synthetic
gagacgacggggctgt

SEQ ID NO: 9882 - DNA, 16 bp, Artificial Sequence
  Synthetic
cgcgcctgttggtcgt

SEQ ID NO: 9883 - DNA, 17 bp, Artificial Sequence
  Synthetic
gtccctgaacagcccca

SEQ ID NO: 9884 - DNA, 19 bp, Artificial Sequence
  Synthetic
agaaaggacagcgacgagc

SEQ ID NO: 9885 - DNA, 16 bp, Artificial Sequence
  Synthetic
tggccctcaaccgtgg

SEQ ID NO: 9886 - DNA, 16 bp, Artificial Sequence
  Synthetic
agtgagggtcgcgtcg

SEQ ID NO: 9887 - DNA, 20 bp, Artificial Sequence
  Synthetic
cccaaatggccctttaaacg

SEQ ID NO: 9888 - DNA, 17 bp, Artificial Sequence
  Synthetic
aggaacacacccccgtg

SEQ ID NO: 9889 - DNA, 16 bp, Artificial Sequence
  Synthetic
ccccaggccaccacaa

SEQ ID NO: 9890 - DNA, 16 bp, Artificial Sequence
  Synthetic
gggagccccttcgtca

SEQ ID NO: 9891 - DNA, 19 bp, Artificial Sequence
  Synthetic
ccagaatttggccaggacg

SEQ ID NO: 9892 - DNA, 18 bp, Artificial Sequence
  Synthetic
gcgcatgttggaaaaggc

SEQ ID NO: 9893 - DNA, 19 bp, Artificial Sequence
  Synthetic
cgcttctggttatgggcga

SEQ ID NO: 9894 - DNA, 18 bp, Artificial Sequence
  Synthetic
gaacccccgacgttcagt

SEQ ID NO: 9895 - DNA, 16 bp, Artificial Sequence
  Synthetic
agtcccgaagaccgcc

SEQ ID NO: 9896 - DNA, 16 bp, Artificial Sequence
  Synthetic
agccccacgcggtgat

SEQ ID NO: 9897 - DNA, 16 bp, Artificial Sequence
  Synthetic
acttggcgggggtggt

SEQ ID NO: 9898 - DNA, 16 bp, Artificial Sequence
  Synthetic
gccatcgccacgtcct

SEQ ID NO: 9899 - DNA, 19 bp, Artificial Sequence
  Synthetic
gaaaacccccaaacgcgtt

SEQ ID NO: 9900 - DNA, 16 bp, Artificial Sequence
  Synthetic
ctcgaggtcgctcggt

SEQ ID NO: 9901 - DNA, 18 bp, Artificial Sequence
  Synthetic
gaacacgctagggtcgga

SEQ ID NO: 9902 - DNA, 16 bp, Artificial Sequence
  Synthetic
caggcgccgcatcttg

SEQ ID NO: 9903 - DNA, 16 bp, Artificial Sequence
  Synthetic
gcccgtgtgttcctgc

SEQ ID NO: 9904 - DNA, 17 bp, Artificial Sequence
  Synthetic
agcctgtcgtgtctgcg

SEQ ID NO: 9905 - DNA, 16 bp, Artificial Sequence
  Synthetic
catgctcgccgtccgt

SEQ ID NO: 9906 - DNA, 20 bp, Artificial Sequence
  Synthetic
agaccctatggtacacacgg

SEQ ID NO: 9907 - DNA, 20 bp, Artificial Sequence
  Synthetic
tatgctaattgacctcggcc

SEQ ID NO: 9908 - DNA, 16 bp, Artificial Sequence
  Synthetic
cgacccccctcaccaa

SEQ ID NO: 9909 - DNA, 20 bp, Artificial Sequence
  Synthetic
gaattgaccctaggaggccg

SEQ ID NO: 9910 - DNA, 16 bp, Artificial Sequence
  Synthetic
ggaggaggttggcgga

SEQ ID NO: 9911 - DNA, 16 bp, Artificial Sequence
  Synthetic
ccgcctccgaagccat

SEQ ID NO: 9912 - DNA, 16 bp, Artificial Sequence
  Synthetic
ttctcccccccccctt

SEQ ID NO: 9913 - DNA, 19 bp, Artificial Sequence
  Synthetic
ttcgaccgagtctggggac

SEQ ID NO: 9914 - DNA, 17 bp, Artificial Sequence
  Synthetic
gggggctaaagggtggt

SEQ ID NO: 9915 - DNA, 16 bp, Artificial Sequence
  Synthetic
ggggctgggttggtct

SEQ ID NO: 9916 - DNA, 17 bp, Artificial Sequence
  Synthetic
ggccaaccgtcgaaggt

SEQ ID NO: 9917 - DNA, 18 bp, Artificial Sequence
  Synthetic
ggggaggggagggtgatt

SEQ ID NO: 9918 - DNA, 16 bp, Artificial Sequence
  Synthetic
gtcccgccggagacaa

SEQ ID NO: 9919 - DNA, 16 bp, Artificial Sequence
  Synthetic
cccgtgtggcgcatct

SEQ ID NO: 9920 - DNA, 16 bp, Artificial Sequence
  Synthetic
agcgctcaccccagga

SEQ ID NO: 9921 - DNA, 16 bp, Artificial Sequence
  Synthetic
tctccggggtcacgtg

SEQ ID NO: 9922 - DNA, 19 bp, Artificial Sequence
  Synthetic
gccggtctggtgatcttcg

SEQ ID NO: 9923 - DNA, 18 bp, Artificial Sequence
  Synthetic
ccaactccagaccaccgg

SEQ ID NO: 9924 - DNA, 18 bp, Artificial Sequence
  Synthetic
gtttttggggtgtggcgg

SEQ ID NO: 9925 - DNA, 18 bp, Artificial Sequence
  Synthetic
gtgtcgcgatgtctctgc

SEQ ID NO: 9926 - DNA, 20 bp, Artificial Sequence
  Synthetic
tggtataaatcaccggtgcg

SEQ ID NO: 9927 - DNA, 17 bp, Artificial Sequence
  Synthetic
cctctgggtctgtgcca

SEQ ID NO: 9928 - DNA, 18 bp, Artificial Sequence
  Synthetic
gcttttgcgggtccagag

SEQ ID NO: 9929 - DNA, 17 bp, Artificial Sequence
  Synthetic
cggacttcgtgtggcag

SEQ ID NO: 9930 - DNA, 19 bp, Artificial Sequence
  Synthetic
gctctccgatcccaactcc

SEQ ID NO: 9931 - DNA, 16 bp, Artificial Sequence
  Synthetic
gctgcgtcggcatggt

SEQ ID NO: 9932 - DNA, 24 bp, Artificial Sequence
  Synthetic
aaagcaggagattaaaatgaatcc

SEQ ID NO: 9933 - DNA, 20 bp, Artificial Sequence
  Synthetic
ctccctccccatataactca

SEQ ID NO: 9934 - DNA, 21 bp, Artificial Sequence
  Synthetic
gcaggcctcatataagatctt

SEQ ID NO: 9935 - DNA, 18 bp, Artificial Sequence
  Synthetic
ctaacggggcatatggag

SEQ ID NO: 9936 - DNA, 19 bp, Artificial Sequence
  Synthetic
cggacctgcatgactactg

SEQ ID NO: 9937 - DNA, 19 bp, Artificial Sequence
  Synthetic
cctttttaccgctgttacc

SEQ ID NO: 9938 - DNA, 19 bp, Artificial Sequence
  Synthetic
tctctttacgcggactccc

SEQ ID NO: 9939 - DNA, 18 bp, Artificial Sequence
  Synthetic
tcagctctgtatcgggaa

SEQ ID NO: 9940 - DNA, 19 bp, Artificial Sequence
  Synthetic
cacactctatggaaggcgg

SEQ ID NO: 9941 - DNA, 25 bp, Artificial Sequence
  Synthetic
caggtcaattatattcagtatggaa

SEQ ID NO: 9942 - DNA, 21 bp, Artificial Sequence
  Synthetic
ggagtaaaatgagtgatgctg

SEQ ID NO: 9943 - DNA, 20 bp, Artificial Sequence
  Synthetic
aatgacgatgttgaccaaag

SEQ ID NO: 9944 - DNA, 24 bp, Artificial Sequence
  Synthetic
tggtgggtttacatttaaaagaac

SEQ ID NO: 9945 - DNA, 22 bp, Artificial Sequence
  Synthetic
catgataaaagcagttagaggt

SEQ ID NO: 9946 - DNA, 18 bp, Artificial Sequence
  Synthetic
gagggtggtggttagcat

SEQ ID NO: 9947 - DNA, 23 bp, Artificial Sequence
  Synthetic
tgaaccatttcaatctttagtcc

SEQ ID NO: 9948 - DNA, 24 bp, Artificial Sequence
  Synthetic
ccactaaaagactaacaattctcg

SEQ ID NO: 9949 - DNA, 20 bp, Artificial Sequence
  Synthetic
gaacctcttgcttccagttt

SEQ ID NO: 9950 - DNA, 24 bp, Artificial Sequence
  Synthetic
agtattttactcaaactccattgc

SEQ ID NO: 9951 - DNA, 21 bp, Artificial Sequence
  Synthetic
gagtttgtcaccagattcaga

SEQ ID NO: 9952 - DNA, 20 bp, Artificial Sequence
  Synthetic
actttgtaactgaagcagac

SEQ ID NO: 9953 - DNA, 23 bp, Artificial Sequence
  Synthetic
aagaaaaacaaagtaaaagacgc

SEQ ID NO: 9954 - DNA, 22 bp, Artificial Sequence
  Synthetic
tcttgaatctaattgagcaggg

SEQ ID NO: 9955 - DNA, 20 bp, Artificial Sequence
  Synthetic
aaaactctttccgcccctag

SEQ ID NO: 9956 - DNA, 23 bp, Artificial Sequence
  Synthetic
tgtaataaacaaagtagaaggca

SEQ ID NO: 9957 - DNA, 20 bp, Artificial Sequence
  Synthetic
agaagctggaattcctgatg

SEQ ID NO: 9958 - DNA, 23 bp, Artificial Sequence
  Synthetic
caatttgattttgaaaatcccgc

SEQ ID NO: 9959 - DNA, 22 bp, Artificial Sequence
  Synthetic
acacttctattttgacctcagt

SEQ ID NO: 9960 - DNA, 22 bp, Artificial Sequence
  Synthetic
cagaatggtaaactgtatctgc

SEQ ID NO: 9961 - DNA, 23 bp, Artificial Sequence
  Synthetic
tctttaacatggatagagaacga

SEQ ID NO: 9962 - DNA, 18 bp, Artificial Sequence
  Synthetic
acctcaggctggagaatg

SEQ ID NO: 9963 - DNA, 25 bp, Artificial Sequence
  Synthetic
tgaggatcaatatagatttttgcag

SEQ ID NO: 9964 - DNA, 24 bp, Artificial Sequence
  Synthetic
cctcaaaataagcaatgtatccaa

SEQ ID NO: 9965 - DNA, 19 bp, Artificial Sequence
  Synthetic
ctgacaagcacgaatctgt

SEQ ID NO: 9966 - DNA, 21 bp, Artificial Sequence
  Synthetic
agaaattgtatcagccatgag

SEQ ID NO: 9967 - DNA, 23 bp, Artificial Sequence
  Synthetic
agaaagttaaatgttactcctga

SEQ ID NO: 9968 - DNA, 18 bp, Artificial Sequence
  Synthetic
gagcgacgacgacgagaa

SEQ ID NO: 9969 - DNA, 25 bp, Artificial Sequence
  Synthetic
tgaaaattctactattgcagattgg

SEQ ID NO: 9970 - DNA, 19 bp, Artificial Sequence
  Synthetic
gcgtcatctatagtccctc

SEQ ID NO: 9971 - DNA, 18 bp, Artificial Sequence
  Synthetic
gcaaacacaggtaaaccc

SEQ ID NO: 9972 - DNA, 18 bp, Artificial Sequence
  Synthetic
ccttctcgattggtgcag

SEQ ID NO: 9973 - DNA, 22 bp, Artificial Sequence
  Synthetic
caaatccatggctactaaatgc

SEQ ID NO: 9974 - DNA, 24 bp, Artificial Sequence
  Synthetic
acaaactgtgatcaataaacactg

SEQ ID NO: 9975 - DNA, 20 bp, Artificial Sequence
  Synthetic
tgcaagggatgttttacagt

SEQ ID NO: 9976 - DNA, 20 bp, Artificial Sequence
  Synthetic
ccatacttggtcaaggcagg

SEQ ID NO: 9977 - DNA, 20 bp, Artificial Sequence
  Synthetic
cctggtcattcggtgttcat

SEQ ID NO: 9978 - DNA, 23 bp, Artificial Sequence
  Synthetic
cctttagacaggtagaagattgt

SEQ ID NO: 9979 - DNA, 20 bp, Artificial Sequence
  Synthetic
agtggcagaaactggaactg

SEQ ID NO: 9980 - DNA, 18 bp, Artificial Sequence
  Synthetic
ttaccagcaggacagctc

SEQ ID NO: 9981 - DNA, 20 bp, Artificial Sequence
  Synthetic
gctgaagccctaaaagaggc

SEQ ID NO: 9982 - DNA, 25 bp, Artificial Sequence
  Synthetic
agtactaaataaaagagtaagagcc

SEQ ID NO: 9983 - DNA, 25 bp, Artificial Sequence
  Synthetic
gaggatgctgatagattttagagaa

SEQ ID NO: 9984 - DNA, 25 bp, Artificial Sequence
  Synthetic
gtacatggatgatatcttaatagct

SEQ ID NO: 9985 - DNA, 23 bp, Artificial Sequence
  Synthetic
aattagaggaaaaatgacactca

SEQ ID NO: 9986 - DNA, 19 bp, Artificial Sequence
  Synthetic
aactactggcaagtgacat

SEQ ID NO: 9987 - DNA, 25 bp, Artificial Sequence
  Synthetic
tagaagaaatgataaagaaggaagc

SEQ ID NO: 9988 - DNA, 20 bp, Artificial Sequence
  Synthetic
gcagtacatgttgcaagtgg

SEQ ID NO: 9989 - DNA, 18 bp, Artificial Sequence
  Synthetic
ctgatggcagttcattgc

SEQ ID NO: 9990 - DNA, 25 bp, Artificial Sequence
  Synthetic
ggaaaaagtcatctagaaatacagg

SEQ ID NO: 9991 - DNA, 18 bp, Artificial Sequence
  Synthetic
ttcgagtggctagagagg

SEQ ID NO: 9992 - DNA, 21 bp, Artificial Sequence
  Synthetic
ggtaatagaaactctgaggga

SEQ ID NO: 9993 - DNA, 21 bp, Artificial Sequence
  Synthetic
atatcatatgagcgaaagggc

SEQ ID NO: 9994 - DNA, 18 bp, Artificial Sequence
  Synthetic
acagaggcttttgatgca

SEQ ID NO: 9995 - DNA, 25 bp, Artificial Sequence
  Synthetic
gataagaaaaggaggtataaggaca

SEQ ID NO: 9996 - DNA, 24 bp, Artificial Sequence
  Synthetic
caagtattataatctcacaatgcg

SEQ ID NO: 9997 - DNA, 20 bp, Artificial Sequence
  Synthetic
ctgtaacatgacttggttcc

SEQ ID NO: 9998 - DNA, 19 bp, Artificial Sequence
  Synthetic
gtctggggaacgaaaaacc

SEQ ID NO: 9999 - DNA, 18 bp, Artificial Sequence
  Synthetic
cgcctcttgatcgggcta

SEQ ID NO: 10000 - DNA, 18 bp, Artificial Sequence
  Synthetic
acagcagtatcagcaggg

SEQ ID NO: 10001 - DNA, 19 bp, Artificial Sequence
  Synthetic
aactgcttagtacacccag

SEQ ID NO: 10002 - DNA, 20 bp, Artificial Sequence
  Synthetic
aaatgtacccgcttcttgca

SEQ ID NO: 10003 - DNA, 22 bp, Artificial Sequence
  Synthetic
cgttgcattttctaatatccac

SEQ ID NO: 10004 - DNA, 20 bp, Artificial Sequence
  Synthetic
ttaactgcacagatctggac

SEQ ID NO: 10005 - DNA, 18 bp, Artificial Sequence
  Synthetic
atcttgccctaacgttgc

SEQ ID NO: 10006 - DNA, 18 bp, Artificial Sequence
  Synthetic
tctcagattggtggcttc

SEQ ID NO: 10007 - DNA, 19 bp, Artificial Sequence
  Synthetic
aaaggccataggaaattgc

SEQ ID NO: 10008 - DNA, 25 bp, Artificial Sequence
  Synthetic
ttaagtgagctagaagtaaaaaacc

SEQ ID NO: 10009 - DNA, 22 bp, Artificial Sequence
  Synthetic
ctgctgtagaaatagggaatgg

SEQ ID NO: 10010 - DNA, 21 bp, Artificial Sequence
  Synthetic
ctttgtccagaatgccttaaa

SEQ ID NO: 10011 - DNA, 20 bp, Artificial Sequence
  Synthetic
gacagatggcaactaccacc

SEQ ID NO: 10012 - DNA, 18 bp, Artificial Sequence
  Synthetic
acgaatgggagtgcaaat

SEQ ID NO: 10013 - DNA, 20 bp, Artificial Sequence
  Synthetic
gagtagactccctttgttct

SEQ ID NO: 10014 - DNA, 23 bp, Artificial Sequence
  Synthetic
atttgatgaaagtacagattgct

SEQ ID NO: 10015 - DNA, 22 bp, Artificial Sequence
  Synthetic
aaaatgccttttactgaaagtg

SEQ ID NO: 10016 - DNA, 22 bp, Artificial Sequence
  Synthetic
taaagcccttccatatcctaac

SEQ ID NO: 10017 - DNA, 23 bp, Artificial Sequence
  Synthetic
ctgtaaatgttcctaaaggctct

SEQ ID NO: 10018 - DNA, 21 bp, Artificial Sequence
  Synthetic
gcactggctatagacctatag

SEQ ID NO: 10019 - DNA, 25 bp, Artificial Sequence
  Synthetic
gggtaatcctacagttataacatca

SEQ ID NO: 10020 - DNA, 22 bp, Artificial Sequence
  Synthetic
cctttaacaacgttttctgaaa

SEQ ID NO: 10021 - DNA, 22 bp, Artificial Sequence
  Synthetic
cctgatagtgatttcagagatg

SEQ ID NO: 10022 - DNA, 20 bp, Artificial Sequence
  Synthetic
cctagcacagacaatacacc

SEQ ID NO: 10023 - DNA, 23 bp, Artificial Sequence
  Synthetic
taggacatccattttttcctgtt

SEQ ID NO: 10024 - DNA, 22 bp, Artificial Sequence
  Synthetic
tagaaaatcccactctttaccc

SEQ ID NO: 10025 - DNA, 23 bp, Artificial Sequence
  Synthetic
ataacagaacattttttgctgac

SEQ ID NO: 10026 - DNA, 23 bp, Artificial Sequence
  Synthetic
tgatattgaaattgtaatgcagc

SEQ ID NO: 10027 - DNA, 20 bp, Artificial Sequence
  Synthetic
tttacctcagagctttctca

SEQ ID NO: 10028 - DNA, 23 bp, Artificial Sequence
  Synthetic
aagaattagcatccttttttgag

SEQ ID NO: 10029 - DNA, 19 bp, Artificial Sequence
  Synthetic
tggaagatctagtgatgcc

SEQ ID NO: 10030 - DNA, 18 bp, Artificial Sequence
  Synthetic
ttgcggctcttagtccaa

SEQ ID NO: 10031 - DNA, 19 bp, Artificial Sequence
  Synthetic
cagccgcattgtactttta

SEQ ID NO: 10032 - DNA, 23 bp, Artificial Sequence
  Synthetic
ctgcaaaagcatttagatcttca

SEQ ID NO: 10033 - DNA, 20 bp, Artificial Sequence
  Synthetic
ctccctctgttaccagctct

SEQ ID NO: 10034 - DNA, 25 bp, Artificial Sequence
  Synthetic
gaaaaattgtaattatgtacccagc

SEQ ID NO: 10035 - DNA, 21 bp, Artificial Sequence
  Synthetic
acaaacaccaaatacaggaac

SEQ ID NO: 10036 - DNA, 23 bp, Artificial Sequence
  Synthetic
ttagagaggagtttgatattgac

SEQ ID NO: 10037 - DNA, 23 bp, Artificial Sequence
  Synthetic
tttttctcaaactcatttggttg

SEQ ID NO: 10038 - DNA, 22 bp, Artificial Sequence
  Synthetic
tattttgatgtagtaggaggcg

SEQ ID NO: 10039 - DNA, 19 bp, Artificial Sequence
  Synthetic
ccgatgctcctttagaagt

SEQ ID NO: 10040 - DNA, 24 bp, Artificial Sequence
  Synthetic
agtagaaataacaatgcaactgtg

SEQ ID NO: 10041 - DNA, 23 bp, Artificial Sequence
  Synthetic
tattgactcatgagtttgttgat

SEQ ID NO: 10042 - DNA, 23 bp, Artificial Sequence
  Synthetic
aagaactaagaaatttgatgtcg

SEQ ID NO: 10043 - DNA, 22 bp, Artificial Sequence
  Synthetic
tctttggagcaaaacaaatgac

SEQ ID NO: 10044 - DNA, 20 bp, Artificial Sequence
  Synthetic
agcacaagatgtcatcatgg

SEQ ID NO: 10045 - DNA, 19 bp, Artificial Sequence
  Synthetic
cagatgtacacaccaggag

SEQ ID NO: 10046 - DNA, 22 bp, Artificial Sequence
  Synthetic
gagggttcactttcaaaagaac

SEQ ID NO: 10047 - DNA, 18 bp, Artificial Sequence
  Synthetic
ttgcatggtaaaggcagt

SEQ ID NO: 10048 - DNA, 18 bp, Artificial Sequence
  Synthetic
gtggtcgtgagcattgac

SEQ ID NO: 10049 - DNA, 24 bp, Artificial Sequence
  Synthetic
tgaaccatttcaatctttagtacc

SEQ ID NO: 10050 - DNA, 20 bp, Artificial Sequence
  Synthetic
caacaagacaactaagaggc

SEQ ID NO: 10051 - DNA, 20 bp, Artificial Sequence
  Synthetic
aaatcctggtattcgctctg

SEQ ID NO: 10052 - DNA, 24 bp, Artificial Sequence
  Synthetic
gtgaccaattcctagaattttcag

SEQ ID NO: 10053 - DNA, 20 bp, Artificial Sequence
  Synthetic
gcccagctctaatagtatgg

SEQ ID NO: 10054 - DNA, 18 bp, Artificial Sequence
  Synthetic
gtgcaagcttcctgagag

SEQ ID NO: 10055 - DNA, 20 bp, Artificial Sequence
  Synthetic
agattccaaaaggaagaggc

SEQ ID NO: 10056 - DNA, 21 bp, Artificial Sequence
  Synthetic
cagaagtgtggtcatacaatg

SEQ ID NO: 10057 - DNA, 25 bp, Artificial Sequence
  Synthetic
gaattataaaaaagtagggaggaac

SEQ ID NO: 10058 - DNA, 19 bp, Artificial Sequence
  Synthetic
gacactacgacagatcagc

SEQ ID NO: 10059 - DNA, 23 bp, Artificial Sequence
  Synthetic
ggttgacctgtattgttatgaac

SEQ ID NO: 10060 - DNA, 20 bp, Artificial Sequence
  Synthetic
caggaacaggtagaaaatgg

SEQ ID NO: 10061 - DNA, 20 bp, Artificial Sequence
  Synthetic
gcagaggcgttatatacaca

SEQ ID NO: 10062 - DNA, 21 bp, Artificial Sequence
  Synthetic
ttaacagaaatggtgcaatgg

SEQ ID NO: 10063 - DNA, 19 bp, Artificial Sequence
  Synthetic
aaggttgtggtccagctta

SEQ ID NO: 10064 - DNA, 20 bp, Artificial Sequence
  Synthetic
agtccacatttggtacagaa

SEQ ID NO: 10065 - DNA, 20 bp, Artificial Sequence
  Synthetic
ccaccgacctatacaacacc

SEQ ID NO: 10066 - DNA, 25 bp, Artificial Sequence
  Synthetic
atgtacaaacatatataggggaaca

SEQ ID NO: 10067 - DNA, 18 bp, Artificial Sequence
  Synthetic
tgtgtggtgtgcatggta

SEQ ID NO: 10068 - DNA, 20 bp, Artificial Sequence
  Synthetic
tattggaagagtctgcagtt

SEQ ID NO: 10069 - DNA, 19 bp, Artificial Sequence
  Synthetic
cttccttgcaaacacgtag

SEQ ID NO: 10070 - DNA, 18 bp, Artificial Sequence
  Synthetic
gtaagcgccgtaaacctg

SEQ ID NO: 10071 - DNA, 18 bp, Artificial Sequence
  Synthetic
gagcattggggtaagggt

SEQ ID NO: 10072 - DNA, 25 bp, Artificial Sequence
  Synthetic
atgcagaggaatatgatatacagtt

SEQ ID NO: 10073 - DNA, 23 bp, Artificial Sequence
  Synthetic
tgattgtgttcattgtatgttgt

SEQ ID NO: 10074 - DNA, 22 bp, Artificial Sequence
  Synthetic
attacaggaaaagcatttgtct

SEQ ID NO: 10075 - DNA, 22 bp, Artificial Sequence
  Synthetic
ctgcgttcttaaacagtaattc

SEQ ID NO: 10076 - DNA, 20 bp, Artificial Sequence
  Synthetic
ttcctccctctgttggtagc

SEQ ID NO: 10077 - DNA, 18 bp, Artificial Sequence
  Synthetic
ctgaaggacgtggaggaa

SEQ ID NO: 10078 - DNA, 20 bp, Artificial Sequence
  Synthetic
ggttaattgacactcctggt

SEQ ID NO: 10079 - DNA, 22 bp, Artificial Sequence
  Synthetic
ggagatatgtgcgatataggtc

SEQ ID NO: 10080 - DNA, 20 bp, Artificial Sequence
  Synthetic
gcaggttctttttatcacct

SEQ ID NO: 10081 - DNA, 23 bp, Artificial Sequence
  Synthetic
attatatgagacataccgaggag

SEQ ID NO: 10082 - DNA, 25 bp, Artificial Sequence
  Synthetic
tacaaggatttaacattttggaagg

SEQ ID NO: 10083 - DNA, 22 bp, Artificial Sequence
  Synthetic
tgtactgtgaaaataagctgtg

SEQ ID NO: 10084 - DNA, 25 bp, Artificial Sequence
  Synthetic
gctttctagtttaaaccacctttta

SEQ ID NO: 10085 - DNA, 18 bp, Artificial Sequence
  Synthetic
cccaacatcggtcccaca

SEQ ID NO: 10086 - DNA, 18 bp, Artificial Sequence
  Synthetic
accagaaacggatgggag

SEQ ID NO: 10087 - DNA, 25 bp, Artificial Sequence
  Synthetic
gctcttctttttttatctcattcac

SEQ ID NO: 10088 - DNA, 22 bp, Artificial Sequence
  Synthetic
atcaggaaactatgttgcagaa

SEQ ID NO: 10089 - DNA, 22 bp, Artificial Sequence
  Synthetic
ctgtatcctcagagatcccata

SEQ ID NO: 10090 - DNA, 25 bp, Artificial Sequence
  Synthetic
atcctattataccagaatatagggt

SEQ ID NO: 10091 - DNA, 25 bp, Artificial Sequence
  Synthetic
agcaaaagatagaactattgatcag

SEQ ID NO: 10092 - DNA, 19 bp, Artificial Sequence
  Synthetic
ccacatcaaaagggcagaa

SEQ ID NO: 10093 - DNA, 22 bp, Artificial Sequence
  Synthetic
tccaatgagagagtatccatga

SEQ ID NO: 10094 - DNA, 25 bp, Artificial Sequence
  Synthetic
tccaaaatgagtataactaactctg

SEQ ID NO: 10095 - DNA, 23 bp, Artificial Sequence
  Synthetic
aaagagatggttgtgtatacagt

SEQ ID NO: 10096 - DNA, 21 bp, Artificial Sequence
  Synthetic
cttaatctggttatctgggct

SEQ ID NO: 10097 - DNA, 22 bp, Artificial Sequence
  Synthetic
taattttgagcctcataccaaa

SEQ ID NO: 10098 - DNA, 25 bp, Artificial Sequence
  Synthetic
tttacagaatcaataaaggtgagag

SEQ ID NO: 10099 - DNA, 19 bp, Artificial Sequence
  Synthetic
ttgtcaatggaggagtggt

SEQ ID NO: 10100 - DNA, 24 bp, Artificial Sequence
  Synthetic
aaaaacttaggagtaaagttacgc

SEQ ID NO: 10101 - DNA, 18 bp, Artificial Sequence
  Synthetic
gaagtgccgcaacaaaga

SEQ ID NO: 10102 - DNA, 22 bp, Artificial Sequence
  Synthetic
taacataagctttgatcaaccc

SEQ ID NO: 10103 - DNA, 21 bp, Artificial Sequence
  Synthetic
tgatgcgtatccactaaatcc

SEQ ID NO: 10104 - DNA, 24 bp, Artificial Sequence
  Synthetic
taattaacggatatagagagaggc

SEQ ID NO: 10105 - DNA, 23 bp, Artificial Sequence
  Synthetic
tgaaacgattataagtagcaaga

SEQ ID NO: 10106 - DNA, 23 bp, Artificial Sequence
  Synthetic
caactatatattgcccttgggat

SEQ ID NO: 10107 - DNA, 21 bp, Artificial Sequence
  Synthetic
aacactaagtaggactttgcg

SEQ ID NO: 10108 - DNA, 21 bp, Artificial Sequence
  Synthetic
ccgcaataagaatagcaatga

SEQ ID NO: 10109 - DNA, 23 bp, Artificial Sequence
  Synthetic
atctacagatagaaaagttgctt

SEQ ID NO: 10110 - DNA, 19 bp, Artificial Sequence
  Synthetic
ccgtagcaagtgattctga

SEQ ID NO: 10111 - DNA, 21 bp, Artificial Sequence
  Synthetic
gatggcaaacctgttatgagt

SEQ ID NO: 10112 - DNA, 23 bp, Artificial Sequence
  Synthetic
tgctcttgacaaactttacaaag

SEQ ID NO: 10113 - DNA, 19 bp, Artificial Sequence
  Synthetic
tgaaggtgtctctgtttgg

SEQ ID NO: 10114 - DNA, 22 bp, Artificial Sequence
  Synthetic
gtggtactatacaaattctcgc

SEQ ID NO: 10115 - DNA, 18 bp, Artificial Sequence
  Synthetic
cgtgaacgtggccttaat

SEQ ID NO: 10116 - DNA, 23 bp, Artificial Sequence
  Synthetic
aattgtcaaacctaatatcagcc

SEQ ID NO: 10117 - DNA, 18 bp, Artificial Sequence
  Synthetic
cacacaacagggtttgct

SEQ ID NO: 10118 - DNA, 20 bp, Artificial Sequence
  Synthetic
atggattgagctttttccac

SEQ ID NO: 10119 - DNA, 21 bp, Artificial Sequence
  Synthetic
tgtttacagagtcaagctttg

SEQ ID NO: 10120 - DNA, 22 bp, Artificial Sequence
  Synthetic
ccttttgaaatgccatttgaag

SEQ ID NO: 10121 - DNA, 22 bp, Artificial Sequence
  Synthetic
actggttttatggttatggatt

SEQ ID NO: 10122 - DNA, 25 bp, Artificial Sequence
  Synthetic
gtattaaggatgcagattataatgc

SEQ ID NO: 10123 - DNA, 20 bp, Artificial Sequence
  Synthetic
atacagacacagaggtttgt

SEQ ID NO: 10124 - DNA, 25 bp, Artificial Sequence
  Synthetic
ccttctggtaatcttattaagtttg

SEQ ID NO: 10125 - DNA, 22 bp, Artificial Sequence
  Synthetic
aagtcatttgaacaacaagttg

SEQ ID NO: 10126 - DNA, 23 bp, Artificial Sequence
  Synthetic
aaaactctgttgcatctatcaat

SEQ ID NO: 10127 - DNA, 24 bp, Artificial Sequence
  Synthetic
tttgtgtaaaactgcagtaactac

SEQ ID NO: 10128 - DNA, 22 bp, Artificial Sequence
  Synthetic
ggttatgctaagtcaaactttg

SEQ ID NO: 10129 - DNA, 23 bp, Artificial Sequence
  Synthetic
aaggttatttcttttgtcagaca

SEQ ID NO: 10130 - DNA, 25 bp, Artificial Sequence
  Synthetic
gatgtactacgtaatagctttggta

SEQ ID NO: 10131 - DNA, 19 bp, Artificial Sequence
  Synthetic
cagtctttctgctgaaggt

SEQ ID NO: 10132 - DNA, 23 bp, Artificial Sequence
  Synthetic
tttttgaaaactttgaggactgg

SEQ ID NO: 10133 - DNA, 22 bp, Artificial Sequence
  Synthetic
ttaagttgccagaagttattgc

SEQ ID NO: 10134 - DNA, 23 bp, Artificial Sequence
  Synthetic
ttagtaacaatgattgcttatgc

SEQ ID NO: 10135 - DNA, 20 bp, Artificial Sequence
  Synthetic
ttagcaaaagcaatgttgga

SEQ ID NO: 10136 - DNA, 19 bp, Artificial Sequence
  Synthetic
ttggtgttgtaggtgctac

SEQ ID NO: 10137 - DNA, 22 bp, Artificial Sequence
  Synthetic
ctttgatggtgttatgtatggt

SEQ ID NO: 10138 - DNA, 19 bp, Artificial Sequence
  Synthetic
cctgcaaagtggtaaaacc

SEQ ID NO: 10139 - DNA, 21 bp, Artificial Sequence
  Synthetic
ctgttatgcaaatggacatcc

SEQ ID NO: 10140 - DNA, 23 bp, Artificial Sequence
  Synthetic
gttttacatgttgttaggctttg

SEQ ID NO: 10141 - DNA, 25 bp, Artificial Sequence
  Synthetic
gtctaaattgactgatcttaagtgc

SEQ ID NO: 10142 - DNA, 23 bp, Artificial Sequence
  Synthetic
ttcctcaccacaaataatcaaac

SEQ ID NO: 10143 - DNA, 23 bp, Artificial Sequence
  Synthetic
taccagatcatgattcatttgtg

SEQ ID NO: 10144 - DNA, 25 bp, Artificial Sequence
  Synthetic
gaaggtaatgctctatacaacaatg

SEQ ID NO: 10145 - DNA, 21 bp, Artificial Sequence
  Synthetic
cattgttcttttgctgttgac

SEQ ID NO: 10146 - DNA, 21 bp, Artificial Sequence
  Synthetic
tgtaaagtttgtggttgttgg

SEQ ID NO: 10147 - DNA, 22 bp, Artificial Sequence
  Synthetic
gcatgatttctttacttggcat

SEQ ID NO: 10148 - DNA, 22 bp, Artificial Sequence
  Synthetic
gttttgaccttagacaaccaag

SEQ ID NO: 10149 - DNA, 23 bp, Artificial Sequence
  Synthetic
gcattgttcaaattttaacacac

SEQ ID NO: 10150 - DNA, 20 bp, Artificial Sequence
  Synthetic
acgcactgtttgtttttctg

SEQ ID NO: 10151 - DNA, 25 bp, Artificial Sequence
  Synthetic
tcattaacaaagcgtaatattctcc

SEQ ID NO: 10152 - DNA, 23 bp, Artificial Sequence
  Synthetic
ttgatgaatcttttgtggatgac

SEQ ID NO: 10153 - DNA, 19 bp, Artificial Sequence
  Synthetic
tctgctggtgtttttgtgg

SEQ ID NO: 10154 - DNA, 23 bp, Artificial Sequence
  Synthetic
tggaggtttgaattattactgtg

SEQ ID NO: 10155 - DNA, 20 bp, Artificial Sequence
  Synthetic
ccaccgttaaaccgtaattc

SEQ ID NO: 10156 - DNA, 19 bp, Artificial Sequence
  Synthetic
gcaaacagcgtataaccac

SEQ ID NO: 10157 - DNA, 19 bp, Artificial Sequence
  Synthetic
gacattgttgtcgtggatg

SEQ ID NO: 10158 - DNA, 22 bp, Artificial Sequence
  Synthetic
ctccagtataaataggcgtcaa

SEQ ID NO: 10159 - DNA, 22 bp, Artificial Sequence
  Synthetic
agtctgaaagtagttgtggttt

SEQ ID NO: 10160 - DNA, 19 bp, Artificial Sequence
  Synthetic
ctagagactttgccatgcg

SEQ ID NO: 10161 - DNA, 19 bp, Artificial Sequence
  Synthetic
ctggctcatctgatgtact

SEQ ID NO: 10162 - DNA, 19 bp, Artificial Sequence
  Synthetic
tgactagatgtttggctgt

SEQ ID NO: 10163 - DNA, 24 bp, Artificial Sequence
  Synthetic
gaattgtaatgtggatatgtaccc

SEQ ID NO: 10164 - DNA, 23 bp, Artificial Sequence
  Synthetic
tctctatagagcatatgttgagt

SEQ ID NO: 10165 - DNA, 22 bp, Artificial Sequence
  Synthetic
agtattctcaaaaaccttggtg

SEQ ID NO: 10166 - DNA, 21 bp, Artificial Sequence
  Synthetic
actgtcaaatcagaagatggt

SEQ ID NO: 10167 - DNA, 23 bp, Artificial Sequence
  Synthetic
ctgacataacactcaaatgttgt

SEQ ID NO: 10168 - DNA, 20 bp, Artificial Sequence
  Synthetic
cccagtggcattatgttcaa

SEQ ID NO: 10169 - DNA, 24 bp, Artificial Sequence
  Synthetic
acttctgttaatacgtcatcatca

SEQ ID NO: 10170 - DNA, 22 bp, Artificial Sequence
  Synthetic
aaatgtttgttttgcttgttgc

SEQ ID NO: 10171 - DNA, 22 bp, Artificial Sequence
  Synthetic
caacaacactttagtttcaggt

SEQ ID NO: 10172 - DNA, 20 bp, Artificial Sequence
  Synthetic
cagttgtcctttgatgtacc

SEQ ID NO: 10173 - DNA, 24 bp, Artificial Sequence
  Synthetic
gttcctttatgaatgttacattgg

SEQ ID NO: 10174 - DNA, 22 bp, Artificial Sequence
  Synthetic
gtccaatggcacttataattgc

SEQ ID NO: 10175 - DNA, 19 bp, Artificial Sequence
  Synthetic
ttaagaaatagcgccaggc

SEQ ID NO: 10176 - DNA, 20 bp, Artificial Sequence
  Synthetic
cgaatggccatgtatacagg

SEQ ID NO: 10177 - DNA, 22 bp, Artificial Sequence
  Synthetic
ctatctctagctctattcaggc

SEQ ID NO: 10178 - DNA, 20 bp, Artificial Sequence
  Synthetic
ataaggatgttgaagcgtgg

SEQ ID NO: 10179 - DNA, 23 bp, Artificial Sequence
  Synthetic
tattgatgttaataagacgctgc

SEQ ID NO: 10180 - DNA, 23 bp, Artificial Sequence
  Synthetic
gctattatgttgttgttctactg

SEQ ID NO: 10181 - DNA, 21 bp, Artificial Sequence
  Synthetic
cagagctgctcttatagtgtt

SEQ ID NO: 10182 - DNA, 25 bp, Artificial Sequence
  Synthetic
aattagaaatccactaagatgttcc

SEQ ID NO: 10183 - DNA, 23 bp, Artificial Sequence
  Synthetic
aatactccagattgttttatggt

SEQ ID NO: 10184 - DNA, 22 bp, Artificial Sequence
  Synthetic
acctacctgaatacatgacagt

SEQ ID NO: 10185 - DNA, 20 bp, Artificial Sequence
  Synthetic
ggtgatacctcgtaatttgg

SEQ ID NO: 10186 - DNA, 21 bp, Artificial Sequence
  Synthetic
gtgaatccaaacctcaatctc

SEQ ID NO: 10187 - DNA, 22 bp, Artificial Sequence
  Synthetic
gaaacaaaagaacaaaagcatg

SEQ ID NO: 10188 - DNA, 23 bp, Artificial Sequence
  Synthetic
aagtttcttgaggagttaaatgc

SEQ ID NO: 10189 - DNA, 22 bp, Artificial Sequence
  Synthetic
tgatctatgtatgatggtacga

SEQ ID NO: 10190 - DNA, 21 bp, Artificial Sequence
  Synthetic
actgtttggcatgtttacagt

SEQ ID NO: 10191 - DNA, 23 bp, Artificial Sequence
  Synthetic
tacaatttatagagactgaagcc

SEQ ID NO: 10192 - DNA, 18 bp, Artificial Sequence
  Synthetic
atcgttgtgtgtgtcgcc

SEQ ID NO: 10193 - DNA, 25 bp, Artificial Sequence
  Synthetic
tgtagaagagtatcaaatacttgca

SEQ ID NO: 10194 - DNA, 21 bp, Artificial Sequence
  Synthetic
gcagatgtagaacctaatgct

SEQ ID NO: 10195 - DNA, 20 bp, Artificial Sequence
  Synthetic
catggggactaacagatacc

SEQ ID NO: 10196 - DNA, 18 bp, Artificial Sequence
  Synthetic
caatcgacgaaggaagcg

SEQ ID NO: 10197 - DNA, 18 bp, Artificial Sequence
  Synthetic
cgcaaaagggacactgta

SEQ ID NO: 10198 - DNA, 18 bp, Artificial Sequence
  Synthetic
cgtgtaacatcccagggc

SEQ ID NO: 10199 - DNA, 18 bp, Artificial Sequence
  Synthetic
cagtgctgtcctagaggt

SEQ ID NO: 10200 - DNA, 18 bp, Artificial Sequence
  Synthetic
ccccagggctttccaaag

SEQ ID NO: 10201 - DNA, 21 bp, Artificial Sequence
  Synthetic
gagcctttactaaatgctgac

SEQ ID NO: 10202 - DNA, 25 bp, Artificial Sequence
  Synthetic
ctgatacattttatttgcatccttc

SEQ ID NO: 10203 - DNA, 23 bp, Artificial Sequence
  Synthetic
aaaactgttgttattcctaaggt

SEQ ID NO: 10204 - DNA, 23 bp, Artificial Sequence
  Synthetic
atgtctaatgatccatatggcag

SEQ ID NO: 10205 - DNA, 20 bp, Artificial Sequence
  Synthetic
ctcttactgctgatgtgttg

SEQ ID NO: 10206 - DNA, 18 bp, Artificial Sequence
  Synthetic
ggcaaggccttccacatg

SEQ ID NO: 10207 - DNA, 20 bp, Artificial Sequence
  Synthetic
acccttagatgtggacgaga

SEQ ID NO: 10208 - DNA, 20 bp, Artificial Sequence
  Synthetic
cattgggagaacaggggtac

SEQ ID NO: 10209 - DNA, 18 bp, Artificial Sequence
  Synthetic
gggcatgacatcagcgac

SEQ ID NO: 10210 - DNA, 17 bp, Artificial Sequence
  Synthetic
agaccctgcgctccatg

SEQ ID NO: 10211 - DNA, 16 bp, Artificial Sequence
  Synthetic
tgagtcccgctggctg

SEQ ID NO: 10212 - DNA, 23 bp, Artificial Sequence
  Synthetic
cacaaaacaaactatctccccta

SEQ ID NO: 10213 - DNA, 18 bp, Artificial Sequence
  Synthetic
tgtgtccaccccagtccc

SEQ ID NO: 10214 - DNA, 17 bp, Artificial Sequence
  Synthetic
cggggccaccttcatca

SEQ ID NO: 10215 - DNA, 16 bp, Artificial Sequence
  Synthetic
tcagggtcccctcgga

SEQ ID NO: 10216 - DNA, 18 bp, Artificial Sequence
  Synthetic
cccaggatgtcccccaga

SEQ ID NO: 10217 - DNA, 18 bp, Artificial Sequence
  Synthetic
acacccaggcacacacta

SEQ ID NO: 10218 - DNA, 20 bp, Artificial Sequence
  Synthetic
ggcttgtttgtgacttcacc

SEQ ID NO: 10219 - DNA, 19 bp, Artificial Sequence
  Synthetic
ctaagcccaacactccacc

SEQ ID NO: 10220 - DNA, 19 bp, Artificial Sequence
  Synthetic
caacacgaccccaaggaag

SEQ ID NO: 10221 - DNA, 17 bp, Artificial Sequence
  Synthetic
ggggtgtcttggggact

SEQ ID NO: 10222 - DNA, 17 bp, Artificial Sequence
  Synthetic
actcgtccgcctactgg

SEQ ID NO: 10223 - DNA, 17 bp, Artificial Sequence
  Synthetic
ccccccttgttgaggca

SEQ ID NO: 10224 - DNA, 17 bp, Artificial Sequence
  Synthetic
tgctggttggggaagga

SEQ ID NO: 10225 - DNA, 19 bp, Artificial Sequence
  Synthetic
atctgctgactgaaacccg

SEQ ID NO: 10226 - DNA, 16 bp, Artificial Sequence
  Synthetic
gccgaggcatagcgca

SEQ ID NO: 10227 - DNA, 18 bp, Artificial Sequence
  Synthetic
gggcctcctggatgatgg

SEQ ID NO: 10228 - DNA, 17 bp, Artificial Sequence
  Synthetic
aagcgtccagtctggcc

SEQ ID NO: 10229 - DNA, 20 bp, Artificial Sequence
  Synthetic
aggagagataatcggaggcc

SEQ ID NO: 10230 - DNA, 20 bp, Artificial Sequence
  Synthetic
gtcctcctcatctaccccag

SEQ ID NO: 10231 - DNA, 20 bp, Artificial Sequence
  Synthetic
cggacatggataggaaaggc

SEQ ID NO: 10232 - DNA, 18 bp, Artificial Sequence
  Synthetic
gttcctgccgttacccag

SEQ ID NO: 10233 - DNA, 16 bp, Artificial Sequence
  Synthetic
gcgtcccggcacacat

SEQ ID NO: 10234 - DNA, 16 bp, Artificial Sequence
  Synthetic
gggagcacagcctcca

SEQ ID NO: 10235 - DNA, 17 bp, Artificial Sequence
  Synthetic
gagagcgggttttgggc

SEQ ID NO: 10236 - DNA, 17 bp, Artificial Sequence
  Synthetic
tggaaacgaagctgccg

SEQ ID NO: 10237 - DNA, 19 bp, Artificial Sequence
  Synthetic
gcgagtactatcggctggt

SEQ ID NO: 10238 - DNA, 16 bp, Artificial Sequence
  Synthetic
caacctgtgcgccgag

SEQ ID NO: 10239 - DNA, 18 bp, Artificial Sequence
  Synthetic
tgagtgtggggccatacg

SEQ ID NO: 10240 - DNA, 19 bp, Artificial Sequence
  Synthetic
acggtcagtccatctcctt

SEQ ID NO: 10241 - DNA, 18 bp, Artificial Sequence
  Synthetic
aagtttggcccggtttgc

SEQ ID NO: 10242 - DNA, 16 bp, Artificial Sequence
  Synthetic
tccacactgagcccgg

SEQ ID NO: 10243 - DNA, 17 bp, Artificial Sequence
  Synthetic
cagcggctctgtgaggt

SEQ ID NO: 10244 - DNA, 17 bp, Artificial Sequence
  Synthetic
agagacgtccaggccca

SEQ ID NO: 10245 - DNA, 19 bp, Artificial Sequence
  Synthetic
tagccgggatcgatgatgc

SEQ ID NO: 10246 - DNA, 16 bp, Artificial Sequence
  Synthetic
tgctcttcctcgccgc

SEQ ID NO: 10247 - DNA, 19 bp, Artificial Sequence
  Synthetic
ttctgacgcttgtcttagt

SEQ ID NO: 10248 - DNA, 18 bp, Artificial Sequence
  Synthetic
acccccaaccattcacct

SEQ ID NO: 10249 - DNA, 17 bp, Artificial Sequence
  Synthetic
gccccggggaaacttct

SEQ ID NO: 10250 - DNA, 18 bp, Artificial Sequence
  Synthetic
gccgtgtgaagctcttga

SEQ ID NO: 10251 - DNA, 20 bp, Artificial Sequence
  Synthetic
gtcatcttgcagatcctggc

SEQ ID NO: 10252 - DNA, 16 bp, Artificial Sequence
  Synthetic
gtcccccaccacgtct

SEQ ID NO: 10253 - DNA, 18 bp, Artificial Sequence
  Synthetic
ctcggtgtcactgttgcc

SEQ ID NO: 10254 - DNA, 19 bp, Artificial Sequence
  Synthetic
attaggcgactctgcatca

SEQ ID NO: 10255 - DNA, 20 bp, Artificial Sequence
  Synthetic
tgctctcagttaacgagcag

SEQ ID NO: 10256 - DNA, 19 bp, Artificial Sequence
  Synthetic
ccagtgacgaagacccatc

SEQ ID NO: 10257 - DNA, 18 bp, Artificial Sequence
  Synthetic
catcccaggcaacctcca

SEQ ID NO: 10258 - DNA, 20 bp, Artificial Sequence
  Synthetic
ccacggctgttagaatgtgc

SEQ ID NO: 10259 - DNA, 19 bp, Artificial Sequence
  Synthetic
ccagtatttggccaggtcc

SEQ ID NO: 10260 - DNA, 20 bp, Artificial Sequence
  Synthetic
tgaccatcgagtaccttccg

SEQ ID NO: 10261 - DNA, 20 bp, Artificial Sequence
  Synthetic
tctacatcgaggacctcggt

SEQ ID NO: 10262 - DNA, 16 bp, Artificial Sequence
  Synthetic
cgtggccaccaacgtc

SEQ ID NO: 10263 - DNA, 18 bp, Artificial Sequence
  Synthetic
agttcggggtccaggagg

SEQ ID NO: 10264 - DNA, 19 bp, Artificial Sequence
  Synthetic
agagtgcctctgagcatgg

SEQ ID NO: 10265 - DNA, 19 bp, Artificial Sequence
  Synthetic
tgtttgagatctgaggagg

SEQ ID NO: 10266 - DNA, 16 bp, Artificial Sequence
  Synthetic
ccatggcgcggtgtca

SEQ ID NO: 10267 - DNA, 20 bp, Artificial Sequence
  Synthetic
agttcaggttccacatctgc

SEQ ID NO: 10268 - DNA, 17 bp, Artificial Sequence
  Synthetic
cctggtgaggtgtgcca

SEQ ID NO: 10269 - DNA, 18 bp, Artificial Sequence
  Synthetic
cctctttctggacggggc

SEQ ID NO: 10270 - DNA, 18 bp, Artificial Sequence
  Synthetic
catagctcgagggcccca

SEQ ID NO: 10271 - DNA, 18 bp, Artificial Sequence
  Synthetic
tccagaagccagggaggg

SEQ ID NO: 10272 - DNA, 18 bp, Artificial Sequence
  Synthetic
ccatccactgccgtgatg

SEQ ID NO: 10273 - DNA, 18 bp, Artificial Sequence
  Synthetic
ctggagatccccgtgact

SEQ ID NO: 10274 - DNA, 23 bp, Artificial Sequence
  Synthetic
aggaaaaacataacaatcttgtg

SEQ ID NO: 10275 - DNA, 17 bp, Artificial Sequence
  Synthetic
tgtaggcggggagatgc

SEQ ID NO: 10276 - DNA, 16 bp, Artificial Sequence
  Synthetic
agcccgctctctgtcc

SEQ ID NO: 10277 - DNA, 17 bp, Artificial Sequence
  Synthetic
acggtatgcaggggctg

SEQ ID NO: 10278 - DNA, 20 bp, Artificial Sequence
  Synthetic
atgctctccttcctctgagc

SEQ ID NO: 10279 - DNA, 17 bp, Artificial Sequence
  Synthetic
acacaggccccgaactc

SEQ ID NO: 10280 - DNA, 17 bp, Artificial Sequence
  Synthetic
tcgtctgcaccccagtg

SEQ ID NO: 10281 - DNA, 18 bp, Artificial Sequence
  Synthetic
atagcgggcacaatggtg

SEQ ID NO: 10282 - DNA, 20 bp, Artificial Sequence
  Synthetic
taatgatgaggagcaccgga

SEQ ID NO: 10283 - DNA, 18 bp, Artificial Sequence
  Synthetic
tggcgtttaccggacaca

SEQ ID NO: 10284 - DNA, 17 bp, Artificial Sequence
  Synthetic
ctcaaggcgaggctcct

SEQ ID NO: 10285 - DNA, 18 bp, Artificial Sequence
  Synthetic
tggatctggggcagttcc

SEQ ID NO: 10286 - DNA, 18 bp, Artificial Sequence
  Synthetic
catcagggtcttgccgtc

SEQ ID NO: 10287 - DNA, 16 bp, Artificial Sequence
  Synthetic
cggcgatggagaggca

SEQ ID NO: 10288 - DNA, 19 bp, Artificial Sequence
  Synthetic
cacatcctccttcttggcc

SEQ ID NO: 10289 - DNA, 20 bp, Artificial Sequence
  Synthetic
atgggaactcgtagacctca

SEQ ID NO: 10290 - DNA, 16 bp, Artificial Sequence
  Synthetic
tcccagggacccgaga

SEQ ID NO: 10291 - DNA, 19 bp, Artificial Sequence
  Synthetic
gccaggtggttacaggaga

SEQ ID NO: 10292 - DNA, 18 bp, Artificial Sequence
  Synthetic
aaactggaccacttcggc

SEQ ID NO: 10293 - DNA, 20 bp, Artificial Sequence
  Synthetic
cgtagaggacggaattggtg

SEQ ID NO: 10294 - DNA, 15 bp, Artificial Sequence
  Synthetic
aaggagcggcaccgt

SEQ ID NO: 10295 - DNA, 18 bp, Artificial Sequence
  Synthetic
tacgtgcgtgtctttgcc

SEQ ID NO: 10296 - DNA, 16 bp, Artificial Sequence
  Synthetic
gaggtcgttggcggca

SEQ ID NO: 10297 - DNA, 22 bp, Artificial Sequence
  Synthetic
caacaataatttcctgtgcaca

SEQ ID NO: 10298 - DNA, 19 bp, Artificial Sequence
  Synthetic
ttggagaaactgttgcaga

SEQ ID NO: 10299 - DNA, 21 bp, Artificial Sequence
  Synthetic
ccctggcattgtttaatgaac

SEQ ID NO: 10300 - DNA, 23 bp, Artificial Sequence
  Synthetic
caaaagctgttttgtaacatgtt

SEQ ID NO: 10301 - DNA, 25 bp, Artificial Sequence
  Synthetic
cctaacaaattaccatttaatgagg

SEQ ID NO: 10302 - DNA, 18 bp, Artificial Sequence
  Synthetic
gcatagagcagctggaaa

SEQ ID NO: 10303 - DNA, 19 bp, Artificial Sequence
  Synthetic
gttcacgacctattcctga

SEQ ID NO: 10304 - DNA, 23 bp, Artificial Sequence
  Synthetic
taggttttgcagaaaatattgtg

SEQ ID NO: 10305 - DNA, 19 bp, Artificial Sequence
  Synthetic
gcagaccactggaaaactg

SEQ ID NO: 10306 - DNA, 24 bp, Artificial Sequence
  Synthetic
ttacaaaaccatgtaaagataggc

SEQ ID NO: 10307 - DNA, 25 bp, Artificial Sequence
  Synthetic
gctcatattaatgtaatgaatccac

SEQ ID NO: 10308 - DNA, 25 bp, Artificial Sequence
  Synthetic
ctctacaaataaatctgcaaacttg

SEQ ID NO: 10309 - DNA, 22 bp, Artificial Sequence
  Synthetic
agcaggggaaaataaaaacaac

SEQ ID NO: 10310 - DNA, 18 bp, Artificial Sequence
  Synthetic
ggatggctcttgggaaac

SEQ ID NO: 10311 - DNA, 22 bp, Artificial Sequence
  Synthetic
gggaaaagcagtttttacagaa

SEQ ID NO: 10312 - DNA, 22 bp, Artificial Sequence
  Synthetic
gaggatgaactattactggacc

SEQ ID NO: 10313 - DNA, 19 bp, Artificial Sequence
  Synthetic
gagtgccaaattgaggatg

SEQ ID NO: 10314 - DNA, 22 bp, Artificial Sequence
  Synthetic
gcatggaaagtgtaagaaatgg

SEQ ID NO: 10315 - DNA, 18 bp, Artificial Sequence
  Synthetic
caaccgccaatttcactg

SEQ ID NO: 10316 - DNA, 23 bp, Artificial Sequence
  Synthetic
tgttgataccttgtaaattttgc

SEQ ID NO: 10317 - DNA, 24 bp, Artificial Sequence
  Synthetic
ggaaatatttgtattaggtgtcgc

SEQ ID NO: 10318 - DNA, 18 bp, Artificial Sequence
  Synthetic
cggtgcaagacttcgttt

SEQ ID NO: 10319 - DNA, 22 bp, Artificial Sequence
  Synthetic
agtttagatggtgatttggaaa

SEQ ID NO: 10320 - DNA, 20 bp, Artificial Sequence
  Synthetic
acagcggactagaatgttct

SEQ ID NO: 10321 - DNA, 20 bp, Artificial Sequence
  Synthetic
ggtaattgctgtgtatgctg

SEQ ID NO: 10322 - DNA, 23 bp, Artificial Sequence
  Synthetic
agtatgaaccctaatgtatacgc

SEQ ID NO: 10323 - DNA, 23 bp, Artificial Sequence
  Synthetic
gaccaaaagtacaaatatttgca

SEQ ID NO: 10324 - DNA, 18 bp, Artificial Sequence
  Synthetic
gtcagattgaccactggc

SEQ ID NO: 10325 - DNA, 20 bp, Artificial Sequence
  Synthetic
tgtttgcccctgttactagc

SEQ ID NO: 10326 - DNA, 20 bp, Artificial Sequence
  Synthetic
caagggtcgaacagaaaccg

SEQ ID NO: 10327 - DNA, 18 bp, Artificial Sequence
  Synthetic
gacatcacgggagacttg

SEQ ID NO: 10328 - DNA, 23 bp, Artificial Sequence
  Synthetic
cctacagtagattggtctttagg

SEQ ID NO: 10329 - DNA, 18 bp, Artificial Sequence
  Synthetic
tgtttttcgggggcttgg

SEQ ID NO: 10330 - DNA, 19 bp, Artificial Sequence
  Synthetic
gttgaccttttacctggtg

SEQ ID NO: 10331 - DNA, 23 bp, Artificial Sequence
  Synthetic
ttcagtttgataatccagcattt

SEQ ID NO: 10332 - DNA, 24 bp, Artificial Sequence
  Synthetic
accattaacacagaagaacctata

SEQ ID NO: 10333 - DNA, 19 bp, Artificial Sequence
  Synthetic
ccagcaagtggtaaggtat

SEQ ID NO: 10334 - DNA, 25 bp, Artificial Sequence
  Synthetic
ttataatcctgataaggaacgtcta

SEQ ID NO: 10335 - DNA, 21 bp, Artificial Sequence
  Synthetic
agagaacaatgttatgccagg

SEQ ID NO: 10336 - DNA, 19 bp, Artificial Sequence
  Synthetic
aaaatgcggacgtaagaga

SEQ ID NO: 10337 - DNA, 20 bp, Artificial Sequence
  Synthetic
gctttgcaagacaatcaagg

SEQ ID NO: 10338 - DNA, 18 bp, Artificial Sequence
  Synthetic
tttacgaggtagccaggt

SEQ ID NO: 10339 - DNA, 18 bp, Artificial Sequence
  Synthetic
catccgttcttcacagga

SEQ ID NO: 10340 - DNA, 21 bp, Artificial Sequence
  Synthetic
cttagaaaaatcttcgcagcg

SEQ ID NO: 10341 - DNA, 22 bp, Artificial Sequence
  Synthetic
atcagaggatatagcttgcaaa

SEQ ID NO: 10342 - DNA, 18 bp, Artificial Sequence
  Synthetic
ccccttgaggcatttgtg

SEQ ID NO: 10343 - DNA, 19 bp, Artificial Sequence
  Synthetic
aacatactgcagcttgtgg

SEQ ID NO: 10344 - DNA, 20 bp, Artificial Sequence
  Synthetic
attcgtggaactttcagtca

SEQ ID NO: 10345 - DNA, 22 bp, Artificial Sequence
  Synthetic
atagggatgttttgatcgaatc

SEQ ID NO: 10346 - DNA, 20 bp, Artificial Sequence
  Synthetic
ctgtggctccaaatacagat

SEQ ID NO: 10347 - DNA, 18 bp, Artificial Sequence
  Synthetic
caaactagacgctcgcat

SEQ ID NO: 10348 - DNA, 19 bp, Artificial Sequence
  Synthetic
ctctggaagcaaaggtttc

SEQ ID NO: 10349 - DNA, 18 bp, Artificial Sequence
  Synthetic
atcgcccaacaattttcc

SEQ ID NO: 10350 - DNA, 23 bp, Artificial Sequence
  Synthetic
gagcaagaatttgtaagaaacag

SEQ ID NO: 10351 - DNA, 20 bp, Artificial Sequence
  Synthetic
tagactagttctgcgccttt

SEQ ID NO: 10352 - DNA, 18 bp, Artificial Sequence
  Synthetic
tctcgaagccgtagaagc

SEQ ID NO: 10353 - DNA, 21 bp, Artificial Sequence
  Synthetic
agttcattcgttttgtatcgt

SEQ ID NO: 10354 - DNA, 20 bp, Artificial Sequence
  Synthetic
ccctgttttcttctcggaaa

SEQ ID NO: 10355 - DNA, 22 bp, Artificial Sequence
  Synthetic
ctattcaactaaatggagcact

SEQ ID NO: 10356 - DNA, 18 bp, Artificial Sequence
  Synthetic
ctagacgggcgatttctg

SEQ ID NO: 10357 - DNA, 21 bp, Artificial Sequence
  Synthetic
ggtatcgtaacgaatagccaa

SEQ ID NO: 10358 - DNA, 18 bp, Artificial Sequence
  Synthetic
ccaacacttccgcgattt

SEQ ID NO: 10359 - DNA, 21 bp, Artificial Sequence
  Synthetic
tggcagattctttttcgtgaa

SEQ ID NO: 10360 - DNA, 21 bp, Artificial Sequence
  Synthetic
aaagccttttagtcattccaa

SEQ ID NO: 10361 - DNA, 18 bp, Artificial Sequence
  Synthetic
atgacagagacacgacga

SEQ ID NO: 10362 - DNA, 20 bp, Artificial Sequence
  Synthetic
agcaatagtcctttccatcg

SEQ ID NO: 10363 - DNA, 21 bp, Artificial Sequence
  Synthetic
atctctagaaacttgtgcaga

SEQ ID NO: 10364 - DNA, 23 bp, Artificial Sequence
  Synthetic
tgcagaagctaagtttatcaaac

SEQ ID NO: 10365 - DNA, 20 bp, Artificial Sequence
  Synthetic
acgaataacaccacgatagc

SEQ ID NO: 10366 - DNA, 19 bp, Artificial Sequence
  Synthetic
tgggcagaatcttatccag

SEQ ID NO: 10367 - DNA, 21 bp, Artificial Sequence
  Synthetic
ccaactcctgtaatacatggt

SEQ ID NO: 10368 - DNA, 18 bp, Artificial Sequence
  Synthetic
ggagagtctcatgaccac

SEQ ID NO: 10369 - DNA, 21 bp, Artificial Sequence
  Synthetic
atttccttcattacgacagga

SEQ ID NO: 10370 - DNA, 19 bp, Artificial Sequence
  Synthetic
gatctcgcatagctgaagg

SEQ ID NO: 10371 - DNA, 21 bp, Artificial Sequence
  Synthetic
ccccaatttttcatgaagagc

SEQ ID NO: 10372 - DNA, 19 bp, Artificial Sequence
  Synthetic
gtgaactcaagctcttcac

SEQ ID NO: 10373 - DNA, 21 bp, Artificial Sequence
  Synthetic
taagacgttgctcttatcacc

SEQ ID NO: 10374 - DNA, 20 bp, Artificial Sequence
  Synthetic
taatttcgccacaagaccac

SEQ ID NO: 10375 - DNA, 18 bp, Artificial Sequence
  Synthetic
gaagtcaacccatccacc

SEQ ID NO: 10376 - DNA, 21 bp, Artificial Sequence
  Synthetic
caattgcacttcaaactcaac

SEQ ID NO: 10377 - DNA, 23 bp, Artificial Sequence
  Synthetic
aactgtgtatgaggtttaacact

SEQ ID NO: 10378 - DNA, 22 bp, Artificial Sequence
  Synthetic
atcacaaaccataacaatacga

SEQ ID NO: 10379 - DNA, 21 bp, Artificial Sequence
  Synthetic
catgctttctgtagaaaaacg

SEQ ID NO: 10380 - DNA, 18 bp, Artificial Sequence
  Synthetic
tagcttcaacacgcctct

SEQ ID NO: 10381 - DNA, 18 bp, Artificial Sequence
  Synthetic
ctcctcttcctgctgttg

SEQ ID NO: 10382 - DNA, 20 bp, Artificial Sequence
  Synthetic
agcgctcttaaacaatctca

SEQ ID NO: 10383 - DNA, 23 bp, Artificial Sequence
  Synthetic
caagcatcacaagatttatagcc

SEQ ID NO: 10384 - DNA, 18 bp, Artificial Sequence
  Synthetic
aactgctccaaaacctga

SEQ ID NO: 10385 - DNA, 23 bp, Artificial Sequence
  Synthetic
agtttgaaactccaatactcttc

SEQ ID NO: 10386 - DNA, 22 bp, Artificial Sequence
  Synthetic
taataaccgtatccgtttgact

SEQ ID NO: 10387 - DNA, 20 bp, Artificial Sequence
  Synthetic
tcaggagacgagaaatcaac

SEQ ID NO: 10388 - DNA, 18 bp, Artificial Sequence
  Synthetic
tgtcattctcggagcaac

SEQ ID NO: 10389 - DNA, 21 bp, Artificial Sequence
  Synthetic
tttccatatttcgtgattgca

SEQ ID NO: 10390 - DNA, 21 bp, Artificial Sequence
  Synthetic
gtggaaaagctttgttagagg

SEQ ID NO: 10391 - DNA, 18 bp, Artificial Sequence
  Synthetic
gctgttgtgttcaaagct

SEQ ID NO: 10392 - DNA, 19 bp, Artificial Sequence
  Synthetic
aaaatcctcgctatcccct

SEQ ID NO: 10393 - DNA, 18 bp, Artificial Sequence
  Synthetic
attgatccgagcaaggga

SEQ ID NO: 10394 - DNA, 18 bp, Artificial Sequence
  Synthetic
gcccggaattggatttgg

SEQ ID NO: 10395 - DNA, 20 bp, Artificial Sequence
  Synthetic
ctttggatagagaagctgct

SEQ ID NO: 10396 - DNA, 18 bp, Artificial Sequence
  Synthetic
ctcaagcgtacgtccttc

SEQ ID NO: 10397 - DNA, 18 bp, Artificial Sequence
  Synthetic
acaagaagcggtgtgaag

SEQ ID NO: 10398 - DNA, 18 bp, Artificial Sequence
  Synthetic
cgttcgttgcagacttac

SEQ ID NO: 10399 - DNA, 19 bp, Artificial Sequence
  Synthetic
gacgttactgcatcttctg

SEQ ID NO: 10400 - DNA, 21 bp, Artificial Sequence
  Synthetic
ttaaatcccttcccattcagg

SEQ ID NO: 10401 - DNA, 22 bp, Artificial Sequence
  Synthetic
gactctgaaggtaatatcgagt

SEQ ID NO: 10402 - DNA, 21 bp, Artificial Sequence
  Synthetic
gaatttaatccctcttcgacc

SEQ ID NO: 10403 - DNA, 19 bp, Artificial Sequence
  Synthetic
ttcaggaacagcttgtgtg

SEQ ID NO: 10404 - DNA, 20 bp, Artificial Sequence
  Synthetic
gcctagtcctggtaaaactg

SEQ ID NO: 10405 - DNA, 19 bp, Artificial Sequence
  Synthetic
aaaggagtcggaccatgaa

SEQ ID NO: 10406 - DNA, 22 bp, Artificial Sequence
  Synthetic
ccagctttctgtaaaaagacaa

SEQ ID NO: 10407 - DNA, 19 bp, Artificial Sequence
  Synthetic
agaaaattgcggaggaacc

SEQ ID NO: 10408 - DNA, 18 bp, Artificial Sequence
  Synthetic
gcatcttcaggaaccgta

SEQ ID NO: 10409 - DNA, 25 bp, Artificial Sequence
  Synthetic
atctactaagccctatattaaagtc

SEQ ID NO: 10410 - DNA, 21 bp, Artificial Sequence
  Synthetic
caaaaccgatacagaacatct

SEQ ID NO: 10411 - DNA, 19 bp, Artificial Sequence
  Synthetic
ctgtccatacactaagcca

SEQ ID NO: 10412 - DNA, 18 bp, Artificial Sequence
  Synthetic
ccattccaccatctgagc

SEQ ID NO: 10413 - DNA, 20 bp, Artificial Sequence
  Synthetic
taaaaagtgagcaacgaacc

SEQ ID NO: 10414 - DNA, 22 bp, Artificial Sequence
  Synthetic
ttttcgttacactcttatctgg

SEQ ID NO: 10415 - DNA, 23 bp, Artificial Sequence
  Synthetic
taattccataagtagtttctgca

SEQ ID NO: 10416 - DNA, 19 bp, Artificial Sequence
  Synthetic
gacatcaacccgaacttct

SEQ ID NO: 10417 - DNA, 19 bp, Artificial Sequence
  Synthetic
tacggccattatgaacctc

SEQ ID NO: 10418 - DNA, 23 bp, Artificial Sequence
  Synthetic
ttctctcttttttgttgatacga

SEQ ID NO: 10419 - DNA, 22 bp, Artificial Sequence
  Synthetic
gcttacattcaagatgagagaa

SEQ ID NO: 10420 - DNA, 20 bp, Artificial Sequence
  Synthetic
ttagaagaactttgcgagca

SEQ ID NO: 10421 - DNA, 22 bp, Artificial Sequence
  Synthetic
ccttctgacttcatgatcatca

SEQ ID NO: 10422 - DNA, 19 bp, Artificial Sequence
  Synthetic
aactattcccgtcaccaat

SEQ ID NO: 10423 - DNA, 18 bp, Artificial Sequence
  Synthetic
agaacaaacgaaggagct

SEQ ID NO: 10424 - DNA, 18 bp, Artificial Sequence
  Synthetic
ccgcttttggtttcttcc

SEQ ID NO: 10425 - DNA, 20 bp, Artificial Sequence
  Synthetic
tagaagctatggccaaaacg

SEQ ID NO: 10426 - DNA, 18 bp, Artificial Sequence
  Synthetic
ttcgataacagaccgctc

SEQ ID NO: 10427 - DNA, 18 bp, Artificial Sequence
  Synthetic
gctggaaactcctatccg

SEQ ID NO: 10428 - DNA, 18 bp, Artificial Sequence
  Synthetic
atcgatggagctgtaggc

SEQ ID NO: 10429 - DNA, 18 bp, Artificial Sequence
  Synthetic
taacgcacgggaaaaagt

SEQ ID NO: 10430 - DNA, 22 bp, Artificial Sequence
  Synthetic
tttcgaaaccataccattactc

SEQ ID NO: 10431 - DNA, 19 bp, Artificial Sequence
  Synthetic
tctttatcagggagagggc

SEQ ID NO: 10432 - DNA, 19 bp, Artificial Sequence
  Synthetic
gaaacgcaaacatggggta

SEQ ID NO: 10433 - DNA, 21 bp, Artificial Sequence
  Synthetic
tttgtaattgctggttttcct

SEQ ID NO: 10434 - DNA, 20 bp, Artificial Sequence
  Synthetic
atggcacgtcttaaaagagc

SEQ ID NO: 10435 - DNA, 18 bp, Artificial Sequence
  Synthetic
acaagatcagtggcaagc

SEQ ID NO: 10436 - DNA, 18 bp, Artificial Sequence
  Synthetic
aatgcgcacagagaactc

SEQ ID NO: 10437 - DNA, 24 bp, Artificial Sequence
  Synthetic
aatacttccactatatccccttag

SEQ ID NO: 10438 - DNA, 23 bp, Artificial Sequence
  Synthetic
catatccttgttgatgttcttga

SEQ ID NO: 10439 - DNA, 21 bp, Artificial Sequence
  Synthetic
cgcctatggattaaaaatggg

SEQ ID NO: 10440 - DNA, 23 bp, Artificial Sequence
  Synthetic
atctggattattagcaaagactt

SEQ ID NO: 10441 - DNA, 19 bp, Artificial Sequence
  Synthetic
acgggatcaccttttctca

SEQ ID NO: 10442 - DNA, 18 bp, Artificial Sequence
  Synthetic
ctcttgtgcatgcgacat

SEQ ID NO: 10443 - DNA, 20 bp, Artificial Sequence
  Synthetic
atcagaaggtagggggattc

SEQ ID NO: 10444 - DNA, 20 bp, Artificial Sequence
  Synthetic
gggacaataatgaaggcctt

SEQ ID NO: 10445 - DNA, 18 bp, Artificial Sequence
  Synthetic
cggacgttatggaccagt

SEQ ID NO: 10446 - DNA, 18 bp, Artificial Sequence
  Synthetic
tcgaagacaacagggaac

SEQ ID NO: 10447 - DNA, 22 bp, Artificial Sequence
  Synthetic
caggagcttttaaaattacagg

SEQ ID NO: 10448 - DNA, 18 bp, Artificial Sequence
  Synthetic
agctcgtggtcaagaaga

SEQ ID NO: 10449 - DNA, 20 bp, Artificial Sequence
  Synthetic
aaaaccccctctttagaaga

SEQ ID NO: 10450 - DNA, 20 bp, Artificial Sequence
  Synthetic
aaactttggaagatgctgga

SEQ ID NO: 10451 - DNA, 23 bp, Artificial Sequence
  Synthetic
gaaagggatttgttctgttttac

SEQ ID NO: 10452 - DNA, 18 bp, Artificial Sequence
  Synthetic
ctttgccggaaattgctc

SEQ ID NO: 10453 - DNA, 22 bp, Artificial Sequence
  Synthetic
taatgggagtggaaatggatac

SEQ ID NO: 10454 - DNA, 18 bp, Artificial Sequence
  Synthetic
cttttgcgtatggctacc

SEQ ID NO: 10455 - DNA, 22 bp, Artificial Sequence
  Synthetic
tagtgacaatagtaggagaagc

SEQ ID NO: 10456 - DNA, 20 bp, Artificial Sequence
  Synthetic
cgtgatatagctatcccgga

SEQ ID NO: 10457 - DNA, 22 bp, Artificial Sequence
  Synthetic
gtggagaagtagactttgagtt

SEQ ID NO: 10458 - DNA, 23 bp, Artificial Sequence
  Synthetic
cttttactgctaagattggatcg

SEQ ID NO: 10459 - DNA, 18 bp, Artificial Sequence
  Synthetic
aggaaacgccatctttcc

SEQ ID NO: 10460 - DNA, 19 bp, Artificial Sequence
  Synthetic
tgttgtttcggagagaagg

SEQ ID NO: 10461 - DNA, 19 bp, Artificial Sequence
  Synthetic
aacttgcttctcagtgagg

SEQ ID NO: 10462 - DNA, 20 bp, Artificial Sequence
  Synthetic
catctctctcgctatctgat

SEQ ID NO: 10463 - DNA, 18 bp, Artificial Sequence
  Synthetic
cgaatcgcccttattggt

SEQ ID NO: 10464 - DNA, 22 bp, Artificial Sequence
  Synthetic
agagatacaaagtgtcttgagt

SEQ ID NO: 10465 - DNA, 21 bp, Artificial Sequence
  Synthetic
gagatcctttttgcaagagaa

SEQ ID NO: 10466 - DNA, 21 bp, Artificial Sequence
  Synthetic
ataacgattacttgcttgtgc

SEQ ID NO: 10467 - DNA, 19 bp, Artificial Sequence
  Synthetic
gactacagtctctcctggg

SEQ ID NO: 10468 - DNA, 23 bp, Artificial Sequence
  Synthetic
ccctaattttatgctaagtgggt

SEQ ID NO: 10469 - DNA, 20 bp, Artificial Sequence
  Synthetic
gcagagaatcctttctgttt

SEQ ID NO: 10470 - DNA, 20 bp, Artificial Sequence
  Synthetic
ttggcttggattacgaatgt

SEQ ID NO: 10471 - DNA, 18 bp, Artificial Sequence
  Synthetic
tattgtctccggcttgtg

SEQ ID NO: 10472 - DNA, 18 bp, Artificial Sequence
  Synthetic
caactgtttccgcagctt

SEQ ID NO: 10473 - DNA, 19 bp, Artificial Sequence
  Synthetic
agttcgttgctatccacat

SEQ ID NO: 10474 - DNA, 20 bp, Artificial Sequence
  Synthetic
aacacttttgagctgctatc

SEQ ID NO: 10475 - DNA, 18 bp, Artificial Sequence
  Synthetic
caccccagagttgtcttt

SEQ ID NO: 10476 - DNA, 21 bp, Artificial Sequence
  Synthetic
atgcttttttggttatgcatg

SEQ ID NO: 10477 - DNA, 22 bp, Artificial Sequence
  Synthetic
aaaatttccaggggatagagaa

SEQ ID NO: 10478 - DNA, 18 bp, Artificial Sequence
  Synthetic
agaagtttgatgcggagg

SEQ ID NO: 10479 - DNA, 23 bp, Artificial Sequence
  Synthetic
gtttgtttttggccttatctttg

SEQ ID NO: 10480 - DNA, 18 bp, Artificial Sequence
  Synthetic
cgaacaatggaaagctgg

SEQ ID NO: 10481 - DNA, 20 bp, Artificial Sequence
  Synthetic
agatgccaaaatgacgattg

SEQ ID NO: 10482 - DNA, 18 bp, Artificial Sequence
  Synthetic
gctgggagagaaactgtg

SEQ ID NO: 10483 - DNA, 19 bp, Artificial Sequence
  Synthetic
aggctttttgggagttacc

SEQ ID NO: 10484 - DNA, 24 bp, Artificial Sequence
  Synthetic
ctttttattgctatagctaccgag

SEQ ID NO: 10485 - DNA, 20 bp, Artificial Sequence
  Synthetic
acaattgttaagcgcaatgg

SEQ ID NO: 10486 - DNA, 21 bp, Artificial Sequence
  Synthetic
ccaatattgaaaaggagcctg

SEQ ID NO: 10487 - DNA, 21 bp, Artificial Sequence
  Synthetic
caatcttggttttgttgatgc

SEQ ID NO: 10488 - DNA, 18 bp, Artificial Sequence
  Synthetic
ggatgaacggttctgcta

SEQ ID NO: 10489 - DNA, 19 bp, Artificial Sequence
  Synthetic
aagactaatcttccagcgt

SEQ ID NO: 10490 - DNA, 19 bp, Artificial Sequence
  Synthetic
acgctcgataatttgacgg

SEQ ID NO: 10491 - DNA, 22 bp, Artificial Sequence
  Synthetic
cagcagcagaatatctagagaa

SEQ ID NO: 10492 - DNA, 20 bp, Artificial Sequence
  Synthetic
agagatagggaaaagaggga

SEQ ID NO: 10493 - DNA, 19 bp, Artificial Sequence
  Synthetic
aagctacctgttccgagtt

SEQ ID NO: 10494 - DNA, 21 bp, Artificial Sequence
  Synthetic
gatcattgactgtgttagctt

SEQ ID NO: 10495 - DNA, 19 bp, Artificial Sequence
  Synthetic
attcccgtagttagtccgg

SEQ ID NO: 10496 - DNA, 23 bp, Artificial Sequence
  Synthetic
tatttttatcgcgaatagaaacg

SEQ ID NO: 10497 - DNA, 19 bp, Artificial Sequence
  Synthetic
gctttattgggactgggtt

SEQ ID NO: 10498 - DNA, 21 bp, Artificial Sequence
  Synthetic
gtactacgagagaagttcgtg

SEQ ID NO: 10499 - DNA, 23 bp, Artificial Sequence
  Synthetic
aaccatcaaaagcttctaaaagg

SEQ ID NO: 10500 - DNA, 20 bp, Artificial Sequence
  Synthetic
ttcgtctacaattgagaggc

SEQ ID NO: 10501 - DNA, 18 bp, Artificial Sequence
  Synthetic
caagcagcaggatccaat

SEQ ID NO: 10502 - DNA, 18 bp, Artificial Sequence
  Synthetic
tgggtataatcctgggcc

SEQ ID NO: 10503 - DNA, 21 bp, Artificial Sequence
  Synthetic
aacaagctttatgtggatcct

SEQ ID NO: 10504 - DNA, 24 bp, Artificial Sequence
  Synthetic
gatggaacgactgtttctttaaat

SEQ ID NO: 10505 - DNA, 20 bp, Artificial Sequence
  Synthetic
atacgccctaattcagctaa

SEQ ID NO: 10506 - DNA, 18 bp, Artificial Sequence
  Synthetic
acggagattctcgcctag

SEQ ID NO: 10507 - DNA, 20 bp, Artificial Sequence
  Synthetic
caccaaacggtcttatgaac

SEQ ID NO: 10508 - DNA, 22 bp, Artificial Sequence
  Synthetic
ggaaggatcctaagaaaactgg

SEQ ID NO: 10509 - DNA, 19 bp, Artificial Sequence
  Synthetic
ctgcagtcaaaggagttgg

SEQ ID NO: 10510 - DNA, 22 bp, Artificial Sequence
  Synthetic
actagaggagtacaaattgctt

SEQ ID NO: 10511 - DNA, 18 bp, Artificial Sequence
  Synthetic
ttagcgggcaattcctct

SEQ ID NO: 10512 - DNA, 20 bp, Artificial Sequence
  Synthetic
tcaagatttgagtcagtcgc

SEQ ID NO: 10513 - DNA, 21 bp, Artificial Sequence
  Synthetic
gcctcatacaagatcttcaga

SEQ ID NO: 10514 - DNA, 20 bp, Artificial Sequence
  Synthetic
cagtatcgtctaatggagca

SEQ ID NO: 10515 - DNA, 21 bp, Artificial Sequence
  Synthetic
atcattgggatcttgcacttt

SEQ ID NO: 10516 - DNA, 25 bp, Artificial Sequence
  Synthetic
gtttttctcattactcttgatgttg

SEQ ID NO: 10517 - DNA, 23 bp, Artificial Sequence
  Synthetic
caaaaactgctgataagtttcgt

SEQ ID NO: 10518 - DNA, 20 bp, Artificial Sequence
  Synthetic
ttcacaatcacattgcatga

SEQ ID NO: 10519 - DNA, 23 bp, Artificial Sequence
  Synthetic
aagaagtgtacaataaaagagga

SEQ ID NO: 10520 - DNA, 18 bp, Artificial Sequence
  Synthetic
agggtgcatgttgatcca

SEQ ID NO: 10521 - DNA, 18 bp, Artificial Sequence
  Synthetic
ccttggctgcaaaggaag

SEQ ID NO: 10522 - DNA, 24 bp, Artificial Sequence
  Synthetic
cctaagatcttctacaaatatcgc

SEQ ID NO: 10523 - DNA, 24 bp, Artificial Sequence
  Synthetic
gggtaattgacaataacatttgtg

SEQ ID NO: 10524 - DNA, 22 bp, Artificial Sequence
  Synthetic
aacatggatagagcagttaaac

SEQ ID NO: 10525 - DNA, 20 bp, Artificial Sequence
  Synthetic
gaaaacagaatggtgctggc

SEQ ID NO: 10526 - DNA, 19 bp, Artificial Sequence
  Synthetic
tgttgccaacaatcatcac

SEQ ID NO: 10527 - DNA, 25 bp, Artificial Sequence
  Synthetic
taggttttgtacagagatatgattg

SEQ ID NO: 10528 - DNA, 19 bp, Artificial Sequence
  Synthetic
aagaaatagcgttgctgtg

SEQ ID NO: 10529 - DNA, 18 bp, Artificial Sequence
  Synthetic
gctgcagcagttaaaacg

SEQ ID NO: 10530 - DNA, 23 bp, Artificial Sequence
  Synthetic
aaagaacttgttgatgtccattt

SEQ ID NO: 10531 - DNA, 23 bp, Artificial Sequence
  Synthetic
aatctttttttcaaaggctttgg

SEQ ID NO: 10532 - DNA, 21 bp, Artificial Sequence
  Synthetic
aaaagactgagggacatttgg

SEQ ID NO: 10533 - DNA, 19 bp, Artificial Sequence
  Synthetic
gtacccactcaacggaagc

SEQ ID NO: 10534 - DNA, 17 bp, Artificial Sequence
  Synthetic
cgggagcagaagcagga

SEQ ID NO: 10535 - DNA, 21 bp, Artificial Sequence
  Synthetic
attttgttgaaaggacaagcc

SEQ ID NO: 10536 - DNA, 18 bp, Artificial Sequence
  Synthetic
cactggatatgggccatt

SEQ ID NO: 10537 - DNA, 25 bp, Artificial Sequence
  Synthetic
ctcctgatagacaatttttagatgt

SEQ ID NO: 10538 - DNA, 22 bp, Artificial Sequence
  Synthetic
tccagaagttattcctacagaa

SEQ ID NO: 10539 - DNA, 18 bp, Artificial Sequence
  Synthetic
aatagtgatcgcctgctg

SEQ ID NO: 10540 - DNA, 22 bp, Artificial Sequence
  Synthetic
aggtattggacactgaaaatcc

SEQ ID NO: 10541 - DNA, 23 bp, Artificial Sequence
  Synthetic
atgaattttaaggccttatcagt

SEQ ID NO: 10542 - DNA, 20 bp, Artificial Sequence
  Synthetic
ccagtgaccagtctagaagt

SEQ ID NO: 10543 - DNA, 18 bp, Artificial Sequence
  Synthetic
ccgcttcactgatctctt

SEQ ID NO: 10544 - DNA, 20 bp, Artificial Sequence
  Synthetic
aacagacggaatttgtcctg

SEQ ID NO: 10545 - DNA, 25 bp, Artificial Sequence
  Synthetic
atcagttatatatgattgatcctgc

SEQ ID NO: 10546 - DNA, 23 bp, Artificial Sequence
  Synthetic
taagacattgcaagaaatgaagg

SEQ ID NO: 10547 - DNA, 20 bp, Artificial Sequence
  Synthetic
gtgttgctttgaaagattgc

SEQ ID NO: 10548 - DNA, 25 bp, Artificial Sequence
  Synthetic
atatgacagtttggtttatactgga

SEQ ID NO: 10549 - DNA, 23 bp, Artificial Sequence
  Synthetic
gttaaaaacattcctcgttatgc

SEQ ID NO: 10550 - DNA, 22 bp, Artificial Sequence
  Synthetic
ttgttacaacttcacttacacc

SEQ ID NO: 10551 - DNA, 23 bp, Artificial Sequence
  Synthetic
aaattgtattgtgcctttacagc

SEQ ID NO: 10552 - DNA, 18 bp, Artificial Sequence
  Synthetic
tttggcagtgatgcagaa

SEQ ID NO: 10553 - DNA, 21 bp, Artificial Sequence
  Synthetic
gacagcagtttgttaaagaga

SEQ ID NO: 10554 - DNA, 21 bp, Artificial Sequence
  Synthetic
gtgtcagataactgctgttga

SEQ ID NO: 10555 - DNA, 24 bp, Artificial Sequence
  Synthetic
gcagggtatttttaataaggctac

SEQ ID NO: 10556 - DNA, 22 bp, Artificial Sequence
  Synthetic
attgcttgcctattacaacatg

SEQ ID NO: 10557 - DNA, 23 bp, Artificial Sequence
  Synthetic
gcaatatgtgattttgaaattgc

SEQ ID NO: 10558 - DNA, 25 bp, Artificial Sequence
  Synthetic
gaaaattgagtataaacctgacttg

SEQ ID NO: 10559 - DNA, 21 bp, Artificial Sequence
  Synthetic
ttaagccatgagaaagcttcc

SEQ ID NO: 10560 - DNA, 21 bp, Artificial Sequence
  Synthetic
tacggcatggttttatccatt

SEQ ID NO: 10561 - DNA, 23 bp, Artificial Sequence
  Synthetic
attacgatgttatggctaatggt

SEQ ID NO: 10562 - DNA, 22 bp, Artificial Sequence
  Synthetic
gtgttctgattcaaaattctgc

SEQ ID NO: 10563 - DNA, 19 bp, Artificial Sequence
  Synthetic
ggcttgtcccattgttgtt

SEQ ID NO: 10564 - DNA, 20 bp, Artificial Sequence
  Synthetic
cgtgcggtataatcttgcta

SEQ ID NO: 10565 - DNA, 25 bp, Artificial Sequence
  Synthetic
tatcagctatttaaaggtttagcac

SEQ ID NO: 10566 - DNA, 23 bp, Artificial Sequence
  Synthetic
taggtattacagcggtaaaatgg

SEQ ID NO: 10567 - DNA, 19 bp, Artificial Sequence
  Synthetic
gtggttaaacctggtgaga

SEQ ID NO: 10568 - DNA, 23 bp, Artificial Sequence
  Synthetic
ttgtaattggtttgtacaaagtg

SEQ ID NO: 10569 - DNA, 23 bp, Artificial Sequence
  Synthetic
atgtttagtattacgttttgtgc

SEQ ID NO: 10570 - DNA, 24 bp, Artificial Sequence
  Synthetic
atttctgttttctctttgtggtac

SEQ ID NO: 10571 - DNA, 24 bp, Artificial Sequence
  Synthetic
atatatgaatgctaatggattgcg

SEQ ID NO: 10572 - DNA, 22 bp, Artificial Sequence
  Synthetic
aagtgcctgactagtattgaag

SEQ ID NO: 10573 - DNA, 22 bp, Artificial Sequence
  Synthetic
gttgtgtaccattgaatgcaat

SEQ ID NO: 10574 - DNA, 23 bp, Artificial Sequence
  Synthetic
ttactgttcaagatgctaaaggt

SEQ ID NO: 10575 - DNA, 19 bp, Artificial Sequence
  Synthetic
ggattcatatggtggtgcg

SEQ ID NO: 10576 - DNA, 19 bp, Artificial Sequence
  Synthetic
cgccagtggtttatctact

SEQ ID NO: 10577 - DNA, 24 bp, Artificial Sequence
  Synthetic
taatgtgtataaaaagctaggacc

SEQ ID NO: 10578 - DNA, 23 bp, Artificial Sequence
  Synthetic
gctaccattataaagaacttggt

SEQ ID NO: 10579 - DNA, 21 bp, Artificial Sequence
  Synthetic
ggacattaagcagttgttgtt

SEQ ID NO: 10580 - DNA, 20 bp, Artificial Sequence
  Synthetic
actatgactggcagaatgtt

SEQ ID NO: 10581 - DNA, 24 bp, Artificial Sequence
  Synthetic
ttcagtctttaacatatgtcaagc

SEQ ID NO: 10582 - DNA, 23 bp, Artificial Sequence
  Synthetic
cgtttttatgtcagaatccaaat

SEQ ID NO: 10583 - DNA, 21 bp, Artificial Sequence
  Synthetic
tacaatgacctgggtaatcag

SEQ ID NO: 10584 - DNA, 19 bp, Artificial Sequence
  Synthetic
tcttgtacaggatctccgt

SEQ ID NO: 10585 - DNA, 25 bp, Artificial Sequence
  Synthetic
tgtaggagatgtttttgttttaacc

SEQ ID NO: 10586 - DNA, 23 bp, Artificial Sequence
  Synthetic
ttgaatataaatgattgcactcg

SEQ ID NO: 10587 - DNA, 24 bp, Artificial Sequence
  Synthetic
aaagttctagtgctgtaaatatgc

SEQ ID NO: 10588 - DNA, 23 bp, Artificial Sequence
  Synthetic
agcattacagtttactacattga

SEQ ID NO: 10589 - DNA, 18 bp, Artificial Sequence
  Synthetic
cctgggttggctttgatg

SEQ ID NO: 10590 - DNA, 20 bp, Artificial Sequence
  Synthetic
tctgtctgattgtgttgtgc

SEQ ID NO: 10591 - DNA, 19 bp, Artificial Sequence
  Synthetic
cttaaagctgccatgctct

SEQ ID NO: 10592 - DNA, 21 bp, Artificial Sequence
  Synthetic
aataaacatgcattccacact

SEQ ID NO: 10593 - DNA, 21 bp, Artificial Sequence
  Synthetic
tacaaagcttggagaatgttg

SEQ ID NO: 10594 - DNA, 21 bp, Artificial Sequence
  Synthetic
ggtgtctgcatgtatacagat

SEQ ID NO: 10595 - DNA, 23 bp, Artificial Sequence
  Synthetic
atagctttagatcaagatgtgtt

SEQ ID NO: 10596 - DNA, 23 bp, Artificial Sequence
  Synthetic
agattttcagtttatgctttggt

SEQ ID NO: 10597 - DNA, 23 bp, Artificial Sequence
  Synthetic
gagtacaatgtgagtaaagatgg

SEQ ID NO: 10598 - DNA, 23 bp, Artificial Sequence
  Synthetic
attttccacttacccattttcag

SEQ ID NO: 10599 - DNA, 18 bp, Artificial Sequence
  Synthetic
gattggccattgcaccat

SEQ ID NO: 10600 - DNA, 22 bp, Artificial Sequence
  Synthetic
tatcatctaaagctggcaactc

SEQ ID NO: 10601 - DNA, 25 bp, Artificial Sequence
  Synthetic
cattaccactggttttgatcttaat

SEQ ID NO: 10602 - DNA, 24 bp, Artificial Sequence
  Synthetic
taccaaggttattaaagatcgtgt

SEQ ID NO: 10603 - DNA, 24 bp, Artificial Sequence
  Synthetic
ttatgcatattttacagacactgg

SEQ ID NO: 10604 - DNA, 18 bp, Artificial Sequence
  Synthetic
ctgttcagccaatcgcag

SEQ ID NO: 10605 - DNA, 21 bp, Artificial Sequence
  Synthetic
tactactgcaacaagttgtca

SEQ ID NO: 10606 - DNA, 24 bp, Artificial Sequence
  Synthetic
tcctgatcctattacatttacagg

SEQ ID NO: 10607 - DNA, 25 bp, Artificial Sequence
  Synthetic
ctctacggttttagagactacataa

SEQ ID NO: 10608 - DNA, 20 bp, Artificial Sequence
  Synthetic
cctgtaggtggtttgtatga

SEQ ID NO: 10609 - DNA, 24 bp, Artificial Sequence
  Synthetic
taaagtaaagttatctgatgtcgg

SEQ ID NO: 10610 - DNA, 25 bp, Artificial Sequence
  Synthetic
caacaactctctaatagatttggtg

SEQ ID NO: 10611 - DNA, 24 bp, Artificial Sequence
  Synthetic
cactttagttatgtccctactaag

SEQ ID NO: 10612 - DNA, 19 bp, Artificial Sequence
  Synthetic
gcaccagatttgtcacttg

SEQ ID NO: 10613 - DNA, 21 bp, Artificial Sequence
  Synthetic
gttaaagttcttaaggccacg

SEQ ID NO: 10614 - DNA, 23 bp, Artificial Sequence
  Synthetic
ttttgtgaatagtatcaggttgt

SEQ ID NO: 10615 - DNA, 22 bp, Artificial Sequence
  Synthetic
ttatgttaagtccaaagtcggt

SEQ ID NO: 10616 - DNA, 18 bp, Artificial Sequence
  Synthetic
gtcaactgctgccacgat

SEQ ID NO: 10617 - DNA, 18 bp, Artificial Sequence
  Synthetic
gagcctctagtgcaggat

SEQ ID NO: 10618 - DNA, 18 bp, Artificial Sequence
  Synthetic
gttggccaaagtgcagaa

SEQ ID NO: 10619 - DNA, 22 bp, Artificial Sequence
  Synthetic
ttcttaagaagatggatgagcc

SEQ ID NO: 10620 - DNA, 18 bp, Artificial Sequence
  Synthetic
acctgcttcgcgatacat

SEQ ID NO: 10621 - DNA, 20 bp, Artificial Sequence
  Synthetic
gaaatctcaccattgccttc

SEQ ID NO: 10622 - DNA, 20 bp, Artificial Sequence
  Synthetic
ttccaacactgtgtcaagct

SEQ ID NO: 10623 - DNA, 18 bp, Artificial Sequence
  Synthetic
cttcagtgcctgcttcac

SEQ ID NO: 10624 - DNA, 21 bp, Artificial Sequence
  Synthetic
gaaatctcaccattaccttcc

SEQ ID NO: 10625 - DNA, 19 bp, Artificial Sequence
  Synthetic
gaggcgacactccaccatg

SEQ ID NO: 10626 - DNA, 20 bp, Artificial Sequence
  Synthetic
tgcaacatgagcacacttcc

SEQ ID NO: 10627 - DNA, 18 bp, Artificial Sequence
  Synthetic
gtccatcctggggcccaa

SEQ ID NO: 10628 - DNA, 20 bp, Artificial Sequence
  Synthetic
gtgtatgaggccgatgatgt

SEQ ID NO: 10629 - DNA, 20 bp, Artificial Sequence
  Synthetic
tgtacccaggccatctttca

SEQ ID NO: 10630 - DNA, 20 bp, Artificial Sequence
  Synthetic
actggatgtcctcaaaggct

SEQ ID NO: 10631 - DNA, 19 bp, Artificial Sequence
  Synthetic
ggcactactgatgccaggg

SEQ ID NO: 10632 - DNA, 20 bp, Artificial Sequence
  Synthetic
aaggtgaggatgtttgtggg

SEQ ID NO: 10633 - DNA, 19 bp, Artificial Sequence
  Synthetic
gttttcctccttctggcgg

SEQ ID NO: 10634 - DNA, 20 bp, Artificial Sequence
  Synthetic
tactgagcattggcagatgg

SEQ ID NO: 10635 - DNA, 20 bp, Artificial Sequence
  Synthetic
ttgtgactagcttgactggc

SEQ ID NO: 10636 - DNA, 18 bp, Artificial Sequence
  Synthetic
ggactccacagcgagctt

SEQ ID NO: 10637 - DNA, 20 bp, Artificial Sequence
  Synthetic
tactaaatccatcggtggcg

SEQ ID NO: 10638 - DNA, 20 bp, Artificial Sequence
  Synthetic
acagtacgttgacttcagcc

SEQ ID NO: 10639 - DNA, 20 bp, Artificial Sequence
  Synthetic
agatgcccactttctgtcac

SEQ ID NO: 10640 - DNA, 18 bp, Artificial Sequence
  Synthetic
cggcctactgcttgtcag

SEQ ID NO: 10641 - DNA, 18 bp, Artificial Sequence
  Synthetic
cctagcaggcctctccac

SEQ ID NO: 10642 - DNA, 20 bp, Artificial Sequence
  Synthetic
gaggacatggtcaacctgtt

SEQ ID NO: 10643 - DNA, 18 bp, Artificial Sequence
  Synthetic
gactgggtttgctcggtg

SEQ ID NO: 10644 - DNA, 19 bp, Artificial Sequence
  Synthetic
gccaacagctacgttgagg

SEQ ID NO: 10645 - DNA, 19 bp, Artificial Sequence
  Synthetic
ctccatcagaggcaagctc

SEQ ID NO: 10646 - DNA, 18 bp, Artificial Sequence
  Synthetic
ctgttggaccgctggaaa

SEQ ID NO: 10647 - DNA, 18 bp, Artificial Sequence
  Synthetic
gacccggacttgagttgc

SEQ ID NO: 10648 - DNA, 19 bp, Artificial Sequence
  Synthetic
ctcaccatcgaggaagcgt

SEQ ID NO: 10649 - DNA, 20 bp, Artificial Sequence
  Synthetic
gggttctcatatgacacccg

SEQ ID NO: 10650 - DNA, 20 bp, Artificial Sequence
  Synthetic
tgttacatcaaggccacagc

SEQ ID NO: 10651 - DNA, 25 bp, Artificial Sequence
  Synthetic
cgaaagcaggtcaattatattcaat

SEQ ID NO: 10652 - DNA, 24 bp, Artificial Sequence
  Synthetic
ttatggagtaaaatgaatgatgcc

SEQ ID NO: 10653 - DNA, 20 bp, Artificial Sequence
  Synthetic
ggcacaggatgtaatcatgg

SEQ ID NO: 10654 - DNA, 18 bp, Artificial Sequence
  Synthetic
ccaggaggggaagtgaag

SEQ ID NO: 10655 - DNA, 23 bp, Artificial Sequence
  Synthetic
ttggtggattcacatttaagaga

SEQ ID NO: 10656 - DNA, 24 bp, Artificial Sequence
  Synthetic
ttgtatgataaaagcagttagagg

SEQ ID NO: 10657 - DNA, 18 bp, Artificial Sequence
  Synthetic
gagagggtagtggtgagc

SEQ ID NO: 10658 - DNA, 21 bp, Artificial Sequence
  Synthetic
tggaatttgaaccatttcagt

SEQ ID NO: 10659 - DNA, 20 bp, Artificial Sequence
  Synthetic
cagttctcggaaaggatgct

SEQ ID NO: 10660 - DNA, 20 bp, Artificial Sequence
  Synthetic
tcaatagcacggccttgaac

SEQ ID NO: 10661 - DNA, 19 bp, Artificial Sequence
  Synthetic
ggggtgcaaatgatacgga

SEQ ID NO: 10662 - DNA, 16 bp, Artificial Sequence
  Synthetic
gcacaggctggaagcg

SEQ ID NO: 10663 - DNA, 15 bp, Artificial Sequence
  Synthetic
aagcggaggcggctt

SEQ ID NO: 10664 - DNA, 19 bp, Artificial Sequence
  Synthetic
cgcgatgccgtcatcttac

SEQ ID NO: 10665 - DNA, 17 bp, Artificial Sequence
  Synthetic
gagactgggcgcacaac

SEQ ID NO: 10666 - DNA, 20 bp, Artificial Sequence
  Synthetic
ctgctacccaaaccttcctg

SEQ ID NO: 10667 - DNA, 16 bp, Artificial Sequence
  Synthetic
acacgccgtgggccta

SEQ ID NO: 10668 - DNA, 18 bp, Artificial Sequence
  Synthetic
ggaccggggtgagaacaa

SEQ ID NO: 10669 - DNA, 20 bp, Artificial Sequence
  Synthetic
tcaaggggggaagacatctc

SEQ ID NO: 10670 - DNA, 16 bp, Artificial Sequence
  Synthetic
agggggaagccaggca

SEQ ID NO: 10671 - DNA, 20 bp, Artificial Sequence
  Synthetic
tgtggaagtgtttgatccgc

SEQ ID NO: 10672 - DNA, 20 bp, Artificial Sequence
  Synthetic
gatggaagagtgctctcagc

SEQ ID NO: 10673 - DNA, 17 bp, Artificial Sequence
  Synthetic
gtgccgctaccgccttt

SEQ ID NO: 10674 - DNA, 16 bp, Artificial Sequence
  Synthetic
tagccttcgcctcccg

SEQ ID NO: 10675 - DNA, 18 bp, Artificial Sequence
  Synthetic
ctgccactgtggagctga

SEQ ID NO: 10676 - DNA, 16 bp, Artificial Sequence
  Synthetic
cccccttgcaagccct

SEQ ID NO: 10677 - DNA, 20 bp, Artificial Sequence
  Synthetic
agtggtgattctggactcct

SEQ ID NO: 10678 - DNA, 20 bp, Artificial Sequence
  Synthetic
aaagttttggcagctcctca

SEQ ID NO: 10679 - DNA, 20 bp, Artificial Sequence
  Synthetic
tgacagactgcaagttctgg

SEQ ID NO: 10680 - DNA, 19 bp, Artificial Sequence
  Synthetic
acgaggttttctgcgttca

SEQ ID NO: 10681 - DNA, 16 bp, Artificial Sequence
  Synthetic
cccgcgtggccatcaa

SEQ ID NO: 10682 - DNA, 20 bp, Artificial Sequence
  Synthetic
aacatcatgctcctccaacg

SEQ ID NO: 10683 - DNA, 18 bp, Artificial Sequence
  Synthetic
gcctcagcgcattttcac

SEQ ID NO: 10684 - DNA, 25 bp, Artificial Sequence
  Synthetic
atctagacaataataaatagggagg

SEQ ID NO: 10685 - DNA, 21 bp, Artificial Sequence
  Synthetic
tacgacgcctaaaatattggg

SEQ ID NO: 10686 - DNA, 25 bp, Artificial Sequence
  Synthetic
gtaaaagatatcgaattgagtcttg

SEQ ID NO: 10687 - DNA, 20 bp, Artificial Sequence
  Synthetic
gaaagtttgcacccagtcct

SEQ ID NO: 10688 - DNA, 18 bp, Artificial Sequence
  Synthetic
tgttttgcacagtggcag

SEQ ID NO: 10689 - DNA, 22 bp, Artificial Sequence
  Synthetic
gtgcctttaaaacattcctaca

SEQ ID NO: 10690 - DNA, 22 bp, Artificial Sequence
  Synthetic
cagctcttcacatttaaaaacc

SEQ ID NO: 10691 - DNA, 20 bp, Artificial Sequence
  Synthetic
tgtgctatgtacaatggagg

SEQ ID NO: 10692 - DNA, 18 bp, Artificial Sequence
  Synthetic
gtccgagggaccggaaca

SEQ ID NO: 10693 - DNA, 25 bp, Artificial Sequence
  Synthetic
agatctatagggtgattgtacattc

SEQ ID NO: 10694 - DNA, 18 bp, Artificial Sequence
  Synthetic
catccgccacacagcttt

SEQ ID NO: 10695 - DNA, 22 bp, Artificial Sequence
  Synthetic
aggactccagcattattaattc

SEQ ID NO: 10696 - DNA, 18 bp, Artificial Sequence
  Synthetic
agtggcaagggtattgga

SEQ ID NO: 10697 - DNA, 22 bp, Artificial Sequence
  Synthetic
aacgtgtctcatatttttttgc

SEQ ID NO: 10698 - DNA, 20 bp, Artificial Sequence
  Synthetic
cccctggagcttataacttc

SEQ ID NO: 10699 - DNA, 21 bp, Artificial Sequence
  Synthetic
aagaatatttgaggcacggag

SEQ ID NO: 10700 - DNA, 25 bp, Artificial Sequence
  Synthetic
gtttgtaatgtctatgtatgtgtgt

SEQ ID NO: 10701 - DNA, 19 bp, Artificial Sequence
  Synthetic
gtttgtcgcctgattctga

SEQ ID NO: 10702 - DNA, 18 bp, Artificial Sequence
  Synthetic
atgtgtgggtagcttgga

SEQ ID NO: 10703 - DNA, 20 bp, Artificial Sequence
  Synthetic
cacacacagccaaaaaactg

SEQ ID NO: 10704 - DNA, 19 bp, Artificial Sequence
  Synthetic
ttttaccctccgcctctgt

SEQ ID NO: 10705 - DNA, 20 bp, Artificial Sequence
  Synthetic
gaatcgccaaccaaaagacg

SEQ ID NO: 10706 - DNA, 23 bp, Artificial Sequence
  Synthetic
attacaaatttttggtagtgctg

SEQ ID NO: 10707 - DNA, 23 bp, Artificial Sequence
  Synthetic
cctactgatattattgacccttt

SEQ ID NO: 10708 - DNA, 20 bp, Artificial Sequence
  Synthetic
attacaaacgagaaacccag

SEQ ID NO: 10709 - DNA, 24 bp, Artificial Sequence
  Synthetic
gaaaatgagcaactttttattccc

SEQ ID NO: 10710 - DNA, 18 bp, Artificial Sequence
  Synthetic
atggctttgtggatgcaa

SEQ ID NO: 10711 - DNA, 24 bp, Artificial Sequence
  Synthetic
aaatctctgtataatccagacagg

SEQ ID NO: 10712 - DNA, 19 bp, Artificial Sequence
  Synthetic
caccagtgggagaacattg

SEQ ID NO: 10713 - DNA, 23 bp, Artificial Sequence
  Synthetic
tgttcttttttggaagaaaggaa

SEQ ID NO: 10714 - DNA, 24 bp, Artificial Sequence
  Synthetic
atactcggaacatactattgaact

SEQ ID NO: 10715 - DNA, 21 bp, Artificial Sequence
  Synthetic
gacgttggctaaaattgaact

SEQ ID NO: 10716 - DNA, 22 bp, Artificial Sequence
  Synthetic
taggaactaaaggacaaatgtg

SEQ ID NO: 10717 - DNA, 24 bp, Artificial Sequence
  Synthetic
aatattattccctaaagaagcagg

SEQ ID NO: 10718 - DNA, 25 bp, Artificial Sequence
  Synthetic
actaactgaatctagatctcaatca

SEQ ID NO: 10719 - DNA, 23 bp, Artificial Sequence
  Synthetic
cggaacaatacaaaagattggaa

SEQ ID NO: 10720 - DNA, 25 bp, Artificial Sequence
  Synthetic
ggagagataaattttcttaatcgag

SEQ ID NO: 10721 - DNA, 25 bp, Artificial Sequence
  Synthetic
tcttagtttaataaaaaggactggg

SEQ ID NO: 10722 - DNA, 19 bp, Artificial Sequence
  Synthetic
taatccctcagaagatggc

SEQ ID NO: 10723 - DNA, 25 bp, Artificial Sequence
  Synthetic
tgaggatgaagaaagaaatagatca

SEQ ID NO: 10724 - DNA, 19 bp, Artificial Sequence
  Synthetic
gagtttgagcgattgacgt

SEQ ID NO: 10725 - DNA, 18 bp, Artificial Sequence
  Synthetic
gaagtcagatgagggtgg

SEQ ID NO: 10726 - DNA, 22 bp, Artificial Sequence
  Synthetic
gtggttttgttatgcagtatgg

SEQ ID NO: 10727 - DNA, 25 bp, Artificial Sequence
  Synthetic
gttaaagaaactgctcttattactc

SEQ ID NO: 10728 - DNA, 25 bp, Artificial Sequence
  Synthetic
agaagatgatgttattgagaatgtc

SEQ ID NO: 10729 - DNA, 25 bp, Artificial Sequence
  Synthetic
atggaatgtcatttagtatgtcttc

SEQ ID NO: 10730 - DNA, 23 bp, Artificial Sequence
  Synthetic
ttaacagtatgtaaatggtctgt

SEQ ID NO: 10731 - DNA, 22 bp, Artificial Sequence
  Synthetic
ttaaacaagaaagtcgtgttgg

SEQ ID NO: 10732 - DNA, 25 bp, Artificial Sequence
  Synthetic
tacaaaacctattataaaggctcag

SEQ ID NO: 10733 - DNA, 24 bp, Artificial Sequence
  Synthetic
atttgtagctaatatgttacctgc

SEQ ID NO: 10734 - DNA, 22 bp, Artificial Sequence
  Synthetic
ttttgttaacattgctcatgct

SEQ ID NO: 10735 - DNA, 23 bp, Artificial Sequence
  Synthetic
aatgatttttatgctagtggttg

SEQ ID NO: 10736 - DNA, 23 bp, Artificial Sequence
  Synthetic
attctgccttattgtgtagagtt

SEQ ID NO: 10737 - DNA, 20 bp, Artificial Sequence
  Synthetic
cacactggcactgattttac

SEQ ID NO: 10738 - DNA, 25 bp, Artificial Sequence
  Synthetic
aaagcatgtaatatagctaagtctg

SEQ ID NO: 10739 - DNA, 22 bp, Artificial Sequence
  Synthetic
aattgtgttaaaatgctctgtg

SEQ ID NO: 10740 - DNA, 25 bp, Artificial Sequence
  Synthetic
aattaggccctatttttaatagagc

SEQ ID NO: 10741 - DNA, 20 bp, Artificial Sequence
  Synthetic
ttggtccccttgttagacaa

SEQ ID NO: 10742 - DNA, 23 bp, Artificial Sequence
  Synthetic
tgataaaagtgctggttatccat

SEQ ID NO: 10743 - DNA, 24 bp, Artificial Sequence
  Synthetic
cgtcatcttataaaggatgttgac

SEQ ID NO: 10744 - DNA, 25 bp, Artificial Sequence
  Synthetic
actatgttagttaagatagatggtg

SEQ ID NO: 10745 - DNA, 23 bp, Artificial Sequence
  Synthetic
ttatgaatggtatggtctttggt

SEQ ID NO: 10746 - DNA, 23 bp, Artificial Sequence
  Synthetic
gttttaacatcacattctgtagc

SEQ ID NO: 10747 - DNA, 24 bp, Artificial Sequence
  Synthetic
tactaaagatgaagccattaaacg

SEQ ID NO: 10748 - DNA, 25 bp, Artificial Sequence
  Synthetic
gtatccaataatttctaatgaggtc

SEQ ID NO: 10749 - DNA, 25 bp, Artificial Sequence
  Synthetic
gaactgtttttgaaaatcttaagcc

SEQ ID NO: 10750 - DNA, 23 bp, Artificial Sequence
  Synthetic
tagaaaagcaagaaatggtgttt

SEQ ID NO: 10751 - DNA, 23 bp, Artificial Sequence
  Synthetic
atggtaaacctattaatttgcct

SEQ ID NO: 10752 - DNA, 22 bp, Artificial Sequence
  Synthetic
aatactttttgtccttgtgcta

SEQ ID NO: 10753 - DNA, 21 bp, Artificial Sequence
  Synthetic
tgatagttatcttggttgcgt

SEQ ID NO: 10754 - DNA, 23 bp, Artificial Sequence
  Synthetic
aatttggtgcaattagttcttct

SEQ ID NO: 10755 - DNA, 24 bp, Artificial Sequence
  Synthetic
ccagagaccaataatcttatgtgt

SEQ ID NO: 10756 - DNA, 25 bp, Artificial Sequence
  Synthetic
aaactattaggatgtcttatactcc

SEQ ID NO: 10757 - DNA, 22 bp, Artificial Sequence
  Synthetic
cgctaatcttgttttagccaag

SEQ ID NO: 10758 - DNA, 25 bp, Artificial Sequence
  Synthetic
cttgaagagaatttaaatgcttacg

SEQ ID NO: 10759 - DNA, 20 bp, Artificial Sequence
  Synthetic
aggtactgattcgaaatgga

SEQ ID NO: 10760 - DNA, 18 bp, Artificial Sequence
  Synthetic
agactacactctcgacga

SEQ ID NO: 10761 - DNA, 18 bp, Artificial Sequence
  Synthetic
gagggcaagctttctcaa

SEQ ID NO: 10762 - DNA, 22 bp, Artificial Sequence
  Synthetic
aaattcaaattacctgctgtca

SEQ ID NO: 10763 - DNA, 20 bp, Artificial Sequence
  Synthetic
tgcgagctaactgattcaat

SEQ ID NO: 10764 - DNA, 24 bp, Artificial Sequence
  Synthetic
atatggattcatcataaagggaag

SEQ ID NO: 10765 - DNA, 18 bp, Artificial Sequence
  Synthetic
ttcagtcactccagcaga

SEQ ID NO: 10766 - DNA, 21 bp, Artificial Sequence
  Synthetic
aaacgatcctatgaacagatg

SEQ ID NO: 10767 - DNA, 19 bp, Artificial Sequence
  Synthetic
tgcagcaataaagggagtc

SEQ ID NO: 10768 - DNA, 20 bp, Artificial Sequence
  Synthetic
atgatggatcaggtgcgaga

SEQ ID NO: 10769 - DNA, 21 bp, Artificial Sequence
  Synthetic
atccagcacataaaagtcaat

SEQ ID NO: 10770 - DNA, 21 bp, Artificial Sequence
  Synthetic
gaggaggagcgctataaaatt

SEQ ID NO: 10771 - DNA, 20 bp, Artificial Sequence
  Synthetic
ttctgcctctgtgtctagct

SEQ ID NO: 10772 - DNA, 19 bp, Artificial Sequence
  Synthetic
ccaactcctgaagaagtgg

SEQ ID NO: 10773 - DNA, 20 bp, Artificial Sequence
  Synthetic
gcgactgtatgtgaaagaca

SEQ ID NO: 10774 - DNA, 20 bp, Artificial Sequence
  Synthetic
gtattggtacaggaaggggt

SEQ ID NO: 10775 - DNA, 20 bp, Artificial Sequence
  Synthetic
cacaataacagacaccactg

SEQ ID NO: 10776 - DNA, 23 bp, Artificial Sequence
  Synthetic
gtgtatgaagatattcctttgga

SEQ ID NO: 10777 - DNA, 18 bp, Artificial Sequence
  Synthetic
catcagtagaggctgcac

SEQ ID NO: 10778 - DNA, 25 bp, Artificial Sequence
  Synthetic
attagagatacagaaaatcccaatc

SEQ ID NO: 10779 - DNA, 23 bp, Artificial Sequence
  Synthetic
ttttggagctgctaatttcaaag

SEQ ID NO: 10780 - DNA, 25 bp, Artificial Sequence
  Synthetic
actagacatactgaagaatatgaac

SEQ ID NO: 10781 - DNA, 18 bp, Artificial Sequence
  Synthetic
ttggactgttgatctgca

SEQ ID NO: 10782 - DNA, 18 bp, Artificial Sequence
  Synthetic
gcagcatagtttacccca

SEQ ID NO: 10783 - DNA, 21 bp, Artificial Sequence
  Synthetic
cgacaatgcttcaatccaatg

SEQ ID NO: 10784 - DNA, 18 bp, Artificial Sequence
  Synthetic
gaatcatggcctggacag

SEQ ID NO: 10785 - DNA, 21 bp, Artificial Sequence
  Synthetic
cagggcaagaatcaaaactag

SEQ ID NO: 10786 - DNA, 24 bp, Artificial Sequence
  Synthetic
tacaggacattgaaaatgaagaga

SEQ ID NO: 10787 - DNA, 22 bp, Artificial Sequence
  Synthetic
ctgattcaagctggatagaact

SEQ ID NO: 10788 - DNA, 24 bp, Artificial Sequence
  Synthetic
atttgagaaatgatactgatgtgg

SEQ ID NO: 10789 - DNA, 20 bp, Artificial Sequence
  Synthetic
ttcttcagtctcttcagcag

SEQ ID NO: 10790 - DNA, 23 bp, Artificial Sequence
  Synthetic
tgacaaagacataatggattcca

SEQ ID NO: 10791 - DNA, 18 bp, Artificial Sequence
  Synthetic
ccattgcttccagtcctg

SEQ ID NO: 10792 - DNA, 18 bp, Artificial Sequence
  Synthetic
cctccgtaccaggacatt

SEQ ID NO: 10793 - DNA, 24 bp, Artificial Sequence
  Synthetic
gaaggttaatagatttcctcaagg

SEQ ID NO: 10794 - DNA, 18 bp, Artificial Sequence
  Synthetic
acccggaatgcaaatcag

SEQ ID NO: 10795 - DNA, 24 bp, Artificial Sequence
  Synthetic
gcatgtttaatatgctaagtacgg

SEQ ID NO: 10796 - DNA, 21 bp, Artificial Sequence
  Synthetic
ttttctaccgctatgggtttg

SEQ ID NO: 10797 - DNA, 20 bp, Artificial Sequence
  Synthetic
ttgcaactacacattcatgg

SEQ ID NO: 10798 - DNA, 21 bp, Artificial Sequence
  Synthetic
attactgaaaagggtgtaacc

SEQ ID NO: 10799 - DNA, 18 bp, Artificial Sequence
  Synthetic
gtgcacaagaacagcaag

SEQ ID NO: 10800 - DNA, 21 bp, Artificial Sequence
  Synthetic
cagatacaggttcagacttgg

SEQ ID NO: 10801 - DNA, 18 bp, Artificial Sequence
  Synthetic
ttgagccaccaaaactgc

SEQ ID NO: 10802 - DNA, 22 bp, Artificial Sequence
  Synthetic
atacaaatcctgcaacagatga

SEQ ID NO: 10803 - DNA, 25 bp, Artificial Sequence
  Synthetic
gatcaaatagactattggaagtgtg

SEQ ID NO: 10804 - DNA, 23 bp, Artificial Sequence
  Synthetic
attgaatgtgtaaatacctgtga

SEQ ID NO: 10805 - DNA, 19 bp, Artificial Sequence
  Synthetic
cgtaccggctatattccat

SEQ ID NO: 10806 - DNA, 23 bp, Artificial Sequence
  Synthetic
aagtagcactagttttaccaatc

SEQ ID NO: 10807 - DNA, 21 bp, Artificial Sequence
  Synthetic
ttaccaatcctgcatatgagc

SEQ ID NO: 10808 - DNA, 25 bp, Artificial Sequence
  Synthetic
tggacatccatactataaagttacc

SEQ ID NO: 10809 - DNA, 23 bp, Artificial Sequence
  Synthetic
caaattggatgacacagaaaatt

SEQ ID NO: 10810 - DNA, 24 bp, Artificial Sequence
  Synthetic
gtactttgcaggataataaaagtg

SEQ ID NO: 10811 - DNA, 25 bp, Artificial Sequence
  Synthetic
aaagggctctgtactataaattcat

SEQ ID NO: 10812 - DNA, 18 bp, Artificial Sequence
  Synthetic
cagggtggaatgcattgg

SEQ ID NO: 10813 - DNA, 23 bp, Artificial Sequence
  Synthetic
ggaaaatattgaaatgggagtct

SEQ ID NO: 10814 - DNA, 25 bp, Artificial Sequence
  Synthetic
ccttatccaggtaataataacaatg

SEQ ID NO: 10815 - DNA, 23 bp, Artificial Sequence
  Synthetic
atggagagaataaaagaactgag

SEQ ID NO: 10816 - DNA, 18 bp, Artificial Sequence
  Synthetic
ctggatcagaccgagtga

SEQ ID NO: 10817 - DNA, 18 bp, Artificial Sequence
  Synthetic
tgacatcagagtcacagc

SEQ ID NO: 10818 - DNA, 21 bp, Artificial Sequence
  Synthetic
agaaatgatgatgttgaccaa

SEQ ID NO: 10819 - DNA, 18 bp, Artificial Sequence
  Synthetic
gcggatcatcagtcaaga

SEQ ID NO: 10820 - DNA, 23 bp, Artificial Sequence
  Synthetic
ttaagggttagagatcaaagagg

SEQ ID NO: 10821 - DNA, 19 bp, Artificial Sequence
  Synthetic
cggtacagtggattcgtaa

SEQ ID NO: 10822 - DNA, 19 bp, Artificial Sequence
  Synthetic
tgcattgactgaagatcca

SEQ ID NO: 10823 - DNA, 22 bp, Artificial Sequence
  Synthetic
caacaatcatctgactagctat

SEQ ID NO: 10824 - DNA, 21 bp, Artificial Sequence
  Synthetic
agaatctttggtgttacctgc

SEQ ID NO: 10825 - DNA, 20 bp, Artificial Sequence
  Synthetic
cgaaagtttatagctagccc

SEQ ID NO: 10826 - DNA, 18 bp, Artificial Sequence
  Synthetic
tcgactacgaggaggaga

SEQ ID NO: 10827 - DNA, 22 bp, Artificial Sequence
  Synthetic
gcagtttagtttactttggtgg

SEQ ID NO: 10828 - DNA, 18 bp, Artificial Sequence
  Synthetic
tgtaccattggcagaagg

SEQ ID NO: 10829 - DNA, 20 bp, Artificial Sequence
  Synthetic
ttcccgcctagttcaatttg

SEQ ID NO: 10830 - DNA, 23 bp, Artificial Sequence
  Synthetic
agtgaaataccaccaatagaaga

SEQ ID NO: 10831 - DNA, 21 bp, Artificial Sequence
  Synthetic
cacaacgtttagtttggagac

SEQ ID NO: 10832 - DNA, 19 bp, Artificial Sequence
  Synthetic
tgcccgccaattcaattag

SEQ ID NO: 10833 - DNA, 25 bp, Artificial Sequence
  Synthetic
catttcaatgtctttatctgtttgg

SEQ ID NO: 10834 - DNA, 18 bp, Artificial Sequence
  Synthetic
gagcaggaagagcaggat

SEQ ID NO: 10835 - DNA, 19 bp, Artificial Sequence
  Synthetic
acagtggcttaggacatga

SEQ ID NO: 10836 - DNA, 23 bp, Artificial Sequence
  Synthetic
ttatgcttgtttgagttttcaag

SEQ ID NO: 10837 - DNA, 24 bp, Artificial Sequence
  Synthetic
gctaatagtaaaagtcagttttgg

SEQ ID NO: 10838 - DNA, 18 bp, Artificial Sequence
  Synthetic
acgctcagacctggaatc

SEQ ID NO: 10839 - DNA, 20 bp, Artificial Sequence
  Synthetic
cgaggaagaaaaagctatgc

SEQ ID NO: 10840 - DNA, 24 bp, Artificial Sequence
  Synthetic
cccccaatattattagttaaaggg

SEQ ID NO: 10841 - DNA, 19 bp, Artificial Sequence
  Synthetic
tggattgccagtgtggttt

SEQ ID NO: 10842 - DNA, 18 bp, Artificial Sequence
  Synthetic
ccactgcatcaacaccta

SEQ ID NO: 10843 - DNA, 22 bp, Artificial Sequence
  Synthetic
gtaggcctactttatctgaaac

SEQ ID NO: 10844 - DNA, 21 bp, Artificial Sequence
  Synthetic
ccttctgtggtagtagattcc

SEQ ID NO: 10845 - DNA, 23 bp, Artificial Sequence
  Synthetic
agttatgttaaaacaggaaagga

SEQ ID NO: 10846 - DNA, 21 bp, Artificial Sequence
  Synthetic
agggccctaataatagtgtgt

SEQ ID NO: 10847 - DNA, 21 bp, Artificial Sequence
  Synthetic
atctttttggaaggtggatct

SEQ ID NO: 10848 - DNA, 23 bp, Artificial Sequence
  Synthetic
ccaactttcaggtatgtactttg

SEQ ID NO: 10849 - DNA, 21 bp, Artificial Sequence
  Synthetic
tgtaaatttggaggagttggt

SEQ ID NO: 10850 - DNA, 19 bp, Artificial Sequence
  Synthetic
gcttcaagaagtgttcctg

SEQ ID NO: 10851 - DNA, 21 bp, Artificial Sequence
  Synthetic
gctattttagcgctaaaacga

SEQ ID NO: 10852 - DNA, 24 bp, Artificial Sequence
  Synthetic
atttcgcagtactaatagaaaagc

SEQ ID NO: 10853 - DNA, 25 bp, Artificial Sequence
  Synthetic
tggactataatggactttatttcac

SEQ ID NO: 10854 - DNA, 19 bp, Artificial Sequence
  Synthetic
cgactactaccgacggagg

SEQ ID NO: 10855 - DNA, 25 bp, Artificial Sequence
  Synthetic
gcaagtgaaattgatatagtttcag

SEQ ID NO: 10856 - DNA, 23 bp, Artificial Sequence
  Synthetic
agttttggagaagaaatagagtt

SEQ ID NO: 10857 - DNA, 19 bp, Artificial Sequence
  Synthetic
caagatttgcaagaggtgg

SEQ ID NO: 10858 - DNA, 24 bp, Artificial Sequence
  Synthetic
ttaactgaaactacaaatgaaggc

SEQ ID NO: 10859 - DNA, 25 bp, Artificial Sequence
  Synthetic
attttgattcctaatgttccagatg

SEQ ID NO: 10860 - DNA, 25 bp, Artificial Sequence
  Synthetic
gtggttcaaataatattactgtacc

SEQ ID NO: 10861 - DNA, 23 bp, Artificial Sequence
  Synthetic
atatggagatacagaaaatcctg

SEQ ID NO: 10862 - DNA, 18 bp, Artificial Sequence
  Synthetic
tgcacatcagcaagtgtc

SEQ ID NO: 10863 - DNA, 18 bp, Artificial Sequence
  Synthetic
ggcaaggccttccacatg

SEQ ID NO: 10864 - DNA, 17 bp, Artificial Sequence
  Synthetic
agaccctgcgctccatg

SEQ ID NO: 10865 - DNA, 21 bp, Artificial Sequence
  Synthetic
ccctacaacacaaaacaaact

SEQ ID NO: 10866 - DNA, 16 bp, Artificial Sequence
  Synthetic
accccagtcccgtcca

SEQ ID NO: 10867 - DNA, 17 bp, Artificial Sequence
  Synthetic
tggggccaccttcatca

SEQ ID NO: 10868 - DNA, 20 bp, Artificial Sequence
  Synthetic
cttctacctctccctagccc

SEQ ID NO: 10869 - DNA, 18 bp, Artificial Sequence
  Synthetic
gtcagctgaccgatgctc

SEQ ID NO: 10870 - DNA, 18 bp, Artificial Sequence
  Synthetic
acccaatagcatgacagc

SEQ ID NO: 10871 - DNA, 17 bp, Artificial Sequence
  Synthetic
ggacaccgacttcacgc

SEQ ID NO: 10872 - DNA, 20 bp, Artificial Sequence
  Synthetic
tcagaagctgagaccgaaga

SEQ ID NO: 10873 - DNA, 16 bp, Artificial Sequence
  Synthetic
cgggcctggactcaca

SEQ ID NO: 10874 - DNA, 18 bp, Artificial Sequence
  Synthetic
gccgggatgttttcgtgg

SEQ ID NO: 10875 - DNA, 20 bp, Artificial Sequence
  Synthetic
agaatggccatagggtgggt

SEQ ID NO: 10876 - DNA, 18 bp, Artificial Sequence
  Synthetic
cggtctgggctctcggaa

SEQ ID NO: 10877 - DNA, 18 bp, Artificial Sequence
  Synthetic
agcctgtaggtgaggacc

SEQ ID NO: 10878 - DNA, 20 bp, Artificial Sequence
  Synthetic
aaagttgtggtagacgggga

SEQ ID NO: 10879 - DNA, 18 bp, Artificial Sequence
  Synthetic
gagttcatcgtcgggggc

SEQ ID NO: 10880 - DNA, 16 bp, Artificial Sequence
  Synthetic
agcagggaggccagca

SEQ ID NO: 10881 - DNA, 16 bp, Artificial Sequence
  Synthetic
tcggccagctggggaa

SEQ ID NO: 10882 - DNA, 20 bp, Artificial Sequence
  Synthetic
agctcttgaccaggtagagg

SEQ ID NO: 10883 - DNA, 17 bp, Artificial Sequence
  Synthetic
ggaggatgcggaatggc

SEQ ID NO: 10884 - DNA, 18 bp, Artificial Sequence
  Synthetic
cgtctggaggtccgtgga

SEQ ID NO: 10885 - DNA, 16 bp, Artificial Sequence
  Synthetic
gtgtgctgctccacgc

SEQ ID NO: 10886 - DNA, 19 bp, Artificial Sequence
  Synthetic
cgggtctccatcaagtccc

SEQ ID NO: 10887 - DNA, 18 bp, Artificial Sequence
  Synthetic
tggccacctgcaatctgg

SEQ ID NO: 10888 - DNA, 19 bp, Artificial Sequence
  Synthetic
gggaggaacagaatgagcg

SEQ ID NO: 10889 - DNA, 17 bp, Artificial Sequence
  Synthetic
aaggctcaggacgtggg

SEQ ID NO: 10890 - DNA, 19 bp, Artificial Sequence
  Synthetic
cctacttgggagagtccgg

SEQ ID NO: 10891 - DNA, 17 bp, Artificial Sequence
  Synthetic
agagggccctggtgaga

SEQ ID NO: 10892 - DNA, 18 bp, Artificial Sequence
  Synthetic
ctcgtgtgcaaagtgggc

SEQ ID NO: 10893 - DNA, 19 bp, Artificial Sequence
  Synthetic
taagcagccgtgactagca

SEQ ID NO: 10894 - DNA, 19 bp, Artificial Sequence
  Synthetic
caggtgaagctgcagttcc

SEQ ID NO: 10895 - DNA, 16 bp, Artificial Sequence
  Synthetic
gtgcctgggcgcaaga

SEQ ID NO: 10896 - DNA, 18 bp, Artificial Sequence
  Synthetic
gacccttgtcctcctcca

SEQ ID NO: 10897 - DNA, 17 bp, Artificial Sequence
  Synthetic
tggaagacatggccgcc

SEQ ID NO: 10898 - DNA, 16 bp, Artificial Sequence
  Synthetic
tgctgaggtggggctg

SEQ ID NO: 10899 - DNA, 22 bp, Artificial Sequence
  Synthetic
tggccagtcttaatttattgtc

SEQ ID NO: 10900 - DNA, 19 bp, Artificial Sequence
  Synthetic
ttgtgcttcgtgatggcag

SEQ ID NO: 10901 - DNA, 16 bp, Artificial Sequence
  Synthetic
gcagtcggcgctttgg

SEQ ID NO: 10902 - DNA, 18 bp, Artificial Sequence
  Synthetic
gaagcgactacacagccg

SEQ ID NO: 10903 - DNA, 20 bp, Artificial Sequence
  Synthetic
ataaccatggacgaggacgg

SEQ ID NO: 10904 - DNA, 18 bp, Artificial Sequence
  Synthetic
ggtcgaggaggcagtgga

SEQ ID NO: 10905 - DNA, 19 bp, Artificial Sequence
  Synthetic
catagtcacggatgctgca

SEQ ID NO: 10906 - DNA, 19 bp, Artificial Sequence
  Synthetic
ccacgatcacattggtggt

SEQ ID NO: 10907 - DNA, 16 bp, Artificial Sequence
  Synthetic
ggcgtccgtagagcga

SEQ ID NO: 10908 - DNA, 18 bp, Artificial Sequence
  Synthetic
gaccgggggagatcatgg

SEQ ID NO: 10909 - DNA, 17 bp, Artificial Sequence
  Synthetic
ttggtccagggtccagg

SEQ ID NO: 10910 - DNA, 19 bp, Artificial Sequence
  Synthetic
tctcacctgtgctagtggc

SEQ ID NO: 10911 - DNA, 18 bp, Artificial Sequence
  Synthetic
catctcggacccgaagcc

SEQ ID NO: 10912 - DNA, 20 bp, Artificial Sequence
  Synthetic
tggtgtataaaccgcagtgg

SEQ ID NO: 10913 - DNA, 19 bp, Artificial Sequence
  Synthetic
cagtgccagttccagacac

SEQ ID NO: 10914 - DNA, 16 bp, Artificial Sequence
  Synthetic
tgcccgtccgatgtgg

SEQ ID NO: 10915 - DNA, 16 bp, Artificial Sequence
  Synthetic
gcagcaaacacgcggc

SEQ ID NO: 10916 - DNA, 18 bp, Artificial Sequence
  Synthetic
cgctggtcctgtgtgtct

SEQ ID NO: 10917 - DNA, 16 bp, Artificial Sequence
  Synthetic
tcctcgctgagccagg

SEQ ID NO: 10918 - DNA, 16 bp, Artificial Sequence
  Synthetic
tcgccgccgtgactca

SEQ ID NO: 10919 - DNA, 18 bp, Artificial Sequence
  Synthetic
atgcagggaatgagcggt

SEQ ID NO: 10920 - DNA, 18 bp, Artificial Sequence
  Synthetic
ctcggagaaggcaaaggc

SEQ ID NO: 10921 - DNA, 18 bp, Artificial Sequence
  Synthetic
ggaaggtcaagagctggc

SEQ ID NO: 10922 - DNA, 20 bp, Artificial Sequence
  Synthetic
agcctagtcagagagaaccg

SEQ ID NO: 10923 - DNA, 16 bp, Artificial Sequence
  Synthetic
gccgtgcacctgccat

SEQ ID NO: 10924 - DNA, 20 bp, Artificial Sequence
  Synthetic
agactcctgcctgaatcaga

SEQ ID NO: 10925 - DNA, 23 bp, Artificial Sequence
  Synthetic
caaaagcaataaagtacaggatt

SEQ ID NO: 10926 - DNA, 17 bp, Artificial Sequence
  Synthetic
ctctagggccgagcaca

SEQ ID NO: 10927 - DNA, 18 bp, Artificial Sequence
  Synthetic
gagtttccagccctgggc

SEQ ID NO: 10928 - DNA, 17 bp, Artificial Sequence
  Synthetic
cgatggacgctcacacc

SEQ ID NO: 10929 - DNA, 16 bp, Artificial Sequence
  Synthetic
ggagcagccgggaact

SEQ ID NO: 10930 - DNA, 19 bp, Artificial Sequence
  Synthetic
gtggcatcctaaggaggga

SEQ ID NO: 10931 - DNA, 17 bp, Artificial Sequence
  Synthetic
ggcttgtcatgccgctg

SEQ ID NO: 10932 - DNA, 18 bp, Artificial Sequence
  Synthetic
tcctcggccatctccgtc

SEQ ID NO: 10933 - DNA, 20 bp, Artificial Sequence
  Synthetic
atgtctatggggatgaggcc

SEQ ID NO: 10934 - DNA, 16 bp, Artificial Sequence
  Synthetic
gggcttccgtgggtgt

SEQ ID NO: 10935 - DNA, 16 bp, Artificial Sequence
  Synthetic
tcgctcggctcgatgc

SEQ ID NO: 10936 - DNA, 16 bp, Artificial Sequence
  Synthetic
gcaggtgctccgagct

SEQ ID NO: 10937 - DNA, 18 bp, Artificial Sequence
  Synthetic
tcagcctccaacaggtgc

SEQ ID NO: 10938 - DNA, 17 bp, Artificial Sequence
  Synthetic
gcctctggaccctcaca

SEQ ID NO: 10939 - DNA, 16 bp, Artificial Sequence
  Synthetic
gcacgccctctgggaa

SEQ ID NO: 10940 - DNA, 16 bp, Artificial Sequence
  Synthetic
agttggggtcgggcct

SEQ ID NO: 10941 - DNA, 16 bp, Artificial Sequence
  Synthetic
agtcaggctggccagg

SEQ ID NO: 10942 - DNA, 19 bp, Artificial Sequence
  Synthetic
tgtgtagcacagcaccacc

SEQ ID NO: 10943 - DNA, 16 bp, Artificial Sequence
  Synthetic
gcagaggaccagggct

SEQ ID NO: 10944 - DNA, 16 bp, Artificial Sequence
  Synthetic
gtgacgaagggcccca

SEQ ID NO: 10945 - DNA, 20 bp, Artificial Sequence
  Synthetic
tgaaagttgtgtggagaagt

SEQ ID NO: 10946 - DNA, 18 bp, Artificial Sequence
  Synthetic
ttggaaaccatgcgaggc

SEQ ID NO: 10947 - DNA, 18 bp, Artificial Sequence
  Synthetic
cagcacacacaggaacaa

SEQ ID NO: 10948 - DNA, 22 bp, Artificial Sequence
  Synthetic
tggggagtggttatattaatgc

SEQ ID NO: 10949 - DNA, 23 bp, Artificial Sequence
  Synthetic
acagatgaaagtatattggcata

SEQ ID NO: 10950 - DNA, 23 bp, Artificial Sequence
  Synthetic
taaagggtataccaaagaaaagc

SEQ ID NO: 10951 - DNA, 18 bp, Artificial Sequence
  Synthetic
tttagatgcgtgccagga

SEQ ID NO: 10952 - DNA, 23 bp, Artificial Sequence
  Synthetic
taaagacattacttaacagtccc

SEQ ID NO: 10953 - DNA, 20 bp, Artificial Sequence
  Synthetic
atatggggacacaggcatct

SEQ ID NO: 10954 - DNA, 21 bp, Artificial Sequence
  Synthetic
caacatttgtaacattgtggc

SEQ ID NO: 10955 - DNA, 22 bp, Artificial Sequence
  Synthetic
tttttgttactgtgtttcttgg

SEQ ID NO: 10956 - DNA, 20 bp, Artificial Sequence
  Synthetic
gcacacaaaatgttacagca

SEQ ID NO: 10957 - DNA, 19 bp, Artificial Sequence
  Synthetic
caccgacgactatgttacc

SEQ ID NO: 10958 - DNA, 18 bp, Artificial Sequence
  Synthetic
aagggtcttgaggtaggc

SEQ ID NO: 10959 - DNA, 22 bp, Artificial Sequence
  Synthetic
atacaggatggtgatatggtag

SEQ ID NO: 10960 - DNA, 18 bp, Artificial Sequence
  Synthetic
tgcttcccctacaagctc

SEQ ID NO: 10961 - DNA, 22 bp, Artificial Sequence
  Synthetic
tttaacagctgaaattatggcc

SEQ ID NO: 10962 - DNA, 19 bp, Artificial Sequence
  Synthetic
ccctggcttcctgtatgca

SEQ ID NO: 10963 - DNA, 21 bp, Artificial Sequence
  Synthetic
catatcctttccaacacaggt

SEQ ID NO: 10964 - DNA, 20 bp, Artificial Sequence
  Synthetic
gccacaagctacattagacc

SEQ ID NO: 10965 - DNA, 24 bp, Artificial Sequence
  Synthetic
gaaagcttattgtagaaagtgtgt

SEQ ID NO: 10966 - DNA, 25 bp, Artificial Sequence
  Synthetic
gtatcagatttaattgatgatgtgg

SEQ ID NO: 10967 - DNA, 23 bp, Artificial Sequence
  Synthetic
caaaacattactacaaacgcatg

SEQ ID NO: 10968 - DNA, 19 bp, Artificial Sequence
  Synthetic
actgaaaatgcaaacgcag

SEQ ID NO: 10969 - DNA, 25 bp, Artificial Sequence
  Synthetic
agctatacaaatacaacttttggtc

SEQ ID NO: 10970 - DNA, 19 bp, Artificial Sequence
  Synthetic
gccgaagaatcacacagga

SEQ ID NO: 10971 - DNA, 23 bp, Artificial Sequence
  Synthetic
actcttgcagatattttactgaa

SEQ ID NO: 10972 - DNA, 24 bp, Artificial Sequence
  Synthetic
actatgagatattgacaaccacag

SEQ ID NO: 10973 - DNA, 25 bp, Artificial Sequence
  Synthetic
ctagatcgcccaatatatagtgaaa

SEQ ID NO: 10974 - DNA, 25 bp, Artificial Sequence
  Synthetic
aactactacatatccagatattcca

SEQ ID NO: 10975 - DNA, 22 bp, Artificial Sequence
  Synthetic
ccatccgttgtttaataaagtg

SEQ ID NO: 10976 - DNA, 24 bp, Artificial Sequence
  Synthetic
ctcagagtattgaggataactaca

SEQ ID NO: 10977 - DNA, 18 bp, Artificial Sequence
  Synthetic
ggagactactgcccaaga

SEQ ID NO: 10978 - DNA, 20 bp, Artificial Sequence
  Synthetic
gctacctgtgccataaacca

SEQ ID NO: 10979 - DNA, 18 bp, Artificial Sequence
  Synthetic
gaggacggtgagcaacct

SEQ ID NO: 10980 - DNA, 18 bp, Artificial Sequence
  Synthetic
gccacagtggacagaacc

SEQ ID NO: 10981 - DNA, 20 bp, Artificial Sequence
  Synthetic
ggcagaagctcacaaaaagc

SEQ ID NO: 10982 - DNA, 19 bp, Artificial Sequence
  Synthetic
tggagctagcaagacagtt

SEQ ID NO: 10983 - DNA, 22 bp, Artificial Sequence
  Synthetic
caacatatgctcatagaacctc

SEQ ID NO: 10984 - DNA, 18 bp, Artificial Sequence
  Synthetic
ggcattcctagcaagcaa

SEQ ID NO: 10985 - DNA, 20 bp, Artificial Sequence
  Synthetic
atatatggacctgcagacac

SEQ ID NO: 10986 - DNA, 22 bp, Artificial Sequence
  Synthetic
atgacaacaaataccaatccct

SEQ ID NO: 10987 - DNA, 19 bp, Artificial Sequence
  Synthetic
aaaaagggctacaccgtag

SEQ ID NO: 10988 - DNA, 20 bp, Artificial Sequence
  Synthetic
tactgaccccccatacaccg

SEQ ID NO: 10989 - DNA, 23 bp, Artificial Sequence
  Synthetic
ggtgatccaaacaaattaaagtg

SEQ ID NO: 10990 - DNA, 20 bp, Artificial Sequence
  Synthetic
ggaacgttaagggacatctg

SEQ ID NO: 10991 - DNA, 24 bp, Artificial Sequence
  Synthetic
tgctgctcaattgtatatattcct

SEQ ID NO: 10992 - DNA, 18 bp, Artificial Sequence
  Synthetic
tggggtagcttgggtgtc

SEQ ID NO: 10993 - DNA, 18 bp, Artificial Sequence
  Synthetic
gttgtacagcagggcata

SEQ ID NO: 10994 - DNA, 25 bp, Artificial Sequence
  Synthetic
caaacatatattattatgcaggcag

SEQ ID NO: 10995 - DNA, 18 bp, Artificial Sequence
  Synthetic
gttgtacaaccgcctgta

SEQ ID NO: 10996 - DNA, 20 bp, Artificial Sequence
  Synthetic
cgttgcaaaccaataagtct

SEQ ID NO: 10997 - DNA, 18 bp, Artificial Sequence
  Synthetic
cctagtgggtccatggtt

SEQ ID NO: 10998 - DNA, 21 bp, Artificial Sequence
  Synthetic
cctctacaaaacgtaaacggt

SEQ ID NO: 10999 - DNA, 18 bp, Artificial Sequence
  Synthetic
ggttgcgccttgtgagtc

SEQ ID NO: 11000 - DNA, 20 bp, Artificial Sequence
  Synthetic
ccctaataggggcgacactc

SEQ ID NO: 11001 - DNA, 20 bp, Artificial Sequence
  Synthetic
gcaccatgagcacaaatcct

SEQ ID NO: 11002 - DNA, 19 bp, Artificial Sequence
  Synthetic
caatgacccccggcatagg

SEQ ID NO: 11003 - DNA, 19 bp, Artificial Sequence
  Synthetic
gcattacctggcagctcca

SEQ ID NO: 11004 - DNA, 20 bp, Artificial Sequence
  Synthetic
atgatgatgaactggtcgcc

SEQ ID NO: 11005 - DNA, 19 bp, Artificial Sequence
  Synthetic
gccctgaactgcaatgact

SEQ ID NO: 11006 - DNA, 20 bp, Artificial Sequence
  Synthetic
attgaacagcactcgaccac

SEQ ID NO: 11007 - DNA, 18 bp, Artificial Sequence
  Synthetic
ctcacggctgcatgcaat

SEQ ID NO: 11008 - DNA, 20 bp, Artificial Sequence
  Synthetic
cagcactagagaagctggtc

SEQ ID NO: 11009 - DNA, 20 bp, Artificial Sequence
  Synthetic
ccgtgatggcatcatatggg

SEQ ID NO: 11010 - DNA, 19 bp, Artificial Sequence
  Synthetic
gtcattgtctggggagcgg

SEQ ID NO: 11011 - DNA, 19 bp, Artificial Sequence
  Synthetic
tccttcctcggaacatcca

SEQ ID NO: 11012 - DNA, 18 bp, Artificial Sequence
  Synthetic
gggcgtggctaagtccat

SEQ ID NO: 11013 - DNA, 18 bp, Artificial Sequence
  Synthetic
cgcccatcacgtactcca

SEQ ID NO: 11014 - DNA, 20 bp, Artificial Sequence
  Synthetic
aaaaagtgtgacgagctcgc

SEQ ID NO: 11015 - DNA, 20 bp, Artificial Sequence
  Synthetic
tatgtttccactggtgagcg

SEQ ID NO: 11016 - DNA, 20 bp, Artificial Sequence
  Synthetic
tgtttgactcgactcaagcc

SEQ ID NO: 11017 - DNA, 18 bp, Artificial Sequence
  Synthetic
gggcggctctcattgaag

SEQ ID NO: 11018 - DNA, 19 bp, Artificial Sequence
  Synthetic
cagtggcctagtgggagct

SEQ ID NO: 11019 - DNA, 18 bp, Artificial Sequence
  Synthetic
caatgtccgcttgggctc

SEQ ID NO: 11020 - DNA, 19 bp, Artificial Sequence
  Synthetic
tcgttctgcgttgggctta

SEQ ID NO: 11021 - DNA, 20 bp, Artificial Sequence
  Synthetic
acccaatggtcgaagaaagg

SEQ ID NO: 11022 - DNA, 16 bp, Artificial Sequence
  Synthetic
cggcagtcagacgcct

SEQ ID NO: 11023 - DNA, 20 bp, Artificial Sequence
  Synthetic
acaaagagcgcctcactaag

SEQ ID NO: 11024 - DNA, 18 bp, Artificial Sequence
  Synthetic
caaggggggcaagaaagc

SEQ ID NO: 11025 - DNA, 18 bp, Artificial Sequence
  Synthetic
ggccaaacctgcgggtac

SEQ ID NO: 11026 - DNA, 20 bp, Artificial Sequence
  Synthetic
ccccagaccggagtatgatc

SEQ ID NO: 11027 - DNA, 20 bp, Artificial Sequence
  Synthetic
aaggttacatgggcttgacg

SEQ ID NO: 11028 - DNA, 19 bp, Artificial Sequence
  Synthetic
ctcaacggtctgctgatgc

SEQ ID NO: 11029 - DNA, 19 bp, Artificial Sequence
  Synthetic
ggcggtgatttgttcgtcg

SEQ ID NO: 11030 - DNA, 18 bp, Artificial Sequence
  Synthetic
gcgcggaggttttgtacg

SEQ ID NO: 11031 - DNA, 17 bp, Artificial Sequence
  Synthetic
ccagcaggctcagttcg

SEQ ID NO: 11032 - DNA, 18 bp, Artificial Sequence
  Synthetic
gattccaaacgcggtgca

SEQ ID NO: 11033 - DNA, 16 bp, Artificial Sequence
  Synthetic
ggtcaacagcggcgac

SEQ ID NO: 11034 - DNA, 19 bp, Artificial Sequence
  Synthetic
cgagctggtacttcttccg

SEQ ID NO: 11035 - DNA, 16 bp, Artificial Sequence
  Synthetic
caggctggccgacagt

SEQ ID NO: 11036 - DNA, 18 bp, Artificial Sequence
  Synthetic
ccaagtcggctacgcaat

SEQ ID NO: 11037 - DNA, 17 bp, Artificial Sequence
  Synthetic
gttcgggtacgctgtcg

SEQ ID NO: 11038 - DNA, 19 bp, Artificial Sequence
  Synthetic
cgattaaatcgtgctcgcg

SEQ ID NO: 11039 - DNA, 20 bp, Artificial Sequence
  Synthetic
ttttgatgttttggtcgcgc

SEQ ID NO: 11040 - DNA, 20 bp, Artificial Sequence
  Synthetic
aataaaactactgcgccgca

SEQ ID NO: 11041 - DNA, 15 bp, Artificial Sequence
  Synthetic
gcgattgcgtgccga

SEQ ID NO: 11042 - DNA, 17 bp, Artificial Sequence
  Synthetic
ggaacgggtgcgtttcc

SEQ ID NO: 11043 - DNA, 20 bp, Artificial Sequence
  Synthetic
tcatatcggtcagcggtact

SEQ ID NO: 11044 - DNA, 17 bp, Artificial Sequence
  Synthetic
tggtgaaatcgctggcg

SEQ ID NO: 11045 - DNA, 18 bp, Artificial Sequence
  Synthetic
cttggtcgtttccacgct

SEQ ID NO: 11046 - DNA, 17 bp, Artificial Sequence
  Synthetic
cggcaggctttcctcga

SEQ ID NO: 11047 - DNA, 16 bp, Artificial Sequence
  Synthetic
tctgcggcggctttcc

SEQ ID NO: 11048 - DNA, 16 bp, Artificial Sequence
  Synthetic
cctgtccgagcgaggt

SEQ ID NO: 11049 - DNA, 16 bp, Artificial Sequence
  Synthetic
cggcggcggttttcac

SEQ ID NO: 11050 - DNA, 16 bp, Artificial Sequence
  Synthetic
ggggttgcgggtgtgt

SEQ ID NO: 11051 - DNA, 16 bp, Artificial Sequence
  Synthetic
gtgaggctgggcggat

SEQ ID NO: 11052 - DNA, 16 bp, Artificial Sequence
  Synthetic
gcctgagaagggcgga

SEQ ID NO: 11053 - DNA, 16 bp, Artificial Sequence
  Synthetic
gttgccgagccagcga

SEQ ID NO: 11054 - DNA, 20 bp, Artificial Sequence
  Synthetic
gaaaaactatctgccgctgc

SEQ ID NO: 11055 - DNA, 17 bp, Artificial Sequence
  Synthetic
agtcgtcgaagccgtgc

SEQ ID NO: 11056 - DNA, 19 bp, Artificial Sequence
  Synthetic
gccagatttgttcggtggg

SEQ ID NO: 11057 - DNA, 16 bp, Artificial Sequence
  Synthetic
atgcgccgtcagagcc

SEQ ID NO: 11058 - DNA, 16 bp, Artificial Sequence
  Synthetic
cgtccgcgcaggttac

SEQ ID NO: 11059 - DNA, 20 bp, Artificial Sequence
  Synthetic
ggggacgacttctttttcca

SEQ ID NO: 11060 - DNA, 18 bp, Artificial Sequence
  Synthetic
ccaatgcgttggcgagtt

SEQ ID NO: 11061 - DNA, 20 bp, Artificial Sequence
  Synthetic
cgctttttcaacggtggcat

SEQ ID NO: 11062 - DNA, 18 bp, Artificial Sequence
  Synthetic
gtgccgatttccgtgtct

SEQ ID NO: 11063 - DNA, 17 bp, Artificial Sequence
  Synthetic
tgttcgggcgttcgtct

SEQ ID NO: 11064 - DNA, 17 bp, Artificial Sequence
  Synthetic
ttcctcgccgcattgtg

SEQ ID NO: 11065 - DNA, 18 bp, Artificial Sequence
  Synthetic
gcgccgtttaccgctatg

SEQ ID NO: 11066 - DNA, 18 bp, Artificial Sequence
  Synthetic
cctgctgcccgtattggc

SEQ ID NO: 11067 - DNA, 20 bp, Artificial Sequence
  Synthetic
taccgagttcgcctattccc

SEQ ID NO: 11068 - DNA, 16 bp, Artificial Sequence
  Synthetic
gattgcccgtcgtggc

SEQ ID NO: 11069 - DNA, 18 bp, Artificial Sequence
  Synthetic
cctcttggcaagcagcaa

SEQ ID NO: 11070 - DNA, 17 bp, Artificial Sequence
  Synthetic
gttcccggccatcaacg

SEQ ID NO: 11071 - DNA, 16 bp, Artificial Sequence
  Synthetic
ggctggacggcatcga

SEQ ID NO: 11072 - DNA, 18 bp, Artificial Sequence
  Synthetic
agcacttggtcggctttg

SEQ ID NO: 11073 - DNA, 16 bp, Artificial Sequence
  Synthetic
aaacagcccgccctga

SEQ ID NO: 11074 - DNA, 17 bp, Artificial Sequence
  Synthetic
gcgcaggcccaaaaagt

SEQ ID NO: 11075 - DNA, 20 bp, Artificial Sequence
  Synthetic
ctgaagcataaagccgaagc

SEQ ID NO: 11076 - DNA, 17 bp, Artificial Sequence
  Synthetic
gcgttacgccgctgtca

SEQ ID NO: 11077 - DNA, 16 bp, Artificial Sequence
  Synthetic
ggcgttgacgagcagg

SEQ ID NO: 11078 - DNA, 19 bp, Artificial Sequence
  Synthetic
aacgcgatttcgtcgtcgg

SEQ ID NO: 11079 - DNA, 20 bp, Artificial Sequence
  Synthetic
gttggacagcaggactttgg

SEQ ID NO: 11080 - DNA, 18 bp, Artificial Sequence
  Synthetic
aggccaggcagaacaatg

SEQ ID NO: 11081 - DNA, 16 bp, Artificial Sequence
  Synthetic
gcgcccaaggtggcaa

SEQ ID NO: 11082 - DNA, 18 bp, Artificial Sequence
  Synthetic
aaacagcaaaaaggcggc

SEQ ID NO: 11083 - DNA, 18 bp, Artificial Sequence
  Synthetic
aagtgtctttgtcggcgg

SEQ ID NO: 11084 - DNA, 19 bp, Artificial Sequence
  Synthetic
ggcgcaaagttggaaaagc

SEQ ID NO: 11085 - DNA, 17 bp, Artificial Sequence
  Synthetic
tcaggcggacggtttcg

SEQ ID NO: 11086 - DNA, 17 bp, Artificial Sequence
  Synthetic
tcgccagcgaggtttga

SEQ ID NO: 11087 - DNA, 17 bp, Artificial Sequence
  Synthetic
tgcggcggaggttttgc

SEQ ID NO: 11088 - DNA, 18 bp, Artificial Sequence
  Synthetic
ggcgatcatgtggcagtg

SEQ ID NO: 11089 - DNA, 18 bp, Artificial Sequence
  Synthetic
ggtcaggggcataggcga

SEQ ID NO: 11090 - DNA, 15 bp, Artificial Sequence
  Synthetic
ggcgcggttttgcct

SEQ ID NO: 11091 - DNA, 15 bp, Artificial Sequence
  Synthetic
cggcggcattgcgtt

SEQ ID NO: 11092 - DNA, 19 bp, Artificial Sequence
  Synthetic
cgtagcatacggtttgcgg

SEQ ID NO: 11093 - DNA, 20 bp, Artificial Sequence
  Synthetic
gtcaggtagtcgatgtcgga

SEQ ID NO: 11094 - DNA, 16 bp, Artificial Sequence
  Synthetic
cggcaggtgtcggaca

SEQ ID NO: 11095 - DNA, 17 bp, Artificial Sequence
  Synthetic
cggcgttggacgttacg

SEQ ID NO: 11096 - DNA, 16 bp, Artificial Sequence
  Synthetic
gcatgaaggccgccga

SEQ ID NO: 11097 - DNA, 18 bp, Artificial Sequence
  Synthetic
gtgcctatgctgcgcttc

SEQ ID NO: 11098 - DNA, 18 bp, Artificial Sequence
  Synthetic
acccacacatcggattgc

SEQ ID NO: 11099 - DNA, 16 bp, Artificial Sequence
  Synthetic
cggtggcgtgcatacc

SEQ ID NO: 11100 - DNA, 18 bp, Artificial Sequence
  Synthetic
cgtacacggcttgggaaa

SEQ ID NO: 11101 - DNA, 20 bp, Artificial Sequence
  Synthetic
agacgatgtcgcattgttcc

SEQ ID NO: 11102 - DNA, 19 bp, Artificial Sequence
  Synthetic
aagccttcagtgaagactt

SEQ ID NO: 11103 - DNA, 20 bp, Artificial Sequence
  Synthetic
atgaacgaaatgaccgctgt

SEQ ID NO: 11104 - DNA, 20 bp, Artificial Sequence
  Synthetic
cgcaagtttacgggaattgc

SEQ ID NO: 11105 - DNA, 16 bp, Artificial Sequence
  Synthetic
cgatatcgcggcgcaa

SEQ ID NO: 11106 - DNA, 20 bp, Artificial Sequence
  Synthetic
ccaacagcgcggattttgtc

SEQ ID NO: 11107 - DNA, 16 bp, Artificial Sequence
  Synthetic
ccccgccattactgcg

SEQ ID NO: 11108 - DNA, 20 bp, Artificial Sequence
  Synthetic
gtaggtaacgagcaatccgg

SEQ ID NO: 11109 - DNA, 16 bp, Artificial Sequence
  Synthetic
ggtttgcccagcgacc

SEQ ID NO: 11110 - DNA, 19 bp, Artificial Sequence
  Synthetic
gtttttcagctgttcggcg

SEQ ID NO: 11111 - DNA, 18 bp, Artificial Sequence
  Synthetic
acagcccgatggttttcg

SEQ ID NO: 11112 - DNA, 15 bp, Artificial Sequence
  Synthetic
tgcttctgccgcgca

SEQ ID NO: 11113 - DNA, 16 bp, Artificial Sequence
  Synthetic
ttccgccgcctctgtc

SEQ ID NO: 11114 - DNA, 19 bp, Artificial Sequence
  Synthetic
cgttacaacgtcggactcg

SEQ ID NO: 11115 - DNA, 18 bp, Artificial Sequence
  Synthetic
aacggcgacatcacttcg

SEQ ID NO: 11116 - DNA, 18 bp, Artificial Sequence
  Synthetic
tcttgaaaggcttgccgg

SEQ ID NO: 11117 - DNA, 19 bp, Artificial Sequence
  Synthetic
acaggtgttcgtcaacgtc

SEQ ID NO: 11118 - DNA, 20 bp, Artificial Sequence
  Synthetic
gatttgctcgcgctttacca

SEQ ID NO: 11119 - DNA, 17 bp, Artificial Sequence
  Synthetic
cgaagccgtcgttccct

SEQ ID NO: 11120 - DNA, 16 bp, Artificial Sequence
  Synthetic
cggcgtggctcaatgc

SEQ ID NO: 11121 - DNA, 18 bp, Artificial Sequence
  Synthetic
ccgctggagattttgcgg

SEQ ID NO: 11122 - DNA, 17 bp, Artificial Sequence
  Synthetic
ggcgacgatgttgctgt

SEQ ID NO: 11123 - DNA, 20 bp, Artificial Sequence
  Synthetic
tttgtgttccaggtatgcgg

SEQ ID NO: 11124 - DNA, 18 bp, Artificial Sequence
  Synthetic
tgtgttggcggtattcgg

SEQ ID NO: 11125 - DNA, 18 bp, Artificial Sequence
  Synthetic
gtggctgccgaattggaa

SEQ ID NO: 11126 - DNA, 17 bp, Artificial Sequence
  Synthetic
aggatggtcaggacggc

SEQ ID NO: 11127 - DNA, 19 bp, Artificial Sequence
  Synthetic
tgtcggacaggatgtcgag

SEQ ID NO: 11128 - DNA, 20 bp, Artificial Sequence
  Synthetic
cgtatggcgggtaaattggc

SEQ ID NO: 11129 - DNA, 18 bp, Artificial Sequence
  Synthetic
gtcagttcgagcggcatg

SEQ ID NO: 11130 - DNA, 19 bp, Artificial Sequence
  Synthetic
ttttggcactgtcgtcagc

SEQ ID NO: 11131 - DNA, 20 bp, Artificial Sequence
  Synthetic
tatagctgacttcgacggcc

SEQ ID NO: 11132 - DNA, 18 bp, Artificial Sequence
  Synthetic
cggtagcggcataaggtg

SEQ ID NO: 11133 - DNA, 18 bp, Artificial Sequence
  Synthetic
cggcggtctctgaggtaa

SEQ ID NO: 11134 - DNA, 19 bp, Artificial Sequence
  Synthetic
aatgcgtttcaggcggtat

SEQ ID NO: 11135 - DNA, 16 bp, Artificial Sequence
  Synthetic
gccaaataccggcgcg

SEQ ID NO: 11136 - DNA, 20 bp, Artificial Sequence
  Synthetic
ttgctgaaaaaagacagtcc

SEQ ID NO: 11137 - DNA, 19 bp, Artificial Sequence
  Synthetic
ccttgccctgaccgacttt

SEQ ID NO: 11138 - DNA, 18 bp, Artificial Sequence
  Synthetic
gtcgccgacgtagagggt

SEQ ID NO: 11139 - DNA, 15 bp, Artificial Sequence
  Synthetic
gcgccgcgtttttgc

SEQ ID NO: 11140 - DNA, 16 bp, Artificial Sequence
  Synthetic
gtaacggcggcggtgt

SEQ ID NO: 11141 - DNA, 19 bp, Artificial Sequence
  Synthetic
gtcgagggaatctgccagt

SEQ ID NO: 11142 - DNA, 20 bp, Artificial Sequence
  Synthetic
tggtgaacacgatgtcttcc

SEQ ID NO: 11143 - DNA, 16 bp, Artificial Sequence
  Synthetic
cgcaccgtccacgaca

SEQ ID NO: 11144 - DNA, 19 bp, Artificial Sequence
  Synthetic
agattttgtcggcatcggg

SEQ ID NO: 11145 - DNA, 19 bp, Artificial Sequence
  Synthetic
gttgtccgcccgaaagttc

SEQ ID NO: 11146 - DNA, 16 bp, Artificial Sequence
  Synthetic
gcggcggcgtattgtg

SEQ ID NO: 11147 - DNA, 18 bp, Artificial Sequence
  Synthetic
tcagacagtttgcgggtg

SEQ ID NO: 11148 - DNA, 19 bp, Artificial Sequence
  Synthetic
caattcggcggtgatttcg

SEQ ID NO: 11149 - DNA, 20 bp, Artificial Sequence
  Synthetic
caggccggttaaaagatcga

SEQ ID NO: 11150 - DNA, 20 bp, Artificial Sequence
  Synthetic
ctgcccagttccaaaatcgc

SEQ ID NO: 11151 - DNA, 18 bp, Artificial Sequence
  Synthetic
gacgcaaggagtaggcga

SEQ ID NO: 11152 - DNA, 17 bp, Artificial Sequence
  Synthetic
gatgctggcatcgtggg

SEQ ID NO: 11153 - DNA, 20 bp, Artificial Sequence
  Synthetic
ctttctttgtcaatgccggg

SEQ ID NO: 11154 - DNA, 16 bp, Artificial Sequence
  Synthetic
cggacgatgcacgagc

SEQ ID NO: 11155 - DNA, 17 bp, Artificial Sequence
  Synthetic
gccgcggttgacgatgt

SEQ ID NO: 11156 - DNA, 19 bp, Artificial Sequence
  Synthetic
cttcgctgaggacggaaac

SEQ ID NO: 11157 - DNA, 17 bp, Artificial Sequence
  Synthetic
cgacggcttcgccttct

SEQ ID NO: 11158 - DNA, 17 bp, Artificial Sequence
  Synthetic
ctgtcgggcagcttgag

SEQ ID NO: 11159 - DNA, 18 bp, Artificial Sequence
  Synthetic
ttctacgccgctgatgct

SEQ ID NO: 11160 - DNA, 18 bp, Artificial Sequence
  Synthetic
cttcctgcgaggcaagtc

SEQ ID NO: 11161 - DNA, 18 bp, Artificial Sequence
  Synthetic
tgccaacagcgtttcgag

SEQ ID NO: 11162 - DNA, 19 bp, Artificial Sequence
  Synthetic
cgtgcaatcaggaaatggc

SEQ ID NO: 11163 - DNA, 17 bp, Artificial Sequence
  Synthetic
aacattgggtgcagggc

SEQ ID NO: 11164 - DNA, 15 bp, Artificial Sequence
  Synthetic
aggctacgggcgcaa

SEQ ID NO: 11165 - DNA, 16 bp, Artificial Sequence
  Synthetic
cgccggcttcctgcaa

SEQ ID NO: 11166 - DNA, 16 bp, Artificial Sequence
  Synthetic
gtcgtcgttgccgcgt

SEQ ID NO: 11167 - DNA, 16 bp, Artificial Sequence
  Synthetic
cgcgccgtcatcatgc

SEQ ID NO: 11168 - DNA, 18 bp, Artificial Sequence
  Synthetic
ttatcgggcgcgtgatga

SEQ ID NO: 11169 - DNA, 16 bp, Artificial Sequence
  Synthetic
gtgtgcgcccccatca

SEQ ID NO: 11170 - DNA, 19 bp, Artificial Sequence
  Synthetic
ggcgacggtctgtatttgg

SEQ ID NO: 11171 - DNA, 16 bp, Artificial Sequence
  Synthetic
gtcgatacgccgggct

SEQ ID NO: 11172 - DNA, 18 bp, Artificial Sequence
  Synthetic
cgataaaggcggcgactt

SEQ ID NO: 11173 - DNA, 17 bp, Artificial Sequence
  Synthetic
ggccggatatcgcgttc

SEQ ID NO: 11174 - DNA, 18 bp, Artificial Sequence
  Synthetic
gctcgctgatttcgctgt

SEQ ID NO: 11175 - DNA, 16 bp, Artificial Sequence
  Synthetic
ccgggcaggacttgga

SEQ ID NO: 11176 - DNA, 18 bp, Artificial Sequence
  Synthetic
tggatacgcctgaccacg

SEQ ID NO: 11177 - DNA, 20 bp, Artificial Sequence
  Synthetic
ttcacaaaatctcttgcgtg

SEQ ID NO: 11178 - DNA, 21 bp, Artificial Sequence
  Synthetic
ctacatcattatgaccgttgt

SEQ ID NO: 11179 - DNA, 18 bp, Artificial Sequence
  Synthetic
ggactggtggtgcatccg

SEQ ID NO: 11180 - DNA, 19 bp, Artificial Sequence
  Synthetic
acgctatcttgcccacagc

SEQ ID NO: 11181 - DNA, 18 bp, Artificial Sequence
  Synthetic
tgtgggaagccaaaccgg

SEQ ID NO: 11182 - DNA, 20 bp, Artificial Sequence
  Synthetic
gggcatgccgtcaatatcga

SEQ ID NO: 11183 - DNA, 18 bp, Artificial Sequence
  Synthetic
gaagacgtgcggacgctg

SEQ ID NO: 11184 - DNA, 16 bp, Artificial Sequence
  Synthetic
aatctggcggatgcgc

SEQ ID NO: 11185 - DNA, 17 bp, Artificial Sequence
  Synthetic
gcgtttgaccgccttca

SEQ ID NO: 11186 - DNA, 16 bp, Artificial Sequence
  Synthetic
tcggggcgggtgaagt

SEQ ID NO: 11187 - DNA, 19 bp, Artificial Sequence
  Synthetic
cacagtgccggataaaggg

SEQ ID NO: 11188 - DNA, 16 bp, Artificial Sequence
  Synthetic
aggccgaggttgtggg

SEQ ID NO: 11189 - DNA, 19 bp, Artificial Sequence
  Synthetic
ctgtcgctgctgattcagg

SEQ ID NO: 11190 - DNA, 20 bp, Artificial Sequence
  Synthetic
tcgccgaaacgggtaaacag

SEQ ID NO: 11191 - DNA, 22 bp, Artificial Sequence
  Synthetic
cgtcaagcaactctatcctaat

SEQ ID NO: 11192 - DNA, 18 bp, Artificial Sequence
  Synthetic
gcaacttttggaacgtgt

SEQ ID NO: 11193 - DNA, 19 bp, Artificial Sequence
  Synthetic
cggtaaggattgggaacag

SEQ ID NO: 11194 - DNA, 18 bp, Artificial Sequence
  Synthetic
cgaacccggcattaccaa

SEQ ID NO: 11195 - DNA, 19 bp, Artificial Sequence
  Synthetic
tagctttcgcctgaaacgg

SEQ ID NO: 11196 - DNA, 19 bp, Artificial Sequence
  Synthetic
gggcaggatgtgttcgatg

SEQ ID NO: 11197 - DNA, 17 bp, Artificial Sequence
  Synthetic
gctttgggctttgcggt

SEQ ID NO: 11198 - DNA, 18 bp, Artificial Sequence
  Synthetic
ttggatgaggacaggttg

SEQ ID NO: 11199 - DNA, 18 bp, Artificial Sequence
  Synthetic
ttacccccgaggacgtgc

SEQ ID NO: 11200 - DNA, 19 bp, Artificial Sequence
  Synthetic
ctgccttcttatggcgaac

SEQ ID NO: 11201 - DNA, 18 bp, Artificial Sequence
  Synthetic
cttgtcggcaatcggtgt

SEQ ID NO: 11202 - DNA, 16 bp, Artificial Sequence
  Synthetic
caccacgtcgccgact

SEQ ID NO: 11203 - DNA, 19 bp, Artificial Sequence
  Synthetic
tgccggaagaaggttttgc

SEQ ID NO: 11204 - DNA, 19 bp, Artificial Sequence
  Synthetic
cagctcaaaatgttgctgt

SEQ ID NO: 11205 - DNA, 15 bp, Artificial Sequence
  Synthetic
gcgggcgtgtttgca

SEQ ID NO: 11206 - DNA, 17 bp, Artificial Sequence
  Synthetic
ttaaatgccgtccgcgc

SEQ ID NO: 11207 - DNA, 18 bp, Artificial Sequence
  Synthetic
acagcagctttcccgcta

SEQ ID NO: 11208 - DNA, 18 bp, Artificial Sequence
  Synthetic
cgataacgcgcttctgct

SEQ ID NO: 11209 - DNA, 18 bp, Artificial Sequence
  Synthetic
aggtcgcacgtatcctga

SEQ ID NO: 11210 - DNA, 20 bp, Artificial Sequence
  Synthetic
aatcgggaatagttggatca

SEQ ID NO: 11211 - DNA, 17 bp, Artificial Sequence
  Synthetic
attgcggcgagtggaac

SEQ ID NO: 11212 - DNA, 16 bp, Artificial Sequence
  Synthetic
ccgccgcctttgccat

SEQ ID NO: 11213 - DNA, 16 bp, Artificial Sequence
  Synthetic
gaaatccgtgccggcc

SEQ ID NO: 11214 - DNA, 16 bp, Artificial Sequence
  Synthetic
tgcatcgggcagccct

SEQ ID NO: 11215 - DNA, 18 bp, Artificial Sequence
  Synthetic
accgttgtaatcgggcgg

SEQ ID NO: 11216 - DNA, 17 bp, Artificial Sequence
  Synthetic
taagcccgtgccgaaca

SEQ ID NO: 11217 - DNA, 19 bp, Artificial Sequence
  Synthetic
gggcgacttccttccattg

SEQ ID NO: 11218 - DNA, 20 bp, Artificial Sequence
  Synthetic
ggtcggcattaaagacctgc

SEQ ID NO: 11219 - DNA, 20 bp, Artificial Sequence
  Synthetic
tttgtttgatgccgtgtccg

SEQ ID NO: 11220 - DNA, 16 bp, Artificial Sequence
  Synthetic
aggcggctgacgggat

SEQ ID NO: 11221 - DNA, 18 bp, Artificial Sequence
  Synthetic
cggttgaggtcgaaggtg

SEQ ID NO: 11222 - DNA, 18 bp, Artificial Sequence
  Synthetic
caccgccgatttggaagc

SEQ ID NO: 11223 - DNA, 19 bp, Artificial Sequence
  Synthetic
caaaaggatgttgctgccg

SEQ ID NO: 11224 - DNA, 17 bp, Artificial Sequence
  Synthetic
gcgggcgttatgacgga

SEQ ID NO: 11225 - DNA, 18 bp, Artificial Sequence
  Synthetic
gtcggcggcaaaaaaacc

SEQ ID NO: 11226 - DNA, 16 bp, Artificial Sequence
  Synthetic
cctgcccgctgatcct

SEQ ID NO: 11227 - DNA, 20 bp, Artificial Sequence
  Synthetic
ttgaccacgccttgaatcag

SEQ ID NO: 11228 - DNA, 18 bp, Artificial Sequence
  Synthetic
cgggtatccgcttggacg

SEQ ID NO: 11229 - DNA, 18 bp, Artificial Sequence
  Synthetic
ggactggtgtcaggacga

SEQ ID NO: 11230 - DNA, 18 bp, Artificial Sequence
  Synthetic
gctttgtcgggcaggaag

SEQ ID NO: 11231 - DNA, 19 bp, Artificial Sequence
  Synthetic
caaaacgtccaaaggctcg

SEQ ID NO: 11232 - DNA, 18 bp, Artificial Sequence
  Synthetic
aacaacccggtcagccaa

SEQ ID NO: 11233 - DNA, 18 bp, Artificial Sequence
  Synthetic
cgatgtcgtccccctcga

SEQ ID NO: 11234 - DNA, 19 bp, Artificial Sequence
  Synthetic
tcagacgactttggtggcg

SEQ ID NO: 11235 - DNA, 16 bp, Artificial Sequence
  Synthetic
cccgcctgcgacatca

SEQ ID NO: 11236 - DNA, 18 bp, Artificial Sequence
  Synthetic
atcgggtatgcgcacttg

SEQ ID NO: 11237 - DNA, 18 bp, Artificial Sequence
  Synthetic
tttccgccctcgaaaggc

SEQ ID NO: 11238 - DNA, 16 bp, Artificial Sequence
  Synthetic
ctgccggcgcgcatat

SEQ ID NO: 11239 - DNA, 16 bp, Artificial Sequence
  Synthetic
cgaacgcgcacggctt

SEQ ID NO: 11240 - DNA, 16 bp, Artificial Sequence
  Synthetic
caatgacggcggcgat

SEQ ID NO: 11241 - DNA, 18 bp, Artificial Sequence
  Synthetic
atgatgggaagaaggacg

SEQ ID NO: 11242 - DNA, 17 bp, Artificial Sequence
  Synthetic
gctggttacgccgaggt

SEQ ID NO: 11243 - DNA, 17 bp, Artificial Sequence
  Synthetic
tattcccccgttgcccg

SEQ ID NO: 11244 - DNA, 16 bp, Artificial Sequence
  Synthetic
gcggctgttgcggtag

SEQ ID NO: 11245 - DNA, 18 bp, Artificial Sequence
  Synthetic
cgacaaccaatgcgactt

SEQ ID NO: 11246 - DNA, 17 bp, Artificial Sequence
  Synthetic
cacgtcagggcttcgtc

SEQ ID NO: 11247 - DNA, 20 bp, Artificial Sequence
  Synthetic
cgttcaggaggccgtaattc

SEQ ID NO: 11248 - DNA, 17 bp, Artificial Sequence
  Synthetic
gtttctctgccgccgtt

SEQ ID NO: 11249 - DNA, 16 bp, Artificial Sequence
  Synthetic
caccgcgtccgctaag

SEQ ID NO: 11250 - DNA, 17 bp, Artificial Sequence
  Synthetic
acgaagttttgggcggc

SEQ ID NO: 11251 - DNA, 18 bp, Artificial Sequence
  Synthetic
cggtttccaaagacggcg

SEQ ID NO: 11252 - DNA, 16 bp, Artificial Sequence
  Synthetic
ccgatattgggcgccg

SEQ ID NO: 11253 - DNA, 16 bp, Artificial Sequence
  Synthetic
cgcgatgccgtccgaa

SEQ ID NO: 11254 - DNA, 18 bp, Artificial Sequence
  Synthetic
catgggcgaaggtggatg

SEQ ID NO: 11255 - DNA, 16 bp, Artificial Sequence
  Synthetic
gggcttgacgggcgaa

SEQ ID NO: 11256 - DNA, 20 bp, Artificial Sequence
  Synthetic
ttttgcgtagggtttagcat

SEQ ID NO: 11257 - DNA, 16 bp, Artificial Sequence
  Synthetic
caggtttcggtgcggg

SEQ ID NO: 11258 - DNA, 16 bp, Artificial Sequence
  Synthetic
gggatttggcggcgga

SEQ ID NO: 11259 - DNA, 18 bp, Artificial Sequence
  Synthetic
tgtgcaggaattggcagg

SEQ ID NO: 11260 - DNA, 18 bp, Artificial Sequence
  Synthetic
atatgaagttcggcgcgg

SEQ ID NO: 11261 - DNA, 16 bp, Artificial Sequence
  Synthetic
cgatacgttcggcggc

SEQ ID NO: 11262 - DNA, 17 bp, Artificial Sequence
  Synthetic
ctaaaaccgggcagccg

SEQ ID NO: 11263 - DNA, 18 bp, Artificial Sequence
  Synthetic
gttgaacatgaccggcgg

SEQ ID NO: 11264 - DNA, 17 bp, Artificial Sequence
  Synthetic
tgtcgtttcgggcgaag

SEQ ID NO: 11265 - DNA, 16 bp, Artificial Sequence
  Synthetic
gcgaagaagcggccga

SEQ ID NO: 11266 - DNA, 18 bp, Artificial Sequence
  Synthetic
ccctgcagatttcagccg

SEQ ID NO: 11267 - DNA, 18 bp, Artificial Sequence
  Synthetic
caggtcgtccgtgaaggt

SEQ ID NO: 11268 - DNA, 20 bp, Artificial Sequence
  Synthetic
tgctgaagcacaatctgacg

SEQ ID NO: 11269 - DNA, 20 bp, Artificial Sequence
  Synthetic
tttcgaccgcacaaatacgt

SEQ ID NO: 11270 - DNA, 16 bp, Artificial Sequence
  Synthetic
cgggcagcgtcaacga

SEQ ID NO: 11271 - DNA, 16 bp, Artificial Sequence
  Synthetic
ggcacgcccgaaagca

SEQ ID NO: 11272 - DNA, 16 bp, Artificial Sequence
  Synthetic
ccggtggcagtggaca

SEQ ID NO: 11273 - DNA, 17 bp, Artificial Sequence
  Synthetic
atttccgtaccggcggc

SEQ ID NO: 11274 - DNA, 16 bp, Artificial Sequence
  Synthetic
ggacgcgcggtcatca

SEQ ID NO: 11275 - DNA, 16 bp, Artificial Sequence
  Synthetic
tgtcggtttgcgccgt

SEQ ID NO: 11276 - DNA, 17 bp, Artificial Sequence
  Synthetic
gatgttttcggcggcgg

SEQ ID NO: 11277 - DNA, 16 bp, Artificial Sequence
  Synthetic
gaacgggccgccgata

SEQ ID NO: 11278 - DNA, 20 bp, Artificial Sequence
  Synthetic
gcctatgacgcattgcagga

SEQ ID NO: 11279 - DNA, 20 bp, Artificial Sequence
  Synthetic
gcgcatatcccatatgtcgg

SEQ ID NO: 11280 - DNA, 19 bp, Artificial Sequence
  Synthetic
agccgttgacgatggtttc

SEQ ID NO: 11281 - DNA, 20 bp, Artificial Sequence
  Synthetic
gaacaccaacgcgtaaatgg

SEQ ID NO: 11282 - DNA, 16 bp, Artificial Sequence
  Synthetic
cgcggcaggcttttgg

SEQ ID NO: 11283 - DNA, 20 bp, Artificial Sequence
  Synthetic
ttatcgttggtgaaggaaga

SEQ ID NO: 11284 - DNA, 22 bp, Artificial Sequence
  Synthetic
ctttgcctatatcgtgaaaacc

SEQ ID NO: 11285 - DNA, 17 bp, Artificial Sequence
  Synthetic
ggctgccgaatttcccg

SEQ ID NO: 11286 - DNA, 17 bp, Artificial Sequence
  Synthetic
cgctgcggatttcgtgc

SEQ ID NO: 11287 - DNA, 20 bp, Artificial Sequence
  Synthetic
gatgaccgcatccaaaacgt

SEQ ID NO: 11288 - DNA, 16 bp, Artificial Sequence
  Synthetic
tcgaccccgccctgtt

SEQ ID NO: 11289 - DNA, 17 bp, Artificial Sequence
  Synthetic
ggtcgatctgcaggcca

SEQ ID NO: 11290 - DNA, 16 bp, Artificial Sequence
  Synthetic
ccctcaatgcgcggca

SEQ ID NO: 11291 - DNA, 18 bp, Artificial Sequence
  Synthetic
tcgttggtggattggctg

SEQ ID NO: 11292 - DNA, 19 bp, Artificial Sequence
  Synthetic
aacgccctgaagttaaacg

SEQ ID NO: 11293 - DNA, 17 bp, Artificial Sequence
  Synthetic
tgaggaggcaggtcggt

SEQ ID NO: 11294 - DNA, 20 bp, Artificial Sequence
  Synthetic
atacgcagttcggaatcagg

SEQ ID NO: 11295 - DNA, 16 bp, Artificial Sequence
  Synthetic
ggctgcgcgtgttacg

SEQ ID NO: 11296 - DNA, 20 bp, Artificial Sequence
  Synthetic
tgttttcaagcacatcgcgg

SEQ ID NO: 11297 - DNA, 18 bp, Artificial Sequence
  Synthetic
ccgaagcctatgtgccca

SEQ ID NO: 11298 - DNA, 20 bp, Artificial Sequence
  Synthetic
tgctgtccgtaaaagaaggc

SEQ ID NO: 11299 - DNA, 16 bp, Artificial Sequence
  Synthetic
gcctcgacatccccga

SEQ ID NO: 11300 - DNA, 16 bp, Artificial Sequence
  Synthetic
ggcatcggcgagctga

SEQ ID NO: 11301 - DNA, 19 bp, Artificial Sequence
  Synthetic
cagcgtaccggttttgtcc

SEQ ID NO: 11302 - DNA, 17 bp, Artificial Sequence
  Synthetic
tttggctgccgagctgc

SEQ ID NO: 11303 - DNA, 19 bp, Artificial Sequence
  Synthetic
gtcaaaccgttaccgttgc

SEQ ID NO: 11304 - DNA, 20 bp, Artificial Sequence
  Synthetic
cagaccgttgaccagatacg

SEQ ID NO: 11305 - DNA, 18 bp, Artificial Sequence
  Synthetic
cgaactgccaaagctgcc

SEQ ID NO: 11306 - DNA, 17 bp, Artificial Sequence
  Synthetic
gatgacagggccggtga

SEQ ID NO: 11307 - DNA, 16 bp, Artificial Sequence
  Synthetic
ccgccgcgctgtttgt

SEQ ID NO: 11308 - DNA, 22 bp, Artificial Sequence
  Synthetic
acgggattaaattgaatttgca

SEQ ID NO: 11309 - DNA, 21 bp, Artificial Sequence
  Synthetic
ccgactttaacttcaatttcg

SEQ ID NO: 11310 - DNA, 19 bp, Artificial Sequence
  Synthetic
catgtcgtttggggggatg

SEQ ID NO: 11311 - DNA, 18 bp, Artificial Sequence
  Synthetic
tgcgttgacaaggttgcc

SEQ ID NO: 11312 - DNA, 19 bp, Artificial Sequence
  Synthetic
aaaaccggcaaaaacctgc

SEQ ID NO: 11313 - DNA, 19 bp, Artificial Sequence
  Synthetic
tcggtgtagagcgtgaagc

SEQ ID NO: 11314 - DNA, 19 bp, Artificial Sequence
  Synthetic
aaggctggcgacttttacg

SEQ ID NO: 11315 - DNA, 16 bp, Artificial Sequence
  Synthetic
cggtatcgcgcgcttt

SEQ ID NO: 11316 - DNA, 20 bp, Artificial Sequence
  Synthetic
gttttcagccaaaacgtgcg

SEQ ID NO: 11317 - DNA, 20 bp, Artificial Sequence
  Synthetic
atagccggtcatacccaaga

SEQ ID NO: 11318 - DNA, 16 bp, Artificial Sequence
  Synthetic
gtgttcgccgtggtgg

SEQ ID NO: 11319 - DNA, 17 bp, Artificial Sequence
  Synthetic
cgaccagtttggcggtt

SEQ ID NO: 11320 - DNA, 20 bp, Artificial Sequence
  Synthetic
gtccaaaagacgcagacagg

SEQ ID NO: 11321 - DNA, 18 bp, Artificial Sequence
  Synthetic
gccgcgaattgcacttct

SEQ ID NO: 11322 - DNA, 16 bp, Artificial Sequence
  Synthetic
cccgtgctgctggctt

SEQ ID NO: 11323 - DNA, 20 bp, Artificial Sequence
  Synthetic
caatccatcaaaaggctctc

SEQ ID NO: 11324 - DNA, 19 bp, Artificial Sequence
  Synthetic
aggggagccggaagaatcc

SEQ ID NO: 11325 - DNA, 16 bp, Artificial Sequence
  Synthetic
cccatcccgcgaacct

SEQ ID NO: 11326 - DNA, 15 bp, Artificial Sequence
  Synthetic
gcaacgcgctggcaa

SEQ ID NO: 11327 - DNA, 17 bp, Artificial Sequence
  Synthetic
ccggcggcttttcgatt

SEQ ID NO: 11328 - DNA, 16 bp, Artificial Sequence
  Synthetic
cccgtccgtccgcaat

SEQ ID NO: 11329 - DNA, 17 bp, Artificial Sequence
  Synthetic
gccgaatgcgatgtgct

SEQ ID NO: 11330 - DNA, 18 bp, Artificial Sequence
  Synthetic
ggcagcaaagccctgttc

SEQ ID NO: 11331 - DNA, 18 bp, Artificial Sequence
  Synthetic
caaccccgacgacgaaac

SEQ ID NO: 11332 - DNA, 20 bp, Artificial Sequence
  Synthetic
gtcgaagataccgatgcgat

SEQ ID NO: 11333 - DNA, 17 bp, Artificial Sequence
  Synthetic
ggttcacgggcaggttg

SEQ ID NO: 11334 - DNA, 17 bp, Artificial Sequence
  Synthetic
gcagtgtgcctaagccg

SEQ ID NO: 11335 - DNA, 19 bp, Artificial Sequence
  Synthetic
ggaaaaaatccgatgccgc

SEQ ID NO: 11336 - DNA, 16 bp, Artificial Sequence
  Synthetic
cactttctcgccgcgg

SEQ ID NO: 11337 - DNA, 18 bp, Artificial Sequence
  Synthetic
aattgccgggaatggaaa

SEQ ID NO: 11338 - DNA, 20 bp, Artificial Sequence
  Synthetic
taattttgtcggcgtgttgc

SEQ ID NO: 11339 - DNA, 19 bp, Artificial Sequence
  Synthetic
gaaaagccggtcgacttgt

SEQ ID NO: 11340 - DNA, 18 bp, Artificial Sequence
  Synthetic
gcgtaccggccttcaaac

SEQ ID NO: 11341 - DNA, 18 bp, Artificial Sequence
  Synthetic
tcgcggtaatgcactggg

SEQ ID NO: 11342 - DNA, 17 bp, Artificial Sequence
  Synthetic
ggctttgagcgatgccg

SEQ ID NO: 11343 - DNA, 20 bp, Artificial Sequence
  Synthetic
tttggctgcttctattgggc

SEQ ID NO: 11344 - DNA, 18 bp, Artificial Sequence
  Synthetic
ccgccccaagaaatcctc

SEQ ID NO: 11345 - DNA, 18 bp, Artificial Sequence
  Synthetic
gcgcgacctgaaaaaccg

SEQ ID NO: 11346 - DNA, 16 bp, Artificial Sequence
  Synthetic
gcgaaggcaagccgct

SEQ ID NO: 11347 - DNA, 16 bp, Artificial Sequence
  Synthetic
ttacgtgccgccgaca

SEQ ID NO: 11348 - DNA, 18 bp, Artificial Sequence
  Synthetic
gcaagccgtgctgtacct

SEQ ID NO: 11349 - DNA, 16 bp, Artificial Sequence
  Synthetic
gggatgcgccgtcttc

SEQ ID NO: 11350 - DNA, 20 bp, Artificial Sequence
  Synthetic
cggcgaatttcatcagttcg

SEQ ID NO: 11351 - DNA, 20 bp, Artificial Sequence
  Synthetic
ggcactcaaattcacagtca

SEQ ID NO: 11352 - DNA, 21 bp, Artificial Sequence
  Synthetic
caatcatgttcgcattggtac

SEQ ID NO: 11353 - DNA, 17 bp, Artificial Sequence
  Synthetic
ccgcagcatgaggcaac

SEQ ID NO: 11354 - DNA, 19 bp, Artificial Sequence
  Synthetic
tgtccgacgatttgttgcg

SEQ ID NO: 11355 - DNA, 19 bp, Artificial Sequence
  Synthetic
gaagaaatcgccctgctgt

SEQ ID NO: 11356 - DNA, 17 bp, Artificial Sequence
  Synthetic
gtcggcgtaaggtccgt

SEQ ID NO: 11357 - DNA, 19 bp, Artificial Sequence
  Synthetic
gcactgctggtcatactgc

SEQ ID NO: 11358 - DNA, 16 bp, Artificial Sequence
  Synthetic
gcgatgttgccgccca

SEQ ID NO: 11359 - DNA, 16 bp, Artificial Sequence
  Synthetic
gggccttggtagcgga

SEQ ID NO: 11360 - DNA, 16 bp, Artificial Sequence
  Synthetic
gcacggttacggcgca

SEQ ID NO: 11361 - DNA, 18 bp, Artificial Sequence
  Synthetic
cccgctgacgatgtgtac

SEQ ID NO: 11362 - DNA, 18 bp, Artificial Sequence
  Synthetic
gcatcaaggcacgcacat

SEQ ID NO: 11363 - DNA, 16 bp, Artificial Sequence
  Synthetic
cgggaatgacggcggt

SEQ ID NO: 11364 - DNA, 18 bp, Artificial Sequence
  Synthetic
gtggtgtgggtgtggtcg

SEQ ID NO: 11365 - DNA, 19 bp, Artificial Sequence
  Synthetic
agccgcgttcctattcttg

SEQ ID NO: 11366 - DNA, 17 bp, Artificial Sequence
  Synthetic
ccggcgaacaggctttg

SEQ ID NO: 11367 - DNA, 18 bp, Artificial Sequence
  Synthetic
tctagattcccgcctgcg

SEQ ID NO: 11368 - DNA, 20 bp, Artificial Sequence
  Synthetic
ttcgcagttgaggcttttgg

SEQ ID NO: 11369 - DNA, 17 bp, Artificial Sequence
  Synthetic
gcaacacttcgcctgcg

SEQ ID NO: 11370 - DNA, 20 bp, Artificial Sequence
  Synthetic
tcgaggaaaaggacgaaagc

SEQ ID NO: 11371 - DNA, 17 bp, Artificial Sequence
  Synthetic
ggaagaatacgcccgcc

SEQ ID NO: 11372 - DNA, 17 bp, Artificial Sequence
  Synthetic
cgacggcggcatcgatt

SEQ ID NO: 11373 - DNA, 20 bp, Artificial Sequence
  Synthetic
tttctttttcctacgcgccc

SEQ ID NO: 11374 - DNA, 18 bp, Artificial Sequence
  Synthetic
cctttcgccaactcctgc

SEQ ID NO: 11375 - DNA, 18 bp, Artificial Sequence
  Synthetic
gcccatctgtcgttcagc

SEQ ID NO: 11376 - DNA, 18 bp, Artificial Sequence
  Synthetic
aataggcagaatgaccgc

SEQ ID NO: 11377 - DNA, 20 bp, Artificial Sequence
  Synthetic
cctacatgactacttgggcg

SEQ ID NO: 11378 - DNA, 20 bp, Artificial Sequence
  Synthetic
attttctgttttgcctgcgg

SEQ ID NO: 11379 - DNA, 24 bp, Artificial Sequence
  Synthetic
ctgtctcagtttgatttttttcag

SEQ ID NO: 11380 - DNA, 19 bp, Artificial Sequence
  Synthetic
atgctgaaatggactcctc

SEQ ID NO: 11381 - DNA, 23 bp, Artificial Sequence
  Synthetic
tttcccactcagataatttctca

SEQ ID NO: 11382 - DNA, 24 bp, Artificial Sequence
  Synthetic
gtaaagttacccgagttaaaaacc

SEQ ID NO: 11383 - DNA, 22 bp, Artificial Sequence
  Synthetic
gaagataaggctttttttaccg

SEQ ID NO: 11384 - DNA, 18 bp, Artificial Sequence
  Synthetic
cgcaagaaatccactccg

SEQ ID NO: 11385 - DNA, 24 bp, Artificial Sequence
  Synthetic
atatcaaccaacttattgagatcc

SEQ ID NO: 11386 - DNA, 21 bp, Artificial Sequence
  Synthetic
aaacagttttttgctggtttg

SEQ ID NO: 11387 - DNA, 19 bp, Artificial Sequence
  Synthetic
ggtggagatggaacaccgc

SEQ ID NO: 11388 - DNA, 18 bp, Artificial Sequence
  Synthetic
gccatgagctgccctacg

SEQ ID NO: 11389 - DNA, 19 bp, Artificial Sequence
  Synthetic
atagccaaggcgtgatcga

SEQ ID NO: 11390 - DNA, 16 bp, Artificial Sequence
  Synthetic
cgtgggtgtgccgcaa

SEQ ID NO: 11391 - DNA, 18 bp, Artificial Sequence
  Synthetic
ccgggcgaaatcgaactc

SEQ ID NO: 11392 - DNA, 19 bp, Artificial Sequence
  Synthetic
atttccccgtccaactggt

SEQ ID NO: 11393 - DNA, 18 bp, Artificial Sequence
  Synthetic
cctgatcggcaaatgggc

SEQ ID NO: 11394 - DNA, 17 bp, Artificial Sequence
  Synthetic
gctgattgccgccatgc

SEQ ID NO: 11395 - DNA, 18 bp, Artificial Sequence
  Synthetic
gtcgaacaaaacgcctgc

SEQ ID NO: 11396 - DNA, 17 bp, Artificial Sequence
  Synthetic
gcaagacggcggtttgg

SEQ ID NO: 11397 - DNA, 16 bp, Artificial Sequence
  Synthetic
ttgaggcttgcgggca

SEQ ID NO: 11398 - DNA, 16 bp, Artificial Sequence
  Synthetic
gcgtttgcggtaggcg

SEQ ID NO: 11399 - DNA, 16 bp, Artificial Sequence
  Synthetic
cggtctgatgccggca

SEQ ID NO: 11400 - DNA, 17 bp, Artificial Sequence
  Synthetic
tccaaatccgcctgcga

SEQ ID NO: 11401 - DNA, 20 bp, Artificial Sequence
  Synthetic
atcgtcaatacagttccggc

SEQ ID NO: 11402 - DNA, 18 bp, Artificial Sequence
  Synthetic
cggcatccagcaaatcgc

SEQ ID NO: 11403 - DNA, 19 bp, Artificial Sequence
  Synthetic
ccttgcacgacgtgtatcg

SEQ ID NO: 11404 - DNA, 17 bp, Artificial Sequence
  Synthetic
cgccgcccaaatcgtac

SEQ ID NO: 11405 - DNA, 19 bp, Artificial Sequence
  Synthetic
ttttgccgaattgatggcg

SEQ ID NO: 11406 - DNA, 18 bp, Artificial Sequence
  Synthetic
ctcgaaacgcgcgtatgc

SEQ ID NO: 11407 - DNA, 15 bp, Artificial Sequence
  Synthetic
aaccgtttccgccgc

SEQ ID NO: 11408 - DNA, 19 bp, Artificial Sequence
  Synthetic
ttgtatttcctgccgctgc

SEQ ID NO: 11409 - DNA, 18 bp, Artificial Sequence
  Synthetic
gcccaagctcaatcggtt

SEQ ID NO: 11410 - DNA, 16 bp, Artificial Sequence
  Synthetic
gcgttttttcggcgcg

SEQ ID NO: 11411 - DNA, 18 bp, Artificial Sequence
  Synthetic
gttacttccgatgcggcg

SEQ ID NO: 11412 - DNA, 20 bp, Artificial Sequence
  Synthetic
cagttcttcttcggtttgcg

SEQ ID NO: 11413 - DNA, 19 bp, Artificial Sequence
  Synthetic
acactttcgacgacaaccg

SEQ ID NO: 11414 - DNA, 20 bp, Artificial Sequence
  Synthetic
ttcattgcaaaaaccgaccg

SEQ ID NO: 11415 - DNA, 17 bp, Artificial Sequence
  Synthetic
gccgcaccaaaacgacc

SEQ ID NO: 11416 - DNA, 20 bp, Artificial Sequence
  Synthetic
tttcaaccgcaaagacaagc

SEQ ID NO: 11417 - DNA, 19 bp, Artificial Sequence
  Synthetic
acacactgacccgattcct

SEQ ID NO: 11418 - DNA, 19 bp, Artificial Sequence
  Synthetic
aaaaacgccatcccgaacg

SEQ ID NO: 11419 - DNA, 18 bp, Artificial Sequence
  Synthetic
gacaagtgactgccttgt

SEQ ID NO: 11420 - DNA, 19 bp, Artificial Sequence
  Synthetic
ttgagcggcaaaatccacc

SEQ ID NO: 11421 - DNA, 18 bp, Artificial Sequence
  Synthetic
gggagcaatacccgaagt

SEQ ID NO: 11422 - DNA, 20 bp, Artificial Sequence
  Synthetic
cataccaacgtttcccccag

SEQ ID NO: 11423 - DNA, 17 bp, Artificial Sequence
  Synthetic
cgaaagccctgttgccg

SEQ ID NO: 11424 - DNA, 16 bp, Artificial Sequence
  Synthetic
cgcaagccgcctgaca

SEQ ID NO: 11425 - DNA, 18 bp, Artificial Sequence
  Synthetic
tgaagcctttcagacggc

SEQ ID NO: 11426 - DNA, 20 bp, Artificial Sequence
  Synthetic
atccatttcatcaaccgccc

SEQ ID NO: 11427 - DNA, 20 bp, Artificial Sequence
  Synthetic
gccctcgataaaaccttggc

SEQ ID NO: 11428 - DNA, 16 bp, Artificial Sequence
  Synthetic
gcgctggccgttttgg

SEQ ID NO: 11429 - DNA, 15 bp, Artificial Sequence
  Synthetic
tgcccgcgaactgga

SEQ ID NO: 11430 - DNA, 17 bp, Artificial Sequence
  Synthetic
atttgtagggcgtgccg

SEQ ID NO: 11431 - DNA, 16 bp, Artificial Sequence
  Synthetic
ttcgggtggcgggatc

SEQ ID NO: 11432 - DNA, 19 bp, Artificial Sequence
  Synthetic
tccgagtgcttgaagaccc

SEQ ID NO: 11433 - DNA, 19 bp, Artificial Sequence
  Synthetic
tcgtcgccgatattgcgtc

SEQ ID NO: 11434 - DNA, 17 bp, Artificial Sequence
  Synthetic
tgatgaaggcggcaagc

SEQ ID NO: 11435 - DNA, 20 bp, Artificial Sequence
  Synthetic
actggtggaaaacggtatgc

SEQ ID NO: 11436 - DNA, 19 bp, Artificial Sequence
  Synthetic
tcgataacggttttctcgc

SEQ ID NO: 11437 - DNA, 18 bp, Artificial Sequence
  Synthetic
gtcgcgctcggatttgac

SEQ ID NO: 11438 - DNA, 17 bp, Artificial Sequence
  Synthetic
taatttgcgcccctgcc

SEQ ID NO: 11439 - DNA, 18 bp, Artificial Sequence
  Synthetic
tgccgtctgaaaccgaac

SEQ ID NO: 11440 - DNA, 19 bp, Artificial Sequence
  Synthetic
ctactcgtcatcctcgccc

SEQ ID NO: 11441 - DNA, 20 bp, Artificial Sequence
  Synthetic
gcatttggatcatcggcacc

SEQ ID NO: 11442 - DNA, 16 bp, Artificial Sequence
  Synthetic
cgtcatcgccggcaca

SEQ ID NO: 11443 - DNA, 16 bp, Artificial Sequence
  Synthetic
accgccctgccgttca

SEQ ID NO: 11444 - DNA, 22 bp, Artificial Sequence
  Synthetic
tcaattcaattacggtttgtct

SEQ ID NO: 11445 - DNA, 20 bp, Artificial Sequence
  Synthetic
gccgatggttacttgttcgc

SEQ ID NO: 11446 - DNA, 19 bp, Artificial Sequence
  Synthetic
aatcgaccaaatcctgcgc

SEQ ID NO: 11447 - DNA, 19 bp, Artificial Sequence
  Synthetic
catgtccgacaacgctttg

SEQ ID NO: 11448 - DNA, 16 bp, Artificial Sequence
  Synthetic
ggtgcgccgtctgctt

SEQ ID NO: 11449 - DNA, 20 bp, Artificial Sequence
  Synthetic
gcttgccaaagaaggattgg

SEQ ID NO: 11450 - DNA, 16 bp, Artificial Sequence
  Synthetic
gccgccgctacaagct

SEQ ID NO: 11451 - DNA, 17 bp, Artificial Sequence
  Synthetic
gcgcctgcggaatttcc

SEQ ID NO: 11452 - DNA, 20 bp, Artificial Sequence
  Synthetic
acgcccttgaatatcgtgtt

SEQ ID NO: 11453 - DNA, 20 bp, Artificial Sequence
  Synthetic
acattcatgcggctttgaac

SEQ ID NO: 11454 - DNA, 16 bp, Artificial Sequence
  Synthetic
tgctgcaaagcgtggc

SEQ ID NO: 11455 - DNA, 16 bp, Artificial Sequence
  Synthetic
ccgccattcctgccga

SEQ ID NO: 11456 - DNA, 20 bp, Artificial Sequence
  Synthetic
ccttggcagggatagatgac

SEQ ID NO: 11457 - DNA, 22 bp, Artificial Sequence
  Synthetic
ttgatttttttaccgcttttgc

SEQ ID NO: 11458 - DNA, 16 bp, Artificial Sequence
  Synthetic
caaccgcgccagagct

SEQ ID NO: 11459 - DNA, 21 bp, Artificial Sequence
  Synthetic
ttaaacataccgagtgaatgg

SEQ ID NO: 11460 - DNA, 21 bp, Artificial Sequence
  Synthetic
aaaacgacttttaccaaagcg

SEQ ID NO: 11461 - DNA, 20 bp, Artificial Sequence
  Synthetic
accgcatttttttgacggag

SEQ ID NO: 11462 - DNA, 19 bp, Artificial Sequence
  Synthetic
attctgaataccgtccgtt

SEQ ID NO: 11463 - DNA, 19 bp, Artificial Sequence
  Synthetic
ccgcattcaaatcatgggc

SEQ ID NO: 11464 - DNA, 18 bp, Artificial Sequence
  Synthetic
ctgacggaaaagcagctt

SEQ ID NO: 11465 - DNA, 18 bp, Artificial Sequence
  Synthetic
acgcgaagaactactgaa

SEQ ID NO: 11466 - DNA, 20 bp, Artificial Sequence
  Synthetic
gcaaaaattccaaaggcatg

SEQ ID NO: 11467 - DNA, 18 bp, Artificial Sequence
  Synthetic
tgcaaacccgcatcctct

SEQ ID NO: 11468 - DNA, 19 bp, Artificial Sequence
  Synthetic
aagcgaaattcacggtcga

SEQ ID NO: 11469 - DNA, 21 bp, Artificial Sequence
  Synthetic
taaaacgtggcagatacagac

SEQ ID NO: 11470 - DNA, 18 bp, Artificial Sequence
  Synthetic
gctgtatcaactgctgcc

SEQ ID NO: 11471 - DNA, 19 bp, Artificial Sequence
  Synthetic
ctgcacgacggcaaaatcg

SEQ ID NO: 11472 - DNA, 16 bp, Artificial Sequence
  Synthetic
cacgcccttgtgcgtt

SEQ ID NO: 11473 - DNA, 19 bp, Artificial Sequence
  Synthetic
ttgcaagccttcatcttcg

SEQ ID NO: 11474 - DNA, 18 bp, Artificial Sequence
  Synthetic
cgttactttggccgggtc

SEQ ID NO: 11475 - DNA, 18 bp, Artificial Sequence
  Synthetic
ccggcaatgattgagcgt

SEQ ID NO: 11476 - DNA, 19 bp, Artificial Sequence
  Synthetic
cgccgagcaggtattgagc

SEQ ID NO: 11477 - DNA, 18 bp, Artificial Sequence
  Synthetic
gttcagacggcatcggtg

SEQ ID NO: 11478 - DNA, 16 bp, Artificial Sequence
  Synthetic
gactggccgcacgaca

SEQ ID NO: 11479 - DNA, 21 bp, Artificial Sequence
  Synthetic
attgatttgattgacgaagct

SEQ ID NO: 11480 - DNA, 18 bp, Artificial Sequence
  Synthetic
tgtacccgaaacggcagg

SEQ ID NO: 11481 - DNA, 18 bp, Artificial Sequence
  Synthetic
gcgcaatgccgtctgaat

SEQ ID NO: 11482 - DNA, 18 bp, Artificial Sequence
  Synthetic
ccatatccgtccgggcaa

SEQ ID NO: 11483 - DNA, 18 bp, Artificial Sequence
  Synthetic
cgtggatgagcaacgaca

SEQ ID NO: 11484 - DNA, 17 bp, Artificial Sequence
  Synthetic
gcagtgaaggcgacacg

SEQ ID NO: 11485 - DNA, 16 bp, Artificial Sequence
  Synthetic
agggacgccgcctgaa

SEQ ID NO: 11486 - DNA, 19 bp, Artificial Sequence
  Synthetic
cagagtttcttaccgccgc

SEQ ID NO: 11487 - DNA, 19 bp, Artificial Sequence
  Synthetic
taccgctaccacaactggg

SEQ ID NO: 11488 - DNA, 20 bp, Artificial Sequence
  Synthetic
cgtcattcccgacaataccg

SEQ ID NO: 11489 - DNA, 17 bp, Artificial Sequence
  Synthetic
caactcgccgtcaaccg

SEQ ID NO: 11490 - DNA, 20 bp, Artificial Sequence
  Synthetic
aaacacgtccaacagttcct

SEQ ID NO: 11491 - DNA, 20 bp, Artificial Sequence
  Synthetic
atccatcgaagacctccctg

SEQ ID NO: 11492 - DNA, 16 bp, Artificial Sequence
  Synthetic
cacatcctgcaccgcg

SEQ ID NO: 11493 - DNA, 16 bp, Artificial Sequence
  Synthetic
cggataccgccgtgca

SEQ ID NO: 11494 - DNA, 16 bp, Artificial Sequence
  Synthetic
cgccggacgaatcagc

SEQ ID NO: 11495 - DNA, 16 bp, Artificial Sequence
  Synthetic
aaacccaaacgccccg

SEQ ID NO: 11496 - DNA, 16 bp, Artificial Sequence
  Synthetic
gcgcggacggttttgc

SEQ ID NO: 11497 - DNA, 20 bp, Artificial Sequence
  Synthetic
agcccgatctgtttagaagc

SEQ ID NO: 11498 - DNA, 16 bp, Artificial Sequence
  Synthetic
acagcctcgcccagct

SEQ ID NO: 11499 - DNA, 17 bp, Artificial Sequence
  Synthetic
attcccgtccgcatcct

SEQ ID NO: 11500 - DNA, 17 bp, Artificial Sequence
  Synthetic
cagatccgcaagcgctt

SEQ ID NO: 11501 - DNA, 19 bp, Artificial Sequence
  Synthetic
ttcgggcgtaaggttttcc

SEQ ID NO: 11502 - DNA, 15 bp, Artificial Sequence
  Synthetic
ccaaacggcgcgtga

SEQ ID NO: 11503 - DNA, 19 bp, Artificial Sequence
  Synthetic
ggtaaccgtaaaccgcacg

SEQ ID NO: 11504 - DNA, 19 bp, Artificial Sequence
  Synthetic
gcataagccttcgttccgg

SEQ ID NO: 11505 - DNA, 18 bp, Artificial Sequence
  Synthetic
ccgccgcctgatattcgg

SEQ ID NO: 11506 - DNA, 16 bp, Artificial Sequence
  Synthetic
gggtttgcgccgtcaa

SEQ ID NO: 11507 - DNA, 16 bp, Artificial Sequence
  Synthetic
cgtctcgcccgggaaa

SEQ ID NO: 11508 - DNA, 20 bp, Artificial Sequence
  Synthetic
ggggtaaggcaggataaggc

SEQ ID NO: 11509 - DNA, 16 bp, Artificial Sequence
  Synthetic
tggccatccccgggat

SEQ ID NO: 11510 - DNA, 16 bp, Artificial Sequence
  Synthetic
gcggtcggcaaagtcg

SEQ ID NO: 11511 - DNA, 18 bp, Artificial Sequence
  Synthetic
cccccgacggataagcga

SEQ ID NO: 11512 - DNA, 18 bp, Artificial Sequence
  Synthetic
caatccggtgttgacgcg

SEQ ID NO: 11513 - DNA, 18 bp, Artificial Sequence
  Synthetic
gtcgggttcgggattggg

SEQ ID NO: 11514 - DNA, 18 bp, Artificial Sequence
  Synthetic
gctttctgttcttcgtgg

SEQ ID NO: 11515 - DNA, 18 bp, Artificial Sequence
  Synthetic
cccgtgtccgtctatggc

SEQ ID NO: 11516 - DNA, 19 bp, Artificial Sequence
  Synthetic
ttgtcccacatgaagctgc

SEQ ID NO: 11517 - DNA, 18 bp, Artificial Sequence
  Synthetic
gactacatcgacgcgctt

SEQ ID NO: 11518 - DNA, 17 bp, Artificial Sequence
  Synthetic
atgcggacatgagcgtg

SEQ ID NO: 11519 - DNA, 20 bp, Artificial Sequence
  Synthetic
ggcgaaagaatccctgatga

SEQ ID NO: 11520 - DNA, 18 bp, Artificial Sequence
  Synthetic
aaaccatcagccccgaac

SEQ ID NO: 11521 - DNA, 18 bp, Artificial Sequence
  Synthetic
gccgactgccaaatctgc

SEQ ID NO: 11522 - DNA, 20 bp, Artificial Sequence
  Synthetic
ttctgccgccgatattttgg

SEQ ID NO: 11523 - DNA, 19 bp, Artificial Sequence
  Synthetic
acgatatggacacacccgt

SEQ ID NO: 11524 - DNA, 18 bp, Artificial Sequence
  Synthetic
gcgaatgctgcaaatttg

SEQ ID NO: 11525 - DNA, 20 bp, Artificial Sequence
  Synthetic
gcgcttatctcttccgaact

SEQ ID NO: 11526 - DNA, 19 bp, Artificial Sequence
  Synthetic
ggaatgccgaagacaaccg

SEQ ID NO: 11527 - DNA, 20 bp, Artificial Sequence
  Synthetic
cagacggcatttccattcca

SEQ ID NO: 11528 - DNA, 20 bp, Artificial Sequence
  Synthetic
gaaagtggaaacgcacaacc

SEQ ID NO: 11529 - DNA, 16 bp, Artificial Sequence
  Synthetic
ccgtacaacgcggcaa

SEQ ID NO: 11530 - DNA, 16 bp, Artificial Sequence
  Synthetic
ctgccgtagccgccaa

SEQ ID NO: 11531 - DNA, 17 bp, Artificial Sequence
  Synthetic
catcgccgcgccgttta

SEQ ID NO: 11532 - DNA, 16 bp, Artificial Sequence
  Synthetic
aaaatgctggcggcgt

SEQ ID NO: 11533 - DNA, 18 bp, Artificial Sequence
  Synthetic
cgtcatcgtttcgcagct

SEQ ID NO: 11534 - DNA, 18 bp, Artificial Sequence
  Synthetic
gccaccgtcatcattgcc

SEQ ID NO: 11535 - DNA, 17 bp, Artificial Sequence
  Synthetic
catcgacggcattgccc

SEQ ID NO: 11536 - DNA, 16 bp, Artificial Sequence
  Synthetic
atggggctgctgctcg

SEQ ID NO: 11537 - DNA, 16 bp, Artificial Sequence
  Synthetic
gcaacgcccccatcct

SEQ ID NO: 11538 - DNA, 16 bp, Artificial Sequence
  Synthetic
acaccctgcgcgacga

SEQ ID NO: 11539 - DNA, 19 bp, Artificial Sequence
  Synthetic
ccgaactgaacggcaaact

SEQ ID NO: 11540 - DNA, 21 bp, Artificial Sequence
  Synthetic
gcttattttcagcggattcac

SEQ ID NO: 11541 - DNA, 18 bp, Artificial Sequence
  Synthetic
gcgcgtacatctgaaccg

SEQ ID NO: 11542 - DNA, 20 bp, Artificial Sequence
  Synthetic
ccatatgctcaacctcggtg

SEQ ID NO: 11543 - DNA, 17 bp, Artificial Sequence
  Synthetic
cgccgaaaccctttccg

SEQ ID NO: 11544 - DNA, 16 bp, Artificial Sequence
  Synthetic
tacccctctcgcgcga

SEQ ID NO: 11545 - DNA, 18 bp, Artificial Sequence
  Synthetic
ggcaacggtataggcccg

SEQ ID NO: 11546 - DNA, 18 bp, Artificial Sequence
  Synthetic
gcgttcgcgaatgtgtcc

SEQ ID NO: 11547 - DNA, 18 bp, Artificial Sequence
  Synthetic
cgcgattttgacggtgtg

SEQ ID NO: 11548 - DNA, 19 bp, Artificial Sequence
  Synthetic
gatgccgctccgtttaagc

SEQ ID NO: 11549 - DNA, 20 bp, Artificial Sequence
  Synthetic
tgtcaccgtgtacgatttcg

SEQ ID NO: 11550 - DNA, 17 bp, Artificial Sequence
  Synthetic
cccatttggcggcttcg

SEQ ID NO: 11551 - DNA, 16 bp, Artificial Sequence
  Synthetic
caacctgcttggccgc

SEQ ID NO: 11552 - DNA, 17 bp, Artificial Sequence
  Synthetic
attcccgccctcccttt

SEQ ID NO: 11553 - DNA, 16 bp, Artificial Sequence
  Synthetic
gctcaaccgcctgctg

SEQ ID NO: 11554 - DNA, 16 bp, Artificial Sequence
  Synthetic
gcgccgcctccaaact

SEQ ID NO: 11555 - DNA, 17 bp, Artificial Sequence
  Synthetic
tttcgtacttgccgcgc

SEQ ID NO: 11556 - DNA, 16 bp, Artificial Sequence
  Synthetic
aacgccttcgtcgccg

SEQ ID NO: 11557 - DNA, 19 bp, Artificial Sequence
  Synthetic
tccgtccgctccttcatcc

SEQ ID NO: 11558 - DNA, 18 bp, Artificial Sequence
  Synthetic
tcatgtaccgccacaacg

SEQ ID NO: 11559 - DNA, 17 bp, Artificial Sequence
  Synthetic
gcaaaggcgacctgcac

SEQ ID NO: 11560 - DNA, 19 bp, Artificial Sequence
  Synthetic
cacaaatcggctgggtagg

SEQ ID NO: 11561 - DNA, 18 bp, Artificial Sequence
  Synthetic
ggcaggtagaaaaggaca

SEQ ID NO: 11562 - DNA, 16 bp, Artificial Sequence
  Synthetic
gtccggctgggcgtat

SEQ ID NO: 11563 - DNA, 20 bp, Artificial Sequence
  Synthetic
tggaaaaagaattggcacgc

SEQ ID NO: 11564 - DNA, 15 bp, Artificial Sequence
  Synthetic
acgcaaccgcacgct

SEQ ID NO: 11565 - DNA, 18 bp, Artificial Sequence
  Synthetic
gaacctgcacgcctcatg

SEQ ID NO: 11566 - DNA, 20 bp, Artificial Sequence
  Synthetic
gtcaccaataccttcgtcgt

SEQ ID NO: 11567 - DNA, 20 bp, Artificial Sequence
  Synthetic
gtcatcctccttcataccgc

SEQ ID NO: 11568 - DNA, 23 bp, Artificial Sequence
  Synthetic
gtttactaaaacttcatcgtcct

SEQ ID NO: 11569 - DNA, 18 bp, Artificial Sequence
  Synthetic
ctgaccgaatcccgaaat

SEQ ID NO: 11570 - DNA, 17 bp, Artificial Sequence
  Synthetic
ttttcggcgggcgatac

SEQ ID NO: 11571 - DNA, 21 bp, Artificial Sequence
  Synthetic
tctaaataacgctgctcttcc

SEQ ID NO: 11572 - DNA, 17 bp, Artificial Sequence
  Synthetic
gctgcttcaggcttgcg

SEQ ID NO: 11573 - DNA, 18 bp, Artificial Sequence
  Synthetic
cctgaatcacgccgacag

SEQ ID NO: 11574 - DNA, 18 bp, Artificial Sequence
  Synthetic
accagtgctcgtatgcct

SEQ ID NO: 11575 - DNA, 19 bp, Artificial Sequence
  Synthetic
tatcctcgcaaccgaaagc

SEQ ID NO: 11576 - DNA, 16 bp, Artificial Sequence
  Synthetic
gcgcatcgatccgcaa

SEQ ID NO: 11577 - DNA, 19 bp, Artificial Sequence
  Synthetic
gcacaagtaaaagccgccc

SEQ ID NO: 11578 - DNA, 19 bp, Artificial Sequence
  Synthetic
cgcagaaacctaccgaagc

SEQ ID NO: 11579 - DNA, 19 bp, Artificial Sequence
  Synthetic
caatgactgcgggctttgt

SEQ ID NO: 11580 - DNA, 16 bp, Artificial Sequence
  Synthetic
agtccgggcgtgtcat

SEQ ID NO: 11581 - DNA, 16 bp, Artificial Sequence
  Synthetic
tgtctccagcgcggca

SEQ ID NO: 11582 - DNA, 17 bp, Artificial Sequence
  Synthetic
ccgacaccagcattccg

SEQ ID NO: 11583 - DNA, 18 bp, Artificial Sequence
  Synthetic
gggtacgaaagggctgga

SEQ ID NO: 11584 - DNA, 18 bp, Artificial Sequence
  Synthetic
ccattgcccgaacggaaa

SEQ ID NO: 11585 - DNA, 18 bp, Artificial Sequence
  Synthetic
acggtgcgttgacgatac

SEQ ID NO: 11586 - DNA, 17 bp, Artificial Sequence
  Synthetic
agctgtttcggcggacg

SEQ ID NO: 11587 - DNA, 19 bp, Artificial Sequence
  Synthetic
actggcgttacaaccggta

SEQ ID NO: 11588 - DNA, 18 bp, Artificial Sequence
  Synthetic
tctttccccgaaacaagt

SEQ ID NO: 11589 - DNA, 18 bp, Artificial Sequence
  Synthetic
cgaacgccatcacgtctg

SEQ ID NO: 11590 - DNA, 18 bp, Artificial Sequence
  Synthetic
aacccgacgcgctgatta

SEQ ID NO: 11591 - DNA, 19 bp, Artificial Sequence
  Synthetic
cactttcccgatgaagccg

SEQ ID NO: 11592 - DNA, 16 bp, Artificial Sequence
  Synthetic
aacctgttgcagccgc

SEQ ID NO: 11593 - DNA, 18 bp, Artificial Sequence
  Synthetic
gcgtggaagttactgccc

SEQ ID NO: 11594 - DNA, 18 bp, Artificial Sequence
  Synthetic
cccctaccgcatcaacac

SEQ ID NO: 11595 - DNA, 20 bp, Artificial Sequence
  Synthetic
tcaaccccaacgaatttgcc

SEQ ID NO: 11596 - DNA, 20 bp, Artificial Sequence
  Synthetic
tgttgaacttccagcaggtg

SEQ ID NO: 11597 - DNA, 17 bp, Artificial Sequence
  Synthetic
gggcatgggtccgattg

SEQ ID NO: 11598 - DNA, 17 bp, Artificial Sequence
  Synthetic
tcgccaaacgcctgatg

SEQ ID NO: 11599 - DNA, 20 bp, Artificial Sequence
  Synthetic
gaaagacgacaacccactgg

SEQ ID NO: 11600 - DNA, 17 bp, Artificial Sequence
  Synthetic
accgggaatcgaaccgc

SEQ ID NO: 11601 - DNA, 17 bp, Artificial Sequence
  Synthetic
cggtgcaggaaatccgc

SEQ ID NO: 11602 - DNA, 17 bp, Artificial Sequence
  Synthetic
gcgttgccgaaaagctg

SEQ ID NO: 11603 - DNA, 16 bp, Artificial Sequence
  Synthetic
cttcctgtgcgtcggc

SEQ ID NO: 11604 - DNA, 20 bp, Artificial Sequence
  Synthetic
aagcgaaccgtcttcatgaa

SEQ ID NO: 11605 - DNA, 20 bp, Artificial Sequence
  Synthetic
tcaaagtcagcatcagaccg

SEQ ID NO: 11606 - DNA, 17 bp, Artificial Sequence
  Synthetic
tatcggtgcgcaggtcg

SEQ ID NO: 11607 - DNA, 19 bp, Artificial Sequence
  Synthetic
gcgtaaagtcttgcacggc

SEQ ID NO: 11608 - DNA, 17 bp, Artificial Sequence
  Synthetic
cggatttcgaggccgtc

SEQ ID NO: 11609 - DNA, 20 bp, Artificial Sequence
  Synthetic
cttttcagacggcattcggc

SEQ ID NO: 11610 - DNA, 19 bp, Artificial Sequence
  Synthetic
acactgcatccgcattgct

SEQ ID NO: 11611 - DNA, 16 bp, Artificial Sequence
  Synthetic
cccaaccgggccaaca

SEQ ID NO: 11612 - DNA, 19 bp, Artificial Sequence
  Synthetic
caataccgcctgtaccacg

SEQ ID NO: 11613 - DNA, 19 bp, Artificial Sequence
  Synthetic
atcgaaactacgcgccatt

SEQ ID NO: 11614 - DNA, 16 bp, Artificial Sequence
  Synthetic
cgcgacgaagccgaag

SEQ ID NO: 11615 - DNA, 18 bp, Artificial Sequence
  Synthetic
tcctcgcctttcagacgg

SEQ ID NO: 11616 - DNA, 16 bp, Artificial Sequence
  Synthetic
ggcgggcgcaatcgaa

SEQ ID NO: 11617 - DNA, 16 bp, Artificial Sequence
  Synthetic
gccggcggcaaaagga

SEQ ID NO: 11618 - DNA, 18 bp, Artificial Sequence
  Synthetic
ccgcccaattcgacagaa

SEQ ID NO: 11619 - DNA, 17 bp, Artificial Sequence
  Synthetic
cagtgctgcttcgctgc

SEQ ID NO: 11620 - DNA, 16 bp, Artificial Sequence
  Synthetic
cggctgcaaccgccaa

SEQ ID NO: 11621 - DNA, 17 bp, Artificial Sequence
  Synthetic
cgttgcagacggccttg

SEQ ID NO: 11622 - DNA, 19 bp, Artificial Sequence
  Synthetic
gggtaacttgtgctagcgt

SEQ ID NO: 11623 - DNA, 16 bp, Artificial Sequence
  Synthetic
ggcagcaggctttccg

SEQ ID NO: 11624 - DNA, 16 bp, Artificial Sequence
  Synthetic
caggatttcgcgcgcg

SEQ ID NO: 11625 - DNA, 16 bp, Artificial Sequence
  Synthetic
ctccgcatcggcacca

SEQ ID NO: 11626 - DNA, 20 bp, Artificial Sequence
  Synthetic
gactgccttttggtcatcgg

SEQ ID NO: 11627 - DNA, 18 bp, Artificial Sequence
  Synthetic
taccacgcgctgacatcc

SEQ ID NO: 11628 - DNA, 18 bp, Artificial Sequence
  Synthetic
ccaatgaggcaagcagcg

SEQ ID NO: 11629 - DNA, 18 bp, Artificial Sequence
  Synthetic
cacgactgaaacggggtt

SEQ ID NO: 11630 - DNA, 19 bp, Artificial Sequence
  Synthetic
ggaatgccggcatattgga

SEQ ID NO: 11631 - DNA, 18 bp, Artificial Sequence
  Synthetic
atgcctacaccacattgc

SEQ ID NO: 11632 - DNA, 20 bp, Artificial Sequence
  Synthetic
ttccgtcaactggctttacg

SEQ ID NO: 11633 - DNA, 16 bp, Artificial Sequence
  Synthetic
ggcggcgttgcaggaa

SEQ ID NO: 11634 - DNA, 20 bp, Artificial Sequence
  Synthetic
gttgtagaggtgcagttcgg

SEQ ID NO: 11635 - DNA, 16 bp, Artificial Sequence
  Synthetic
tggcgctgtcggggtt

SEQ ID NO: 11636 - DNA, 16 bp, Artificial Sequence
  Synthetic
gccgccgaagtgctgt

SEQ ID NO: 11637 - DNA, 18 bp, Artificial Sequence
  Synthetic
aagggtttccaaacggcg

SEQ ID NO: 11638 - DNA, 20 bp, Artificial Sequence
  Synthetic
tttggcaagctgtttcatcg

SEQ ID NO: 11639 - DNA, 17 bp, Artificial Sequence
  Synthetic
tggctcgccgttgaaga

SEQ ID NO: 11640 - DNA, 17 bp, Artificial Sequence
  Synthetic
cgacttcgcccgcaatc

SEQ ID NO: 11641 - DNA, 18 bp, Artificial Sequence
  Synthetic
gattcagacggcatcggc

SEQ ID NO: 11642 - DNA, 17 bp, Artificial Sequence
  Synthetic
ggcggcaaactcttggg

SEQ ID NO: 11643 - DNA, 17 bp, Artificial Sequence
  Synthetic
gtccggcgaacttgtgc

SEQ ID NO: 11644 - DNA, 17 bp, Artificial Sequence
  Synthetic
acggcgtgatgatcggc

SEQ ID NO: 11645 - DNA, 19 bp, Artificial Sequence
  Synthetic
ctgcaccatcacgaactct

SEQ ID NO: 11646 - DNA, 18 bp, Artificial Sequence
  Synthetic
tgcacccacaaactcacg

SEQ ID NO: 11647 - DNA, 17 bp, Artificial Sequence
  Synthetic
tcaccagcttcgcctgc

SEQ ID NO: 11648 - DNA, 16 bp, Artificial Sequence
  Synthetic
gcggtatcgagtgcgc

SEQ ID NO: 11649 - DNA, 20 bp, Artificial Sequence
  Synthetic
gacggcatttttgacatccc

SEQ ID NO: 11650 - DNA, 20 bp, Artificial Sequence
  Synthetic
gcaccgacatttctttgacc

SEQ ID NO: 11651 - DNA, 19 bp, Artificial Sequence
  Synthetic
gccgattctttcgccaacg

SEQ ID NO: 11652 - DNA, 16 bp, Artificial Sequence
  Synthetic
cggcggcttcctgcaa

SEQ ID NO: 11653 - DNA, 19 bp, Artificial Sequence
  Synthetic
tgcgcttggatttggttca

SEQ ID NO: 11654 - DNA, 16 bp, Artificial Sequence
  Synthetic
gggcgcggtgatgtgt

SEQ ID NO: 11655 - DNA, 18 bp, Artificial Sequence
  Synthetic
tgcttggcaacggtttgt

SEQ ID NO: 11656 - DNA, 17 bp, Artificial Sequence
  Synthetic
aatgcccaagcggtggc

SEQ ID NO: 11657 - DNA, 16 bp, Artificial Sequence
  Synthetic
ccgtatctgggcgcga

SEQ ID NO: 11658 - DNA, 18 bp, Artificial Sequence
  Synthetic
ggcgacgaatccctctcc

SEQ ID NO: 11659 - DNA, 20 bp, Artificial Sequence
  Synthetic
ggcatccgtgttttggaaac

SEQ ID NO: 11660 - DNA, 17 bp, Artificial Sequence
  Synthetic
atgggtggacagccgct

SEQ ID NO: 11661 - DNA, 20 bp, Artificial Sequence
  Synthetic
cccacagcagaacaaaaacg

SEQ ID NO: 11662 - DNA, 17 bp, Artificial Sequence
  Synthetic
cgagttcggcagcttcc

SEQ ID NO: 11663 - DNA, 18 bp, Artificial Sequence
  Synthetic
tccccagttgtggtagcg

SEQ ID NO: 11664 - DNA, 16 bp, Artificial Sequence
  Synthetic
gtccgccgcgtcgaaa

SEQ ID NO: 11665 - DNA, 19 bp, Artificial Sequence
  Synthetic
ttgatgcggttgatgtcgg

SEQ ID NO: 11666 - DNA, 20 bp, Artificial Sequence
  Synthetic
atctgtttgacggtttcgcc

SEQ ID NO: 11667 - DNA, 16 bp, Artificial Sequence
  Synthetic
cttcgagttcggcggc

SEQ ID NO: 11668 - DNA, 16 bp, Artificial Sequence
  Synthetic
agcagcagggacagcg

SEQ ID NO: 11669 - DNA, 20 bp, Artificial Sequence
  Synthetic
gggatgatactgctgcacgt

SEQ ID NO: 11670 - DNA, 18 bp, Artificial Sequence
  Synthetic
cgcctatccgaacaggcc

SEQ ID NO: 11671 - DNA, 22 bp, Artificial Sequence
  Synthetic
aaatcatgagcaattacgaaga

SEQ ID NO: 11672 - DNA, 18 bp, Artificial Sequence
  Synthetic
agtcaatacgatgcagcc

SEQ ID NO: 11673 - DNA, 20 bp, Artificial Sequence
  Synthetic
agaacgccctgatactaact

SEQ ID NO: 11674 - DNA, 20 bp, Artificial Sequence
  Synthetic
tgatgcaaatgaccgtgatt

SEQ ID NO: 11675 - DNA, 19 bp, Artificial Sequence
  Synthetic
ataacgaagaacctcagcc

SEQ ID NO: 11676 - DNA, 20 bp, Artificial Sequence
  Synthetic
cgaacttgaccctaagcagc

SEQ ID NO: 11677 - DNA, 20 bp, Artificial Sequence
  Synthetic
gaaacgcatcactttatcgg

SEQ ID NO: 11678 - DNA, 18 bp, Artificial Sequence
  Synthetic
ctgtttagggctgcgttc

SEQ ID NO: 11679 - DNA, 21 bp, Artificial Sequence
  Synthetic
aaccagtttgcatcaaaacac

SEQ ID NO: 11680 - DNA, 20 bp, Artificial Sequence
  Synthetic
caccgtattcaaaggtatgg

SEQ ID NO: 11681 - DNA, 19 bp, Artificial Sequence
  Synthetic
tccaaatggaaaactgcca

SEQ ID NO: 11682 - DNA, 20 bp, Artificial Sequence
  Synthetic
caattccaacacgttttcca

SEQ ID NO: 11683 - DNA, 22 bp, Artificial Sequence
  Synthetic
tctgccaaaatcaaacttttcg

SEQ ID NO: 11684 - DNA, 17 bp, Artificial Sequence
  Synthetic
tactgcgaccaacccga

SEQ ID NO: 11685 - DNA, 16 bp, Artificial Sequence
  Synthetic
tgaagccttgcgcgtc

SEQ ID NO: 11686 - DNA, 21 bp, Artificial Sequence
  Synthetic
ttttgatggtttgatggtttg

SEQ ID NO: 11687 - DNA, 18 bp, Artificial Sequence
  Synthetic
ttgccgcaaacagcatct

SEQ ID NO: 11688 - DNA, 18 bp, Artificial Sequence
  Synthetic
caaatcatccgccgcacc

SEQ ID NO: 11689 - DNA, 20 bp, Artificial Sequence
  Synthetic
acgtgttcatcccattgagc

SEQ ID NO: 11690 - DNA, 19 bp, Artificial Sequence
  Synthetic
gccaatttcgccgtattgc

SEQ ID NO: 11691 - DNA, 16 bp, Artificial Sequence
  Synthetic
cggcgaggatgcggat

SEQ ID NO: 11692 - DNA, 16 bp, Artificial Sequence
  Synthetic
tcaggctgacgcggct

SEQ ID NO: 11693 - DNA, 16 bp, Artificial Sequence
  Synthetic
ccgtgtccggcgttga

SEQ ID NO: 11694 - DNA, 16 bp, Artificial Sequence
  Synthetic
cgcgcgcggtcagttt

SEQ ID NO: 11695 - DNA, 18 bp, Artificial Sequence
  Synthetic
ctgacgggtttcgacctg

SEQ ID NO: 11696 - DNA, 16 bp, Artificial Sequence
  Synthetic
gcatgcctgcgtgtcc

SEQ ID NO: 11697 - DNA, 19 bp, Artificial Sequence
  Synthetic
acggtataactttgcgcca

SEQ ID NO: 11698 - DNA, 18 bp, Artificial Sequence
  Synthetic
gagtttcttaccgccgcc

SEQ ID NO: 11699 - DNA, 17 bp, Artificial Sequence
  Synthetic
aactggggacgcctgga

SEQ ID NO: 11700 - DNA, 16 bp, Artificial Sequence
  Synthetic
ccgtcattcccgcgca

SEQ ID NO: 11701 - DNA, 20 bp, Artificial Sequence
  Synthetic
agtgccggaagaaaatacgg

SEQ ID NO: 11702 - DNA, 16 bp, Artificial Sequence
  Synthetic
cagttccgtgccgtcg

SEQ ID NO: 11703 - DNA, 19 bp, Artificial Sequence
  Synthetic
ggcacggcataagtgtagg

SEQ ID NO: 11704 - DNA, 17 bp, Artificial Sequence
  Synthetic
ggccgtccattgtccgt

SEQ ID NO: 11705 - DNA, 18 bp, Artificial Sequence
  Synthetic
agtttgcccatgctcagg

SEQ ID NO: 11706 - DNA, 18 bp, Artificial Sequence
  Synthetic
cactgccggccaaaatcg

SEQ ID NO: 11707 - DNA, 16 bp, Artificial Sequence
  Synthetic
ggcggcgacaacgttg

SEQ ID NO: 11708 - DNA, 16 bp, Artificial Sequence
  Synthetic
gcagtcgcgccgaact

SEQ ID NO: 11709 - DNA, 16 bp, Artificial Sequence
  Synthetic
gtcagctccacgccga

SEQ ID NO: 11710 - DNA, 20 bp, Artificial Sequence
  Synthetic
tcaaaaacattgccttcgcc

SEQ ID NO: 11711 - DNA, 17 bp, Artificial Sequence
  Synthetic
gggttgccgccatttcg

SEQ ID NO: 11712 - DNA, 17 bp, Artificial Sequence
  Synthetic
tcggtatgcgcttccgg

SEQ ID NO: 11713 - DNA, 16 bp, Artificial Sequence
  Synthetic
gccgtctgaaccgcct

SEQ ID NO: 11714 - DNA, 18 bp, Artificial Sequence
  Synthetic
cgcaatcaccttgtcgcc

SEQ ID NO: 11715 - DNA, 18 bp, Artificial Sequence
  Synthetic
caacagggtggacacggt

SEQ ID NO: 11716 - DNA, 17 bp, Artificial Sequence
  Synthetic
ggttgcgcccttgatgc

SEQ ID NO: 11717 - DNA, 16 bp, Artificial Sequence
  Synthetic
acggcgggcaggatgt

SEQ ID NO: 11718 - DNA, 16 bp, Artificial Sequence
  Synthetic
ggcacgccgttgactc

SEQ ID NO: 11719 - DNA, 19 bp, Artificial Sequence
  Synthetic
tgccttcgcaatcacgaac

SEQ ID NO: 11720 - DNA, 18 bp, Artificial Sequence
  Synthetic
ccatacaggctgtcttca

SEQ ID NO: 11721 - DNA, 19 bp, Artificial Sequence
  Synthetic
cgtatagaggcgcgacaga

SEQ ID NO: 11722 - DNA, 20 bp, Artificial Sequence
  Synthetic
cggtttgttcacgctcttcc

SEQ ID NO: 11723 - DNA, 19 bp, Artificial Sequence
  Synthetic
aaaccgaagaagaaaccgg

SEQ ID NO: 11724 - DNA, 18 bp, Artificial Sequence
  Synthetic
ttcgctgacgctcaaagc

SEQ ID NO: 11725 - DNA, 19 bp, Artificial Sequence
  Synthetic
accgcgactatgtcaaagc

SEQ ID NO: 11726 - DNA, 16 bp, Artificial Sequence
  Synthetic
acacccccgcgctgat

SEQ ID NO: 11727 - DNA, 16 bp, Artificial Sequence
  Synthetic
aacttcccgctcgcca

SEQ ID NO: 11728 - DNA, 16 bp, Artificial Sequence
  Synthetic
cgggtgcggcattgac

SEQ ID NO: 11729 - DNA, 16 bp, Artificial Sequence
  Synthetic
aggccttctgcgccct

SEQ ID NO: 11730 - DNA, 18 bp, Artificial Sequence
  Synthetic
aggtctcggtgtcatcgc

SEQ ID NO: 11731 - DNA, 20 bp, Artificial Sequence
  Synthetic
agcagtccccaaacaaatcc

SEQ ID NO: 11732 - DNA, 19 bp, Artificial Sequence
  Synthetic
ggcacgcaaatcgaaatcc

SEQ ID NO: 11733 - DNA, 16 bp, Artificial Sequence
  Synthetic
tctgacctgcgcggac

SEQ ID NO: 11734 - DNA, 18 bp, Artificial Sequence
  Synthetic
gtggtcgggagaggacga

SEQ ID NO: 11735 - DNA, 16 bp, Artificial Sequence
  Synthetic
ccgccgaaaccgccaa

SEQ ID NO: 11736 - DNA, 18 bp, Artificial Sequence
  Synthetic
tcccattcgttgtggcac

SEQ ID NO: 11737 - DNA, 18 bp, Artificial Sequence
  Synthetic
gcaaaatcgcaaggcagc

SEQ ID NO: 11738 - DNA, 18 bp, Artificial Sequence
  Synthetic
gcggtttgagcgcatcaa

SEQ ID NO: 11739 - DNA, 17 bp, Artificial Sequence
  Synthetic
aacatcctgtgccgccc

SEQ ID NO: 11740 - DNA, 20 bp, Artificial Sequence
  Synthetic
gagaatgccgtctgaaatgt

SEQ ID NO: 11741 - DNA, 16 bp, Artificial Sequence
  Synthetic
cggaagggcacgcctt

SEQ ID NO: 11742 - DNA, 16 bp, Artificial Sequence
  Synthetic
tcgtccccgcctttca

SEQ ID NO: 11743 - DNA, 16 bp, Artificial Sequence
  Synthetic
acaaccccgacagcgc

SEQ ID NO: 11744 - DNA, 18 bp, Artificial Sequence
  Synthetic
gtccgcctgttccgaaat

SEQ ID NO: 11745 - DNA, 19 bp, Artificial Sequence
  Synthetic
ggcaaacgttaccgtaccg

SEQ ID NO: 11746 - DNA, 20 bp, Artificial Sequence
  Synthetic
tctgatttccaagatggcgc

SEQ ID NO: 11747 - DNA, 20 bp, Artificial Sequence
  Synthetic
tgtccacaatcatgcccaaa

SEQ ID NO: 11748 - DNA, 20 bp, Artificial Sequence
  Synthetic
gaacttgccaaagacgctca

SEQ ID NO: 11749 - DNA, 19 bp, Artificial Sequence
  Synthetic
aaaccctcaaagcctacgc

SEQ ID NO: 11750 - DNA, 19 bp, Artificial Sequence
  Synthetic
gccgcctatcaagattggg

SEQ ID NO: 11751 - DNA, 17 bp, Artificial Sequence
  Synthetic
gcaaacagccgtcgtgg

SEQ ID NO: 11752 - DNA, 18 bp, Artificial Sequence
  Synthetic
ggcgttacccacatcgtg

SEQ ID NO: 11753 - DNA, 16 bp, Artificial Sequence
  Synthetic
ggctgtggcggacgat

SEQ ID NO: 11754 - DNA, 19 bp, Artificial Sequence
  Synthetic
ttcgttcatcagacacgcg

SEQ ID NO: 11755 - DNA, 16 bp, Artificial Sequence
  Synthetic
ttacggcccggaccaa

SEQ ID NO: 11756 - DNA, 18 bp, Artificial Sequence
  Synthetic
cgcaggcgcaaaaaaacc

SEQ ID NO: 11757 - DNA, 16 bp, Artificial Sequence
  Synthetic
ccgcaaaacccacggc

SEQ ID NO: 11758 - DNA, 19 bp, Artificial Sequence
  Synthetic
atatccccgtcgtcttggt

SEQ ID NO: 11759 - DNA, 20 bp, Artificial Sequence
  Synthetic
cgtgatacgccttatcctgc

SEQ ID NO: 11760 - DNA, 16 bp, Artificial Sequence
  Synthetic
ggttttcggcgggcga

SEQ ID NO: 11761 - DNA, 16 bp, Artificial Sequence
  Synthetic
caaagagacgggcggc

SEQ ID NO: 11762 - DNA, 17 bp, Artificial Sequence
  Synthetic
ttgatgctgacggcgtg

SEQ ID NO: 11763 - DNA, 18 bp, Artificial Sequence
  Synthetic
gagattcggctcgttgat

SEQ ID NO: 11764 - DNA, 20 bp, Artificial Sequence
  Synthetic
accagaacaatactgtcggc

SEQ ID NO: 11765 - DNA, 20 bp, Artificial Sequence
  Synthetic
ccacaggggatacatcttgc

SEQ ID NO: 11766 - DNA, 17 bp, Artificial Sequence
  Synthetic
gcggcagcgttaccgtt

SEQ ID NO: 11767 - DNA, 18 bp, Artificial Sequence
  Synthetic
cgtgtttcatcaggccgg

SEQ ID NO: 11768 - DNA, 20 bp, Artificial Sequence
  Synthetic
tattcggcgtaaacgtctgc

SEQ ID NO: 11769 - DNA, 18 bp, Artificial Sequence
  Synthetic
gtccacgcgtttgacgat

SEQ ID NO: 11770 - DNA, 20 bp, Artificial Sequence
  Synthetic
ctgccttcttcgacaatcgc

SEQ ID NO: 11771 - DNA, 16 bp, Artificial Sequence
  Synthetic
cccgctagcagttcgc

SEQ ID NO: 11772 - DNA, 17 bp, Artificial Sequence
  Synthetic
ggcggatttcgggcaac

SEQ ID NO: 11773 - DNA, 16 bp, Artificial Sequence
  Synthetic
gtatggcgggcggtca

SEQ ID NO: 11774 - DNA, 23 bp, Artificial Sequence
  Synthetic
aacaggcaaataacaatacaatg

SEQ ID NO: 11775 - DNA, 17 bp, Artificial Sequence
  Synthetic
ctacggcaaacgcagcg

SEQ ID NO: 11776 - DNA, 17 bp, Artificial Sequence
  Synthetic
ggtaatcacgccgtcgg

SEQ ID NO: 11777 - DNA, 15 bp, Artificial Sequence
  Synthetic
aaaacgcgggctgcc

SEQ ID NO: 11778 - DNA, 20 bp, Artificial Sequence
  Synthetic
tgtttatggacgatttgcgc

SEQ ID NO: 11779 - DNA, 21 bp, Artificial Sequence
  Synthetic
cttacctcattgtttcacaca

SEQ ID NO: 11780 - DNA, 20 bp, Artificial Sequence
  Synthetic
atcccaaagtttcaagccgt

SEQ ID NO: 11781 - DNA, 20 bp, Artificial Sequence
  Synthetic
tcatcacgatatgcagcctg

SEQ ID NO: 11782 - DNA, 16 bp, Artificial Sequence
  Synthetic
tcgacctcacccgcaa

SEQ ID NO: 11783 - DNA, 20 bp, Artificial Sequence
  Synthetic
attccgattatcgatgccgc

SEQ ID NO: 11784 - DNA, 18 bp, Artificial Sequence
  Synthetic
aatgccagccccatcagc

SEQ ID NO: 11785 - DNA, 20 bp, Artificial Sequence
  Synthetic
acagggcgaactctacatcc

SEQ ID NO: 11786 - DNA, 18 bp, Artificial Sequence
  Synthetic
tcgccaaactccccttcg

SEQ ID NO: 11787 - DNA, 19 bp, Artificial Sequence
  Synthetic
cagcaaaaggggatacagg

SEQ ID NO: 11788 - DNA, 20 bp, Artificial Sequence
  Synthetic
ttctcgtaaggattggcgac

SEQ ID NO: 11789 - DNA, 16 bp, Artificial Sequence
  Synthetic
cgtgggtgcggctcat

SEQ ID NO: 11790 - DNA, 19 bp, Artificial Sequence
  Synthetic
tcggcaaaacgggaaaacc

SEQ ID NO: 11791 - DNA, 16 bp, Artificial Sequence
  Synthetic
ccggcatcgcgcactt

SEQ ID NO: 11792 - DNA, 16 bp, Artificial Sequence
  Synthetic
atcggcgtgccaaacc

SEQ ID NO: 11793 - DNA, 18 bp, Artificial Sequence
  Synthetic
ctgctcgaggaaggcatc

SEQ ID NO: 11794 - DNA, 20 bp, Artificial Sequence
  Synthetic
ggcaatgccgtctgaaaagc

SEQ ID NO: 11795 - DNA, 19 bp, Artificial Sequence
  Synthetic
cgtcagtttgtaacgccct

SEQ ID NO: 11796 - DNA, 16 bp, Artificial Sequence
  Synthetic
taccttggacggcggc

SEQ ID NO: 11797 - DNA, 18 bp, Artificial Sequence
  Synthetic
acacgcgctacttcctcc

SEQ ID NO: 11798 - DNA, 18 bp, Artificial Sequence
  Synthetic
caacgccgaacacatccg

SEQ ID NO: 11799 - DNA, 20 bp, Artificial Sequence
  Synthetic
ctgcgtcaaaaactcgaagc

SEQ ID NO: 11800 - DNA, 17 bp, Artificial Sequence
  Synthetic
ggcagacctgacgatgc

SEQ ID NO: 11801 - DNA, 17 bp, Artificial Sequence
  Synthetic
cgccctgaccaccaaag

SEQ ID NO: 11802 - DNA, 16 bp, Artificial Sequence
  Synthetic
tggtacggcggcaggt

SEQ ID NO: 11803 - DNA, 16 bp, Artificial Sequence
  Synthetic
cggcatcggcgcgaaa

SEQ ID NO: 11804 - DNA, 20 bp, Artificial Sequence
  Synthetic
gggcaaaatcgtagagtggc

SEQ ID NO: 11805 - DNA, 18 bp, Artificial Sequence
  Synthetic
ctctttttccacggcgcg

SEQ ID NO: 11806 - DNA, 19 bp, Artificial Sequence
  Synthetic
aactcctcgaaaaacgcgg

SEQ ID NO: 11807 - DNA, 17 bp, Artificial Sequence
  Synthetic
ccaaattaccgccggct

SEQ ID NO: 11808 - DNA, 20 bp, Artificial Sequence
  Synthetic
actcccaaccctgattgtgt

SEQ ID NO: 11809 - DNA, 19 bp, Artificial Sequence
  Synthetic
gttttcgcactcgttgtcc

SEQ ID NO: 11810 - DNA, 17 bp, Artificial Sequence
  Synthetic
aagacgtgctgccctgt

SEQ ID NO: 11811 - DNA, 18 bp, Artificial Sequence
  Synthetic
tcgcggcgtgaatcaatg

SEQ ID NO: 11812 - DNA, 18 bp, Artificial Sequence
  Synthetic
catcgcgctgataccgaa

SEQ ID NO: 11813 - DNA, 19 bp, Artificial Sequence
  Synthetic
aacaacaccattacggcgc

SEQ ID NO: 11814 - DNA, 20 bp, Artificial Sequence
  Synthetic
acggcgcacgatagaatcag

SEQ ID NO: 11815 - DNA, 20 bp, Artificial Sequence
  Synthetic
ctgtcgggttgttttgctct

SEQ ID NO: 11816 - DNA, 18 bp, Artificial Sequence
  Synthetic
cataatgccgcctacgcc

SEQ ID NO: 11817 - DNA, 16 bp, Artificial Sequence
  Synthetic
cggttccggcgggttt

SEQ ID NO: 11818 - DNA, 18 bp, Artificial Sequence
  Synthetic
tacgtttggggcgcaatc

SEQ ID NO: 11819 - DNA, 17 bp, Artificial Sequence
  Synthetic
gccaccctgttcggact

SEQ ID NO: 11820 - DNA, 18 bp, Artificial Sequence
  Synthetic
cgaaagcgggaatccagg

SEQ ID NO: 11821 - DNA, 17 bp, Artificial Sequence
  Synthetic
cacgcccgtgttcttcc

SEQ ID NO: 11822 - DNA, 20 bp, Artificial Sequence
  Synthetic
gcattgtcttcactgttggc

SEQ ID NO: 11823 - DNA, 18 bp, Artificial Sequence
  Synthetic
ccagtcaggggcacaaag

SEQ ID NO: 11824 - DNA, 19 bp, Artificial Sequence
  Synthetic
gtgcgtctatgctcggttc

SEQ ID NO: 11825 - DNA, 19 bp, Artificial Sequence
  Synthetic
cccattctacgccgttgat

SEQ ID NO: 11826 - DNA, 16 bp, Artificial Sequence
  Synthetic
cgcagttcgggcgtgt

SEQ ID NO: 11827 - DNA, 16 bp, Artificial Sequence
  Synthetic
gttccgccgccgaagt

SEQ ID NO: 11828 - DNA, 16 bp, Artificial Sequence
  Synthetic
aacacccggctctggc

SEQ ID NO: 11829 - DNA, 16 bp, Artificial Sequence
  Synthetic
gcgcaatcggcatcct

SEQ ID NO: 11830 - DNA, 18 bp, Artificial Sequence
  Synthetic
tgggcttaacttgcgacc

SEQ ID NO: 11831 - DNA, 18 bp, Artificial Sequence
  Synthetic
gtaaacgaggcatccggg

SEQ ID NO: 11832 - DNA, 20 bp, Artificial Sequence
  Synthetic
atcagaatcatcagcggcac

SEQ ID NO: 11833 - DNA, 16 bp, Artificial Sequence
  Synthetic
cgcgccgtttcagcct

SEQ ID NO: 11834 - DNA, 19 bp, Artificial Sequence
  Synthetic
atgccgtctgaaactcggg

SEQ ID NO: 11835 - DNA, 17 bp, Artificial Sequence
  Synthetic
cagggcgaatacgggga

SEQ ID NO: 11836 - DNA, 17 bp, Artificial Sequence
  Synthetic
caccgtgtaccgccaca

SEQ ID NO: 11837 - DNA, 16 bp, Artificial Sequence
  Synthetic
gcgcccgcgtacagat

SEQ ID NO: 11838 - DNA, 18 bp, Artificial Sequence
  Synthetic
tttgcgcatggttcagga

SEQ ID NO: 11839 - DNA, 17 bp, Artificial Sequence
  Synthetic
cacccgttgcagatgcc

SEQ ID NO: 11840 - DNA, 17 bp, Artificial Sequence
  Synthetic
caaagtccgttccgccg

SEQ ID NO: 11841 - DNA, 16 bp, Artificial Sequence
  Synthetic
ggcaccgaaagccgca

SEQ ID NO: 11842 - DNA, 16 bp, Artificial Sequence
  Synthetic
tctcgacggcggtctc

SEQ ID NO: 11843 - DNA, 17 bp, Artificial Sequence
  Synthetic
gtgatcaccgcgatggg

SEQ ID NO: 11844 - DNA, 19 bp, Artificial Sequence
  Synthetic
gcaaaaactcgccgaagac

SEQ ID NO: 11845 - DNA, 16 bp, Artificial Sequence
  Synthetic
gcacttcccgggcgat

SEQ ID NO: 11846 - DNA, 15 bp, Artificial Sequence
  Synthetic
tgcccgtcgtcgcat

SEQ ID NO: 11847 - DNA, 17 bp, Artificial Sequence
  Synthetic
gtgcatgctcatcggcg

SEQ ID NO: 11848 - DNA, 15 bp, Artificial Sequence
  Synthetic
agcaacggcaggcgt

SEQ ID NO: 11849 - DNA, 20 bp, Artificial Sequence
  Synthetic
aaatcgtcaacaccaccgag

SEQ ID NO: 11850 - DNA, 17 bp, Artificial Sequence
  Synthetic
cgccatcaaccccgaac

SEQ ID NO: 11851 - DNA, 16 bp, Artificial Sequence
  Synthetic
cccttttggacgcgcg

SEQ ID NO: 11852 - DNA, 18 bp, Artificial Sequence
  Synthetic
catcccgatgatgccctg

SEQ ID NO: 11853 - DNA, 20 bp, Artificial Sequence
  Synthetic
ccgacttcaccatccaagac

SEQ ID NO: 11854 - DNA, 18 bp, Artificial Sequence
  Synthetic
aaaaccggcatctcaggc

SEQ ID NO: 11855 - DNA, 18 bp, Artificial Sequence
  Synthetic
tttcccattttgcggcgt

SEQ ID NO: 11856 - DNA, 16 bp, Artificial Sequence
  Synthetic
aagtttccggcggcac

SEQ ID NO: 11857 - DNA, 20 bp, Artificial Sequence
  Synthetic
gaagaactgtggcaaaccgt

SEQ ID NO: 11858 - DNA, 20 bp, Artificial Sequence
  Synthetic
agcatctaattgagtctcgt

SEQ ID NO: 11859 - DNA, 18 bp, Artificial Sequence
  Synthetic
gcacatgcacgatgagat

SEQ ID NO: 11860 - DNA, 20 bp, Artificial Sequence
  Synthetic
ccaaaatacgaccaaaacgc

SEQ ID NO: 11861 - DNA, 20 bp, Artificial Sequence
  Synthetic
atgccgtctgaaaattcttg

SEQ ID NO: 11862 - DNA, 20 bp, Artificial Sequence
  Synthetic
ccgcgcttttaggaacttca

SEQ ID NO: 11863 - DNA, 20 bp, Artificial Sequence
  Synthetic
acaaagccgtctgaagtacc

SEQ ID NO: 11864 - DNA, 18 bp, Artificial Sequence
  Synthetic
gcgccgtatgcttccaat

SEQ ID NO: 11865 - DNA, 18 bp, Artificial Sequence
  Synthetic
ggtatttccccgcacctg

SEQ ID NO: 11866 - DNA, 20 bp, Artificial Sequence
  Synthetic
taatcagtttgtggcagcct

SEQ ID NO: 11867 - DNA, 19 bp, Artificial Sequence
  Synthetic
tcttgggcgatgtggtact

SEQ ID NO: 11868 - DNA, 17 bp, Artificial Sequence
  Synthetic
cggcggaaagctggatg

SEQ ID NO: 11869 - DNA, 19 bp, Artificial Sequence
  Synthetic
aacggctgaaagacaacga

SEQ ID NO: 11870 - DNA, 19 bp, Artificial Sequence
  Synthetic
tcagcacataacgcggatt

SEQ ID NO: 11871 - DNA, 16 bp, Artificial Sequence
  Synthetic
acccgcgcggaagtca

SEQ ID NO: 11872 - DNA, 16 bp, Artificial Sequence
  Synthetic
cgtttccgcccaacgc

SEQ ID NO: 11873 - DNA, 18 bp, Artificial Sequence
  Synthetic
acacgccgatgtcaaagg

SEQ ID NO: 11874 - DNA, 24 bp, Artificial Sequence
  Synthetic
tagtgtggttaaatctttttgcag

SEQ ID NO: 11875 - DNA, 19 bp, Artificial Sequence
  Synthetic
tcgtcagcgcgatacgttt

SEQ ID NO: 11876 - DNA, 16 bp, Artificial Sequence
  Synthetic
ttcgaccaccgcgtcc

SEQ ID NO: 11877 - DNA, 16 bp, Artificial Sequence
  Synthetic
cgccagttcggacgca

SEQ ID NO: 11878 - DNA, 15 bp, Artificial Sequence
  Synthetic
acggccttgcgctct

SEQ ID NO: 11879 - DNA, 18 bp, Artificial Sequence
  Synthetic
gcagcatcaaaagcgtcc

SEQ ID NO: 11880 - DNA, 20 bp, Artificial Sequence
  Synthetic
tgacacccttacctttcacg

SEQ ID NO: 11881 - DNA, 22 bp, Artificial Sequence
  Synthetic
ggggatattcgggtaaaattag

SEQ ID NO: 11882 - DNA, 15 bp, Artificial Sequence
  Synthetic
acgcccagcccgatt

SEQ ID NO: 11883 - DNA, 15 bp, Artificial Sequence
  Synthetic
tgaccgccgccgaaa

SEQ ID NO: 11884 - DNA, 16 bp, Artificial Sequence
  Synthetic
ggcagacggcggtaca

SEQ ID NO: 11885 - DNA, 20 bp, Artificial Sequence
  Synthetic
agcctctgctcattacctcg

SEQ ID NO: 11886 - DNA, 19 bp, Artificial Sequence
  Synthetic
tacctacacccccgaaacc

SEQ ID NO: 11887 - DNA, 16 bp, Artificial Sequence
  Synthetic
tcggacgcgccatcga

SEQ ID NO: 11888 - DNA, 16 bp, Artificial Sequence
  Synthetic
catcgccgccctcgaa

SEQ ID NO: 11889 - DNA, 18 bp, Artificial Sequence
  Synthetic
tgaccgcccttttcgtct

SEQ ID NO: 11890 - DNA, 18 bp, Artificial Sequence
  Synthetic
cgaacccgcaaaattcgc

SEQ ID NO: 11891 - DNA, 17 bp, Artificial Sequence
  Synthetic
cttccaacacctgcccg

SEQ ID NO: 11892 - DNA, 19 bp, Artificial Sequence
  Synthetic
gagattggcgggatgaagc

SEQ ID NO: 11893 - DNA, 20 bp, Artificial Sequence
  Synthetic
tgccttggatttgggcattc

SEQ ID NO: 11894 - DNA, 16 bp, Artificial Sequence
  Synthetic
ttcggcaccgcacacc

SEQ ID NO: 11895 - DNA, 16 bp, Artificial Sequence
  Synthetic
gctgccgaccgatgtc

SEQ ID NO: 11896 - DNA, 18 bp, Artificial Sequence
  Synthetic
cgctttggatgcccagat

SEQ ID NO: 11897 - DNA, 18 bp, Artificial Sequence
  Synthetic
tcgtccgcttcaaaacgc

SEQ ID NO: 11898 - DNA, 18 bp, Artificial Sequence
  Synthetic
ttgccgtctttcagccag

SEQ ID NO: 11899 - DNA, 20 bp, Artificial Sequence
  Synthetic
ttccagtaatgcggaatcgg

SEQ ID NO: 11900 - DNA, 19 bp, Artificial Sequence
  Synthetic
gaaatgtcctacacctgcc

SEQ ID NO: 11901 - DNA, 23 bp, Artificial Sequence
  Synthetic
gcagaaactgaatcaaaaacaac

SEQ ID NO: 11902 - DNA, 18 bp, Artificial Sequence
  Synthetic
gataccggtttgctgcat

SEQ ID NO: 11903 - DNA, 18 bp, Artificial Sequence
  Synthetic
tgcttatccgaccgaatc

SEQ ID NO: 11904 - DNA, 20 bp, Artificial Sequence
  Synthetic
gaggatgccggagaaattgt

SEQ ID NO: 11905 - DNA, 16 bp, Artificial Sequence
  Synthetic
aatagcgcaggcgggt

SEQ ID NO: 11906 - DNA, 16 bp, Artificial Sequence
  Synthetic
cgcggaggcattcagg

SEQ ID NO: 11907 - DNA, 16 bp, Artificial Sequence
  Synthetic
ccgccgtcaagcagga

SEQ ID NO: 11908 - DNA, 16 bp, Artificial Sequence
  Synthetic
gcgcccgtaccttcca

SEQ ID NO: 11909 - DNA, 19 bp, Artificial Sequence
  Synthetic
attgcctgccggaaattgc

SEQ ID NO: 11910 - DNA, 18 bp, Artificial Sequence
  Synthetic
cagttgtcgccgtcgaag

SEQ ID NO: 11911 - DNA, 18 bp, Artificial Sequence
  Synthetic
gtgcaacggtgtaacccg

SEQ ID NO: 11912 - DNA, 19 bp, Artificial Sequence
  Synthetic
cacgttgttgagcagctgg

SEQ ID NO: 11913 - DNA, 17 bp, Artificial Sequence
  Synthetic
tcaagtcggcggacacg

SEQ ID NO: 11914 - DNA, 20 bp, Artificial Sequence
  Synthetic
ttatgaacattcgcttccac

SEQ ID NO: 11915 - DNA, 20 bp, Artificial Sequence
  Synthetic
actgccggttttgtcattgg

SEQ ID NO: 11916 - DNA, 17 bp, Artificial Sequence
  Synthetic
cggggcttcgtggaaac

SEQ ID NO: 11917 - DNA, 16 bp, Artificial Sequence
  Synthetic
cagtccgctgccgctt

SEQ ID NO: 11918 - DNA, 17 bp, Artificial Sequence
  Synthetic
cgacttgtccgagcagc

SEQ ID NO: 11919 - DNA, 19 bp, Artificial Sequence
  Synthetic
ccttccagcagtacggagt

SEQ ID NO: 11920 - DNA, 18 bp, Artificial Sequence
  Synthetic
cgtcggcacccttatccg

SEQ ID NO: 11921 - DNA, 17 bp, Artificial Sequence
  Synthetic
ccgttccctgcaactcg

SEQ ID NO: 11922 - DNA, 18 bp, Artificial Sequence
  Synthetic
gcttcgtgatggccgaca

SEQ ID NO: 11923 - DNA, 20 bp, Artificial Sequence
  Synthetic
ggcaaagtcatgcatacgct

SEQ ID NO: 11924 - DNA, 15 bp, Artificial Sequence
  Synthetic
caacacgcggcgcat

SEQ ID NO: 11925 - DNA, 16 bp, Artificial Sequence
  Synthetic
tcggcaagctcgtccg

SEQ ID NO: 11926 - DNA, 17 bp, Artificial Sequence
  Synthetic
gccgggtttgatccacc

SEQ ID NO: 11927 - DNA, 16 bp, Artificial Sequence
  Synthetic
ggagcttgccgacggt

SEQ ID NO: 11928 - DNA, 16 bp, Artificial Sequence
  Synthetic
ggtcgcaccgtttggg

SEQ ID NO: 11929 - DNA, 18 bp, Artificial Sequence
  Synthetic
tgcacttggaaacggcag

SEQ ID NO: 11930 - DNA, 16 bp, Artificial Sequence
  Synthetic
ggtgtcggcaacagcc

SEQ ID NO: 11931 - DNA, 18 bp, Artificial Sequence
  Synthetic
ctttcattgcgccggaca

SEQ ID NO: 11932 - DNA, 16 bp, Artificial Sequence
  Synthetic
aatgccagccgtccgg

SEQ ID NO: 11933 - DNA, 20 bp, Artificial Sequence
  Synthetic
caatttgtccaagccttgcg

SEQ ID NO: 11934 - DNA, 17 bp, Artificial Sequence
  Synthetic
tgagcgtgatttcgggc

SEQ ID NO: 11935 - DNA, 18 bp, Artificial Sequence
  Synthetic
cgtttgagatggcggacg

SEQ ID NO: 11936 - DNA, 18 bp, Artificial Sequence
  Synthetic
cccgtcagcgtataggcg

SEQ ID NO: 11937 - DNA, 16 bp, Artificial Sequence
  Synthetic
ccgacggcatgaccca

SEQ ID NO: 11938 - DNA, 17 bp, Artificial Sequence
  Synthetic
agcaatcgccaaagccg

SEQ ID NO: 11939 - DNA, 16 bp, Artificial Sequence
  Synthetic
cgaccgtgccgaagca

SEQ ID NO: 11940 - DNA, 19 bp, Artificial Sequence
  Synthetic
cggctatgttgacgcaaac

SEQ ID NO: 11941 - DNA, 18 bp, Artificial Sequence
  Synthetic
ttgccgccgtgatgaatg

SEQ ID NO: 11942 - DNA, 16 bp, Artificial Sequence
  Synthetic
gtgccgctgtgtaccg

SEQ ID NO: 11943 - DNA, 16 bp, Artificial Sequence
  Synthetic
ccgggcattcggggtt

SEQ ID NO: 11944 - DNA, 16 bp, Artificial Sequence
  Synthetic
ccgcagcgaactcgac

SEQ ID NO: 11945 - DNA, 20 bp, Artificial Sequence
  Synthetic
ggacaaatccgcattaccga

SEQ ID NO: 11946 - DNA, 17 bp, Artificial Sequence
  Synthetic
cggtttgcaagtcgcca

SEQ ID NO: 11947 - DNA, 18 bp, Artificial Sequence
  Synthetic
tccgccaaatgcaggaag

SEQ ID NO: 11948 - DNA, 16 bp, Artificial Sequence
  Synthetic
cactggttacgcgcgg

SEQ ID NO: 11949 - DNA, 20 bp, Artificial Sequence
  Synthetic
gtatcagttcgtgggcgagg

SEQ ID NO: 11950 - DNA, 19 bp, Artificial Sequence
  Synthetic
acatccttgtcgccatcgg

SEQ ID NO: 11951 - DNA, 20 bp, Artificial Sequence
  Synthetic
tcctgattgtcttctgtgcc

SEQ ID NO: 11952 - DNA, 18 bp, Artificial Sequence
  Synthetic
ttcattttgcctgccgtt

SEQ ID NO: 11953 - DNA, 16 bp, Artificial Sequence
  Synthetic
ggcggcggaagacctt

SEQ ID NO: 11954 - DNA, 18 bp, Artificial Sequence
  Synthetic
gaactggaaaccgacggc

SEQ ID NO: 11955 - DNA, 19 bp, Artificial Sequence
  Synthetic
aggtcgaaacactcgttgc

SEQ ID NO: 11956 - DNA, 16 bp, Artificial Sequence
  Synthetic
gaagacgtgcgcaccg

SEQ ID NO: 11957 - DNA, 20 bp, Artificial Sequence
  Synthetic
ttgtcattgacgtatcgcgg

SEQ ID NO: 11958 - DNA, 17 bp, Artificial Sequence
  Synthetic
ttcgcgcgtgttcttcc

SEQ ID NO: 11959 - DNA, 16 bp, Artificial Sequence
  Synthetic
gatgccgccgctgatg

SEQ ID NO: 11960 - DNA, 20 bp, Artificial Sequence
  Synthetic
gaagcggcttccttcaaacc

SEQ ID NO: 11961 - DNA, 18 bp, Artificial Sequence
  Synthetic
gaatgcacgggggtttga

SEQ ID NO: 11962 - DNA, 16 bp, Artificial Sequence
  Synthetic
gtggcagcggtcaagg

SEQ ID NO: 11963 - DNA, 18 bp, Artificial Sequence
  Synthetic
gcttgggcttcctgatgg

SEQ ID NO: 11964 - DNA, 20 bp, Artificial Sequence
  Synthetic
cgatatagggtttgaagcgg

SEQ ID NO: 11965 - DNA, 16 bp, Artificial Sequence
  Synthetic
cgccgtcttcgccttc

SEQ ID NO: 11966 - DNA, 16 bp, Artificial Sequence
  Synthetic
tgtcggtgggggggat

SEQ ID NO: 11967 - DNA, 20 bp, Artificial Sequence
  Synthetic
atccgataagtttccgcacc

SEQ ID NO: 11968 - DNA, 16 bp, Artificial Sequence
  Synthetic
ttgaatcgggcgggcg

SEQ ID NO: 11969 - DNA, 18 bp, Artificial Sequence
  Synthetic
cgttcgagacggggaatc

SEQ ID NO: 11970 - DNA, 20 bp, Artificial Sequence
  Synthetic
gcggaaaaatctcttggagc

SEQ ID NO: 11971 - DNA, 19 bp, Artificial Sequence
  Synthetic
tgctgctgattgtcaggtc

SEQ ID NO: 11972 - DNA, 17 bp, Artificial Sequence
  Synthetic
ggcgcggttctgtttgc

SEQ ID NO: 11973 - DNA, 18 bp, Artificial Sequence
  Synthetic
ggattcgtacagcggcag

SEQ ID NO: 11974 - DNA, 16 bp, Artificial Sequence
  Synthetic
acaccgaccagcccga

SEQ ID NO: 11975 - DNA, 20 bp, Artificial Sequence
  Synthetic
cgtatagtccgaccagttcg

SEQ ID NO: 11976 - DNA, 16 bp, Artificial Sequence
  Synthetic
ccggtgaagcggtcga

SEQ ID NO: 11977 - DNA, 18 bp, Artificial Sequence
  Synthetic
agtatgaagggcgtggcg

SEQ ID NO: 11978 - DNA, 16 bp, Artificial Sequence
  Synthetic
cgccgccgatttccct

SEQ ID NO: 11979 - DNA, 18 bp, Artificial Sequence
  Synthetic
cgcgacatcatgcgttcg

SEQ ID NO: 11980 - DNA, 18 bp, Artificial Sequence
  Synthetic
ccaaccacggatagcggt

SEQ ID NO: 11981 - DNA, 18 bp, Artificial Sequence
  Synthetic
ggaatgcccaaatccgcc

SEQ ID NO: 11982 - DNA, 17 bp, Artificial Sequence
  Synthetic
ggcaggttctttcggcg

SEQ ID NO: 11983 - DNA, 20 bp, Artificial Sequence
  Synthetic
ccgtaaaattcggaagcggc

SEQ ID NO: 11984 - DNA, 20 bp, Artificial Sequence
  Synthetic
agatgttttatcggcctggg

SEQ ID NO: 11985 - DNA, 20 bp, Artificial Sequence
  Synthetic
aacattaccgtcttggcagt

SEQ ID NO: 11986 - DNA, 22 bp, Artificial Sequence
  Synthetic
tgcttctaatttctccaatcgt

SEQ ID NO: 11987 - DNA, 17 bp, Artificial Sequence
  Synthetic
acccgaccacaacaccg

SEQ ID NO: 11988 - DNA, 16 bp, Artificial Sequence
  Synthetic
acggacgcgctttcgg

SEQ ID NO: 11989 - DNA, 19 bp, Artificial Sequence
  Synthetic
gatttcggtattgcgcgcg

SEQ ID NO: 11990 - DNA, 20 bp, Artificial Sequence
  Synthetic
ggcaactacggttacaacgc

SEQ ID NO: 11991 - DNA, 15 bp, Artificial Sequence
  Synthetic
cggcggcgcattcat

SEQ ID NO: 11992 - DNA, 20 bp, Artificial Sequence
  Synthetic
caacacctacggcattgttg

SEQ ID NO: 11993 - DNA, 20 bp, Artificial Sequence
  Synthetic
gacgatgcttttcaagacgc

SEQ ID NO: 11994 - DNA, 16 bp, Artificial Sequence
  Synthetic
cgggcagcgtcatcgt

SEQ ID NO: 11995 - DNA, 17 bp, Artificial Sequence
  Synthetic
ccgtaatgcagcacgcg

SEQ ID NO: 11996 - DNA, 16 bp, Artificial Sequence
  Synthetic
cggtccggttgtgcga

SEQ ID NO: 11997 - DNA, 19 bp, Artificial Sequence
  Synthetic
gccggtgctgtattttgcc

SEQ ID NO: 11998 - DNA, 16 bp, Artificial Sequence
  Synthetic
cgaaatcggggcgcag

SEQ ID NO: 11999 - DNA, 16 bp, Artificial Sequence
  Synthetic
gaatccgtgccgccga

SEQ ID NO: 12000 - DNA, 18 bp, Artificial Sequence
  Synthetic
cggtttgggcgattttgc

SEQ ID NO: 12001 - DNA, 17 bp, Artificial Sequence
  Synthetic
ccggatggcttcgtgga

SEQ ID NO: 12002 - DNA, 18 bp, Artificial Sequence
  Synthetic
gtccttcggtgcgtttgc

SEQ ID NO: 12003 - DNA, 15 bp, Artificial Sequence
  Synthetic
tgtcgcccgcatcga

SEQ ID NO: 12004 - DNA, 20 bp, Artificial Sequence
  Synthetic
tatgctgacctataccccgc

SEQ ID NO: 12005 - DNA, 18 bp, Artificial Sequence
  Synthetic
cacacccttgtggctgtg

SEQ ID NO: 12006 - DNA, 20 bp, Artificial Sequence
  Synthetic
agcgcaatgtgtagttgagt

SEQ ID NO: 12007 - DNA, 20 bp, Artificial Sequence
  Synthetic
cttctttgccgatgacgttc

SEQ ID NO: 12008 - DNA, 19 bp, Artificial Sequence
  Synthetic
ggcttttgtcatacagcgc

SEQ ID NO: 12009 - DNA, 16 bp, Artificial Sequence
  Synthetic
ggaaacaccacgccgc

SEQ ID NO: 12010 - DNA, 15 bp, Artificial Sequence
  Synthetic
cgcgggcaaggcaaa

SEQ ID NO: 12011 - DNA, 17 bp, Artificial Sequence
  Synthetic
cgacaagctgcccgaaa

SEQ ID NO: 12012 - DNA, 17 bp, Artificial Sequence
  Synthetic
tgaccgccaaactgcag

SEQ ID NO: 12013 - DNA, 20 bp, Artificial Sequence
  Synthetic
tgccgaccaattatgccttt

SEQ ID NO: 12014 - DNA, 18 bp, Artificial Sequence
  Synthetic
ttgaatacgccgtcccgc

SEQ ID NO: 12015 - DNA, 18 bp, Artificial Sequence
  Synthetic
cagttcggcggcatcgag

SEQ ID NO: 12016 - DNA, 18 bp, Artificial Sequence
  Synthetic
gcatcggcgatgtcttgc

SEQ ID NO: 12017 - DNA, 17 bp, Artificial Sequence
  Synthetic
cgaggcgttcggattcg

SEQ ID NO: 12018 - DNA, 17 bp, Artificial Sequence
  Synthetic
tgatgcgcccttcgaca

SEQ ID NO: 12019 - DNA, 16 bp, Artificial Sequence
  Synthetic
tcgcgccagttttgca

SEQ ID NO: 12020 - DNA, 17 bp, Artificial Sequence
  Synthetic
cggcgggtttcatcagg

SEQ ID NO: 12021 - DNA, 17 bp, Artificial Sequence
  Synthetic
cccgttgccgtctgaac

SEQ ID NO: 12022 - DNA, 21 bp, Artificial Sequence
  Synthetic
cctgatggagaacctatttcc

SEQ ID NO: 12023 - DNA, 25 bp, Artificial Sequence
  Synthetic
gagttaagtgagttagttatacctg

SEQ ID NO: 12024 - DNA, 20 bp, Artificial Sequence
  Synthetic
cgaaagtatgctaaaagccc

SEQ ID NO: 12025 - DNA, 25 bp, Artificial Sequence
  Synthetic
gtaaaagaatgccaattattgtgtg

SEQ ID NO: 12026 - DNA, 22 bp, Artificial Sequence
  Synthetic
ggatactcaaatttaggtttgc

SEQ ID NO: 12027 - DNA, 21 bp, Artificial Sequence
  Synthetic
caagacgaagatgatatgtgg

SEQ ID NO: 12028 - DNA, 23 bp, Artificial Sequence
  Synthetic
aatcttaacagacttgaaagact

SEQ ID NO: 12029 - DNA, 18 bp, Artificial Sequence
  Synthetic
cactcctattcgcccttc

SEQ ID NO: 12030 - DNA, 25 bp, Artificial Sequence
  Synthetic
ttaagggagtcatttgaaattgaag

SEQ ID NO: 12031 - DNA, 21 bp, Artificial Sequence
  Synthetic
ctttgaacaaccaattcaggg

SEQ ID NO: 12032 - DNA, 25 bp, Artificial Sequence
  Synthetic
aaaccatagatgttcctaaagtttc

SEQ ID NO: 12033 - DNA, 23 bp, Artificial Sequence
  Synthetic
tgcacctcttgaagttattaact

SEQ ID NO: 12034 - DNA, 25 bp, Artificial Sequence
  Synthetic
gaaagtatttgagacatgtagaaga

SEQ ID NO: 12035 - DNA, 22 bp, Artificial Sequence
  Synthetic
ttatcatgcttactaactgtgg

SEQ ID NO: 12036 - DNA, 23 bp, Artificial Sequence
  Synthetic
gattcgaaatggaagattttgtg

SEQ ID NO: 12037 - DNA, 19 bp, Artificial Sequence
  Synthetic
tagagggaagagatcgcac

SEQ ID NO: 12038 - DNA, 23 bp, Artificial Sequence
  Synthetic
caaatgtccaaagaagtaaatgc

SEQ ID NO: 12039 - DNA, 22 bp, Artificial Sequence
  Synthetic
aaatccaaattatctgctgtca

SEQ ID NO: 12040 - DNA, 18 bp, Artificial Sequence
  Synthetic
cgagctgaccgattcaat

SEQ ID NO: 12041 - DNA, 18 bp, Artificial Sequence
  Synthetic
ggaaggcgaaagaccaat

SEQ ID NO: 12042 - DNA, 18 bp, Artificial Sequence
  Synthetic
aatggagatgaggccttg

SEQ ID NO: 12043 - DNA, 20 bp, Artificial Sequence
  Synthetic
gggttgagagtaccccagag

SEQ ID NO: 12044 - DNA, 20 bp, Artificial Sequence
  Synthetic
gtccccacatagcagactcc

SEQ ID NO: 12045 - DNA, 19 bp, Artificial Sequence
  Synthetic
ctcggtaatggcgaatggg

SEQ ID NO: 12046 - DNA, 20 bp, Artificial Sequence
  Synthetic
atcctatgggaatccctggc

SEQ ID NO: 12047 - DNA, 20 bp, Artificial Sequence
  Synthetic
gccgatagctgctttctctt

SEQ ID NO: 12048 - DNA, 24 bp, Artificial Sequence
  Synthetic
atatgttactaaaagggtgtaacc

SEQ ID NO: 12049 - DNA, 23 bp, Artificial Sequence
  Synthetic
atagacgctatacatgttctgtg

SEQ ID NO: 12050 - DNA, 24 bp, Artificial Sequence
  Synthetic
cagaaacacaagtgtaaagaacaa

SEQ ID NO: 12051 - DNA, 21 bp, Artificial Sequence
  Synthetic
gagcagatgttaatggaagac

SEQ ID NO: 12052 - DNA, 20 bp, Artificial Sequence
  Synthetic
tgattatgcagaacaggagg

SEQ ID NO: 12053 - DNA, 23 bp, Artificial Sequence
  Synthetic
tccaaatacatttccatttgaca

SEQ ID NO: 12054 - DNA, 18 bp, Artificial Sequence
  Synthetic
ctcgtgaaggaaacatgc

SEQ ID NO: 12055 - DNA, 25 bp, Artificial Sequence
  Synthetic
attataaaactgatatagggtggtg

SEQ ID NO: 12056 - DNA, 18 bp, Artificial Sequence
  Synthetic
ccagaccaccgaagccta

SEQ ID NO: 12057 - DNA, 21 bp, Artificial Sequence
  Synthetic
gtccgcccattattattgaac

SEQ ID NO: 12058 - DNA, 25 bp, Artificial Sequence
  Synthetic
tagatgaaacacttacatatgcttc

SEQ ID NO: 12059 - DNA, 21 bp, Artificial Sequence
  Synthetic
attcatctgcacctttgtttg

SEQ ID NO: 12060 - DNA, 21 bp, Artificial Sequence
  Synthetic
accactaacttacctgcaata

SEQ ID NO: 12061 - DNA, 19 bp, Artificial Sequence
  Synthetic
cctaaaactggccaaaagg

SEQ ID NO: 12062 - DNA, 20 bp, Artificial Sequence
  Synthetic
gacaacagggacaatgtttc

SEQ ID NO: 12063 - DNA, 22 bp, Artificial Sequence
  Synthetic
atgtctgcagatacatatggaa

SEQ ID NO: 12064 - DNA, 21 bp, Artificial Sequence
  Synthetic
cttctacctcttcctctacca

SEQ ID NO: 12065 - DNA, 20 bp, Artificial Sequence
  Synthetic
tccagtttgttacactccgc

SEQ ID NO: 12066 - DNA, 19 bp, Artificial Sequence
  Synthetic
gagtatcacgcctccggaa

SEQ ID NO: 12067 - DNA, 19 bp, Artificial Sequence
  Synthetic
cctttggggtggattggtg

SEQ ID NO: 12068 - DNA, 20 bp, Artificial Sequence
  Synthetic
caatcctgaccaattgctgc

SEQ ID NO: 12069 - DNA, 24 bp, Artificial Sequence
  Synthetic
actcttatttgagtgagaatgtgt

SEQ ID NO: 12070 - DNA, 24 bp, Artificial Sequence
  Synthetic
ggtctaaagaaatgtttaaacctc

SEQ ID NO: 12071 - DNA, 20 bp, Artificial Sequence
  Synthetic
tggcagggttagttttgtgg

SEQ ID NO: 12072 - DNA, 19 bp, Artificial Sequence
  Synthetic
ccttgtgctggtttgtttc

SEQ ID NO: 12073 - DNA, 16 bp, Artificial Sequence
  Synthetic
gcttggcgtgtgggga

SEQ ID NO: 12074 - DNA, 18 bp, Artificial Sequence
  Synthetic
ggttggctcatcccacag

SEQ ID NO: 12075 - DNA, 19 bp, Artificial Sequence
  Synthetic
ataccatccccagtacaca

SEQ ID NO: 12076 - DNA, 18 bp, Artificial Sequence
  Synthetic
gtgttgggcattggaaag

SEQ ID NO: 12077 - DNA, 19 bp, Artificial Sequence
  Synthetic
ggtatggttcctgaatgca

SEQ ID NO: 12078 - DNA, 19 bp, Artificial Sequence
  Synthetic
ctgcaattgacaagctgaa

SEQ ID NO: 12079 - DNA, 20 bp, Artificial Sequence
  Synthetic
ttggtacatggacatcggtg

SEQ ID NO: 12080 - DNA, 20 bp, Artificial Sequence
  Synthetic
aactttacaaaggacccaga

SEQ ID NO: 12081 - DNA, 19 bp, Artificial Sequence
  Synthetic
gagatccgtcccaggagtg

SEQ ID NO: 12082 - DNA, 21 bp, Artificial Sequence
  Synthetic
aacggcctacaaaaaagaagt

SEQ ID NO: 12083 - DNA, 20 bp, Artificial Sequence
  Synthetic
atgaagtagcagctcacacg

SEQ ID NO: 12084 - DNA, 18 bp, Artificial Sequence
  Synthetic
gtacccgtgtcaagcgtc

SEQ ID NO: 12085 - DNA, 20 bp, Artificial Sequence
  Synthetic
tgctggctgaaggtaaatgc

SEQ ID NO: 12086 - DNA, 18 bp, Artificial Sequence
  Synthetic
cgtgtgttggctgtccat

SEQ ID NO: 12087 - DNA, 18 bp, Artificial Sequence
  Synthetic
gcaaaattggctcgcttc

SEQ ID NO: 12088 - DNA, 17 bp, Artificial Sequence
  Synthetic
tttagggcagcggcaac

SEQ ID NO: 12089 - DNA, 23 bp, Artificial Sequence
  Synthetic
atcaaaagataataacgattggc

SEQ ID NO: 12090 - DNA, 18 bp, Artificial Sequence
  Synthetic
tgccccaaactagcagaa

SEQ ID NO: 12091 - DNA, 23 bp, Artificial Sequence
  Synthetic
gaattaggtgttccatttcatct

SEQ ID NO: 12092 - DNA, 25 bp, Artificial Sequence
  Synthetic
actaaaatactattcattgaggagg

SEQ ID NO: 12093 - DNA, 18 bp, Artificial Sequence
  Synthetic
aaaaacgacagctccagc

SEQ ID NO: 12094 - DNA, 20 bp, Artificial Sequence
  Synthetic
gaaactgttgcagaaaaagc

SEQ ID NO: 12095 - DNA, 19 bp, Artificial Sequence
  Synthetic
ctgaagaggaggagcaaca

SEQ ID NO: 12096 - DNA, 23 bp, Artificial Sequence
  Synthetic
gtgaagctgaatgtattactgat

SEQ ID NO: 12097 - DNA, 22 bp, Artificial Sequence
  Synthetic
aatttctgtggaaggaaaaagt

SEQ ID NO: 12098 - DNA, 25 bp, Artificial Sequence
  Synthetic
ctgtttcagcttgttaaatttcttg

SEQ ID NO: 12099 - DNA, 20 bp, Artificial Sequence
  Synthetic
ttgtctcctcttccagctcc

SEQ ID NO: 12100 - DNA, 18 bp, Artificial Sequence
  Synthetic
acaccagtgaatcagctg

SEQ ID NO: 12101 - DNA, 23 bp, Artificial Sequence
  Synthetic
tttggaagtgtaatttatttggg

SEQ ID NO: 12102 - DNA, 21 bp, Artificial Sequence
  Synthetic
atttgagtatgataatcccgc

SEQ ID NO: 12103 - DNA, 21 bp, Artificial Sequence
  Synthetic
cttacaattaggtcgtggtgg

SEQ ID NO: 12104 - DNA, 23 bp, Artificial Sequence
  Synthetic
cacctattgaattagtcagttca

SEQ ID NO: 12105 - DNA, 24 bp, Artificial Sequence
  Synthetic
aaatcaatatagacatcacacctg

SEQ ID NO: 12106 - DNA, 23 bp, Artificial Sequence
  Synthetic
actattgaaggactagtctatgg

SEQ ID NO: 12107 - DNA, 19 bp, Artificial Sequence
  Synthetic
ggagtatgagatggctgac

SEQ ID NO: 12108 - DNA, 21 bp, Artificial Sequence
  Synthetic
tattggtcggtactaaaacca

SEQ ID NO: 12109 - DNA, 18 bp, Artificial Sequence
  Synthetic
gtgcctgctagatcaagt

SEQ ID NO: 12110 - DNA, 22 bp, Artificial Sequence
  Synthetic
aattcagtgaggttgaaactag

SEQ ID NO: 12111 - DNA, 20 bp, Artificial Sequence
  Synthetic
agaaagcgtctagccatggc

SEQ ID NO: 12112 - DNA, 20 bp, Artificial Sequence
  Synthetic
caaaagaaacaccaaccgcc

SEQ ID NO: 12113 - DNA, 17 bp, Artificial Sequence
  Synthetic
acacgcacctggttgtg

SEQ ID NO: 12114 - DNA, 19 bp, Artificial Sequence
  Synthetic
gcatactttgcgtcaacgg

SEQ ID NO: 12115 - DNA, 19 bp, Artificial Sequence
  Synthetic
gggtttatagccggcctca

SEQ ID NO: 12116 - DNA, 18 bp, Artificial Sequence
  Synthetic
ggcagcaacgagactgac

SEQ ID NO: 12117 - DNA, 18 bp, Artificial Sequence
  Synthetic
catcggaggcctagagca

SEQ ID NO: 12118 - DNA, 20 bp, Artificial Sequence
  Synthetic
tgctcctaatctgtcaggca

SEQ ID NO: 12119 - DNA, 18 bp, Artificial Sequence
  Synthetic
gtgctggtcatgtggtgg

SEQ ID NO: 12120 - DNA, 20 bp, Artificial Sequence
  Synthetic
ttatgaccatcttgccccca

SEQ ID NO: 12121 - DNA, 19 bp, Artificial Sequence
  Synthetic
gccgggacaaaaatgaagc

SEQ ID NO: 12122 - DNA, 17 bp, Artificial Sequence
  Synthetic
tccttgctcagcccgag

SEQ ID NO: 12123 - DNA, 16 bp, Artificial Sequence
  Synthetic
ccgtccgtcgcagcaa

SEQ ID NO: 12124 - DNA, 20 bp, Artificial Sequence
  Synthetic
gaaatccccttctacggcag

SEQ ID NO: 12125 - DNA, 20 bp, Artificial Sequence
  Synthetic
tggacttcagtctggatccc

SEQ ID NO: 12126 - DNA, 20 bp, Artificial Sequence
  Synthetic
agcaacagtctgtgttcgtg

SEQ ID NO: 12127 - DNA, 20 bp, Artificial Sequence
  Synthetic
aataccttgctggcctttcg

SEQ ID NO: 12128 - DNA, 20 bp, Artificial Sequence
  Synthetic
gaactggtaaacctcctgcc

SEQ ID NO: 12129 - DNA, 18 bp, Artificial Sequence
  Synthetic
tttgggactgggtctgca

SEQ ID NO: 12130 - DNA, 20 bp, Artificial Sequence
  Synthetic
taccactacataacgggggt

SEQ ID NO: 12131 - DNA, 18 bp, Artificial Sequence
  Synthetic
gcgcaggctaaatcgagg

SEQ ID NO: 12132 - DNA, 16 bp, Artificial Sequence
  Synthetic
acccgcccctcttgga

SEQ ID NO: 12133 - DNA, 18 bp, Artificial Sequence
  Synthetic
gggaccctgacctttcgt

SEQ ID NO: 12134 - DNA, 20 bp, Artificial Sequence
  Synthetic
ggttaaggccagactactgc

SEQ ID NO: 12135 - DNA, 20 bp, Artificial Sequence
  Synthetic
ccactagtatgggcaacacc

SEQ ID NO: 12136 - DNA, 20 bp, Artificial Sequence
  Synthetic
ggaaactgccaaacactccc

SEQ ID NO: 12137 - DNA, 19 bp, Artificial Sequence
  Synthetic
gggtaccccctttgagagc

SEQ ID NO: 12138 - DNA, 21 bp, Artificial Sequence
  Synthetic
ttttacctacccaggaaaagc

SEQ ID NO: 12139 - DNA, 20 bp, Artificial Sequence
  Synthetic
ctcagtttgcctgtccttca

SEQ ID NO: 12140 - DNA, 18 bp, Artificial Sequence
  Synthetic
accagacacccttcgaaa

SEQ ID NO: 12141 - DNA, 21 bp, Artificial Sequence
  Synthetic
tgcagattatcacaaccactc

SEQ ID NO: 12142 - DNA, 23 bp, Artificial Sequence
  Synthetic
ttgattacaagtctttcaaaacc

SEQ ID NO: 12143 - DNA, 21 bp, Artificial Sequence
  Synthetic
ttctgaacagtcattacgtct

SEQ ID NO: 12144 - DNA, 23 bp, Artificial Sequence
  Synthetic
ttgtgtaaaatgcttcattgatg

SEQ ID NO: 12145 - DNA, 20 bp, Artificial Sequence
  Synthetic
cacaaatggagctatcgttg

SEQ ID NO: 12146 - DNA, 22 bp, Artificial Sequence
  Synthetic
acttatttgatgatgctggtga

SEQ ID NO: 12147 - DNA, 23 bp, Artificial Sequence
  Synthetic
ttaaaacttactgacaatgttgc

SEQ ID NO: 12148 - DNA, 23 bp, Artificial Sequence
  Synthetic
aggcagcatatgaaaatttcaat

SEQ ID NO: 12149 - DNA, 22 bp, Artificial Sequence
  Synthetic
gtaagctttaccatgattctca

SEQ ID NO: 12150 - DNA, 24 bp, Artificial Sequence
  Synthetic
taatgctaaggaagagattctagg

SEQ ID NO: 12151 - DNA, 20 bp, Artificial Sequence
  Synthetic
gctgtatgcgttctcttaaa

SEQ ID NO: 12152 - DNA, 23 bp, Artificial Sequence
  Synthetic
atggtgctgatgttacaaaaatt

SEQ ID NO: 12153 - DNA, 23 bp, Artificial Sequence
  Synthetic
aaactatgacccatcttctacag

SEQ ID NO: 12154 - DNA, 23 bp, Artificial Sequence
  Synthetic
ggtcattacactcatataactgc

SEQ ID NO: 12155 - DNA, 22 bp, Artificial Sequence
  Synthetic
ttaaatcaaatgacaggcttca

SEQ ID NO: 12156 - DNA, 22 bp, Artificial Sequence
  Synthetic
tgaagaagtagtggaaaatcct

SEQ ID NO: 12157 - DNA, 25 bp, Artificial Sequence
  Synthetic
gcttttggtgtactcttatctaatt

SEQ ID NO: 12158 - DNA, 21 bp, Artificial Sequence
  Synthetic
gctagtcatttcatcagcaat

SEQ ID NO: 12159 - DNA, 19 bp, Artificial Sequence
  Synthetic
tgtgacacattttgcactg

SEQ ID NO: 12160 - DNA, 22 bp, Artificial Sequence
  Synthetic
agacgttggagatagtactgaa

SEQ ID NO: 12161 - DNA, 19 bp, Artificial Sequence
  Synthetic
tcttggcgcatgtattgac

SEQ ID NO: 12162 - DNA, 24 bp, Artificial Sequence
  Synthetic
tatgccagtacatacattgtcaat

SEQ ID NO: 12163 - DNA, 19 bp, Artificial Sequence
  Synthetic
ttcttgctgctgagtgtac

SEQ ID NO: 12164 - DNA, 24 bp, Artificial Sequence
  Synthetic
cgatgaatctcatagctaacatct

SEQ ID NO: 12165 - DNA, 25 bp, Artificial Sequence
  Synthetic
taggaaaagagtcatgtttaatgga

SEQ ID NO: 12166 - DNA, 20 bp, Artificial Sequence
  Synthetic
atgactttagcaactcaggt

SEQ ID NO: 12167 - DNA, 21 bp, Artificial Sequence
  Synthetic
gtgttattggccattctatgc

SEQ ID NO: 12168 - DNA, 23 bp, Artificial Sequence
  Synthetic
tatcaatggtgataggtggtttc

SEQ ID NO: 12169 - DNA, 25 bp, Artificial Sequence
  Synthetic
gtaagttcaagaaaattgttaaggg

SEQ ID NO: 12170 - DNA, 23 bp, Artificial Sequence
  Synthetic
tgtcattacacttgtttacaaag

SEQ ID NO: 12171 - DNA, 23 bp, Artificial Sequence
  Synthetic
tggtctctacacaagaatttagg

SEQ ID NO: 12172 - DNA, 21 bp, Artificial Sequence
  Synthetic
ttgcaaaagacacaactgaag

SEQ ID NO: 12173 - DNA, 19 bp, Artificial Sequence
  Synthetic
agttggaaaagatggcaga

SEQ ID NO: 12174 - DNA, 25 bp, Artificial Sequence
  Synthetic
gttcaacttagtgaaattaacatgg

SEQ ID NO: 12175 - DNA, 23 bp, Artificial Sequence
  Synthetic
ggcttaaacaacctaaatagagg

SEQ ID NO: 12176 - DNA, 20 bp, Artificial Sequence
  Synthetic
cacattgaccatccaaatcc

SEQ ID NO: 12177 - DNA, 23 bp, Artificial Sequence
  Synthetic
gcatactatgtctaactaccaac

SEQ ID NO: 12178 - DNA, 22 bp, Artificial Sequence
  Synthetic
catcttacgcgtatatgctaac

SEQ ID NO: 12179 - DNA, 23 bp, Artificial Sequence
  Synthetic
gctgaaatatgattttacggaag

SEQ ID NO: 12180 - DNA, 18 bp, Artificial Sequence
  Synthetic
catgcagcttctggcaat

SEQ ID NO: 12181 - DNA, 21 bp, Artificial Sequence
  Synthetic
gcgtatactaagcgtaatgtc

SEQ ID NO: 12182 - DNA, 21 bp, Artificial Sequence
  Synthetic
cttaggataatggcctctctt

SEQ ID NO: 12183 - DNA, 25 bp, Artificial Sequence
  Synthetic
tgtctctatagaaatagggatgttg

SEQ ID NO: 12184 - DNA, 25 bp, Artificial Sequence
  Synthetic
atgatattgtcaaaacagatggtac

SEQ ID NO: 12185 - DNA, 18 bp, Artificial Sequence
  Synthetic
gttgcggtgcctgtatta

SEQ ID NO: 12186 - DNA, 20 bp, Artificial Sequence
  Synthetic
tgctggcgattacatacttg

SEQ ID NO: 12187 - DNA, 20 bp, Artificial Sequence
  Synthetic
acatctcacactgtaatgcc

SEQ ID NO: 12188 - DNA, 24 bp, Artificial Sequence
  Synthetic
caaagtgaattcaacactagaaca

SEQ ID NO: 12189 - DNA, 23 bp, Artificial Sequence
  Synthetic
tgtgagtgctttagtttatgaca

SEQ ID NO: 12190 - DNA, 18 bp, Artificial Sequence
  Synthetic
ccgcttcaatgtggctat

SEQ ID NO: 12191 - DNA, 22 bp, Artificial Sequence
  Synthetic
gggtttcaaaatgaattaccaa

SEQ ID NO: 12192 - DNA, 25 bp, Artificial Sequence
  Synthetic
atgtagtgcgtattaagatagtaca

SEQ ID NO: 12193 - DNA, 18 bp, Artificial Sequence
  Synthetic
cgcgttgattggtctgtt

SEQ ID NO: 12194 - DNA, 18 bp, Artificial Sequence
  Synthetic
gttgatcgttacccagcc

SEQ ID NO: 12195 - DNA, 19 bp, Artificial Sequence
  Synthetic
taccgacagtacttggatg

SEQ ID NO: 12196 - DNA, 23 bp, Artificial Sequence
  Synthetic
agcacatgtatctacaataggtg

SEQ ID NO: 12197 - DNA, 22 bp, Artificial Sequence
  Synthetic
agagcagagacttagaggattt

SEQ ID NO: 12198 - DNA, 24 bp, Artificial Sequence
  Synthetic
atcttttacttgatgactttgtcg

SEQ ID NO: 12199 - DNA, 18 bp, Artificial Sequence
  Synthetic
taaaggagttgcaccagg

SEQ ID NO: 12200 - DNA, 19 bp, Artificial Sequence
  Synthetic
gcttatgggccatttctca

SEQ ID NO: 12201 - DNA, 25 bp, Artificial Sequence
  Synthetic
tctactaatgttgttatacgagcat

SEQ ID NO: 12202 - DNA, 21 bp, Artificial Sequence
  Synthetic
tttagagccattcttacagcc

SEQ ID NO: 12203 - DNA, 24 bp, Artificial Sequence
  Synthetic
ctaattgtgttgctgattactctg

SEQ ID NO: 12204 - DNA, 23 bp, Artificial Sequence
  Synthetic
tataggtatcttagacatggcaa

SEQ ID NO: 12205 - DNA, 21 bp, Artificial Sequence
  Synthetic
ctgatttcactgattccgttc

SEQ ID NO: 12206 - DNA, 22 bp, Artificial Sequence
  Synthetic
tttgtgctagttaccatacagt

SEQ ID NO: 12207 - DNA, 21 bp, Artificial Sequence
  Synthetic
gaccctctaaagccaactaag

SEQ ID NO: 12208 - DNA, 21 bp, Artificial Sequence
  Synthetic
ttggagttacccaaaatgttc

SEQ ID NO: 12209 - DNA, 19 bp, Artificial Sequence
  Synthetic
ttctgctaatcttgctgct

SEQ ID NO: 12210 - DNA, 23 bp, Artificial Sequence
  Synthetic
atacatttgtctcaggaaattgt

SEQ ID NO: 12211 - DNA, 20 bp, Artificial Sequence
  Synthetic
gcttcattgctggactaatt

SEQ ID NO: 12212 - DNA, 18 bp, Artificial Sequence
  Synthetic
ggatggcttgttattggc

SEQ ID NO: 12213 - DNA, 22 bp, Artificial Sequence
  Synthetic
caaaactcaaagaagactacca

SEQ ID NO: 12214 - DNA, 24 bp, Artificial Sequence
  Synthetic
aaagtgagtacgaacttatgtact

SEQ ID NO: 12215 - DNA, 21 bp, Artificial Sequence
  Synthetic
attaccgttgaggagcttaaa

SEQ ID NO: 12216 - DNA, 20 bp, Artificial Sequence
  Synthetic
ggggacaattgtgaccagac

SEQ ID NO: 12217 - DNA, 25 bp, Artificial Sequence
  Synthetic
ggagttagattatccataaaacgaa

SEQ ID NO: 12218 - DNA, 24 bp, Artificial Sequence
  Synthetic
catgaaacttctcattgttttgac

SEQ ID NO: 12219 - DNA, 20 bp, Artificial Sequence
  Synthetic
tggaccccaatcaaaccaac

SEQ ID NO: 12220 - DNA, 19 bp, Artificial Sequence
  Synthetic
taggaactggcccagaagc

SEQ ID NO: 12221 - DNA, 20 bp, Artificial Sequence
  Synthetic
tgctagacagattgaaccag

SEQ ID NO: 12222 - DNA, 18 bp, Artificial Sequence
  Synthetic
gggaacatggctgactta

SEQ ID NO: 12223 - DNA, 20 bp, Artificial Sequence
  Synthetic
cagatgggctatgtaaacgt

SEQ ID NO: 12224 - DNA, 19 bp, Artificial Sequence
  Synthetic
ttaaaactgggagtgggtt

SEQ ID NO: 12225 - DNA, 18 bp, Artificial Sequence
  Synthetic
aattgggttggtcgctcc

SEQ ID NO: 12226 - DNA, 18 bp, Artificial Sequence
  Synthetic
gtaatgcgtaagtgcggg

SEQ ID NO: 12227 - DNA, 25 bp, Artificial Sequence
  Synthetic
tcaagaccctagtaaatttactgat

SEQ ID NO: 12228 - DNA, 21 bp, Artificial Sequence
  Synthetic
catccaacagattctacacct

SEQ ID NO: 12229 - DNA, 18 bp, Artificial Sequence
  Synthetic
ggtacaatcacacccacc

SEQ ID NO: 12230 - DNA, 24 bp, Artificial Sequence
  Synthetic
acacaatccatacctataacagta

SEQ ID NO: 12231 - DNA, 24 bp, Artificial Sequence
  Synthetic
cactcattcctgttaacaatacac

SEQ ID NO: 12232 - DNA, 25 bp, Artificial Sequence
  Synthetic
tgaaactattaattgcatacactcc

SEQ ID NO: 12233 - DNA, 18 bp, Artificial Sequence
  Synthetic
atggtgtgcatggtttct

SEQ ID NO: 12234 - DNA, 25 bp, Artificial Sequence
  Synthetic
aatgatagtggacatatagtattgc

SEQ ID NO: 12235 - DNA, 25 bp, Artificial Sequence
  Synthetic
accatatgtgttagaatagtgacat

SEQ ID NO: 12236 - DNA, 25 bp, Artificial Sequence
  Synthetic
cttcatctctttaattctgatcttg

SEQ ID NO: 12237 - DNA, 23 bp, Artificial Sequence
  Synthetic
gattgtggaggaaaactattgtg

SEQ ID NO: 12238 - DNA, 24 bp, Artificial Sequence
  Synthetic
taatggtaaggaatagttctgatc

SEQ ID NO: 12239 - DNA, 23 bp, Artificial Sequence
  Synthetic
aaccagttgcagttctaatacat

SEQ ID NO: 12240 - DNA, 23 bp, Artificial Sequence
  Synthetic
gcagatcttccagataaaggaaa

SEQ ID NO: 12241 - DNA, 25 bp, Artificial Sequence
  Synthetic
agtgttctattgaaagagatttagg

SEQ ID NO: 12242 - DNA, 20 bp, Artificial Sequence
  Synthetic
aaattcacaggtcttggcat

SEQ ID NO: 12243 - DNA, 24 bp, Artificial Sequence
  Synthetic
taacatcttattgagtggtaccaa

SEQ ID NO: 12244 - DNA, 25 bp, Artificial Sequence
  Synthetic
gtcatagaagctaatagtgtgaatg

SEQ ID NO: 12245 - DNA, 19 bp, Artificial Sequence
  Synthetic
tcttgccaaagaaggagaa

SEQ ID NO: 12246 - DNA, 22 bp, Artificial Sequence
  Synthetic
ttaagtgacgaatcattgtcag

SEQ ID NO: 12247 - DNA, 23 bp, Artificial Sequence
  Synthetic
gttcatataactcctgaaaaagc

SEQ ID NO: 12248 - DNA, 25 bp, Artificial Sequence
  Synthetic
catgaataagtctagtcatttttgg

SEQ ID NO: 12249 - DNA, 24 bp, Artificial Sequence
  Synthetic
tttagatcttacttctgaagatgc

SEQ ID NO: 12250 - DNA, 25 bp, Artificial Sequence
  Synthetic
taaagaacatactggagatattgtg

SEQ ID NO: 12251 - DNA, 23 bp, Artificial Sequence
  Synthetic
tgaaatgctggagaaatagatgt

SEQ ID NO: 12252 - DNA, 23 bp, Artificial Sequence
  Synthetic
aaatgctggtaaacctattcaag

SEQ ID NO: 12253 - DNA, 25 bp, Artificial Sequence
  Synthetic
atcttcaggagtttgaaatagaaga

SEQ ID NO: 12254 - DNA, 25 bp, Artificial Sequence
  Synthetic
ctcatatagtagtgacaagtaccac

SEQ ID NO: 12255 - DNA, 23 bp, Artificial Sequence
  Synthetic
aggtctctgctaatcaatatagg

SEQ ID NO: 12256 - DNA, 20 bp, Artificial Sequence
  Synthetic
ggatagatccgcagtacctt

SEQ ID NO: 12257 - DNA, 23 bp, Artificial Sequence
  Synthetic
tgaggagtttgaaattgaaatgg

SEQ ID NO: 12258 - DNA, 18 bp, Artificial Sequence
  Synthetic
ctggacttgagcctggaa

SEQ ID NO: 12259 - DNA, 18 bp, Artificial Sequence
  Synthetic
cgcacagagtgtagactt

SEQ ID NO: 12260 - DNA, 20 bp, Artificial Sequence
  Synthetic
aattggagaactgtctgtca

SEQ ID NO: 12261 - DNA, 22 bp, Artificial Sequence
  Synthetic
ctcaaattactgatgaatgcga

SEQ ID NO: 12262 - DNA, 21 bp, Artificial Sequence
  Synthetic
ctcgctgttcaattagatctg

SEQ ID NO: 12263 - DNA, 22 bp, Artificial Sequence
  Synthetic
aatattttctgaggatgcagac

SEQ ID NO: 12264 - DNA, 20 bp, Artificial Sequence
  Synthetic
actaccaactaccaccaccg

SEQ ID NO: 12265 - DNA, 20 bp, Artificial Sequence
  Synthetic
cgtgcacctgaaattactgt

SEQ ID NO: 12266 - DNA, 18 bp, Artificial Sequence
  Synthetic
ctttgagtagcacaccca

SEQ ID NO: 12267 - DNA, 18 bp, Artificial Sequence
  Synthetic
cacccgtgagtatcttgc

SEQ ID NO: 12268 - DNA, 21 bp, Artificial Sequence
  Synthetic
agaagcacgcactttcttaaa

SEQ ID NO: 12269 - DNA, 19 bp, Artificial Sequence
  Synthetic
ggagattcatcacagagcc

SEQ ID NO: 12270 - DNA, 18 bp, Artificial Sequence
  Synthetic
ccatagcagagcagcaag

SEQ ID NO: 12271 - DNA, 21 bp, Artificial Sequence
  Synthetic
agcaaaagcagggtagataat

SEQ ID NO: 12272 - DNA, 20 bp, Artificial Sequence
  Synthetic
aaggacccaaagaaaactgg

SEQ ID NO: 12273 - DNA, 20 bp, Artificial Sequence
  Synthetic
atgatggatcaggtacggga

SEQ ID NO: 12274 - DNA, 23 bp, Artificial Sequence
  Synthetic
atgagaatccagcacataaaagt

SEQ ID NO: 12275 - DNA, 25 bp, Artificial Sequence
  Synthetic
attagctcagagtcaattaaaacag

SEQ ID NO: 12276 - DNA, 25 bp, Artificial Sequence
  Synthetic
actttattcaaggagatgaaaatcg

SEQ ID NO: 12277 - DNA, 23 bp, Artificial Sequence
  Synthetic
tagtctggttgctaatttcaaac

SEQ ID NO: 12278 - DNA, 25 bp, Artificial Sequence
  Synthetic
gaattttcagcagtatttacagatg

SEQ ID NO: 12279 - DNA, 25 bp, Artificial Sequence
  Synthetic
gataatataagtggagaaaagggaa

SEQ ID NO: 12280 - DNA, 21 bp, Artificial Sequence
  Synthetic
ttaacagcaggtattgtaggc

SEQ ID NO: 12281 - DNA, 24 bp, Artificial Sequence
  Synthetic
tcttagctgatttagagtcaatca

SEQ ID NO: 12282 - DNA, 24 bp, Artificial Sequence
  Synthetic
aatgctgaagtagttgttatctca

SEQ ID NO: 12283 - DNA, 18 bp, Artificial Sequence
  Synthetic
acattccagcccttttgg

SEQ ID NO: 12284 - DNA, 19 bp, Artificial Sequence
  Synthetic
tacgtagtaagggttcagc

SEQ ID NO: 12285 - DNA, 24 bp, Artificial Sequence
  Synthetic
agctatagcctttatcatttttcg

SEQ ID NO: 12286 - DNA, 20 bp, Artificial Sequence
  Synthetic
ctgaatattgcggtaccatc

SEQ ID NO: 12287 - DNA, 21 bp, Artificial Sequence
  Synthetic
cttcaggcgtttttttaaggt

SEQ ID NO: 12288 - DNA, 23 bp, Artificial Sequence
  Synthetic
aggtggtaagctgatgattaatc

SEQ ID NO: 12289 - DNA, 20 bp, Artificial Sequence
  Synthetic
aatgccagagatgagttgag

SEQ ID NO: 12290 - DNA, 24 bp, Artificial Sequence
  Synthetic
gaaaaaggagaagtttctatgact

SEQ ID NO: 12291 - DNA, 23 bp, Artificial Sequence
  Synthetic
aacgctgatattgttttagttgg

SEQ ID NO: 12292 - DNA, 19 bp, Artificial Sequence
  Synthetic
ggtgaacctttactcgttg

SEQ ID NO: 12293 - DNA, 23 bp, Artificial Sequence
  Synthetic
tgatgacattgatttgattgaag

SEQ ID NO: 12294 - DNA, 25 bp, Artificial Sequence
  Synthetic
ctatcagtcatattaaagatggtga

SEQ ID NO: 12295 - DNA, 23 bp, Artificial Sequence
  Synthetic
catcttagacatactagcaggat

SEQ ID NO: 12296 - DNA, 23 bp, Artificial Sequence
  Synthetic
ccaccagacctttaaaaagaaac

SEQ ID NO: 12297 - DNA, 22 bp, Artificial Sequence
  Synthetic
tatagctaaatcatcctcgtgg

SEQ ID NO: 12298 - DNA, 25 bp, Artificial Sequence
  Synthetic
tctgtattaggataagtattagctc

SEQ ID NO: 12299 - DNA, 20 bp, Artificial Sequence
  Synthetic
tttagcttgcccttagaaac

SEQ ID NO: 12300 - DNA, 23 bp, Artificial Sequence
  Synthetic
tttaggggtgacttttatgaaga

SEQ ID NO: 12301 - DNA, 22 bp, Artificial Sequence
  Synthetic
atacttatactcttcgcgatgg

SEQ ID NO: 12302 - DNA, 18 bp, Artificial Sequence
  Synthetic
tggtacaaccgatccatc

SEQ ID NO: 12303 - DNA, 22 bp, Artificial Sequence
  Synthetic
tttaacatggaatttgaaccgt

SEQ ID NO: 12304 - DNA, 25 bp, Artificial Sequence
  Synthetic
atggtttctataatcctgaaaaagc

SEQ ID NO: 12305 - DNA, 19 bp, Artificial Sequence
  Synthetic
acaaagcagtgctattcgt

SEQ ID NO: 12306 - DNA, 23 bp, Artificial Sequence
  Synthetic
aaataaaaaggaagcagagatga

SEQ ID NO: 12307 - DNA, 20 bp, Artificial Sequence
  Synthetic
acggtcaggcaacgaatttg

SEQ ID NO: 12308 - DNA, 18 bp, Artificial Sequence
  Synthetic
agcacaaaaagctgtagc

SEQ ID NO: 12309 - DNA, 19 bp, Artificial Sequence
  Synthetic
ggaaacagcgattctatgc

SEQ ID NO: 12310 - DNA, 22 bp, Artificial Sequence
  Synthetic
tgatgatatcactttgcttgac

SEQ ID NO: 12311 - DNA, 20 bp, Artificial Sequence
  Synthetic
ttgagtgtatgtgggacatg

SEQ ID NO: 12312 - DNA, 20 bp, Artificial Sequence
  Synthetic
ctgtagaaatgcgacgctat

SEQ ID NO: 12313 - DNA, 18 bp, Artificial Sequence
  Synthetic
aaagcagcacatacggta

SEQ ID NO: 12314 - DNA, 23 bp, Artificial Sequence
  Synthetic
gtcaacctcattttaaagaacaa

SEQ ID NO: 12315 - DNA, 22 bp, Artificial Sequence
  Synthetic
cattcaatgtaatgggattggt

SEQ ID NO: 12316 - DNA, 18 bp, Artificial Sequence
  Synthetic
ccaagcggctaaaaatgg

SEQ ID NO: 12317 - DNA, 19 bp, Artificial Sequence
  Synthetic
caaaggttttggttgggga

SEQ ID NO: 12318 - DNA, 19 bp, Artificial Sequence
  Synthetic
ttttgacgaggaaaggagg

SEQ ID NO: 12319 - DNA, 20 bp, Artificial Sequence
  Synthetic
gtcaggtttattatgaccgc

SEQ ID NO: 12320 - DNA, 23 bp, Artificial Sequence
  Synthetic
gacatgtttgatagaaaaaaggc

SEQ ID NO: 12321 - DNA, 21 bp, Artificial Sequence
  Synthetic
gaagatcagctctatcacagt

SEQ ID NO: 12322 - DNA, 21 bp, Artificial Sequence
  Synthetic
tattttagcaggagcacagtt

SEQ ID NO: 12323 - DNA, 25 bp, Artificial Sequence
  Synthetic
aagaattatggaaagagttgttagg

SEQ ID NO: 12324 - DNA, 19 bp, Artificial Sequence
  Synthetic
caaagcagccaatctgaca

SEQ ID NO: 12325 - DNA, 23 bp, Artificial Sequence
  Synthetic
aacaagaaaattagtcgttgctg

SEQ ID NO: 12326 - DNA, 25 bp, Artificial Sequence
  Synthetic
aaagtgaccaaaaatattagtgacc

SEQ ID NO: 12327 - DNA, 24 bp, Artificial Sequence
  Synthetic
tgaaacacatgtcaaaaacagtag

SEQ ID NO: 12328 - DNA, 24 bp, Artificial Sequence
  Synthetic
cggatttctgtcaataattcttct

SEQ ID NO: 12329 - DNA, 23 bp, Artificial Sequence
  Synthetic
agtaaacaaaatccaatggaatc

SEQ ID NO: 12330 - DNA, 25 bp, Artificial Sequence
  Synthetic
ggggatgtttttaaatttattgagg

SEQ ID NO: 12331 - DNA, 23 bp, Artificial Sequence
  Synthetic
tcaagctctttctaaaaaatacg

SEQ ID NO: 12332 - DNA, 18 bp, Artificial Sequence
  Synthetic
ggaagggtttatggacgt

SEQ ID NO: 12333 - DNA, 23 bp, Artificial Sequence
  Synthetic
gcaatcacaaattgtttatgtgg

SEQ ID NO: 12334 - DNA, 21 bp, Artificial Sequence
  Synthetic
tagctcttggtgagattgatg

SEQ ID NO: 12335 - DNA, 23 bp, Artificial Sequence
  Synthetic
caatttcaagcaaccttaacaga

SEQ ID NO: 12336 - DNA, 23 bp, Artificial Sequence
  Synthetic
cttgagacgtttaatcattgacc

SEQ ID NO: 12337 - DNA, 19 bp, Artificial Sequence
  Synthetic
tatcacaccaccaccaagt

SEQ ID NO: 12338 - DNA, 21 bp, Artificial Sequence
  Synthetic
gcaaggagaatgtgaagacat

SEQ ID NO: 12339 - DNA, 18 bp, Artificial Sequence
  Synthetic
tggatgtttgattgcggt

SEQ ID NO: 12340 - DNA, 22 bp, Artificial Sequence
  Synthetic
gataagtttgaggtctatgcag

SEQ ID NO: 12341 - DNA, 18 bp, Artificial Sequence
  Synthetic
ccacctatggtaagggtg

SEQ ID NO: 12342 - DNA, 22 bp, Artificial Sequence
  Synthetic
cagcttgattttattaggacgt

SEQ ID NO: 12343 - DNA, 25 bp, Artificial Sequence
  Synthetic
tcaccttattaatattgtgtccatg

SEQ ID NO: 12344 - DNA, 24 bp, Artificial Sequence
  Synthetic
cttctttaagctagcaaagacaaa

SEQ ID NO: 12345 - DNA, 19 bp, Artificial Sequence
  Synthetic
aggaaaaagcagaagcagc

SEQ ID NO: 12346 - DNA, 18 bp, Artificial Sequence
  Synthetic
gcgagcagttgaagtagc

SEQ ID NO: 12347 - DNA, 22 bp, Artificial Sequence
  Synthetic
atggggattttaaatgtgactc

SEQ ID NO: 12348 - DNA, 18 bp, Artificial Sequence
  Synthetic
caggtttgtacgacggtc

SEQ ID NO: 12349 - DNA, 18 bp, Artificial Sequence
  Synthetic
cggcaacaccaaagctaa

SEQ ID NO: 12350 - DNA, 21 bp, Artificial Sequence
  Synthetic
gggatggtgtttgatagtgtc

SEQ ID NO: 12351 - DNA, 18 bp, Artificial Sequence
  Synthetic
gccaggctgattttctca

SEQ ID NO: 12352 - DNA, 23 bp, Artificial Sequence
  Synthetic
acttcatgggattgatattcgag

SEQ ID NO: 12353 - DNA, 23 bp, Artificial Sequence
  Synthetic
gccaaattccatagtttaacagg

SEQ ID NO: 12354 - DNA, 23 bp, Artificial Sequence
  Synthetic
aaacaacctttagaatttccatc

SEQ ID NO: 12355 - DNA, 24 bp, Artificial Sequence
  Synthetic
ggtcatttgaggaagattaaagac

SEQ ID NO: 12356 - DNA, 25 bp, Artificial Sequence
  Synthetic
ctaaaatagctacaataattccagc

SEQ ID NO: 12357 - DNA, 20 bp, Artificial Sequence
  Synthetic
tctccaaaagctcttgccat

SEQ ID NO: 12358 - DNA, 18 bp, Artificial Sequence
  Synthetic
ccaaccaaaagctcaacc

SEQ ID NO: 12359 - DNA, 19 bp, Artificial Sequence
  Synthetic
aaagccagacacaaaaacg

SEQ ID NO: 12360 - DNA, 18 bp, Artificial Sequence
  Synthetic
agccacgttcttagcatt

SEQ ID NO: 12361 - DNA, 22 bp, Artificial Sequence
  Synthetic
tactgagattggaaaccttgac

SEQ ID NO: 12362 - DNA, 23 bp, Artificial Sequence
  Synthetic
cgctaaaatcttaaccctttagg

SEQ ID NO: 12363 - DNA, 18 bp, Artificial Sequence
  Synthetic
agaccatctggcaagagg

SEQ ID NO: 12364 - DNA, 22 bp, Artificial Sequence
  Synthetic
catcttcattttcttcaggagc

SEQ ID NO: 12365 - DNA, 19 bp, Artificial Sequence
  Synthetic
tagacaccactgctggaaa

SEQ ID NO: 12366 - DNA, 22 bp, Artificial Sequence
  Synthetic
taacacgtctaacaggaacttg

SEQ ID NO: 12367 - DNA, 22 bp, Artificial Sequence
  Synthetic
attctttttccttttctagggc

SEQ ID NO: 12368 - DNA, 22 bp, Artificial Sequence
  Synthetic
tgtaaagagtttagttgggtct

SEQ ID NO: 12369 - DNA, 25 bp, Artificial Sequence
  Synthetic
accatcacataatacttaatgtcga

SEQ ID NO: 12370 - DNA, 19 bp, Artificial Sequence
  Synthetic
aacatcaaccctaacccca

SEQ ID NO: 12371 - DNA, 22 bp, Artificial Sequence
  Synthetic
ggtacaaagtttcaaaagaagc

SEQ ID NO: 12372 - DNA, 21 bp, Artificial Sequence
  Synthetic
tttagtcatgacacagccttt

SEQ ID NO: 12373 - DNA, 18 bp, Artificial Sequence
  Synthetic
ggttgttccttgtgcttg

SEQ ID NO: 12374 - DNA, 20 bp, Artificial Sequence
  Synthetic
agttatctcttgagcagtga

SEQ ID NO: 12375 - DNA, 22 bp, Artificial Sequence
  Synthetic
tgtctaaagcagtcaataaggt

SEQ ID NO: 12376 - DNA, 21 bp, Artificial Sequence
  Synthetic
tatcatagaagactgtctgca

SEQ ID NO: 12377 - DNA, 22 bp, Artificial Sequence
  Synthetic
taagtttcagagacttgaccaa

SEQ ID NO: 12378 - DNA, 25 bp, Artificial Sequence
  Synthetic
ttctttagtattcatgactccattc

SEQ ID NO: 12379 - DNA, 20 bp, Artificial Sequence
  Synthetic
attgtaaaggcgtgtttcac

SEQ ID NO: 12380 - DNA, 22 bp, Artificial Sequence
  Synthetic
tttgtattttgtcccaacattg

SEQ ID NO: 12381 - DNA, 21 bp, Artificial Sequence
  Synthetic
tgatgctgtaacggtaaatgg

SEQ ID NO: 12382 - DNA, 20 bp, Artificial Sequence
  Synthetic
tttgaaatcatctcgctgtt

SEQ ID NO: 12383 - DNA, 21 bp, Artificial Sequence
  Synthetic
acgttttttgtaaagctctgc

SEQ ID NO: 12384 - DNA, 18 bp, Artificial Sequence
  Synthetic
ctcatcatctcccgcttg

SEQ ID NO: 12385 - DNA, 18 bp, Artificial Sequence
  Synthetic
aaccgtccataaccctga

SEQ ID NO: 12386 - DNA, 24 bp, Artificial Sequence
  Synthetic
aatacaatcaaccaagttagttcg

SEQ ID NO: 12387 - DNA, 19 bp, Artificial Sequence
  Synthetic
tgaccctctgcttgtaagg

SEQ ID NO: 12388 - DNA, 19 bp, Artificial Sequence
  Synthetic
tcatcttgaggggggcttc

SEQ ID NO: 12389 - DNA, 20 bp, Artificial Sequence
  Synthetic
actcttgggggagataagcc

SEQ ID NO: 12390 - DNA, 19 bp, Artificial Sequence
  Synthetic
ttgcgctaaaccctcctct

SEQ ID NO: 12391 - DNA, 20 bp, Artificial Sequence
  Synthetic
ctactaaaattcgctcccca

SEQ ID NO: 12392 - DNA, 21 bp, Artificial Sequence
  Synthetic
accttcttcacacatagaacg

SEQ ID NO: 12393 - DNA, 18 bp, Artificial Sequence
  Synthetic
cggctccgtctcttcaac

SEQ ID NO: 12394 - DNA, 18 bp, Artificial Sequence
  Synthetic
gatggagcctagcgggat

SEQ ID NO: 12395 - DNA, 20 bp, Artificial Sequence
  Synthetic
tcaaagcctttaccttcagt

SEQ ID NO: 12396 - DNA, 18 bp, Artificial Sequence
  Synthetic
ttggaagcgaccaagagt

SEQ ID NO: 12397 - DNA, 20 bp, Artificial Sequence
  Synthetic
cttttacagcttcgacaact

SEQ ID NO: 12398 - DNA, 22 bp, Artificial Sequence
  Synthetic
taattttttggtcaaagtcgtc

SEQ ID NO: 12399 - DNA, 24 bp, Artificial Sequence
  Synthetic
taatagagattactgtttctgggt

SEQ ID NO: 12400 - DNA, 21 bp, Artificial Sequence
  Synthetic
tagtttaatcagcaagcgaaa

SEQ ID NO: 12401 - DNA, 24 bp, Artificial Sequence
  Synthetic
cttttttaacatcatctgtcaacc

SEQ ID NO: 12402 - DNA, 24 bp, Artificial Sequence
  Synthetic
gccattatcagtgaacttcataat

SEQ ID NO: 12403 - DNA, 22 bp, Artificial Sequence
  Synthetic
tctatgacactattatccagca

SEQ ID NO: 12404 - DNA, 24 bp, Artificial Sequence
  Synthetic
ggagtgctctacaaaatacttaaa

SEQ ID NO: 12405 - DNA, 21 bp, Artificial Sequence
  Synthetic
aagtcgttaaagcagacaatg

SEQ ID NO: 12406 - DNA, 23 bp, Artificial Sequence
  Synthetic
atgggtagatcaaaacaacaaac

SEQ ID NO: 12407 - DNA, 19 bp, Artificial Sequence
  Synthetic
accgcttctgcttttcaat

SEQ ID NO: 12408 - DNA, 18 bp, Artificial Sequence
  Synthetic
ccggcactcctatctttg

SEQ ID NO: 12409 - DNA, 22 bp, Artificial Sequence
  Synthetic
tactaaccgttaagagtattgc

SEQ ID NO: 12410 - DNA, 21 bp, Artificial Sequence
  Synthetic
accgtcatgaacaattagacc

SEQ ID NO: 12411 - DNA, 18 bp, Artificial Sequence
  Synthetic
atccagacgctttcccaa

SEQ ID NO: 12412 - DNA, 21 bp, Artificial Sequence
  Synthetic
tgaccttaattcaagcctttg

SEQ ID NO: 12413 - DNA, 18 bp, Artificial Sequence
  Synthetic
aagtgggcatgtcaacct

SEQ ID NO: 12414 - DNA, 22 bp, Artificial Sequence
  Synthetic
caggttcaacttttgatagcat

SEQ ID NO: 12415 - DNA, 21 bp, Artificial Sequence
  Synthetic
ttttgaaaacttgctggaatc

SEQ ID NO: 12416 - DNA, 18 bp, Artificial Sequence
  Synthetic
tttggtctggcaaagcac

SEQ ID NO: 12417 - DNA, 25 bp, Artificial Sequence
  Synthetic
cgtttatctggtatgatagttttac

SEQ ID NO: 12418 - DNA, 18 bp, Artificial Sequence
  Synthetic
cagggggggaaatctttg

SEQ ID NO: 12419 - DNA, 18 bp, Artificial Sequence
  Synthetic
acgatgctaaagccttct

SEQ ID NO: 12420 - DNA, 22 bp, Artificial Sequence
  Synthetic
gtgctaatacactctttgctaa

SEQ ID NO: 12421 - DNA, 24 bp, Artificial Sequence
  Synthetic
ctgcaagctatctaaaatagtcaa

SEQ ID NO: 12422 - DNA, 25 bp, Artificial Sequence
  Synthetic
atccgttagataatgattttcatcg

SEQ ID NO: 12423 - DNA, 18 bp, Artificial Sequence
  Synthetic
aatcaagtgcgcaggatg

SEQ ID NO: 12424 - DNA, 22 bp, Artificial Sequence
  Synthetic
ctttttcaattgaccatcctga

SEQ ID NO: 12425 - DNA, 17 bp, Artificial Sequence
  Synthetic
gcaacccccgatggaga

SEQ ID NO: 12426 - DNA, 20 bp, Artificial Sequence
  Synthetic
ttcttccacctgacggtaga

SEQ ID NO: 12427 - DNA, 20 bp, Artificial Sequence
  Synthetic
ccttgcacgatctacatccg

SEQ ID NO: 12428 - DNA, 18 bp, Artificial Sequence
  Synthetic
ctgctgtgcactcgtcat

SEQ ID NO: 12429 - DNA, 19 bp, Artificial Sequence
  Synthetic
cttgcgaggcatctccttt

SEQ ID NO: 12430 - DNA, 19 bp, Artificial Sequence
  Synthetic
gctattggccaaggtgtgt

SEQ ID NO: 12431 - DNA, 20 bp, Artificial Sequence
  Synthetic
ttagaggactcttgcgagga

SEQ ID NO: 12432 - DNA, 19 bp, Artificial Sequence
  Synthetic
gccttattgggctgatgcg

SEQ ID NO: 12433 - DNA, 18 bp, Artificial Sequence
  Synthetic
caatttggaccccccccg

SEQ ID NO: 12434 - DNA, 20 bp, Artificial Sequence
  Synthetic
gacacccaggcccataattc

SEQ ID NO: 12435 - DNA, 18 bp, Artificial Sequence
  Synthetic
ggtgcactaccggtttgt

SEQ ID NO: 12436 - DNA, 18 bp, Artificial Sequence
  Synthetic
gacccaaggcagatccct

SEQ ID NO: 12437 - DNA, 16 bp, Artificial Sequence
  Synthetic
gagcggacggccaaca

SEQ ID NO: 12438 - DNA, 18 bp, Artificial Sequence
  Synthetic
ttggcggtcttgtcgact

SEQ ID NO: 12439 - DNA, 20 bp, Artificial Sequence
  Synthetic
actctttaggccttgagtgc

SEQ ID NO: 12440 - DNA, 20 bp, Artificial Sequence
  Synthetic
ctaccagcaagagcctcgag

SEQ ID NO: 12441 - DNA, 16 bp, Artificial Sequence
  Synthetic
aggctgcgcaacgtca

SEQ ID NO: 12442 - DNA, 18 bp, Artificial Sequence
  Synthetic
ccatgtaccccggtggag

SEQ ID NO: 12443 - DNA, 19 bp, Artificial Sequence
  Synthetic
gctggttccaaactcggtg

SEQ ID NO: 12444 - DNA, 19 bp, Artificial Sequence
  Synthetic
tggtgcccccattaattcg

SEQ ID NO: 12445 - DNA, 19 bp, Artificial Sequence
  Synthetic
cagcacctccaggataggc

SEQ ID NO: 12446 - DNA, 22 bp, Artificial Sequence
  Synthetic
ttgtatactatcaactgccact

SEQ ID NO: 12447 - DNA, 22 bp, Artificial Sequence
  Synthetic
gactttgtgtctactcttctca

SEQ ID NO: 12448 - DNA, 19 bp, Artificial Sequence
  Synthetic
gttttgccattccttctgt

SEQ ID NO: 12449 - DNA, 18 bp, Artificial Sequence
  Synthetic
aatgctgtgtatagggcg

SEQ ID NO: 12450 - DNA, 23 bp, Artificial Sequence
  Synthetic
gaaattcattagaccctttttgc

SEQ ID NO: 12451 - DNA, 24 bp, Artificial Sequence
  Synthetic
ctacaactgaagttaagttttctg

SEQ ID NO: 12452 - DNA, 22 bp, Artificial Sequence
  Synthetic
aaactgcagtttttgtgtacac

SEQ ID NO: 12453 - DNA, 25 bp, Artificial Sequence
  Synthetic
acagattggttaaaaactcttaagc

SEQ ID NO: 12454 - DNA, 23 bp, Artificial Sequence
  Synthetic
gatgatgttgttaccagtctttg

SEQ ID NO: 12455 - DNA, 22 bp, Artificial Sequence
  Synthetic
ttttgagatgtcttgtgattgt

SEQ ID NO: 12456 - DNA, 23 bp, Artificial Sequence
  Synthetic
actgtttgttttgttgatgttga

SEQ ID NO: 12457 - DNA, 20 bp, Artificial Sequence
  Synthetic
gttaaaactgtaccagctgg

SEQ ID NO: 12458 - DNA, 23 bp, Artificial Sequence
  Synthetic
atgttaaagatgttgttgttgag

SEQ ID NO: 12459 - DNA, 23 bp, Artificial Sequence
  Synthetic
tgaacaatattcaacttgtgaca

SEQ ID NO: 12460 - DNA, 25 bp, Artificial Sequence
  Synthetic
gattttaagtacattgagaatggtc

SEQ ID NO: 12461 - DNA, 22 bp, Artificial Sequence
  Synthetic
actattagaactttggctacac

SEQ ID NO: 12462 - DNA, 24 bp, Artificial Sequence
  Synthetic
gaaacttaagaattatgctgcaag

SEQ ID NO: 12463 - DNA, 21 bp, Artificial Sequence
  Synthetic
ctagacatgtcatagcaccat

SEQ ID NO: 12464 - DNA, 23 bp, Artificial Sequence
  Synthetic
aatgttagaaatgatggtactgt

SEQ ID NO: 12465 - DNA, 25 bp, Artificial Sequence
  Synthetic
ggttatttagtttgtacttattggg

SEQ ID NO: 12466 - DNA, 23 bp, Artificial Sequence
  Synthetic
gtgttgcttcatcatttgttagt

SEQ ID NO: 12467 - DNA, 23 bp, Artificial Sequence
  Synthetic
attctaagattgtttgtgatggt

SEQ ID NO: 12468 - DNA, 23 bp, Artificial Sequence
  Synthetic
ttaaataccttacgtagaggtgc

SEQ ID NO: 12469 - DNA, 21 bp, Artificial Sequence
  Synthetic
gttcctcaccctagtatggat

SEQ ID NO: 12470 - DNA, 25 bp, Artificial Sequence
  Synthetic
ttaaaaatgctgatcttaaggatgg

SEQ ID NO: 12471 - DNA, 25 bp, Artificial Sequence
  Synthetic
tattttgatagtaagggttggtatg

SEQ ID NO: 12472 - DNA, 20 bp, Artificial Sequence
  Synthetic
cttttggtccactatgtcgt

SEQ ID NO: 12473 - DNA, 25 bp, Artificial Sequence
  Synthetic
ctatatcttatgaagaacaggatgc

SEQ ID NO: 12474 - DNA, 24 bp, Artificial Sequence
  Synthetic
ttatcccaaatgtgatagagcttt

SEQ ID NO: 12475 - DNA, 25 bp, Artificial Sequence
  Synthetic
accagaataatgtctttatgagtac

SEQ ID NO: 12476 - DNA, 23 bp, Artificial Sequence
  Synthetic
gggtgttcttgaatctttttctg

SEQ ID NO: 12477 - DNA, 24 bp, Artificial Sequence
  Synthetic
aactactaagttagttcctggtat

SEQ ID NO: 12478 - DNA, 23 bp, Artificial Sequence
  Synthetic
atagtttgttttgtacacgtgac

SEQ ID NO: 12479 - DNA, 23 bp, Artificial Sequence
  Synthetic
ttgttgttttaaacatgcattgg

SEQ ID NO: 12480 - DNA, 25 bp, Artificial Sequence
  Synthetic
agtgttattcatgacattggtaatc

SEQ ID NO: 12481 - DNA, 19 bp, Artificial Sequence
  Synthetic
gtgagttacctgttgcagt

SEQ ID NO: 12482 - DNA, 25 bp, Artificial Sequence
  Synthetic
tgtacttatatggatttgttgttgg

SEQ ID NO: 12483 - DNA, 24 bp, Artificial Sequence
  Synthetic
ctttgtcaatacctaaatagcact

SEQ ID NO: 12484 - DNA, 23 bp, Artificial Sequence
  Synthetic
gaaacttttcttgattttgcttg

SEQ ID NO: 12485 - DNA, 25 bp, Artificial Sequence
  Synthetic
ttgttatttacagaacagttaggtg

SEQ ID NO: 12486 - DNA, 24 bp, Artificial Sequence
  Synthetic
acatattttctgttcaacaggatg

SEQ ID NO: 12487 - DNA, 24 bp, Artificial Sequence
  Synthetic
tattgtagtaattcttcctcaggt

SEQ ID NO: 12488 - DNA, 24 bp, Artificial Sequence
  Synthetic
aaacttactttattgcgattctcc

SEQ ID NO: 12489 - DNA, 25 bp, Artificial Sequence
  Synthetic
tggtggtattacatatgtttctaac

SEQ ID NO: 12490 - DNA, 25 bp, Artificial Sequence
  Synthetic
tggagattataacctttctagtgtt

SEQ ID NO: 12491 - DNA, 24 bp, Artificial Sequence
  Synthetic
gctatacatactgttactattgca

SEQ ID NO: 12492 - DNA, 20 bp, Artificial Sequence
  Synthetic
gctgccaactgattacaaga

SEQ ID NO: 12493 - DNA, 25 bp, Artificial Sequence
  Synthetic
cagtacatatgttgatttgaagttg

SEQ ID NO: 12494 - DNA, 25 bp, Artificial Sequence
  Synthetic
tttagtaggacattatatcaaccag

SEQ ID NO: 12495 - DNA, 20 bp, Artificial Sequence
  Synthetic
gccgtgttaaaactttttgg

SEQ ID NO: 12496 - DNA, 21 bp, Artificial Sequence
  Synthetic
gggtgttttgtcagaaagaga

SEQ ID NO: 12497 - DNA, 23 bp, Artificial Sequence
  Synthetic
ctcataaggaccttaaattcaga

SEQ ID NO: 12498 - DNA, 21 bp, Artificial Sequence
  Synthetic
gtagcacttcaagacaacagt

SEQ ID NO: 12499 - DNA, 19 bp, Artificial Sequence
  Synthetic
cagaatggtgttgatgcca

SEQ ID NO: 12500 - DNA, 19 bp, Artificial Sequence
  Synthetic
atttggtgtttggatgctg

SEQ ID NO: 12501 - DNA, 25 bp, Artificial Sequence
  Synthetic
cagtaaaatggcagataataaaggt

SEQ ID NO: 12502 - DNA, 18 bp, Artificial Sequence
  Synthetic
cgccgcattattaagcag

SEQ ID NO: 12503 - DNA, 23 bp, Artificial Sequence
  Synthetic
taaccacaattcttccagttgat

SEQ ID NO: 12504 - DNA, 20 bp, Artificial Sequence
  Synthetic
cgcttagacttactgcaaga

SEQ ID NO: 12505 - DNA, 20 bp, Artificial Sequence
  Synthetic
gtcacttcaagacactagca

SEQ ID NO: 12506 - DNA, 20 bp, Artificial Sequence
  Synthetic
tgtcttccactagctcccca

SEQ ID NO: 12507 - DNA, 22 bp, Artificial Sequence
  Synthetic
gacagatagaaaaaacaccgag

SEQ ID NO: 12508 - DNA, 20 bp, Artificial Sequence
  Synthetic
gcccccaaagatatataccc

SEQ ID NO: 12509 - DNA, 18 bp, Artificial Sequence
  Synthetic
tgtggaaacagtaggccc

SEQ ID NO: 12510 - DNA, 25 bp, Artificial Sequence
  Synthetic
tgcatctacatctaatataagtgct

SEQ ID NO: 12511 - DNA, 18 bp, Artificial Sequence
  Synthetic
ggttcgttgagcagccac

SEQ ID NO: 12512 - DNA, 25 bp, Artificial Sequence
  Synthetic
cccactttttctatgatttaagttc

SEQ ID NO: 12513 - DNA, 18 bp, Artificial Sequence
  Synthetic
tctatcttcctccccagc

SEQ ID NO: 12514 - DNA, 21 bp, Artificial Sequence
  Synthetic
atagagataggtagaggccag

SEQ ID NO: 12515 - DNA, 21 bp, Artificial Sequence
  Synthetic
ggtgacatgatggatattggt

SEQ ID NO: 12516 - DNA, 18 bp, Artificial Sequence
  Synthetic
gcagatgctgaaccaaga

SEQ ID NO: 12517 - DNA, 21 bp, Artificial Sequence
  Synthetic
cacaagtgtgcattttttgtg

SEQ ID NO: 12518 - DNA, 22 bp, Artificial Sequence
  Synthetic
ttaaaagactacacctacagga

SEQ ID NO: 12519 - DNA, 18 bp, Artificial Sequence
  Synthetic
tgcagcaaccctatttgg

SEQ ID NO: 12520 - DNA, 24 bp, Artificial Sequence
  Synthetic
cttggatgattctgatatagatga

SEQ ID NO: 12521 - DNA, 22 bp, Artificial Sequence
  Synthetic
cacctaaagaaaagggtaaacg

SEQ ID NO: 12522 - DNA, 24 bp, Artificial Sequence
  Synthetic
ctgaacctccaaaattaagaagtg

SEQ ID NO: 12523 - DNA, 23 bp, Artificial Sequence
  Synthetic
gttttgtattttatggacctcct

SEQ ID NO: 12524 - DNA, 19 bp, Artificial Sequence
  Synthetic
agagtcactgcaagagaga

SEQ ID NO: 12525 - DNA, 23 bp, Artificial Sequence
  Synthetic
aattgaaaacacaacaattgctg

SEQ ID NO: 12526 - DNA, 23 bp, Artificial Sequence
  Synthetic
ccttcagtgattcctttagaaga

SEQ ID NO: 12527 - DNA, 23 bp, Artificial Sequence
  Synthetic
atttgtacactcattcataggag

SEQ ID NO: 12528 - DNA, 18 bp, Artificial Sequence
  Synthetic
ggccaacctttaggaagt

SEQ ID NO: 12529 - DNA, 21 bp, Artificial Sequence
  Synthetic
tccacctttagagttaatgca

SEQ ID NO: 12530 - DNA, 18 bp, Artificial Sequence
  Synthetic
gaagcagttccaaacctg

SEQ ID NO: 12531 - DNA, 25 bp, Artificial Sequence
  Synthetic
ttgtattatatttgcccctaaactg

SEQ ID NO: 12532 - DNA, 18 bp, Artificial Sequence
  Synthetic
cgcagaagcagaggattt

SEQ ID NO: 12533 - DNA, 22 bp, Artificial Sequence
  Synthetic
tcttgaagagagaaaagcaatt

SEQ ID NO: 12534 - DNA, 20 bp, Artificial Sequence
  Synthetic
aaagaggggaaattccgttt

SEQ ID NO: 12535 - DNA, 19 bp, Artificial Sequence
  Synthetic
catcggatcctcaactcac

SEQ ID NO: 12536 - DNA, 18 bp, Artificial Sequence
  Synthetic
ggaatttccggagtccct

SEQ ID NO: 12537 - DNA, 18 bp, Artificial Sequence
  Synthetic
ggggtcaactccatgatt

SEQ ID NO: 12538 - DNA, 21 bp, Artificial Sequence
  Synthetic
aaggtattttccagactgttg

SEQ ID NO: 12539 - DNA, 22 bp, Artificial Sequence
  Synthetic
catgctcttttccatgaagttg

SEQ ID NO: 12540 - DNA, 23 bp, Artificial Sequence
  Synthetic
tgcaatattaacaatgtggttag

SEQ ID NO: 12541 - DNA, 25 bp, Artificial Sequence
  Synthetic
atctgtcaaattatgaagatgcaag

SEQ ID NO: 12542 - DNA, 23 bp, Artificial Sequence
  Synthetic
tttgtcagatgttttgtttttgg

SEQ ID NO: 12543 - DNA, 20 bp, Artificial Sequence
  Synthetic
ctccttacagagtgaacagg

SEQ ID NO: 12544 - DNA, 23 bp, Artificial Sequence
  Synthetic
aacaaccatgaaagatttgaaag

SEQ ID NO: 12545 - DNA, 25 bp, Artificial Sequence
  Synthetic
aagagtacacatttcctataacctt

SEQ ID NO: 12546 - DNA, 21 bp, Artificial Sequence
  Synthetic
aaatgccatgttatccactga

SEQ ID NO: 12547 - DNA, 23 bp, Artificial Sequence
  Synthetic
tctcttttttatactgaggagca

SEQ ID NO: 12548 - DNA, 20 bp, Artificial Sequence
  Synthetic
ctgtggcttcagattactgg

SEQ ID NO: 12549 - DNA, 25 bp, Artificial Sequence
  Synthetic
tttcagatgatgataatgatagtgc

SEQ ID NO: 12550 - DNA, 25 bp, Artificial Sequence
  Synthetic
gtgattaaattagatgcagatccag

SEQ ID NO: 12551 - DNA, 18 bp, Artificial Sequence
  Synthetic
gatcaggcatggagagga

SEQ ID NO: 12552 - DNA, 21 bp, Artificial Sequence
  Synthetic
cgctttttagaaagagtccca

SEQ ID NO: 12553 - DNA, 21 bp, Artificial Sequence
  Synthetic
tgatgctatcaacatggattc

SEQ ID NO: 12554 - DNA, 18 bp, Artificial Sequence
  Synthetic
gatgcttgtcctctggat

SEQ ID NO: 12555 - DNA, 23 bp, Artificial Sequence
  Synthetic
ccatgaagactatcattgctttg

SEQ ID NO: 12556 - DNA, 20 bp, Artificial Sequence
  Synthetic
ccttgatggagaaaactgca

SEQ ID NO: 12557 - DNA, 25 bp, Artificial Sequence
  Synthetic
cagtttctttagtagattgaattgg

SEQ ID NO: 12558 - DNA, 25 bp, Artificial Sequence
  Synthetic
gcatctattggacaatagtaaaacc

SEQ ID NO: 12559 - DNA, 21 bp, Artificial Sequence
  Synthetic
tgttaagcaaaacactctgaa

SEQ ID NO: 12560 - DNA, 25 bp, Artificial Sequence
  Synthetic
ccatcagattgaaaaagaattctca

SEQ ID NO: 12561 - DNA, 23 bp, Artificial Sequence
  Synthetic
aatggaacttatgaccatgatgt

SEQ ID NO: 12562 - DNA, 18 bp, Artificial Sequence
  Synthetic
ttgagaggttgttggcaa

SEQ ID NO: 12563 - DNA, 20 bp, Artificial Sequence
  Synthetic
aggaaggttatgcatatgcg

SEQ ID NO: 12564 - DNA, 23 bp, Artificial Sequence
  Synthetic
ttgtagagagatatgattgggaa

SEQ ID NO: 12565 - DNA, 22 bp, Artificial Sequence
  Synthetic
tagaagacttgctgctagaaga

SEQ ID NO: 12566 - DNA, 18 bp, Artificial Sequence
  Synthetic
caggggagtgaggagttt

SEQ ID NO: 12567 - DNA, 23 bp, Artificial Sequence
  Synthetic
ttgttaaaatgcagtaatctcag

SEQ ID NO: 12568 - DNA, 21 bp, Artificial Sequence
  Synthetic
aaaatgttatcgctacagggt

SEQ ID NO: 12569 - DNA, 25 bp, Artificial Sequence
  Synthetic
taacccactttatatattgtatggc

SEQ ID NO: 12570 - DNA, 19 bp, Artificial Sequence
  Synthetic
gtcattccagaagcgattg

SEQ ID NO: 12571 - DNA, 22 bp, Artificial Sequence
  Synthetic
ctacatatgctgaaacaccaga

SEQ ID NO: 12572 - DNA, 25 bp, Artificial Sequence
  Synthetic
ccaacaataataattcatacagagg

SEQ ID NO: 12573 - DNA, 24 bp, Artificial Sequence
  Synthetic
gatgtgaggaaaaataatggagat

SEQ ID NO: 12574 - DNA, 25 bp, Artificial Sequence
  Synthetic
aaaatccaaatggctataatacagg

SEQ ID NO: 12575 - DNA, 25 bp, Artificial Sequence
  Synthetic
agtatccagatttcttaaaaatggc

SEQ ID NO: 12576 - DNA, 25 bp, Artificial Sequence
  Synthetic
aaagataataacaattggctctgtc

SEQ ID NO: 12577 - DNA, 19 bp, Artificial Sequence
  Synthetic
acagaaattggtcaaagcc

SEQ ID NO: 12578 - DNA, 19 bp, Artificial Sequence
  Synthetic
tcatttaggaaccaggcaa

SEQ ID NO: 12579 - DNA, 25 bp, Artificial Sequence
  Synthetic
actagaatactattcattgaagagg

SEQ ID NO: 12580 - DNA, 20 bp, Artificial Sequence
  Synthetic
tgcaggaatcctaacaatga

SEQ ID NO: 12581 - DNA, 18 bp, Artificial Sequence
  Synthetic
gcaagttgctaccgctgg

SEQ ID NO: 12582 - DNA, 17 bp, Artificial Sequence
  Synthetic
cctggccgctttctacg

SEQ ID NO: 12583 - DNA, 16 bp, Artificial Sequence
  Synthetic
cgaggtgcagaccgct

SEQ ID NO: 12584 - DNA, 20 bp, Artificial Sequence
  Synthetic
ggtacctgaaaccgaaagcg

SEQ ID NO: 12585 - DNA, 17 bp, Artificial Sequence
  Synthetic
tgggcaaagacggagcc

SEQ ID NO: 12586 - DNA, 17 bp, Artificial Sequence
  Synthetic
gagggtgagcgcgaaga

SEQ ID NO: 12587 - DNA, 16 bp, Artificial Sequence
  Synthetic
cgatcaccaccgcgac

SEQ ID NO: 12588 - DNA, 20 bp, Artificial Sequence
  Synthetic
ccggtttcggtgagacactt

SEQ ID NO: 12589 - DNA, 21 bp, Artificial Sequence
  Synthetic
ctccgttatgtctttcagatc

SEQ ID NO: 12590 - DNA, 22 bp, Artificial Sequence
  Synthetic
aatcttctcataaccgtagtcc

SEQ ID NO: 12591 - DNA, 19 bp, Artificial Sequence
  Synthetic
ccgtcacatgacaggaaat

SEQ ID NO: 12592 - DNA, 20 bp, Artificial Sequence
  Synthetic
gagaatgacacaccacagaa

SEQ ID NO: 12593 - DNA, 18 bp, Artificial Sequence
  Synthetic
aaacggtcgtcatcacat

SEQ ID NO: 12594 - DNA, 20 bp, Artificial Sequence
  Synthetic
acagaagttttccaccaaag

SEQ ID NO: 12595 - DNA, 19 bp, Artificial Sequence
  Synthetic
gtgtctaaacgagtctgga

SEQ ID NO: 12596 - DNA, 20 bp, Artificial Sequence
  Synthetic
ctttttccgacaaacacaga

SEQ ID NO: 12597 - DNA, 18 bp, Artificial Sequence
  Synthetic
ggagccgagtaagcattt

SEQ ID NO: 12598 - DNA, 18 bp, Artificial Sequence
  Synthetic
gagtccaccattttcgga

SEQ ID NO: 12599 - DNA, 21 bp, Artificial Sequence
  Synthetic
aaaacctctagattcttcccg

SEQ ID NO: 12600 - DNA, 19 bp, Artificial Sequence
  Synthetic
ggtggtttcttttgaagca

SEQ ID NO: 12601 - DNA, 19 bp, Artificial Sequence
  Synthetic
tcgccagattacttcagac

SEQ ID NO: 12602 - DNA, 25 bp, Artificial Sequence
  Synthetic
ggaattagatttttattgatggtgc

SEQ ID NO: 12603 - DNA, 18 bp, Artificial Sequence
  Synthetic
cgaagtgcttctctcgat

SEQ ID NO: 12604 - DNA, 20 bp, Artificial Sequence
  Synthetic
cgaatccggaatttacttgt

SEQ ID NO: 12605 - DNA, 22 bp, Artificial Sequence
  Synthetic
tatgaataacggagagcttgtt

SEQ ID NO: 12606 - DNA, 18 bp, Artificial Sequence
  Synthetic
tttctgtgtgtgctttcg

SEQ ID NO: 12607 - DNA, 19 bp, Artificial Sequence
  Synthetic
cgtggatttgttgaatgga

SEQ ID NO: 12608 - DNA, 20 bp, Artificial Sequence
  Synthetic
acagatccgtctctcagctg

SEQ ID NO: 12609 - DNA, 18 bp, Artificial Sequence
  Synthetic
gcacagagctggtcctga

SEQ ID NO: 12610 - DNA, 16 bp, Artificial Sequence
  Synthetic
gagggctgcaacgcga

SEQ ID NO: 12611 - DNA, 17 bp, Artificial Sequence
  Synthetic
gagacgcagaagccgtc

SEQ ID NO: 12612 - DNA, 18 bp, Artificial Sequence
  Synthetic
cagagacgtgaccggaga

SEQ ID NO: 12613 - DNA, 21 bp, Artificial Sequence
  Synthetic
caagaaacatagcatggatgg

SEQ ID NO: 12614 - DNA, 18 bp, Artificial Sequence
  Synthetic
gggagagtgctaagcaga

SEQ ID NO: 12615 - DNA, 21 bp, Artificial Sequence
  Synthetic
tcagttacacccaaaaagttg

SEQ ID NO: 12616 - DNA, 19 bp, Artificial Sequence
  Synthetic
ggaggttatggagggactg

SEQ ID NO: 12617 - DNA, 20 bp, Artificial Sequence
  Synthetic
acggatgttgtaacagttgt

SEQ ID NO: 12618 - DNA, 21 bp, Artificial Sequence
  Synthetic
gaggcaattgttgatcaagaa

SEQ ID NO: 12619 - DNA, 18 bp, Artificial Sequence
  Synthetic
cgcaaatgcagacacatt

SEQ ID NO: 12620 - DNA, 19 bp, Artificial Sequence
  Synthetic
gtgaatcactctccacagc

SEQ ID NO: 12621 - DNA, 25 bp, Artificial Sequence
  Synthetic
caaatcctacattaatgataaaggg

SEQ ID NO: 12622 - DNA, 23 bp, Artificial Sequence
  Synthetic
gggagacaaaataacattcgaag

SEQ ID NO: 12623 - DNA, 20 bp, Artificial Sequence
  Synthetic
gattgaggaatatcccgtct

SEQ ID NO: 12624 - DNA, 16 bp, Artificial Sequence
  Synthetic
cgacacactgcagcgg

SEQ ID NO: 12625 - DNA, 18 bp, Artificial Sequence
  Synthetic
gagctctctcaccccgtg

SEQ ID NO: 12626 - DNA, 20 bp, Artificial Sequence
  Synthetic
ctttgcgtttctcacggcat

SEQ ID NO: 12627 - DNA, 17 bp, Artificial Sequence
  Synthetic
ggccgccgagattaacg

SEQ ID NO: 12628 - DNA, 20 bp, Artificial Sequence
  Synthetic
aatcatctgactcgtgccag

SEQ ID NO: 12629 - DNA, 16 bp, Artificial Sequence
  Synthetic
tgagggcggccagact

SEQ ID NO: 12630 - DNA, 20 bp, Artificial Sequence
  Synthetic
ctgggaccgtggatagtgtg

SEQ ID NO: 12631 - DNA, 17 bp, Artificial Sequence
  Synthetic
aaagtaacgccgcgtcc

SEQ ID NO: 12632 - DNA, 17 bp, Artificial Sequence
  Synthetic
tccactcatgccgccga

SEQ ID NO: 12633 - DNA, 16 bp, Artificial Sequence
  Synthetic
cagcaccagcgcggaa

SEQ ID NO: 12634 - DNA, 23 bp, Artificial Sequence
  Synthetic
agatggatattcaaagtacaggg

SEQ ID NO: 12635 - DNA, 20 bp, Artificial Sequence
  Synthetic
tacgtcatcacactctttgc

SEQ ID NO: 12636 - DNA, 22 bp, Artificial Sequence
  Synthetic
aactaagaaaccgatttaccac

SEQ ID NO: 12637 - DNA, 19 bp, Artificial Sequence
  Synthetic
cccacataaaatcacgtgc

SEQ ID NO: 12638 - DNA, 22 bp, Artificial Sequence
  Synthetic
caacgattgaagaacatcatca

SEQ ID NO: 12639 - DNA, 22 bp, Artificial Sequence
  Synthetic
aaacaccaacgttttagttagg

SEQ ID NO: 12640 - DNA, 21 bp, Artificial Sequence
  Synthetic
ttctaatgaaatcgtcagtcg

SEQ ID NO: 12641 - DNA, 18 bp, Artificial Sequence
  Synthetic
cgctgaccacataaacgt

SEQ ID NO: 12642 - DNA, 21 bp, Artificial Sequence
  Synthetic
ggatacagagagcaaaaacag

SEQ ID NO: 12643 - DNA, 18 bp, Artificial Sequence
  Synthetic
ggtttgaggtgtctggtt

SEQ ID NO: 12644 - DNA, 21 bp, Artificial Sequence
  Synthetic
taacttggactggaaagatca

SEQ ID NO: 12645 - DNA, 21 bp, Artificial Sequence
  Synthetic
ccaattttagaagggcatgtc

SEQ ID NO: 12646 - DNA, 21 bp, Artificial Sequence
  Synthetic
cgaatccacgtatttatgtcc

SEQ ID NO: 12647 - DNA, 22 bp, Artificial Sequence
  Synthetic
agatcgagtcaatcatagagaa

SEQ ID NO: 12648 - DNA, 21 bp, Artificial Sequence
  Synthetic
cgttaatgctgatgaacttgg

SEQ ID NO: 12649 - DNA, 20 bp, Artificial Sequence
  Synthetic
gataggacggggaaaagaac

SEQ ID NO: 12650 - DNA, 25 bp, Artificial Sequence
  Synthetic
agtgtatcttccgagtctagtatta

SEQ ID NO: 12651 - DNA, 20 bp, Artificial Sequence
  Synthetic
gtcatctatggagacgctag

SEQ ID NO: 12652 - DNA, 21 bp, Artificial Sequence
  Synthetic
ttcagtgtttcgatttcatcc

SEQ ID NO: 12653 - DNA, 18 bp, Artificial Sequence
  Synthetic
tggatcctggggagttct

SEQ ID NO: 12654 - DNA, 18 bp, Artificial Sequence
  Synthetic
tttccatgcgcgtttcgg

SEQ ID NO: 12655 - DNA, 18 bp, Artificial Sequence
  Synthetic
catctgggatcccgctcg

SEQ ID NO: 12656 - DNA, 17 bp, Artificial Sequence
  Synthetic
gcacgagaacacgcgag

SEQ ID NO: 12657 - DNA, 20 bp, Artificial Sequence
  Synthetic
aatgtttccacgtgacgtcc

SEQ ID NO: 12658 - DNA, 18 bp, Artificial Sequence
  Synthetic
gagccgtgtacgtccacc

SEQ ID NO: 12659 - DNA, 19 bp, Artificial Sequence
  Synthetic
gacgctttgtccaaaatgc

SEQ ID NO: 12660 - DNA, 18 bp, Artificial Sequence
  Synthetic
gcagatgcaacggttcaa

SEQ ID NO: 12661 - DNA, 20 bp, Artificial Sequence
  Synthetic
atggactccaacaccatgtc

SEQ ID NO: 12662 - DNA, 18 bp, Artificial Sequence
  Synthetic
tacctacttcgcgctacc

SEQ ID NO: 12663 - DNA, 25 bp, Artificial Sequence
  Synthetic
atacttatgaggatgtcaaaaatgc

SEQ ID NO: 12664 - DNA, 22 bp, Artificial Sequence
  Synthetic
aattgtacagttactaaagggc

SEQ ID NO: 12665 - DNA, 18 bp, Artificial Sequence
  Synthetic
gactttccttttgcagcg

SEQ ID NO: 12666 - DNA, 20 bp, Artificial Sequence
  Synthetic
agcaattagacagctcagac

SEQ ID NO: 12667 - DNA, 18 bp, Artificial Sequence
  Synthetic
ttgctgatgggcacacta

SEQ ID NO: 12668 - DNA, 18 bp, Artificial Sequence
  Synthetic
gaaggtatagaggggggc

SEQ ID NO: 12669 - DNA, 25 bp, Artificial Sequence
  Synthetic
ttcatacattattaaaaggacaggc

SEQ ID NO: 12670 - DNA, 18 bp, Artificial Sequence
  Synthetic
aacaccggaatggatagc

SEQ ID NO: 12671 - DNA, 21 bp, Artificial Sequence
  Synthetic
cttttttaaaaggttggcgtc

SEQ ID NO: 12672 - DNA, 18 bp, Artificial Sequence
  Synthetic
tgtgtcaaaagccaaagc

SEQ ID NO: 12673 - DNA, 18 bp, Artificial Sequence
  Synthetic
ccgaaagcgaaggagaga

SEQ ID NO: 12674 - DNA, 19 bp, Artificial Sequence
  Synthetic
cagagggtgggttttcaat

SEQ ID NO: 12675 - DNA, 21 bp, Artificial Sequence
  Synthetic
gccacaattcctgatacattc

SEQ ID NO: 12676 - DNA, 21 bp, Artificial Sequence
  Synthetic
ttatcatgcaggtagtaccag

SEQ ID NO: 12677 - DNA, 18 bp, Artificial Sequence
  Synthetic
ggtcaggacagcagagaa

SEQ ID NO: 12678 - DNA, 21 bp, Artificial Sequence
  Synthetic
acagggcctaagtttaaatcc

SEQ ID NO: 12679 - DNA, 21 bp, Artificial Sequence
  Synthetic
tgtttcaaattgctaggtcaa

SEQ ID NO: 12680 - DNA, 19 bp, Artificial Sequence
  Synthetic
ggtttaggaccgaaaacgg

SEQ ID NO: 12681 - DNA, 23 bp, Artificial Sequence
  Synthetic
gagtagtgtatagagacgggtat

SEQ ID NO: 12682 - DNA, 18 bp, Artificial Sequence
  Synthetic
tgacatgctggagacaca

SEQ ID NO: 12683 - DNA, 19 bp, Artificial Sequence
  Synthetic
tctacacaggcagaaaggg

SEQ ID NO: 12684 - DNA, 18 bp, Artificial Sequence
  Synthetic
cgggaaagagcaaaatgg

SEQ ID NO: 12685 - DNA, 21 bp, Artificial Sequence
  Synthetic
attagtgacgtgtatgggagt

SEQ ID NO: 12686 - DNA, 18 bp, Artificial Sequence
  Synthetic
gggcacaacaacaacaga

SEQ ID NO: 12687 - DNA, 22 bp, Artificial Sequence
  Synthetic
aaatccatttccaattgatgtg

SEQ ID NO: 12688 - DNA, 18 bp, Artificial Sequence
  Synthetic
tgttgtgtggaaatgggt

SEQ ID NO: 12689 - DNA, 19 bp, Artificial Sequence
  Synthetic
ccataagacccccaccacc

SEQ ID NO: 12690 - DNA, 22 bp, Artificial Sequence
  Synthetic
gtgaagcaaacagactaaagtg

SEQ ID NO: 12691 - DNA, 25 bp, Artificial Sequence
  Synthetic
tacctggtatatacaatactacaca

SEQ ID NO: 12692 - DNA, 19 bp, Artificial Sequence
  Synthetic
ataacacccacctctacct

SEQ ID NO: 12693 - DNA, 22 bp, Artificial Sequence
  Synthetic
gatcctgcatttcttcacaaac

SEQ ID NO: 12694 - DNA, 18 bp, Artificial Sequence
  Synthetic
tacatggccttatgcacc

SEQ ID NO: 12695 - DNA, 18 bp, Artificial Sequence
  Synthetic
tatccctgtctgctgagg

SEQ ID NO: 12696 - DNA, 18 bp, Artificial Sequence
  Synthetic
gcatagtgccgtttcctg

SEQ ID NO: 12697 - DNA, 19 bp, Artificial Sequence
  Synthetic
ttaaaactgggtgtgggtt

SEQ ID NO: 12698 - DNA, 20 bp, Artificial Sequence
  Synthetic
tctttggttggtcgttcagc

SEQ ID NO: 12699 - DNA, 21 bp, Artificial Sequence
  Synthetic
tcaagatccaagcaaattcac

SEQ ID NO: 12700 - DNA, 24 bp, Artificial Sequence
  Synthetic
attagtccattacgtagtgaaact

SEQ ID NO: 12701 - DNA, 24 bp, Artificial Sequence
  Synthetic
tcaataatgtgggtaacaatgttg

SEQ ID NO: 12702 - DNA, 20 bp, Artificial Sequence
  Synthetic
attacttgcatacacaccac

SEQ ID NO: 12703 - DNA, 23 bp, Artificial Sequence
  Synthetic
ataacatcacaaacaagagatga

SEQ ID NO: 12704 - DNA, 25 bp, Artificial Sequence
  Synthetic
gtaatgcaatatatgtatgttcctc

SEQ ID NO: 12705 - DNA, 20 bp, Artificial Sequence
  Synthetic
tgattgtggtggaaaacttc

SEQ ID NO: 12706 - DNA, 25 bp, Artificial Sequence
  Synthetic
tctcggctatggttattataatcag

SEQ ID NO: 12707 - DNA, 19 bp, Artificial Sequence
  Synthetic
cattcaaagatcgcagcac

SEQ ID NO: 12708 - DNA, 20 bp, Artificial Sequence
  Synthetic
cgttttcggtacaattttgg

SEQ ID NO: 12709 - DNA, 25 bp, Artificial Sequence
  Synthetic
gtgttagattatctgctttgtatga

SEQ ID NO: 12710 - DNA, 25 bp, Artificial Sequence
  Synthetic
aaaggtactgatactaatgaaactg

SEQ ID NO: 12711 - DNA, 23 bp, Artificial Sequence
  Synthetic
gttcaaagaaatgtttggtgttc

SEQ ID NO: 12712 - DNA, 23 bp, Artificial Sequence
  Synthetic
aatgaattctatgatgaagcaga

SEQ ID NO: 12713 - DNA, 22 bp, Artificial Sequence
  Synthetic
catggcagtatatggacttaaa

SEQ ID NO: 12714 - DNA, 25 bp, Artificial Sequence
  Synthetic
gaaaagaagggttaagtagtttagg

SEQ ID NO: 12715 - DNA, 20 bp, Artificial Sequence
  Synthetic
gctcttcacggtgtgcttac

SEQ ID NO: 12716 - DNA, 24 bp, Artificial Sequence
  Synthetic
tagtagtgtaactcaaagagaagc

SEQ ID NO: 12717 - DNA, 18 bp, Artificial Sequence
  Synthetic
ccaacaacggaattggga

SEQ ID NO: 12718 - DNA, 19 bp, Artificial Sequence
  Synthetic
tttgaaaatcccgcctttg

SEQ ID NO: 12719 - DNA, 25 bp, Artificial Sequence
  Synthetic
gggtatttattgatgattatggttc

SEQ ID NO: 12720 - DNA, 23 bp, Artificial Sequence
  Synthetic
agaacgtttagtctggaaattac

SEQ ID NO: 12721 - DNA, 24 bp, Artificial Sequence
  Synthetic
ttatgccagacatatgttaaacag

SEQ ID NO: 12722 - DNA, 19 bp, Artificial Sequence
  Synthetic
tactggggtagaagatgcg

SEQ ID NO: 12723 - DNA, 20 bp, Artificial Sequence
  Synthetic
tgaagcttacttggttggcc

SEQ ID NO: 12724 - DNA, 20 bp, Artificial Sequence
  Synthetic
gttgatagtcgtaatgggca

SEQ ID NO: 12725 - DNA, 18 bp, Artificial Sequence
  Synthetic
ttttcccaagacccatcg

SEQ ID NO: 12726 - DNA, 20 bp, Artificial Sequence
  Synthetic
gtagattggaccactacgtc

SEQ ID NO: 12727 - DNA, 20 bp, Artificial Sequence
  Synthetic
gagggaggacatgtaattgg

SEQ ID NO: 12728 - DNA, 22 bp, Artificial Sequence
  Synthetic
ccattacaatctcaatagcacc

SEQ ID NO: 12729 - DNA, 25 bp, Artificial Sequence
  Synthetic
tctcaatttacaatgtacaagtgac

SEQ ID NO: 12730 - DNA, 18 bp, Artificial Sequence
  Synthetic
gttagaatgctgcgtgac

SEQ ID NO: 12731 - DNA, 20 bp, Artificial Sequence
  Synthetic
aattgagaacttcatgggcc

SEQ ID NO: 12732 - DNA, 21 bp, Artificial Sequence
  Synthetic
caacccgagtgttttctatca

SEQ ID NO: 12733 - DNA, 18 bp, Artificial Sequence
  Synthetic
cacccaatacacccacaa

SEQ ID NO: 12734 - DNA, 18 bp, Artificial Sequence
  Synthetic
cccagataccatcccaca

SEQ ID NO: 12735 - DNA, 23 bp, Artificial Sequence
  Synthetic
cacagatctaagaccctattcat

SEQ ID NO: 12736 - DNA, 19 bp, Artificial Sequence
  Synthetic
caacccttgctcttttagg

SEQ ID NO: 12737 - DNA, 24 bp, Artificial Sequence
  Synthetic
tttggttacttcaataatagccag

SEQ ID NO: 12738 - DNA, 23 bp, Artificial Sequence
  Synthetic
acaaatcttttaaatctccaacc

SEQ ID NO: 12739 - DNA, 18 bp, Artificial Sequence
  Synthetic
acatggtggttcagcaac

SEQ ID NO: 12740 - DNA, 23 bp, Artificial Sequence
  Synthetic
gtaccatatacgcattatatcgc

SEQ ID NO: 12741 - DNA, 20 bp, Artificial Sequence
  Synthetic
gctacatgcaggttgtacaa

SEQ ID NO: 12742 - DNA, 18 bp, Artificial Sequence
  Synthetic
tgtcttccacgatgtgtt

SEQ ID NO: 12743 - DNA, 18 bp, Artificial Sequence
  Synthetic
cttaccactagccctggt

SEQ ID NO: 12744 - DNA, 21 bp, Artificial Sequence
  Synthetic
acagtacttttcatgcaaacc

SEQ ID NO: 12745 - DNA, 18 bp, Artificial Sequence
  Synthetic
tccaagatgacctgggat

SEQ ID NO: 12746 - DNA, 25 bp, Artificial Sequence
  Synthetic
aaaagaactaagagatctaatgtcg

SEQ ID NO: 12747 - DNA, 19 bp, Artificial Sequence
  Synthetic
ggagcaagacaaatgatgc

SEQ ID NO: 12748 - DNA, 21 bp, Artificial Sequence
  Synthetic
agcacaagatgttatcatgga

SEQ ID NO: 12749 - DNA, 22 bp, Artificial Sequence
  Synthetic
gaggcttcactttcaaaagaac

SEQ ID NO: 12750 - DNA, 19 bp, Artificial Sequence
  Synthetic
catgataaaggcagtccga

SEQ ID NO: 12751 - DNA, 18 bp, Artificial Sequence
  Synthetic
gagagagtggtggtgagt

SEQ ID NO: 12752 - DNA, 20 bp, Artificial Sequence
  Synthetic
ttaacggttttagggcaggg

SEQ ID NO: 12753 - DNA, 18 bp, Artificial Sequence
  Synthetic
gagggccaacagactttg

SEQ ID NO: 12754 - DNA, 20 bp, Artificial Sequence
  Synthetic
tgcatttatctccgtttgag

SEQ ID NO: 12755 - DNA, 22 bp, Artificial Sequence
  Synthetic
ggttgtggaaaatcattttgtg

SEQ ID NO: 12756 - DNA, 20 bp, Artificial Sequence
  Synthetic
ttacaaatgacacgcccctg

SEQ ID NO: 12757 - DNA, 22 bp, Artificial Sequence
  Synthetic
atggatgtgtggagtattcttg

SEQ ID NO: 12758 - DNA, 20 bp, Artificial Sequence
  Synthetic
gacaaatggagccaggacac

SEQ ID NO: 12759 - DNA, 19 bp, Artificial Sequence
  Synthetic
acccattggttgaacccag

SEQ ID NO: 12760 - DNA, 20 bp, Artificial Sequence
  Synthetic
aagttttacggctgctggat

SEQ ID NO: 12761 - DNA, 18 bp, Artificial Sequence
  Synthetic
caccttccagccgtacca

SEQ ID NO: 12762 - DNA, 20 bp, Artificial Sequence
  Synthetic
agcccttatttgacaacccg

SEQ ID NO: 12763 - DNA, 18 bp, Artificial Sequence
  Synthetic
tattttttcgcgcgcggt

SEQ ID NO: 12764 - DNA, 18 bp, Artificial Sequence
  Synthetic
cggggggagatgatgtgt

SEQ ID NO: 12765 - DNA, 18 bp, Artificial Sequence
  Synthetic
aaaatggtttccggggcg

SEQ ID NO: 12766 - DNA, 18 bp, Artificial Sequence
  Synthetic
agggtctgcgagaggagc

SEQ ID NO: 12767 - DNA, 18 bp, Artificial Sequence
  Synthetic
gctggtagttcagggcct

SEQ ID NO: 12768 - DNA, 20 bp, Artificial Sequence
  Synthetic
cgtagacggacttgattggc

SEQ ID NO: 12769 - DNA, 20 bp, Artificial Sequence
  Synthetic
tgctcgtcctcactctcttc

SEQ ID NO: 12770 - DNA, 20 bp, Artificial Sequence
  Synthetic
ttgagctggacatattcgcg

SEQ ID NO: 12771 - DNA, 16 bp, Artificial Sequence
  Synthetic
gcggaggcgtacatgc

SEQ ID NO: 12772 - DNA, 18 bp, Artificial Sequence
  Synthetic
cacggtaagagcccagca

SEQ ID NO: 12773 - DNA, 18 bp, Artificial Sequence
  Synthetic
gcaggctcggttgttgat

SEQ ID NO: 12774 - DNA, 18 bp, Artificial Sequence
  Synthetic
aaggtaagggggtcccgc

SEQ ID NO: 12775 - DNA, 19 bp, Artificial Sequence
  Synthetic
aaaagcgtccgcagtactc

SEQ ID NO: 12776 - DNA, 16 bp, Artificial Sequence
  Synthetic
gtgctgcgccctgaga

SEQ ID NO: 12777 - DNA, 19 bp, Artificial Sequence
  Synthetic
caaacgcggctgtaaacca

SEQ ID NO: 12778 - DNA, 17 bp, Artificial Sequence
  Synthetic
agctcggcaatggtggc

SEQ ID NO: 12779 - DNA, 18 bp, Artificial Sequence
  Synthetic
cccgttgggtagcgaaag

SEQ ID NO: 12780 - DNA, 20 bp, Artificial Sequence
  Synthetic
agtcatgcatgagcctctca

SEQ ID NO: 12781 - DNA, 18 bp, Artificial Sequence
  Synthetic
cgtagtcgttgcaggtgc

SEQ ID NO: 12782 - DNA, 16 bp, Artificial Sequence
  Synthetic
agcggttgagcaggct

SEQ ID NO: 12783 - DNA, 17 bp, Artificial Sequence
  Synthetic
cgcccgtagtctggaga

SEQ ID NO: 12784 - DNA, 16 bp, Artificial Sequence
  Synthetic
gcggccaacctggtga

SEQ ID NO: 12785 - DNA, 18 bp, Artificial Sequence
  Synthetic
cctgagcctggccgagaa

SEQ ID NO: 12786 - DNA, 20 bp, Artificial Sequence
  Synthetic
tgaggatgaggaagaggagg

SEQ ID NO: 12787 - DNA, 16 bp, Artificial Sequence
  Synthetic
gcgctggcggagaaca

SEQ ID NO: 12788 - DNA, 16 bp, Artificial Sequence
  Synthetic
agtcgggcccggacta

SEQ ID NO: 12789 - DNA, 16 bp, Artificial Sequence
  Synthetic
cgtgcactggggcaga

SEQ ID NO: 12790 - DNA, 20 bp, Artificial Sequence
  Synthetic
gttgatggactacctgcacc

SEQ ID NO: 12791 - DNA, 20 bp, Artificial Sequence
  Synthetic
gtacctgaacgactcgctgc

SEQ ID NO: 12792 - DNA, 18 bp, Artificial Sequence
  Synthetic
caccaaggccatagcgtg

SEQ ID NO: 12793 - DNA, 20 bp, Artificial Sequence
  Synthetic
tagacctgatgaacaacgcc

SEQ ID NO: 12794 - DNA, 19 bp, Artificial Sequence
  Synthetic
tccccgcacttctaaatgt

SEQ ID NO: 12795 - DNA, 16 bp, Artificial Sequence
  Synthetic
ttacctgcggcgcgga

SEQ ID NO: 12796 - DNA, 19 bp, Artificial Sequence
  Synthetic
cagtatccgcggagtccag

SEQ ID NO: 12797 - DNA, 18 bp, Artificial Sequence
  Synthetic
cactttcgcgctccctgg

SEQ ID NO: 12798 - DNA, 16 bp, Artificial Sequence
  Synthetic
acccccacaggcagga

SEQ ID NO: 12799 - DNA, 19 bp, Artificial Sequence
  Synthetic
gcgagggggcagtagagtt

SEQ ID NO: 12800 - DNA, 17 bp, Artificial Sequence
  Synthetic
gcgagggcgagaacatg

SEQ ID NO: 12801 - DNA, 20 bp, Artificial Sequence
  Synthetic
aaaaaccctcgaccagcatc

SEQ ID NO: 12802 - DNA, 18 bp, Artificial Sequence
  Synthetic
gctaccaccccagcatcc

SEQ ID NO: 12803 - DNA, 19 bp, Artificial Sequence
  Synthetic
tctgacacacctggtcctg

SEQ ID NO: 12804 - DNA, 20 bp, Artificial Sequence
  Synthetic
agtggacattgcaaaccagg

SEQ ID NO: 12805 - DNA, 17 bp, Artificial Sequence
  Synthetic
acctgccttcaccaccc

SEQ ID NO: 12806 - DNA, 18 bp, Artificial Sequence
  Synthetic
ggacgcctcggagtacct

SEQ ID NO: 12807 - DNA, 18 bp, Artificial Sequence
  Synthetic
ccccaaactccagtcagt

SEQ ID NO: 12808 - DNA, 18 bp, Artificial Sequence
  Synthetic
ggcctctcagttgaatgc

SEQ ID NO: 12809 - DNA, 20 bp, Artificial Sequence
  Synthetic
tttctgtactcgaacgtggc

SEQ ID NO: 12810 - DNA, 16 bp, Artificial Sequence
  Synthetic
tgctcccgggctccta

SEQ ID NO: 12811 - DNA, 20 bp, Artificial Sequence
  Synthetic
ccttctacctcaaccacacc

SEQ ID NO: 12812 - DNA, 20 bp, Artificial Sequence
  Synthetic
acaaggattacaaggccgtt

SEQ ID NO: 12813 - DNA, 18 bp, Artificial Sequence
  Synthetic
atgagcccaccctcctct

SEQ ID NO: 12814 - DNA, 17 bp, Artificial Sequence
  Synthetic
gcctttggctggaaccc

SEQ ID NO: 12815 - DNA, 17 bp, Artificial Sequence
  Synthetic
cccgatcgacccatgga

SEQ ID NO: 12816 - DNA, 16 bp, Artificial Sequence
  Synthetic
ctgggaagggccacgt

SEQ ID NO: 12817 - DNA, 20 bp, Artificial Sequence
  Synthetic
ggggtcatcttacacagctg

SEQ ID NO: 12818 - DNA, 17 bp, Artificial Sequence
  Synthetic
gccttgctgggttgctc

SEQ ID NO: 12819 - DNA, 20 bp, Artificial Sequence
  Synthetic
gcctcctcgtttatccaggt

SEQ ID NO: 12820 - DNA, 19 bp, Artificial Sequence
  Synthetic
tcggggtttaccttggtca

SEQ ID NO: 12821 - DNA, 20 bp, Artificial Sequence
  Synthetic
ggagaacttaaccacccacg

SEQ ID NO: 12822 - DNA, 20 bp, Artificial Sequence
  Synthetic
agaaacagcagaggaacagg

SEQ ID NO: 12823 - DNA, 16 bp, Artificial Sequence
  Synthetic
tggccgtggtcctggt

SEQ ID NO: 12824 - DNA, 18 bp, Artificial Sequence
  Synthetic
tggcagcagtgtctcgag

SEQ ID NO: 12825 - DNA, 19 bp, Artificial Sequence
  Synthetic
agccactgctacctcttgc

SEQ ID NO: 12826 - DNA, 20 bp, Artificial Sequence
  Synthetic
tttgtaccccaggactacca

SEQ ID NO: 12827 - DNA, 20 bp, Artificial Sequence
  Synthetic
ttggaagaggtggaacagga

SEQ ID NO: 12828 - DNA, 18 bp, Artificial Sequence
  Synthetic
aggaggaggcctgaggat

SEQ ID NO: 12829 - DNA, 18 bp, Artificial Sequence
  Synthetic
tcagaaaatccccgggcc

SEQ ID NO: 12830 - DNA, 19 bp, Artificial Sequence
  Synthetic
cggaggcattggaactctc

SEQ ID NO: 12831 - DNA, 18 bp, Artificial Sequence
  Synthetic
caccacctacaccgtgta

SEQ ID NO: 12832 - DNA, 20 bp, Artificial Sequence
  Synthetic
cttgctgggtggaaatcaat

SEQ ID NO: 12833 - DNA, 19 bp, Artificial Sequence
  Synthetic
actgcatgtggctagactt

SEQ ID NO: 12834 - DNA, 21 bp, Artificial Sequence
  Synthetic
ctttagtgggaccattagacc

SEQ ID NO: 12835 - DNA, 25 bp, Artificial Sequence
  Synthetic
taacaaagacggttctaatagagaa

SEQ ID NO: 12836 - DNA, 20 bp, Artificial Sequence
  Synthetic
cagcacttatgatggcatct

SEQ ID NO: 12837 - DNA, 23 bp, Artificial Sequence
  Synthetic
gagtattattaatgcatggccag

SEQ ID NO: 12838 - DNA, 18 bp, Artificial Sequence
  Synthetic
cacacctcacccgactgt

SEQ ID NO: 12839 - DNA, 24 bp, Artificial Sequence
  Synthetic
gctataatgctacaatggatatgc

SEQ ID NO: 12840 - DNA, 18 bp, Artificial Sequence
  Synthetic
cagcatcgccttgcctat

SEQ ID NO: 12841 - DNA, 19 bp, Artificial Sequence
  Synthetic
gtctacccctatggctacg

SEQ ID NO: 12842 - DNA, 20 bp, Artificial Sequence
  Synthetic
ctggaaagggtattggaaca

SEQ ID NO: 12843 - DNA, 21 bp, Artificial Sequence
  Synthetic
aaagctattggttttatgcct

SEQ ID NO: 12844 - DNA, 18 bp, Artificial Sequence
  Synthetic
tttacaccagcgcgggta

SEQ ID NO: 12845 - DNA, 18 bp, Artificial Sequence
  Synthetic
catcagtcttctggtgcg

SEQ ID NO: 12846 - DNA, 18 bp, Artificial Sequence
  Synthetic
ctctcaccagatccaggg

SEQ ID NO: 12847 - DNA, 20 bp, Artificial Sequence
  Synthetic
tgaaacaaaaagcccgtcca

SEQ ID NO: 12848 - DNA, 19 bp, Artificial Sequence
  Synthetic
ccctccatcgatttcatca

SEQ ID NO: 12849 - DNA, 19 bp, Artificial Sequence
  Synthetic
ctccaaagctagcacctaa

SEQ ID NO: 12850 - DNA, 21 bp, Artificial Sequence
  Synthetic
ccttgcggacatacaaaaatt

SEQ ID NO: 12851 - DNA, 21 bp, Artificial Sequence
  Synthetic
gcttaccagtagacaaagagc

SEQ ID NO: 12852 - DNA, 19 bp, Artificial Sequence
  Synthetic
aagggacaagtcacagaca

SEQ ID NO: 12853 - DNA, 22 bp, Artificial Sequence
  Synthetic
tttggacctatgatcaacaaga

SEQ ID NO: 12854 - DNA, 19 bp, Artificial Sequence
  Synthetic
ccgagccccttttatatgt

SEQ ID NO: 12855 - DNA, 20 bp, Artificial Sequence
  Synthetic
gtggtggagctatagaagtg

SEQ ID NO: 12856 - DNA, 18 bp, Artificial Sequence
  Synthetic
caagattgcacgaaggct

SEQ ID NO: 12857 - DNA, 20 bp, Artificial Sequence
  Synthetic
accacgaaaacaagaatcac

SEQ ID NO: 12858 - DNA, 22 bp, Artificial Sequence
  Synthetic
caagatcatagatcaagtgagg

SEQ ID NO: 12859 - DNA, 22 bp, Artificial Sequence
  Synthetic
gtacacccttatctgatgatgg

SEQ ID NO: 12860 - DNA, 21 bp, Artificial Sequence
  Synthetic
caagtgaaaatagctccaacc

SEQ ID NO: 12861 - DNA, 25 bp, Artificial Sequence
  Synthetic
cactccatataattacagatagagg

SEQ ID NO: 12862 - DNA, 18 bp, Artificial Sequence
  Synthetic
attttgcccggagaaagg

SEQ ID NO: 12863 - DNA, 21 bp, Artificial Sequence
  Synthetic
gtattacggcacagatcaaga

SEQ ID NO: 12864 - DNA, 22 bp, Artificial Sequence
  Synthetic
cagattcagggttgtatttgtc

SEQ ID NO: 12865 - DNA, 22 bp, Artificial Sequence
  Synthetic
ataagtttccatgtacatgcaa

SEQ ID NO: 12866 - DNA, 25 bp, Artificial Sequence
  Synthetic
tcgtaccattaatcaaatacagatc

SEQ ID NO: 12867 - DNA, 19 bp, Artificial Sequence
  Synthetic
ctctgaaggatgccttgga

SEQ ID NO: 12868 - DNA, 25 bp, Artificial Sequence
  Synthetic
ggactataggagaaaaaagtcttac

SEQ ID NO: 12869 - DNA, 21 bp, Artificial Sequence
  Synthetic
gtgtagtggctaattgcattg

SEQ ID NO: 12870 - DNA, 22 bp, Artificial Sequence
  Synthetic
cagatcaagtacattgtagcat

SEQ ID NO: 12871 - DNA, 19 bp, Artificial Sequence
  Synthetic
aagtcatgcaacagacagg

SEQ ID NO: 12872 - DNA, 25 bp, Artificial Sequence
  Synthetic
cagatatgtatcctgatttaaaccc

SEQ ID NO: 12873 - DNA, 23 bp, Artificial Sequence
  Synthetic
tctcatcgatacaaaaatgaaga

SEQ ID NO: 12874 - DNA, 24 bp, Artificial Sequence
  Synthetic
ataactcaaaattacttaggtgcc

SEQ ID NO: 12875 - DNA, 25 bp, Artificial Sequence
  Synthetic
atcaggtgtatatactgatgcatat

SEQ ID NO: 12876 - DNA, 24 bp, Artificial Sequence
  Synthetic
caccaaatacaaaatcagaaatgg

SEQ ID NO: 12877 - DNA, 23 bp, Artificial Sequence
  Synthetic
ttaaaattaaccggttatgtcct

SEQ ID NO: 12878 - DNA, 21 bp, Artificial Sequence
  Synthetic
gactctttgccaagatgacat

SEQ ID NO: 12879 - DNA, 23 bp, Artificial Sequence
  Synthetic
ctaatctctattagtgcaatcca

SEQ ID NO: 12880 - DNA, 25 bp, Artificial Sequence
  Synthetic
ccattaatcctactattacgtcaac

SEQ ID NO: 12881 - DNA, 18 bp, Artificial Sequence
  Synthetic
ggacactcagaaaaccgg

SEQ ID NO: 12882 - DNA, 21 bp, Artificial Sequence
  Synthetic
gaatcgcaatggtttacactt

SEQ ID NO: 12883 - DNA, 25 bp, Artificial Sequence
  Synthetic
tgatatacccttattttgttccact

SEQ ID NO: 12884 - DNA, 24 bp, Artificial Sequence
  Synthetic
tcaggaaatcttcaattaaggtgt

SEQ ID NO: 12885 - DNA, 21 bp, Artificial Sequence
  Synthetic
taactctaccttttgatgggc

SEQ ID NO: 12886 - DNA, 18 bp, Artificial Sequence
  Synthetic
caaaagcaggcaaaccat

SEQ ID NO: 12887 - DNA, 19 bp, Artificial Sequence
  Synthetic
caatggctttccttgagga

SEQ ID NO: 12888 - DNA, 21 bp, Artificial Sequence
  Synthetic
cgggaaggctaatagatttcc

SEQ ID NO: 12889 - DNA, 18 bp, Artificial Sequence
  Synthetic
ttcgtgcactttgtcgaa

SEQ ID NO: 12890 - DNA, 20 bp, Artificial Sequence
  Synthetic
cctgaatggtttagaaacgt

SEQ ID NO: 12891 - DNA, 22 bp, Artificial Sequence
  Synthetic
atgttcaacatgctaagtacag

SEQ ID NO: 12892 - DNA, 22 bp, Artificial Sequence
  Synthetic
acaagctttttctatcgctatg

SEQ ID NO: 12893 - DNA, 25 bp, Artificial Sequence
  Synthetic
gatcaaacttatacaatatccggaa

SEQ ID NO: 12894 - DNA, 20 bp, Artificial Sequence
  Synthetic
attctcaacacaagccaaag

SEQ ID NO: 12895 - DNA, 25 bp, Artificial Sequence
  Synthetic
gacctgggtacatatataaagaaac

SEQ ID NO: 12896 - DNA, 19 bp, Artificial Sequence
  Synthetic
catgcttggcacgtgaagt

SEQ ID NO: 12897 - DNA, 20 bp, Artificial Sequence
  Synthetic
tagtccttgaagagcgtcct

SEQ ID NO: 12898 - DNA, 18 bp, Artificial Sequence
  Synthetic
aggtaaccaggaaacgca

SEQ ID NO: 12899 - DNA, 23 bp, Artificial Sequence
  Synthetic
gtggggaatggtaatattaatgc

SEQ ID NO: 12900 - DNA, 22 bp, Artificial Sequence
  Synthetic
tagtttgtccatgttagtgcaa

SEQ ID NO: 12901 - DNA, 24 bp, Artificial Sequence
  Synthetic
ttgtaccatttattagtgccctta

SEQ ID NO: 12902 - DNA, 20 bp, Artificial Sequence
  Synthetic
atctgatcaacaggaggagg

SEQ ID NO: 12903 - DNA, 22 bp, Artificial Sequence
  Synthetic
attgaagtacatctgtcattgc

SEQ ID NO: 12904 - DNA, 22 bp, Artificial Sequence
  Synthetic
tcctgctgcttatacttttctg

SEQ ID NO: 12905 - DNA, 18 bp, Artificial Sequence
  Synthetic
gtgggctagtttgggggt

SEQ ID NO: 12906 - DNA, 18 bp, Artificial Sequence
  Synthetic
ccggctgtgttggacatt

SEQ ID NO: 12907 - DNA, 18 bp, Artificial Sequence
  Synthetic
ccgtagtggtaggcgcat

SEQ ID NO: 12908 - DNA, 21 bp, Artificial Sequence
  Synthetic
ctgatgttgattttgcacatg

SEQ ID NO: 12909 - DNA, 24 bp, Artificial Sequence
  Synthetic
caccaacttattttattatggtgg

SEQ ID NO: 12910 - DNA, 18 bp, Artificial Sequence
  Synthetic
gccattgattttgctgca

SEQ ID NO: 12911 - DNA, 19 bp, Artificial Sequence
  Synthetic
tagtggctctatggtgtcc

SEQ ID NO: 12912 - DNA, 20 bp, Artificial Sequence
  Synthetic
cctgaaattatggcctacct

SEQ ID NO: 12913 - DNA, 18 bp, Artificial Sequence
  Synthetic
ctacccctacatcctccc

SEQ ID NO: 12914 - DNA, 20 bp, Artificial Sequence
  Synthetic
actgtgtgtcatgtgtgtgt

SEQ ID NO: 12915 - DNA, 20 bp, Artificial Sequence
  Synthetic
aaactttatgtgttgcacct

SEQ ID NO: 12916 - DNA, 18 bp, Artificial Sequence
  Synthetic
gtgacggtgacattgcag

SEQ ID NO: 12917 - DNA, 23 bp, Artificial Sequence
  Synthetic
atgatccaaacaattcaaatcct

SEQ ID NO: 12918 - DNA, 19 bp, Artificial Sequence
  Synthetic
gagcactcacgtccctaac

SEQ ID NO: 12919 - DNA, 18 bp, Artificial Sequence
  Synthetic
ccctctcccattggtccg

SEQ ID NO: 12920 - DNA, 24 bp, Artificial Sequence
  Synthetic
cataggctcttgaaataaacaatg

SEQ ID NO: 12921 - DNA, 21 bp, Artificial Sequence
  Synthetic
cgagttccttatatgcttacc

SEQ ID NO: 12922 - DNA, 17 bp, Artificial Sequence
  Synthetic
gcgactgctggcttcaa

SEQ ID NO: 12923 - DNA, 16 bp, Artificial Sequence
  Synthetic
actggcgggtggctca

SEQ ID NO: 12924 - DNA, 16 bp, Artificial Sequence
  Synthetic
gtggtcctgggacgca

SEQ ID NO: 12925 - DNA, 17 bp, Artificial Sequence
  Synthetic
tagatcgggcagggtgg

SEQ ID NO: 12926 - DNA, 16 bp, Artificial Sequence
  Synthetic
ggtgtgtggtcgccct

SEQ ID NO: 12927 - DNA, 20 bp, Artificial Sequence
  Synthetic
tggtgtcggaagatttcgtg

SEQ ID NO: 12928 - DNA, 20 bp, Artificial Sequence
  Synthetic
cactccggtagtatctgcgt

SEQ ID NO: 12929 - DNA, 18 bp, Artificial Sequence
  Synthetic
ggtgtgccgcctagacac

SEQ ID NO: 12930 - DNA, 18 bp, Artificial Sequence
  Synthetic
gttttgggggtagcagcg

SEQ ID NO: 12931 - DNA, 18 bp, Artificial Sequence
  Synthetic
gcagtgactccatcatgg

SEQ ID NO: 12932 - DNA, 18 bp, Artificial Sequence
  Synthetic
gtggacacgctgacgaaa

SEQ ID NO: 12933 - DNA, 20 bp, Artificial Sequence
  Synthetic
cgcagcttggctatacagac

SEQ ID NO: 12934 - DNA, 19 bp, Artificial Sequence
  Synthetic
ctgaaaggagggagcacac

SEQ ID NO: 12935 - DNA, 17 bp, Artificial Sequence
  Synthetic
cggccaccggtagttca

SEQ ID NO: 12936 - DNA, 16 bp, Artificial Sequence
  Synthetic
cccggtggtgcagttg

SEQ ID NO: 12937 - DNA, 19 bp, Artificial Sequence
  Synthetic
gaaccgccggtcaaaacac

SEQ ID NO: 12938 - DNA, 16 bp, Artificial Sequence
  Synthetic
acaggcgcgcgtatgg

SEQ ID NO: 12939 - DNA, 17 bp, Artificial Sequence
  Synthetic
cttcggcaccggtttcc

SEQ ID NO: 12940 - DNA, 20 bp, Artificial Sequence
  Synthetic
ccccgtatatgtccaacggg

SEQ ID NO: 12941 - DNA, 18 bp, Artificial Sequence
  Synthetic
aacccgccacgtaaagga

SEQ ID NO: 12942 - DNA, 20 bp, Artificial Sequence
  Synthetic
tcttgtgaggcctctttgtg

SEQ ID NO: 12943 - DNA, 20 bp, Artificial Sequence
  Synthetic
tacggtggaaacaaaggacg

SEQ ID NO: 12944 - DNA, 19 bp, Artificial Sequence
  Synthetic
aaactcggcataccaacgg

SEQ ID NO: 12945 - DNA, 18 bp, Artificial Sequence
  Synthetic
gctaccgaccccgaaacc

SEQ ID NO: 12946 - DNA, 20 bp, Artificial Sequence
  Synthetic
aaacaactcccccatccacg

SEQ ID NO: 12947 - DNA, 19 bp, Artificial Sequence
  Synthetic
agtggagatcgaacagggc

SEQ ID NO: 12948 - DNA, 17 bp, Artificial Sequence
  Synthetic
cgcagggggagagaaca

SEQ ID NO: 12949 - DNA, 18 bp, Artificial Sequence
  Synthetic
agcacctgttctgcgacc

SEQ ID NO: 12950 - DNA, 18 bp, Artificial Sequence
  Synthetic
tgctgctcctgctcctcc

SEQ ID NO: 12951 - DNA, 20 bp, Artificial Sequence
  Synthetic
gaatgagtatccgtggtccc

SEQ ID NO: 12952 - DNA, 16 bp, Artificial Sequence
  Synthetic
ttgtccctcggggcca

SEQ ID NO: 12953 - DNA, 18 bp, Artificial Sequence
  Synthetic
gaaggtggacccggctat

SEQ ID NO: 12954 - DNA, 16 bp, Artificial Sequence
  Synthetic
gcacatggcgctccga

SEQ ID NO: 12955 - DNA, 19 bp, Artificial Sequence
  Synthetic
tgtgtaggaggttggccat

SEQ ID NO: 12956 - DNA, 19 bp, Artificial Sequence
  Synthetic
cgggtcatgcgatctgttt

SEQ ID NO: 12957 - DNA, 23 bp, Artificial Sequence
  Synthetic
cgaattcggttgtatataaacag

SEQ ID NO: 12958 - DNA, 18 bp, Artificial Sequence
  Synthetic
accagatgtgcaggccta

SEQ ID NO: 12959 - DNA, 20 bp, Artificial Sequence
  Synthetic
cgaagaggcgcttattcgag

SEQ ID NO: 12960 - DNA, 19 bp, Artificial Sequence
  Synthetic
atgctgctaaacattcccg

SEQ ID NO: 12961 - DNA, 18 bp, Artificial Sequence
  Synthetic
gggactggaagcccatag

SEQ ID NO: 12962 - DNA, 21 bp, Artificial Sequence
  Synthetic
gaaatcttttggatggacacc

SEQ ID NO: 12963 - DNA, 20 bp, Artificial Sequence
  Synthetic
ggtccggctagaaaatgtca

SEQ ID NO: 12964 - DNA, 16 bp, Artificial Sequence
  Synthetic
ggacgtgggaggtgca

SEQ ID NO: 12965 - DNA, 19 bp, Artificial Sequence
  Synthetic
tgggaacggtgataagaca

SEQ ID NO: 12966 - DNA, 21 bp, Artificial Sequence
  Synthetic
ggaacatatcctgtggtactg

SEQ ID NO: 12967 - DNA, 20 bp, Artificial Sequence
  Synthetic
tttggtggaggactctagca

SEQ ID NO: 12968 - DNA, 20 bp, Artificial Sequence
  Synthetic
actgaggagttggagatgga

SEQ ID NO: 12969 - DNA, 22 bp, Artificial Sequence
  Synthetic
aaacgtgtccactatttctttg

SEQ ID NO: 12970 - DNA, 21 bp, Artificial Sequence
  Synthetic
cccctccaatttactaacaca

SEQ ID NO: 12971 - DNA, 25 bp, Artificial Sequence
  Synthetic
gtctgatactaattataaggctacc

SEQ ID NO: 12972 - DNA, 21 bp, Artificial Sequence
  Synthetic
tgtttatgttgttgttgtgct

SEQ ID NO: 12973 - DNA, 25 bp, Artificial Sequence
  Synthetic
aggaaagtgatggatctatagtttc

SEQ ID NO: 12974 - DNA, 20 bp, Artificial Sequence
  Synthetic
cagaaggcgactatttgatg

SEQ ID NO: 12975 - DNA, 25 bp, Artificial Sequence
  Synthetic
acagcttaatgtcatttttagaagg

SEQ ID NO: 12976 - DNA, 24 bp, Artificial Sequence
  Synthetic
tgaggaccaaatattgtattggaa

SEQ ID NO: 12977 - DNA, 20 bp, Artificial Sequence
  Synthetic
ccagtactggtgggaagtct

SEQ ID NO: 12978 - DNA, 19 bp, Artificial Sequence
  Synthetic
gaagctgtcctgatgatgt

SEQ ID NO: 12979 - DNA, 24 bp, Artificial Sequence
  Synthetic
tccaggaactagtagtatagtacc

SEQ ID NO: 12980 - DNA, 18 bp, Artificial Sequence
  Synthetic
ctcaggcggttcagtttg

SEQ ID NO: 12981 - DNA, 18 bp, Artificial Sequence
  Synthetic
tgtccctacacttccacc

SEQ ID NO: 12982 - DNA, 18 bp, Artificial Sequence
  Synthetic
cgaaccagggtaaggtgt

SEQ ID NO: 12983 - DNA, 22 bp, Artificial Sequence
  Synthetic
catcaacacaacgattagtttg

SEQ ID NO: 12984 - DNA, 18 bp, Artificial Sequence
  Synthetic
ctgagcctccacaagaca

SEQ ID NO: 12985 - DNA, 19 bp, Artificial Sequence
  Synthetic
tgctaggcattttttcacc

SEQ ID NO: 12986 - DNA, 22 bp, Artificial Sequence
  Synthetic
gccattgaggatcattacagat

SEQ ID NO: 12987 - DNA, 18 bp, Artificial Sequence
  Synthetic
gggcttaaggggtcttac

SEQ ID NO: 12988 - DNA, 22 bp, Artificial Sequence
  Synthetic
tgcattctatagttcagaagcc

SEQ ID NO: 12989 - DNA, 25 bp, Artificial Sequence
  Synthetic
agttgctttattattactgaagctg

SEQ ID NO: 12990 - DNA, 25 bp, Artificial Sequence
  Synthetic
aagcaataaagttaactcctgaaag

SEQ ID NO: 12991 - DNA, 19 bp, Artificial Sequence
  Synthetic
gaagtgtacctgcagcatt

SEQ ID NO: 12992 - DNA, 18 bp, Artificial Sequence
  Synthetic
ctaccagcaggtcgccaa

SEQ ID NO: 12993 - DNA, 19 bp, Artificial Sequence
  Synthetic
gctatgagcacagtatggc

SEQ ID NO: 12994 - DNA, 18 bp, Artificial Sequence
  Synthetic
gtacacagccaggaggtt

SEQ ID NO: 12995 - DNA, 22 bp, Artificial Sequence
  Synthetic
gtccatagtacctttagctgaa

SEQ ID NO: 12996 - DNA, 25 bp, Artificial Sequence
  Synthetic
agatccctctattagtaaaactaca

SEQ ID NO: 12997 - DNA, 18 bp, Artificial Sequence
  Synthetic
caacacgtcctgctgaat

SEQ ID NO: 12998 - DNA, 23 bp, Artificial Sequence
  Synthetic
gcctaggtttaaaagtttacagt

SEQ ID NO: 12999 - DNA, 22 bp, Artificial Sequence
  Synthetic
gtggctaaagttttgtctacag

SEQ ID NO: 13000 - DNA, 18 bp, Artificial Sequence
  Synthetic
ccagaacatgaacgcctt

SEQ ID NO: 13001 - DNA, 18 bp, Artificial Sequence
  Synthetic
ggggacgctattccagat

SEQ ID NO: 13002 - DNA, 25 bp, Artificial Sequence
  Synthetic
ctagtaaaagaaagaagtcttctgc

SEQ ID NO: 13003 - DNA, 23 bp, Artificial Sequence
  Synthetic
aagcagagcatattcttagaact

SEQ ID NO: 13004 - DNA, 20 bp, Artificial Sequence
  Synthetic
ataccctcgtttatcttgcc

SEQ ID NO: 13005 - DNA, 20 bp, Artificial Sequence
  Synthetic
gctgaggcatctagtatcag

SEQ ID NO: 13006 - DNA, 21 bp, Artificial Sequence
  Synthetic
cttatgataacagacggctca

SEQ ID NO: 13007 - DNA, 23 bp, Artificial Sequence
  Synthetic
tgcacaaagacttatctagacac

SEQ ID NO: 13008 - DNA, 21 bp, Artificial Sequence
  Synthetic
ggtattcttttggcttcgaaa

SEQ ID NO: 13009 - DNA, 18 bp, Artificial Sequence
  Synthetic
ccacattcgttccagcta

SEQ ID NO: 13010 - DNA, 19 bp, Artificial Sequence
  Synthetic
cagcacagagagtttcaca

SEQ ID NO: 13011 - DNA, 18 bp, Artificial Sequence
  Synthetic
cgagtcttcgtgttagcc

SEQ ID NO: 13012 - DNA, 20 bp, Artificial Sequence
  Synthetic
atttgatgaaagcccaaagt

SEQ ID NO: 13013 - DNA, 21 bp, Artificial Sequence
  Synthetic
ctcatctgtgtatgctcatgg

SEQ ID NO: 13014 - DNA, 23 bp, Artificial Sequence
  Synthetic
aaacataagttcccattcaaaga

SEQ ID NO: 13015 - DNA, 22 bp, Artificial Sequence
  Synthetic
aacattggaaactgttaagaca

SEQ ID NO: 13016 - DNA, 25 bp, Artificial Sequence
  Synthetic
ctaatggtatatactgcttggaaag

SEQ ID NO: 13017 - DNA, 18 bp, Artificial Sequence
  Synthetic
ctagctccaccccaccat

SEQ ID NO: 13018 - DNA, 19 bp, Artificial Sequence
  Synthetic
ggtctagaaccaggacccg

SEQ ID NO: 13019 - DNA, 18 bp, Artificial Sequence
  Synthetic
cctgacaaggtgggatca

SEQ ID NO: 13020 - DNA, 25 bp, Artificial Sequence
  Synthetic
tcaaatattaactgaatctacaccc

SEQ ID NO: 13021 - DNA, 22 bp, Artificial Sequence
  Synthetic
ctcaacaagtaaatgtccagga

SEQ ID NO: 13022 - DNA, 18 bp, Artificial Sequence
  Synthetic
gagctacagtaggggctc

SEQ ID NO: 13023 - DNA, 21 bp, Artificial Sequence
  Synthetic
agttagtttatggtagtggca

SEQ ID NO: 13024 - DNA, 20 bp, Artificial Sequence
  Synthetic
agatgacctcgctatggtta

SEQ ID NO: 13025 - DNA, 21 bp, Artificial Sequence
  Synthetic
atcccaacagatttgcactag

SEQ ID NO: 13026 - DNA, 21 bp, Artificial Sequence
  Synthetic
tcttctatgctagacgtgaac

SEQ ID NO: 13027 - DNA, 25 bp, Artificial Sequence
  Synthetic
taatcctatacatgacacatatagg

SEQ ID NO: 13028 - DNA, 22 bp, Artificial Sequence
  Synthetic
attggttaatgctcattcccaa

SEQ ID NO: 13029 - DNA, 25 bp, Artificial Sequence
  Synthetic
ttacgctgaacatctaaataaaacc

SEQ ID NO: 13030 - DNA, 20 bp, Artificial Sequence
  Synthetic
ctaagagagtcagcaaaggc

SEQ ID NO: 13031 - DNA, 22 bp, Artificial Sequence
  Synthetic
atatgatgggcaaagagtgtac

SEQ ID NO: 13032 - DNA, 19 bp, Artificial Sequence
  Synthetic
ccctggcattattcaacga

SEQ ID NO: 13033 - DNA, 24 bp, Artificial Sequence
  Synthetic
acataccacctctaaaaatttcag

SEQ ID NO: 13034 - DNA, 21 bp, Artificial Sequence
  Synthetic
tggcataaagttaaaggggaa

SEQ ID NO: 13035 - DNA, 18 bp, Artificial Sequence
  Synthetic
cctgaaacagctgacaca

SEQ ID NO: 13036 - DNA, 20 bp, Artificial Sequence
  Synthetic
acaccaatcacaagtcgagc

SEQ ID NO: 13037 - DNA, 19 bp, Artificial Sequence
  Synthetic
gttgcttataactgctggc

SEQ ID NO: 13038 - DNA, 19 bp, Artificial Sequence
  Synthetic
tattgttggttgtgctcca

SEQ ID NO: 13039 - DNA, 22 bp, Artificial Sequence
  Synthetic
gtgatcgtttgtttttctttgg

SEQ ID NO: 13040 - DNA, 21 bp, Artificial Sequence
  Synthetic
tgaactcagctattttggatg

SEQ ID NO: 13041 - DNA, 19 bp, Artificial Sequence
  Synthetic
ctgaatctttgtcacccga

SEQ ID NO: 13042 - DNA, 25 bp, Artificial Sequence
  Synthetic
agtctttggatgatctatttgaaga

SEQ ID NO: 13043 - DNA, 19 bp, Artificial Sequence
  Synthetic
ggatttctcctcgcaaacc

SEQ ID NO: 13044 - DNA, 24 bp, Artificial Sequence
  Synthetic
taagaagtcgtttactaatacctc

SEQ ID NO: 13045 - DNA, 21 bp, Artificial Sequence
  Synthetic
ccaaatctccatcaagaagac

SEQ ID NO: 13046 - DNA, 20 bp, Artificial Sequence
  Synthetic
cgtttgcaagtgtttggaag

SEQ ID NO: 13047 - DNA, 20 bp, Artificial Sequence
  Synthetic
cccatctgttgtacccctta

SEQ ID NO: 13048 - DNA, 21 bp, Artificial Sequence
  Synthetic
atttgaaattgaaaatcccgc

SEQ ID NO: 13049 - DNA, 20 bp, Artificial Sequence
  Synthetic
ttagtatggcagcttaaggg

SEQ ID NO: 13050 - DNA, 23 bp, Artificial Sequence
  Synthetic
gtgattgtccagctatagaatta

SEQ ID NO: 13051 - DNA, 25 bp, Artificial Sequence
  Synthetic
tgcctgatagttataaatatactgc

SEQ ID NO: 13052 - DNA, 22 bp, Artificial Sequence
  Synthetic
gccaaaatctgttaacaactgt

SEQ ID NO: 13053 - DNA, 21 bp, Artificial Sequence
  Synthetic
cacttttgaagcaaaaaaggc

SEQ ID NO: 13054 - DNA, 23 bp, Artificial Sequence
  Synthetic
tttagcttctctagttgaaaagc

SEQ ID NO: 13055 - DNA, 24 bp, Artificial Sequence
  Synthetic
gagcaacgactatttagaattgac

SEQ ID NO: 13056 - DNA, 21 bp, Artificial Sequence
  Synthetic
gtctaatacaccgagacaaca

SEQ ID NO: 13057 - DNA, 24 bp, Artificial Sequence
  Synthetic
gcactgttcttttatagaaaatcg

SEQ ID NO: 13058 - DNA, 20 bp, Artificial Sequence
  Synthetic
taccactctttctccccctg

SEQ ID NO: 13059 - DNA, 18 bp, Artificial Sequence
  Synthetic
gagaggtgggaggaagac

SEQ ID NO: 13060 - DNA, 23 bp, Artificial Sequence
  Synthetic
agtattttattctttgggggatt

SEQ ID NO: 13061 - DNA, 21 bp, Artificial Sequence
  Synthetic
cccttagttgaattaggccaa

SEQ ID NO: 13062 - DNA, 21 bp, Artificial Sequence
  Synthetic
tgtggattctcattttgatgg

SEQ ID NO: 13063 - DNA, 22 bp, Artificial Sequence
  Synthetic
agttaggtgacactgaaaatcc

SEQ ID NO: 13064 - DNA, 21 bp, Artificial Sequence
  Synthetic
ggcgatatgtgtgatataggc

SEQ ID NO: 13065 - DNA, 20 bp, Artificial Sequence
  Synthetic
cctgcaaaagagaaggtaga

SEQ ID NO: 13066 - DNA, 25 bp, Artificial Sequence
  Synthetic
attctgtatgaaggcattattatgc

SEQ ID NO: 13067 - DNA, 19 bp, Artificial Sequence
  Synthetic
cgatttcggtaccaaaagg

SEQ ID NO: 13068 - DNA, 22 bp, Artificial Sequence
  Synthetic
aagcagggttaataatcactca

SEQ ID NO: 13069 - DNA, 19 bp, Artificial Sequence
  Synthetic
gagcaatggtggatcaagt

SEQ ID NO: 13070 - DNA, 18 bp, Artificial Sequence
  Synthetic
acgagaatccagcacaca

SEQ ID NO: 13071 - DNA, 19 bp, Artificial Sequence
  Synthetic
caaaccagtgtgcaaccta

SEQ ID NO: 13072 - DNA, 24 bp, Artificial Sequence
  Synthetic
caagcatagtttatagaaagggag

SEQ ID NO: 13073 - DNA, 22 bp, Artificial Sequence
  Synthetic
tgagacagcagtataatcatgc

SEQ ID NO: 13074 - DNA, 23 bp, Artificial Sequence
  Synthetic
agtaatgtaataacaacacaggc

SEQ ID NO: 13075 - DNA, 19 bp, Artificial Sequence
  Synthetic
tggtagtggtaaacagcaa

SEQ ID NO: 13076 - DNA, 19 bp, Artificial Sequence
  Synthetic
ggatacagcgacaaacaca

SEQ ID NO: 13077 - DNA, 22 bp, Artificial Sequence
  Synthetic
acaaatgaacatgaaacaatgg

SEQ ID NO: 13078 - DNA, 25 bp, Artificial Sequence
  Synthetic
aaggtatatattatgtacatgacgg

SEQ ID NO: 13079 - DNA, 24 bp, Artificial Sequence
  Synthetic
ctatagttatacaacaacaaacgc

SEQ ID NO: 13080 - DNA, 25 bp, Artificial Sequence
  Synthetic
atacctttattacttgtatatgccc

SEQ ID NO: 13081 - DNA, 22 bp, Artificial Sequence
  Synthetic
attagacattacacctaccact

SEQ ID NO: 13082 - DNA, 20 bp, Artificial Sequence
  Synthetic
ccccacattccttaccaaac

SEQ ID NO: 13083 - DNA, 18 bp, Artificial Sequence
  Synthetic
aggccccatttgacacta

SEQ ID NO: 13084 - DNA, 23 bp, Artificial Sequence
  Synthetic
ccaatatattttatcatgcaggc

SEQ ID NO: 13085 - DNA, 23 bp, Artificial Sequence
  Synthetic
aggctcagttgtttaataaacct

SEQ ID NO: 13086 - DNA, 19 bp, Artificial Sequence
  Synthetic
tgtctgcagaaactatggc

SEQ ID NO: 13087 - DNA, 20 bp, Artificial Sequence
  Synthetic
gggttcgtactaaaccttct

SEQ ID NO: 13088 - DNA, 22 bp, Artificial Sequence
  Synthetic
cgtgtggttacataaactaagg

SEQ ID NO: 13089 - DNA, 23 bp, Artificial Sequence
  Synthetic
ctgcactttatgtttttttttgc

SEQ ID NO: 13090 - DNA, 21 bp, Artificial Sequence
  Synthetic
tatagggtgtaaccgaaaacg

SEQ ID NO: 13091 - DNA, 23 bp, Artificial Sequence
  Synthetic
gtaagaatgcatggaaaaaaacc

SEQ ID NO: 13092 - DNA, 18 bp, Artificial Sequence
  Synthetic
ctgcttatgggtgcacta

SEQ ID NO: 13093 - DNA, 20 bp, Artificial Sequence
  Synthetic
aacattagtgaaacggtggg

SEQ ID NO: 13094 - DNA, 21 bp, Artificial Sequence
  Synthetic
agtttatgcaaggtgtggtta

SEQ ID NO: 13095 - DNA, 23 bp, Artificial Sequence
  Synthetic
ggaaatatttgcacagtagaatg

SEQ ID NO: 13096 - DNA, 18 bp, Artificial Sequence
  Synthetic
cgtgcgactggaaaatgt

SEQ ID NO: 13097 - DNA, 18 bp, Artificial Sequence
  Synthetic
gtaaacgtgcatcagcca

SEQ ID NO: 13098 - DNA, 23 bp, Artificial Sequence
  Synthetic
cctcctgttattacatctgtagg

SEQ ID NO: 13099 - DNA, 18 bp, Artificial Sequence
  Synthetic
gcctgcaagataccacat

SEQ ID NO: 13100 - DNA, 18 bp, Artificial Sequence
  Synthetic
acctgtacagccttctgg

SEQ ID NO: 13101 - DNA, 23 bp, Artificial Sequence
  Synthetic
gtggaaacatagcagatagtagg

SEQ ID NO: 13102 - DNA, 25 bp, Artificial Sequence
  Synthetic
tccaacactatatgtaaatatccag

SEQ ID NO: 13103 - DNA, 25 bp, Artificial Sequence
  Synthetic
taaactatatatgttgtgtgagtgg

SEQ ID NO: 13104 - DNA, 22 bp, Artificial Sequence
  Synthetic
tcttgcaatagtcagtcttgtc

SEQ ID NO: 13105 - DNA, 19 bp, Artificial Sequence
  Synthetic
ctcggaaaccctatgtgtg

SEQ ID NO: 13106 - DNA, 23 bp, Artificial Sequence
  Synthetic
gcttatcaaaaagaacagtgcat

SEQ ID NO: 13107 - DNA, 23 bp, Artificial Sequence
  Synthetic
ttcttctggacaattttaaagcc

SEQ ID NO: 13108 - DNA, 18 bp, Artificial Sequence
  Synthetic
cttgcgactggactcaga

SEQ ID NO: 13109 - DNA, 24 bp, Artificial Sequence
  Synthetic
gttggaagggaatttaataacttg

SEQ ID NO: 13110 - DNA, 23 bp, Artificial Sequence
  Synthetic
tgtatggaaagtgtaaaaaacgg

SEQ ID NO: 13111 - DNA, 21 bp, Artificial Sequence
  Synthetic
agcaaaagcagggtagataat

SEQ ID NO: 13112 - DNA, 19 bp, Artificial Sequence
  Synthetic
tgcttttgacgaaaggaga

SEQ ID NO: 13113 - DNA, 19 bp, Artificial Sequence
  Synthetic
tctgatgcaaggttcaact

SEQ ID NO: 13114 - DNA, 19 bp, Artificial Sequence
  Synthetic
atgagaatccagcacacaa

SEQ ID NO: 13115 - DNA, 19 bp, Artificial Sequence
  Synthetic
atgagaggacaaaaggcaa

SEQ ID NO: 13116 - DNA, 23 bp, Artificial Sequence
  Synthetic
cagcagcttaagattctaaaacg

SEQ ID NO: 13117 - DNA, 18 bp, Artificial Sequence
  Synthetic
aatactggaggcagcaaa

SEQ ID NO: 13118 - DNA, 20 bp, Artificial Sequence
  Synthetic
cctgatacgggcaaatcaat

SEQ ID NO: 13119 - DNA, 25 bp, Artificial Sequence
  Synthetic
ccaataataacaattactgatgcag

SEQ ID NO: 13120 - DNA, 23 bp, Artificial Sequence
  Synthetic
tatgaactgtttatgacacctcc

SEQ ID NO: 13121 - DNA, 23 bp, Artificial Sequence
  Synthetic
cgaatccaacaaagaaaacataa

SEQ ID NO: 13122 - DNA, 19 bp, Artificial Sequence
  Synthetic
acaagtgccgttattgagg

SEQ ID NO: 13123 - DNA, 24 bp, Artificial Sequence
  Synthetic
ttatgatttcagctctatagatgc

SEQ ID NO: 13124 - DNA, 20 bp, Artificial Sequence
  Synthetic
cctttttctgtgccttctgt

SEQ ID NO: 13125 - DNA, 22 bp, Artificial Sequence
  Synthetic
tcctaatggatatcaaaagggt

SEQ ID NO: 13126 - DNA, 19 bp, Artificial Sequence
  Synthetic
ccataatggcactgttggt

SEQ ID NO: 13127 - DNA, 22 bp, Artificial Sequence
  Synthetic
caccgtctacctctattgaaac

SEQ ID NO: 13128 - DNA, 21 bp, Artificial Sequence
  Synthetic
ggctctgctacatatttttcg

SEQ ID NO: 13129 - DNA, 18 bp, Artificial Sequence
  Synthetic
tacctgaagaggaggagc

SEQ ID NO: 13130 - DNA, 25 bp, Artificial Sequence
  Synthetic
actaactcatcatttaagtttggag

SEQ ID NO: 13131 - DNA, 23 bp, Artificial Sequence
  Synthetic
tgtatctttcatgaataggcaaa

SEQ ID NO: 13132 - DNA, 19 bp, Artificial Sequence
  Synthetic
tgctaaaacagtggaagca

SEQ ID NO: 13133 - DNA, 20 bp, Artificial Sequence
  Synthetic
gcactccactatttcctccc

SEQ ID NO: 13134 - DNA, 19 bp, Artificial Sequence
  Synthetic
accagagaagctcccagaa

SEQ ID NO: 13135 - DNA, 18 bp, Artificial Sequence
  Synthetic
tggggaagaggaagatgt

SEQ ID NO: 13136 - DNA, 22 bp, Artificial Sequence
  Synthetic
cctaatgtaaatgtgtttgtgg

SEQ ID NO: 13137 - DNA, 18 bp, Artificial Sequence
  Synthetic
cgcctttacggatgacat

SEQ ID NO: 13138 - DNA, 21 bp, Artificial Sequence
  Synthetic
aggctggagaaatagaaatgc

SEQ ID NO: 13139 - DNA, 18 bp, Artificial Sequence
  Synthetic
tgtggaggttggaaggta

SEQ ID NO: 13140 - DNA, 18 bp, Artificial Sequence
  Synthetic
agcgggtattgatggtga

SEQ ID NO: 13141 - DNA, 19 bp, Artificial Sequence
  Synthetic
aaatgtcctccagatgctg

SEQ ID NO: 13142 - DNA, 21 bp, Artificial Sequence
  Synthetic
catggggtcaatatttttgcc

SEQ ID NO: 13143 - DNA, 21 bp, Artificial Sequence
  Synthetic
tgtattgttcaacaacagctg

SEQ ID NO: 13144 - DNA, 25 bp, Artificial Sequence
  Synthetic
aagacatttgctattagacttttgg

SEQ ID NO: 13145 - DNA, 18 bp, Artificial Sequence
  Synthetic
ggaaattccctggcattg

SEQ ID NO: 13146 - DNA, 25 bp, Artificial Sequence
  Synthetic
atgcattaccatttgataatgaagg

SEQ ID NO: 13147 - DNA, 19 bp, Artificial Sequence
  Synthetic
aaccccagaagactccgtg

SEQ ID NO: 13148 - DNA, 18 bp, Artificial Sequence
  Synthetic
gatttgtcccgtctccag

SEQ ID NO: 13149 - DNA, 18 bp, Artificial Sequence
  Synthetic
ggtctcgggattggtact

SEQ ID NO: 13150 - DNA, 21 bp, Artificial Sequence
  Synthetic
aggttgtaacaacacctgatc

SEQ ID NO: 13151 - DNA, 19 bp, Artificial Sequence
  Synthetic
tgcacattttacaggtgac

SEQ ID NO: 13152 - DNA, 20 bp, Artificial Sequence
  Synthetic
tgaccctgatgtaacaatga

SEQ ID NO: 13153 - DNA, 22 bp, Artificial Sequence
  Synthetic
gtactcctctagaaccttatgc

SEQ ID NO: 13154 - DNA, 20 bp, Artificial Sequence
  Synthetic
ttccatatacttccacgctg

SEQ ID NO: 13155 - DNA, 20 bp, Artificial Sequence
  Synthetic
taggagacacagaaaatccc

SEQ ID NO: 13156 - DNA, 22 bp, Artificial Sequence
  Synthetic
taataggagctcaagacaatca

SEQ ID NO: 13157 - DNA, 18 bp, Artificial Sequence
  Synthetic
ctcccctgcgaggaacca

SEQ ID NO: 13158 - DNA, 20 bp, Artificial Sequence
  Synthetic
accaaaagaaacaccgtccg

SEQ ID NO: 13159 - DNA, 20 bp, Artificial Sequence
  Synthetic
cctcggtaaggtgatcgaca

SEQ ID NO: 13160 - DNA, 20 bp, Artificial Sequence
  Synthetic
aacagacaacgccatcctac

SEQ ID NO: 13161 - DNA, 15 bp, Artificial Sequence
  Synthetic
acgtcaccggccaca

SEQ ID NO: 13162 - DNA, 20 bp, Artificial Sequence
  Synthetic
atgactctttgcagacaggg

SEQ ID NO: 13163 - DNA, 20 bp, Artificial Sequence
  Synthetic
gctcatggatgaacacaacg

SEQ ID NO: 13164 - DNA, 16 bp, Artificial Sequence
  Synthetic
tgcaattggacgcggg

SEQ ID NO: 13165 - DNA, 20 bp, Artificial Sequence
  Synthetic
tgatgatgcttatggcccag

SEQ ID NO: 13166 - DNA, 20 bp, Artificial Sequence
  Synthetic
agcccttattctctggtggg

SEQ ID NO: 13167 - DNA, 16 bp, Artificial Sequence
  Synthetic
cgctggaccggcactt

SEQ ID NO: 13168 - DNA, 19 bp, Artificial Sequence
  Synthetic
ctacccttgtcgtgagcct

SEQ ID NO: 13169 - DNA, 19 bp, Artificial Sequence
  Synthetic
tacagcgtccctactgtcc

SEQ ID NO: 13170 - DNA, 20 bp, Artificial Sequence
  Synthetic
gcttaatccatcagtcgcgg

SEQ ID NO: 13171 - DNA, 18 bp, Artificial Sequence
  Synthetic
cttggcaacgatggggaa

SEQ ID NO: 13172 - DNA, 19 bp, Artificial Sequence
  Synthetic
gacttctccttggacccca

SEQ ID NO: 13173 - DNA, 20 bp, Artificial Sequence
  Synthetic
tactggcagtgttgttgtgg

SEQ ID NO: 13174 - DNA, 20 bp, Artificial Sequence
  Synthetic
actgccaggtaatccaactg

SEQ ID NO: 13175 - DNA, 20 bp, Artificial Sequence
  Synthetic
ctggcaaacctcttacctgc

SEQ ID NO: 13176 - DNA, 19 bp, Artificial Sequence
  Synthetic
tgcatggtcctatccgact

SEQ ID NO: 13177 - DNA, 20 bp, Artificial Sequence
  Synthetic
tcgtcacaatgaccagcatt

SEQ ID NO: 13178 - DNA, 18 bp, Artificial Sequence
  Synthetic
cgagtacgcacctcccca

SEQ ID NO: 13179 - DNA, 18 bp, Artificial Sequence
  Synthetic
ctgcccactcagccagat

SEQ ID NO: 13180 - DNA, 20 bp, Artificial Sequence
  Synthetic
ggcttctcatatgacacccg

SEQ ID NO: 13181 - DNA, 16 bp, Artificial Sequence
  Synthetic
aaagcggctgcagcag

SEQ ID NO: 13182 - DNA, 20 bp, Artificial Sequence
  Synthetic
tgcggtctctacctcttcaa

SEQ ID NO: 13183 - DNA, 23 bp, Artificial Sequence
  Synthetic
atttctaaaaaatgttgctcctg

SEQ ID NO: 13184 - DNA, 25 bp, Artificial Sequence
  Synthetic
cttctagtttgaaaaaatcagaagg

SEQ ID NO: 13185 - DNA, 18 bp, Artificial Sequence
  Synthetic
aacattcccatacaccgg

SEQ ID NO: 13186 - DNA, 24 bp, Artificial Sequence
  Synthetic
ctttggatagaatggatgaagaac

SEQ ID NO: 13187 - DNA, 23 bp, Artificial Sequence
  Synthetic
aaacttggctaaaaatatctgtg

SEQ ID NO: 13188 - DNA, 18 bp, Artificial Sequence
  Synthetic
gagtcgctggagtgaatg

SEQ ID NO: 13189 - DNA, 22 bp, Artificial Sequence
  Synthetic
agagatggtctattagtagcag

SEQ ID NO: 13190 - DNA, 25 bp, Artificial Sequence
  Synthetic
aaaggaacagatctatactaaacac

SEQ ID NO: 13191 - DNA, 20 bp, Artificial Sequence
  Synthetic
ccaaaagcataacaatggcc

SEQ ID NO: 13192 - DNA, 20 bp, Artificial Sequence
  Synthetic
ccagaatgtgataggcttct

SEQ ID NO: 13193 - DNA, 18 bp, Artificial Sequence
  Synthetic
gtctggctgacacgtaaa

SEQ ID NO: 13194 - DNA, 21 bp, Artificial Sequence
  Synthetic
gggacaccataaattttgaga

SEQ ID NO: 13195 - DNA, 21 bp, Artificial Sequence
  Synthetic
gttccccagattgaatcaaga

SEQ ID NO: 13196 - DNA, 21 bp, Artificial Sequence
  Synthetic
gcaaataaatcaattcagccg

SEQ ID NO: 13197 - DNA, 24 bp, Artificial Sequence
  Synthetic
ttaaggagagacataagatgaaag

SEQ ID NO: 13198 - DNA, 21 bp, Artificial Sequence
  Synthetic
ggatagatctggtcttacagc

SEQ ID NO: 13199 - DNA, 22 bp, Artificial Sequence
  Synthetic
agcatcattattgtctttgact

SEQ ID NO: 13200 - DNA, 21 bp, Artificial Sequence
  Synthetic
acacattagtagtagcgagtg

SEQ ID NO: 13201 - DNA, 23 bp, Artificial Sequence
  Synthetic
tgatttctgatcagttaccaatc

SEQ ID NO: 13202 - DNA, 25 bp, Artificial Sequence
  Synthetic
ccagcagatttacttataaaagaac

SEQ ID NO: 13203 - DNA, 23 bp, Artificial Sequence
  Synthetic
acacacttgaaaatataacaacc

SEQ ID NO: 13204 - DNA, 21 bp, Artificial Sequence
  Synthetic
tgtggttcaactaatcaaaca

SEQ ID NO: 13205 - DNA, 19 bp, Artificial Sequence
  Synthetic
tccaaaaacaaggaccaac

SEQ ID NO: 13206 - DNA, 18 bp, Artificial Sequence
  Synthetic
agcccaccacaaaacaac

SEQ ID NO: 13207 - DNA, 20 bp, Artificial Sequence
  Synthetic
atcagaactacactgctcac

SEQ ID NO: 13208 - DNA, 25 bp, Artificial Sequence
  Synthetic
caaatcaaccagaatcaaaatcaac

SEQ ID NO: 13209 - DNA, 20 bp, Artificial Sequence
  Synthetic
ctagaaggggaagtgaacaa

SEQ ID NO: 13210 - DNA, 19 bp, Artificial Sequence
  Synthetic
aagggtccaacatctgttt

SEQ ID NO: 13211 - DNA, 19 bp, Artificial Sequence
  Synthetic
actgctcctatactgcaag

SEQ ID NO: 13212 - DNA, 19 bp, Artificial Sequence
  Synthetic
aaataagtggagctgcaga

SEQ ID NO: 13213 - DNA, 23 bp, Artificial Sequence
  Synthetic
atcaaagttatcttaacaaccct

SEQ ID NO: 13214 - DNA, 22 bp, Artificial Sequence
  Synthetic
caatagactggcagttactgag

SEQ ID NO: 13215 - DNA, 21 bp, Artificial Sequence
  Synthetic
cttagcataggaattcttggg

SEQ ID NO: 13216 - DNA, 20 bp, Artificial Sequence
  Synthetic
atcactcccctgtgaggaac

SEQ ID NO: 13217 - DNA, 20 bp, Artificial Sequence
  Synthetic
accaaacgtaacaccaaccg

SEQ ID NO: 13218 - DNA, 20 bp, Artificial Sequence
  Synthetic
catcgatacccttacgtgcg

SEQ ID NO: 13219 - DNA, 16 bp, Artificial Sequence
  Synthetic
gccgatgccatcctgc

SEQ ID NO: 13220 - DNA, 20 bp, Artificial Sequence
  Synthetic
tgatgatgaactggtcccct

SEQ ID NO: 13221 - DNA, 20 bp, Artificial Sequence
  Synthetic
ttcaactcttcaggctgtcc

SEQ ID NO: 13222 - DNA, 20 bp, Artificial Sequence
  Synthetic
tccttaacaacaccaggcca

SEQ ID NO: 13223 - DNA, 16 bp, Artificial Sequence
  Synthetic
gcacaggctggaagcg

SEQ ID NO: 13224 - DNA, 18 bp, Artificial Sequence
  Synthetic
cggctttggagaacctcg

SEQ ID NO: 13225 - DNA, 19 bp, Artificial Sequence
  Synthetic
tgtgtagtacacccgaccc

SEQ ID NO: 13226 - DNA, 17 bp, Artificial Sequence
  Synthetic
agactgggcgcacaacg

SEQ ID NO: 13227 - DNA, 20 bp, Artificial Sequence
  Synthetic
aactgctacccaaaccttcc

SEQ ID NO: 13228 - DNA, 16 bp, Artificial Sequence
  Synthetic
cacgccgtgggcctat

SEQ ID NO: 13229 - DNA, 20 bp, Artificial Sequence
  Synthetic
cctaatatcaggaccggggt

SEQ ID NO: 13230 - DNA, 19 bp, Artificial Sequence
  Synthetic
ggtgatcaaggggggaaga

SEQ ID NO: 13231 - DNA, 18 bp, Artificial Sequence
  Synthetic
caggactggcagggggaa

SEQ ID NO: 13232 - DNA, 19 bp, Artificial Sequence
  Synthetic
ccatcgtgggaccagatgt

SEQ ID NO: 13233 - DNA, 20 bp, Artificial Sequence
  Synthetic
gatggaagagtgctctcagc

SEQ ID NO: 13234 - DNA, 20 bp, Artificial Sequence
  Synthetic
tcaacatattgggggggtgg

SEQ ID NO: 13235 - DNA, 19 bp, Artificial Sequence
  Synthetic
gctaatagccttcgcctcc

SEQ ID NO: 13236 - DNA, 18 bp, Artificial Sequence
  Synthetic
ttatgcacactcgctgcc

SEQ ID NO: 13237 - DNA, 18 bp, Artificial Sequence
  Synthetic
gcgcctacacaggtttgc

SEQ ID NO: 13238 - DNA, 16 bp, Artificial Sequence
  Synthetic
caggagatgggcggca

SEQ ID NO: 13239 - DNA, 20 bp, Artificial Sequence
  Synthetic
cctatctactgccttggccg

SEQ ID NO: 13240 - DNA, 18 bp, Artificial Sequence
  Synthetic
caactcgttgctacgcca

SEQ ID NO: 13241 - DNA, 20 bp, Artificial Sequence
  Synthetic
gaacgaggttttctgcgttc

SEQ ID NO: 13242 - DNA, 20 bp, Artificial Sequence
  Synthetic
accaatgttgtgacctggac

SEQ ID NO: 13243 - DNA, 19 bp, Artificial Sequence
  Synthetic
acatcatgctcctccaacg

SEQ ID NO: 13244 - DNA, 20 bp, Artificial Sequence
  Synthetic
ttcaaagactccatggcctc

SEQ ID NO: 13245 - DNA, 18 bp, Artificial Sequence
  Synthetic
actttgtgcgacaatgct

SEQ ID NO: 13246 - DNA, 18 bp, Artificial Sequence
  Synthetic
gaacaatggcctggacag

SEQ ID NO: 13247 - DNA, 18 bp, Artificial Sequence
  Synthetic
attacctcctggcttgga

SEQ ID NO: 13248 - DNA, 22 bp, Artificial Sequence
  Synthetic
ttgacagattcaagttggattg

SEQ ID NO: 13249 - DNA, 25 bp, Artificial Sequence
  Synthetic
ttataaaaggaagatcccatttgag

SEQ ID NO: 13250 - DNA, 19 bp, Artificial Sequence
  Synthetic
gcccttttcaatcccttca

SEQ ID NO: 13251 - DNA, 21 bp, Artificial Sequence
  Synthetic
tattgaggaattgtcaaggga

SEQ ID NO: 13252 - DNA, 20 bp, Artificial Sequence
  Synthetic
ctcatcggaggacttgaatg

SEQ ID NO: 13253 - DNA, 22 bp, Artificial Sequence
  Synthetic
cgaaaccggtacatataaaagc

SEQ ID NO: 13254 - DNA, 18 bp, Artificial Sequence
  Synthetic
atgcatggaaatgtggct

SEQ ID NO: 13255 - DNA, 18 bp, Artificial Sequence
  Synthetic
catggcggataaccaagg

SEQ ID NO: 13256 - DNA, 20 bp, Artificial Sequence
  Synthetic
ggcagtccgtatgtaagtcc

SEQ ID NO: 13257 - DNA, 19 bp, Artificial Sequence
  Synthetic
tgctacaacacaatgctgg

SEQ ID NO: 13258 - DNA, 18 bp, Artificial Sequence
  Synthetic
gtcacgtttagcgctgaa

SEQ ID NO: 13259 - DNA, 18 bp, Artificial Sequence
  Synthetic
gcacaaggccattgaact

SEQ ID NO: 13260 - DNA, 22 bp, Artificial Sequence
  Synthetic
aggtgtgcagtaatatagatgc

SEQ ID NO: 13261 - DNA, 19 bp, Artificial Sequence
  Synthetic
caggaccctgcctttttac

SEQ ID NO: 13262 - DNA, 21 bp, Artificial Sequence
  Synthetic
atacacctatacccacatcct

SEQ ID NO: 13263 - DNA, 21 bp, Artificial Sequence
  Synthetic
ggctatggattttaaaaccct

SEQ ID NO: 13264 - DNA, 20 bp, Artificial Sequence
  Synthetic
aactcctagtggctctatgg

SEQ ID NO: 13265 - DNA, 23 bp, Artificial Sequence
  Synthetic
agatgttatggcctatattcatg

SEQ ID NO: 13266 - DNA, 16 bp, Artificial Sequence
  Synthetic
ccgccgccttacctga

SEQ ID NO: 13267 - DNA, 17 bp, Artificial Sequence
  Synthetic
caactctgctggctcgg

SEQ ID NO: 13268 - DNA, 18 bp, Artificial Sequence
  Synthetic
ccctcctagccagcctac

SEQ ID NO: 13269 - DNA, 19 bp, Artificial Sequence
  Synthetic
ggaagcccccagtttatgc

SEQ ID NO: 13270 - DNA, 20 bp, Artificial Sequence
  Synthetic
aaggcgagaataccagcaac

SEQ ID NO: 13271 - DNA, 18 bp, Artificial Sequence
  Synthetic
cctggacccccaaagaca

SEQ ID NO: 13272 - DNA, 20 bp, Artificial Sequence
  Synthetic
ggtcgtgatgccttacaaca

SEQ ID NO: 13273 - DNA, 18 bp, Artificial Sequence
  Synthetic
ggaggcaggccatatcga

SEQ ID NO: 13274 - DNA, 18 bp, Artificial Sequence
  Synthetic
ccggcactagatacgcct

SEQ ID NO: 13275 - DNA, 18 bp, Artificial Sequence
  Synthetic
ctgggcgctacctgaact

SEQ ID NO: 13276 - DNA, 19 bp, Artificial Sequence
  Synthetic
ccactgtggtgttccagtc

SEQ ID NO: 13277 - DNA, 18 bp, Artificial Sequence
  Synthetic
aaggcaggtcctctcagg

SEQ ID NO: 13278 - DNA, 21 bp, Artificial Sequence
  Synthetic
taggcaagcctagctacataa

SEQ ID NO: 13279 - DNA, 19 bp, Artificial Sequence
  Synthetic
tggaaaggaccacaggagg

SEQ ID NO: 13280 - DNA, 20 bp, Artificial Sequence
  Synthetic
catcctcggtgattacagcc

SEQ ID NO: 13281 - DNA, 21 bp, Artificial Sequence
  Synthetic
ctcttattcagacccttgttc

SEQ ID NO: 13282 - DNA, 20 bp, Artificial Sequence
  Synthetic
cataactccctcatcctgcc

SEQ ID NO: 13283 - DNA, 20 bp, Artificial Sequence
  Synthetic
aaaccctgagtcatccctgt

SEQ ID NO: 13284 - DNA, 15 bp, Artificial Sequence
  Synthetic
tgcgccgtgccttct

SEQ ID NO: 13285 - DNA, 20 bp, Artificial Sequence
  Synthetic
ccaaggataatagcccgtcc

SEQ ID NO: 13286 - DNA, 20 bp, Artificial Sequence
  Synthetic
gagcatcagatcacctggga

SEQ ID NO: 13287 - DNA, 20 bp, Artificial Sequence
  Synthetic
tttggacatttaccgatggc

SEQ ID NO: 13288 - DNA, 19 bp, Artificial Sequence
  Synthetic
taaggctctgacgtctccc

SEQ ID NO: 13289 - DNA, 20 bp, Artificial Sequence
  Synthetic
ataaaagcgtggggacagtt

SEQ ID NO: 13290 - DNA, 19 bp, Artificial Sequence
  Synthetic
aatctgatgtcgcagtctc

SEQ ID NO: 13291 - DNA, 19 bp, Artificial Sequence
  Synthetic
ggtcagatcgagtaatggt

SEQ ID NO: 13292 - DNA, 21 bp, Artificial Sequence
  Synthetic
ggatactaacgtcggaatcac

SEQ ID NO: 13293 - DNA, 22 bp, Artificial Sequence
  Synthetic
caaagtctaattattgcagcca

SEQ ID NO: 13294 - DNA, 19 bp, Artificial Sequence
  Synthetic
agcgggtcatcaatcaaga

SEQ ID NO: 13295 - DNA, 22 bp, Artificial Sequence
  Synthetic
gacctgaatttcgttaataggg

SEQ ID NO: 13296 - DNA, 19 bp, Artificial Sequence
  Synthetic
ttgaccggtttttgagagt

SEQ ID NO: 13297 - DNA, 21 bp, Artificial Sequence
  Synthetic
tctttagttcctaaggccatt

SEQ ID NO: 13298 - DNA, 20 bp, Artificial Sequence
  Synthetic
aacaattctcggaaaggatg

SEQ ID NO: 13299 - DNA, 20 bp, Artificial Sequence
  Synthetic
cttgaggaaatgtcaaggga

SEQ ID NO: 13300 - DNA, 19 bp, Artificial Sequence
  Synthetic
cttccaggacatactgctg

SEQ ID NO: 13301 - DNA, 18 bp, Artificial Sequence
  Synthetic
ccagcgcaaaatgccata

SEQ ID NO: 13302 - DNA, 22 bp, Artificial Sequence
  Synthetic
tatggctttccttgaagaatcc

SEQ ID NO: 13303 - DNA, 21 bp, Artificial Sequence
  Synthetic
aaggagagtaagagacaacat

SEQ ID NO: 13304 - DNA, 18 bp, Artificial Sequence
  Synthetic
gcgaaaagcttgaacagt

SEQ ID NO: 13305 - DNA, 21 bp, Artificial Sequence
  Synthetic
tgttctcaaacaaaatggcaa

SEQ ID NO: 13306 - DNA, 23 bp, Artificial Sequence
  Synthetic
caaaagaaatacaccaagacaat

SEQ ID NO: 13307 - DNA, 21 bp, Artificial Sequence
  Synthetic
tctggagtaaatgaatcagct

SEQ ID NO: 13308 - DNA, 17 bp, Artificial Sequence
  Synthetic
gctggtgcatgtgggga

SEQ ID NO: 13309 - DNA, 19 bp, Artificial Sequence
  Synthetic
ttttactcggaggccacgg

SEQ ID NO: 13310 - DNA, 20 bp, Artificial Sequence
  Synthetic
cagatcacacgctctttcct

SEQ ID NO: 13311 - DNA, 20 bp, Artificial Sequence
  Synthetic
gtagacggggtagggagatc

SEQ ID NO: 13312 - DNA, 18 bp, Artificial Sequence
  Synthetic
aacggataacgcggtggc

SEQ ID NO: 13313 - DNA, 20 bp, Artificial Sequence
  Synthetic
caactcttactgctctctcc

SEQ ID NO: 13314 - DNA, 20 bp, Artificial Sequence
  Synthetic
tcataaagctgttgaccggc

SEQ ID NO: 13315 - DNA, 20 bp, Artificial Sequence
  Synthetic
tacgggagatacaaggagcg

SEQ ID NO: 13316 - DNA, 16 bp, Artificial Sequence
  Synthetic
gcagccggcagaggat

SEQ ID NO: 13317 - DNA, 17 bp, Artificial Sequence
  Synthetic
tgttacatcgccggcgg

SEQ ID NO: 13318 - DNA, 16 bp, Artificial Sequence
  Synthetic
cactcggaccgctcct

SEQ ID NO: 13319 - DNA, 16 bp, Artificial Sequence
  Synthetic
gcgaactgtgcgtgcc

SEQ ID NO: 13320 - DNA, 18 bp, Artificial Sequence
  Synthetic
cctgctgtgctactggtg

SEQ ID NO: 13321 - DNA, 18 bp, Artificial Sequence
  Synthetic
ggtgagctggggaacagg

SEQ ID NO: 13322 - DNA, 20 bp, Artificial Sequence
  Synthetic
ttccacgctgttttcgaaac

SEQ ID NO: 13323 - DNA, 18 bp, Artificial Sequence
  Synthetic
caggtagcgcatgcagtg

SEQ ID NO: 13324 - DNA, 18 bp, Artificial Sequence
  Synthetic
tgcgcttcagatcgtgga

SEQ ID NO: 13325 - DNA, 18 bp, Artificial Sequence
  Synthetic
gggctccagaaacaggca

SEQ ID NO: 13326 - DNA, 16 bp, Artificial Sequence
  Synthetic
tggatgggctccgggt

SEQ ID NO: 13327 - DNA, 19 bp, Artificial Sequence
  Synthetic
aactcctgctgctcactgt

SEQ ID NO: 13328 - DNA, 18 bp, Artificial Sequence
  Synthetic
caggacgtggtgacctcg

SEQ ID NO: 13329 - DNA, 16 bp, Artificial Sequence
  Synthetic
tcaccaagggcgggct

SEQ ID NO: 13330 - DNA, 18 bp, Artificial Sequence
  Synthetic
ctcggacaagatcacggc

SEQ ID NO: 13331 - DNA, 17 bp, Artificial Sequence
  Synthetic
cctgcggggaaacgaga

SEQ ID NO: 13332 - DNA, 17 bp, Artificial Sequence
  Synthetic
tctggccgatggctgtg

SEQ ID NO: 13333 - DNA, 15 bp, Artificial Sequence
  Synthetic
cgtgtgcgcgctctt

SEQ ID NO: 13334 - DNA, 18 bp, Artificial Sequence
  Synthetic
agggctgctccaactttg

SEQ ID NO: 13335 - DNA, 16 bp, Artificial Sequence
  Synthetic
attgcgggacctgcgc

SEQ ID NO: 13336 - DNA, 17 bp, Artificial Sequence
  Synthetic
ggtgcacagcgacagtg

SEQ ID NO: 13337 - DNA, 16 bp, Artificial Sequence
  Synthetic
cgccgcggtagagcat

SEQ ID NO: 13338 - DNA, 18 bp, Artificial Sequence
  Synthetic
gccgctcagattccagga

SEQ ID NO: 13339 - DNA, 17 bp, Artificial Sequence
  Synthetic
ccaccgggaacaaagcg

SEQ ID NO: 13340 - DNA, 20 bp, Artificial Sequence
  Synthetic
actacatcaaagggtcggct

SEQ ID NO: 13341 - DNA, 20 bp, Artificial Sequence
  Synthetic
atcagcaacgtgttatcggc

SEQ ID NO: 13342 - DNA, 16 bp, Artificial Sequence
  Synthetic
gcagtacgggggtcga

SEQ ID NO: 13343 - DNA, 16 bp, Artificial Sequence
  Synthetic
gaactcgcgacccacg

SEQ ID NO: 13344 - DNA, 16 bp, Artificial Sequence
  Synthetic
ggtgccgcctggaaca

SEQ ID NO: 13345 - DNA, 17 bp, Artificial Sequence
  Synthetic
cgaagcccacactgacg

SEQ ID NO: 13346 - DNA, 16 bp, Artificial Sequence
  Synthetic
cacgccgatgtgcagc

SEQ ID NO: 13347 - DNA, 16 bp, Artificial Sequence
  Synthetic
cgggctctcgtcctgt

SEQ ID NO: 13348 - DNA, 20 bp, Artificial Sequence
  Synthetic
ccagcccagcttttgtatga

SEQ ID NO: 13349 - DNA, 17 bp, Artificial Sequence
  Synthetic
gcttcctgcgacaccag

SEQ ID NO: 13350 - DNA, 18 bp, Artificial Sequence
  Synthetic
tacccaccacgcgtttcg

SEQ ID NO: 13351 - DNA, 18 bp, Artificial Sequence
  Synthetic
ccgacaccgatcacgaag

SEQ ID NO: 13352 - DNA, 16 bp, Artificial Sequence
  Synthetic
ggcaccaccgagacgt

SEQ ID NO: 13353 - DNA, 18 bp, Artificial Sequence
  Synthetic
cggaatgtcacaacgccg

SEQ ID NO: 13354 - DNA, 20 bp, Artificial Sequence
  Synthetic
gacattcacgacctagacgc

SEQ ID NO: 13355 - DNA, 18 bp, Artificial Sequence
  Synthetic
ggccttggtacaggagca

SEQ ID NO: 13356 - DNA, 18 bp, Artificial Sequence
  Synthetic
cgcaccaaccactggagg

SEQ ID NO: 13357 - DNA, 15 bp, Artificial Sequence
  Synthetic
tgagcacggcgcaga

SEQ ID NO: 13358 - DNA, 19 bp, Artificial Sequence
  Synthetic
gctggcttttctggaggaa

SEQ ID NO: 13359 - DNA, 16 bp, Artificial Sequence
  Synthetic
acgtggcaggcggtct

SEQ ID NO: 13360 - DNA, 19 bp, Artificial Sequence
  Synthetic
agcctggtggaactcatca

SEQ ID NO: 13361 - DNA, 19 bp, Artificial Sequence
  Synthetic
ggctttcttggcgtacagc

SEQ ID NO: 13362 - DNA, 16 bp, Artificial Sequence
  Synthetic
tccgcgtcctcgtcga

SEQ ID NO: 13363 - DNA, 16 bp, Artificial Sequence
  Synthetic
gtccacgccgcctcat

SEQ ID NO: 13364 - DNA, 17 bp, Artificial Sequence
  Synthetic
tagttgcacacggccga

SEQ ID NO: 13365 - DNA, 16 bp, Artificial Sequence
  Synthetic
tggcgccctggtacga

SEQ ID NO: 13366 - DNA, 16 bp, Artificial Sequence
  Synthetic
aagggcggcgacatct

SEQ ID NO: 13367 - DNA, 18 bp, Artificial Sequence
  Synthetic
cgggtgacgttgtggatg

SEQ ID NO: 13368 - DNA, 16 bp, Artificial Sequence
  Synthetic
gtccgtcgccgctgtt

SEQ ID NO: 13369 - DNA, 19 bp, Artificial Sequence
  Synthetic
aacttgtccatcagcgacg

SEQ ID NO: 13370 - DNA, 16 bp, Artificial Sequence
  Synthetic
aggcgcacctccgaaa

SEQ ID NO: 13371 - DNA, 16 bp, Artificial Sequence
  Synthetic
tcggtaggcacgcgat

SEQ ID NO: 13372 - DNA, 20 bp, Artificial Sequence
  Synthetic
cgtcgtaacaaagcacaggc

SEQ ID NO: 13373 - DNA, 17 bp, Artificial Sequence
  Synthetic
acaaccgcaacgatccc

SEQ ID NO: 13374 - DNA, 18 bp, Artificial Sequence
  Synthetic
ctggaggggtccggaaca

SEQ ID NO: 13375 - DNA, 18 bp, Artificial Sequence
  Synthetic
gtcttcttgcggtaccgg

SEQ ID NO: 13376 - DNA, 19 bp, Artificial Sequence
  Synthetic
actgttgacggatgtgcaa

SEQ ID NO: 13377 - DNA, 19 bp, Artificial Sequence
  Synthetic
gtcgtcgtcatcgaaaggc

SEQ ID NO: 13378 - DNA, 17 bp, Artificial Sequence
  Synthetic
cgagaaacggctgtcgg

SEQ ID NO: 13379 - DNA, 16 bp, Artificial Sequence
  Synthetic
ggcggcccagaaaacc

SEQ ID NO: 13380 - DNA, 20 bp, Artificial Sequence
  Synthetic
cacgcgtcctatgatgagtt

SEQ ID NO: 13381 - DNA, 18 bp, Artificial Sequence
  Synthetic
gattcgacggggaacgct

SEQ ID NO: 13382 - DNA, 17 bp, Artificial Sequence
  Synthetic
gacacgcgctttgggag

SEQ ID NO: 13383 - DNA, 18 bp, Artificial Sequence
  Synthetic
acgctactacatgcccct

SEQ ID NO: 13384 - DNA, 17 bp, Artificial Sequence
  Synthetic
gaatttgcccgtgcgga

SEQ ID NO: 13385 - DNA, 17 bp, Artificial Sequence
  Synthetic
acgaccagtctccggac

SEQ ID NO: 13386 - DNA, 16 bp, Artificial Sequence
  Synthetic
ccgttcttcccgcgga

SEQ ID NO: 13387 - DNA, 20 bp, Artificial Sequence
  Synthetic
acgtggatccccattatccc

SEQ ID NO: 13388 - DNA, 17 bp, Artificial Sequence
  Synthetic
tggtcaccgtggtcagt

SEQ ID NO: 13389 - DNA, 16 bp, Artificial Sequence
  Synthetic
agcgtgagagccccgt

SEQ ID NO: 13390 - DNA, 19 bp, Artificial Sequence
  Synthetic
cggaaaaagtggatgcggc

SEQ ID NO: 13391 - DNA, 15 bp, Artificial Sequence
  Synthetic
gcagcgcaaaggcca

SEQ ID NO: 13392 - DNA, 20 bp, Artificial Sequence
  Synthetic
aaaacagcagagaaccgagg

SEQ ID NO: 13393 - DNA, 18 bp, Artificial Sequence
  Synthetic
actggttctgctgacgcg

SEQ ID NO: 13394 - DNA, 19 bp, Artificial Sequence
  Synthetic
agcgcgtacacatagatcg

SEQ ID NO: 13395 - DNA, 16 bp, Artificial Sequence
  Synthetic
ggacgccagtcgcatg

SEQ ID NO: 13396 - DNA, 20 bp, Artificial Sequence
  Synthetic
agatacgtaacgtgtgcgag

SEQ ID NO: 13397 - DNA, 18 bp, Artificial Sequence
  Synthetic
tacggctggtgagtccac

SEQ ID NO: 13398 - DNA, 18 bp, Artificial Sequence
  Synthetic
tcctggcacttgacgagc

SEQ ID NO: 13399 - DNA, 20 bp, Artificial Sequence
  Synthetic
aagtaatggtctgcagctgc

SEQ ID NO: 13400 - DNA, 18 bp, Artificial Sequence
  Synthetic
atcgagtcttcgggggtg

SEQ ID NO: 13401 - DNA, 18 bp, Artificial Sequence
  Synthetic
ttccatgttacgcggcag

SEQ ID NO: 13402 - DNA, 16 bp, Artificial Sequence
  Synthetic
gcaccgcccatgggtt

SEQ ID NO: 13403 - DNA, 16 bp, Artificial Sequence
  Synthetic
ccggcgctggtcttga

SEQ ID NO: 13404 - DNA, 18 bp, Artificial Sequence
  Synthetic
gcctgtccgatacacgtg

SEQ ID NO: 13405 - DNA, 19 bp, Artificial Sequence
  Synthetic
gacgttgttgttgcggatc

SEQ ID NO: 13406 - DNA, 18 bp, Artificial Sequence
  Synthetic
accgtcagaatcgacggt

SEQ ID NO: 13407 - DNA, 16 bp, Artificial Sequence
  Synthetic
gtcaacggcggtcgga

SEQ ID NO: 13408 - DNA, 19 bp, Artificial Sequence
  Synthetic
gaagggctgttcgatgtgg

SEQ ID NO: 13409 - DNA, 17 bp, Artificial Sequence
  Synthetic
cacctgcgagttgaggc

SEQ ID NO: 13410 - DNA, 18 bp, Artificial Sequence
  Synthetic
cgtgttcgagcacctgac

SEQ ID NO: 13411 - DNA, 20 bp, Artificial Sequence
  Synthetic
cgtagccacctgttggaacc

SEQ ID NO: 13412 - DNA, 17 bp, Artificial Sequence
  Synthetic
ccgcagaaggccatgag

SEQ ID NO: 13413 - DNA, 16 bp, Artificial Sequence
  Synthetic
tggcggccgaatctcc

SEQ ID NO: 13414 - DNA, 19 bp, Artificial Sequence
  Synthetic
cgtcttcgtcgtccctagt

SEQ ID NO: 13415 - DNA, 17 bp, Artificial Sequence
  Synthetic
cgtgatgcgtgacggag

SEQ ID NO: 13416 - DNA, 18 bp, Artificial Sequence
  Synthetic
gcgcgaatgttaccaccc

SEQ ID NO: 13417 - DNA, 17 bp, Artificial Sequence
  Synthetic
catgggtacggaggcgt

SEQ ID NO: 13418 - DNA, 20 bp, Artificial Sequence
  Synthetic
gcataatctgcgaggaggac

SEQ ID NO: 13419 - DNA, 20 bp, Artificial Sequence
  Synthetic
gtctctacgctcctacgaca

SEQ ID NO: 13420 - DNA, 17 bp, Artificial Sequence
  Synthetic
gcactgggcgtggaaac

SEQ ID NO: 13421 - DNA, 20 bp, Artificial Sequence
  Synthetic
cctacgatttggccatgtcg

SEQ ID NO: 13422 - DNA, 20 bp, Artificial Sequence
  Synthetic
attggcgcaaactttttggc

SEQ ID NO: 13423 - DNA, 16 bp, Artificial Sequence
  Synthetic
cgcgaagtgcagcagg

SEQ ID NO: 13424 - DNA, 17 bp, Artificial Sequence
  Synthetic
tggaaaccagcagcccg

SEQ ID NO: 13425 - DNA, 18 bp, Artificial Sequence
  Synthetic
tggcggtcaccactttca

SEQ ID NO: 13426 - DNA, 17 bp, Artificial Sequence
  Synthetic
gcgctccacaccaacag

SEQ ID NO: 13427 - DNA, 16 bp, Artificial Sequence
  Synthetic
tccagcgcctgcagat

SEQ ID NO: 13428 - DNA, 20 bp, Artificial Sequence
  Synthetic
ccttatgctgcgctacatgc

SEQ ID NO: 13429 - DNA, 16 bp, Artificial Sequence
  Synthetic
ccagagcgtgccggta

SEQ ID NO: 13430 - DNA, 18 bp, Artificial Sequence
  Synthetic
ggcgctgctttctttcga

SEQ ID NO: 13431 - DNA, 16 bp, Artificial Sequence
  Synthetic
ggctccttcgtgggca

SEQ ID NO: 13432 - DNA, 20 bp, Artificial Sequence
  Synthetic
ctttgtgctcgacgttaacg

SEQ ID NO: 13433 - DNA, 18 bp, Artificial Sequence
  Synthetic
gcctccggatcacatggt

SEQ ID NO: 13434 - DNA, 16 bp, Artificial Sequence
  Synthetic
tgtacacggccggcga

SEQ ID NO: 13435 - DNA, 18 bp, Artificial Sequence
  Synthetic
gtaggagcgacgctgacg

SEQ ID NO: 13436 - DNA, 20 bp, Artificial Sequence
  Synthetic
tgaagtgacgttaggggagg

SEQ ID NO: 13437 - DNA, 20 bp, Artificial Sequence
  Synthetic
ccacatctggtatacacccg

SEQ ID NO: 13438 - DNA, 20 bp, Artificial Sequence
  Synthetic
tacttttcactcccgggtgc

SEQ ID NO: 13439 - DNA, 19 bp, Artificial Sequence
  Synthetic
gcgtacaggagtcctaggt

SEQ ID NO: 13440 - DNA, 17 bp, Artificial Sequence
  Synthetic
tgcaagcccattccccg

SEQ ID NO: 13441 - DNA, 16 bp, Artificial Sequence
  Synthetic
acgcagcccagcctag

SEQ ID NO: 13442 - DNA, 18 bp, Artificial Sequence
  Synthetic
acaggaagcttacagggt

SEQ ID NO: 13443 - DNA, 21 bp, Artificial Sequence
  Synthetic
atatgtgcggtatgattttgc

SEQ ID NO: 13444 - DNA, 19 bp, Artificial Sequence
  Synthetic
tgattccgtagacgccagg

SEQ ID NO: 13445 - DNA, 18 bp, Artificial Sequence
  Synthetic
tgcgcgaatggaaaccat

SEQ ID NO: 13446 - DNA, 20 bp, Artificial Sequence
  Synthetic
ggatctacgtcccagtctct

SEQ ID NO: 13447 - DNA, 18 bp, Artificial Sequence
  Synthetic
cgacgtcgtacgagtcgc

SEQ ID NO: 13448 - DNA, 19 bp, Artificial Sequence
  Synthetic
cgagagattctccagcccg

SEQ ID NO: 13449 - DNA, 18 bp, Artificial Sequence
  Synthetic
ttgcaacagcttcgacgg

SEQ ID NO: 13450 - DNA, 17 bp, Artificial Sequence
  Synthetic
gcggatgctggtcgttg

SEQ ID NO: 13451 - DNA, 16 bp, Artificial Sequence
  Synthetic
cagctccaagcgccgt

SEQ ID NO: 13452 - DNA, 19 bp, Artificial Sequence
  Synthetic
gaaagccgtcccggtcatt

SEQ ID NO: 13453 - DNA, 15 bp, Artificial Sequence
  Synthetic
tgtggtgcacggcgt

SEQ ID NO: 13454 - DNA, 16 bp, Artificial Sequence
  Synthetic
ggatcggtcgtcgcgt

SEQ ID NO: 13455 - DNA, 16 bp, Artificial Sequence
  Synthetic
tggcgtgcgaggaaga

SEQ ID NO: 13456 - DNA, 19 bp, Artificial Sequence
  Synthetic
gatgtcgggcgtccaccta

SEQ ID NO: 13457 - DNA, 19 bp, Artificial Sequence
  Synthetic
aaagcctggttggatctcg

SEQ ID NO: 13458 - DNA, 18 bp, Artificial Sequence
  Synthetic
tagcctcctccaccacgg

SEQ ID NO: 13459 - DNA, 20 bp, Artificial Sequence
  Synthetic
cttgaagtacagcatgccca

SEQ ID NO: 13460 - DNA, 19 bp, Artificial Sequence
  Synthetic
aaaccgcgactttccacac

SEQ ID NO: 13461 - DNA, 18 bp, Artificial Sequence
  Synthetic
gcccacccccattacacg

SEQ ID NO: 13462 - DNA, 18 bp, Artificial Sequence
  Synthetic
acggatcaagaggtccat

SEQ ID NO: 13463 - DNA, 16 bp, Artificial Sequence
  Synthetic
gctctcggggccgtat

SEQ ID NO: 13464 - DNA, 20 bp, Artificial Sequence
  Synthetic
agcgttcataacaatcccgg

SEQ ID NO: 13465 - DNA, 17 bp, Artificial Sequence
  Synthetic
gttgcaggccacgaaca

SEQ ID NO: 13466 - DNA, 18 bp, Artificial Sequence
  Synthetic
accggtgtgcagctaagc

SEQ ID NO: 13467 - DNA, 17 bp, Artificial Sequence
  Synthetic
gacccaagccagactgc

SEQ ID NO: 13468 - DNA, 18 bp, Artificial Sequence
  Synthetic
ggccggcgagtaatagca

SEQ ID NO: 13469 - DNA, 16 bp, Artificial Sequence
  Synthetic
agccgccgaaacacga

SEQ ID NO: 13470 - DNA, 18 bp, Artificial Sequence
  Synthetic
ccgaaagcgtcgtgagca

SEQ ID NO: 13471 - DNA, 19 bp, Artificial Sequence
  Synthetic
taggggactacctcctcga

SEQ ID NO: 13472 - DNA, 18 bp, Artificial Sequence
  Synthetic
ccaatcggcgtcgcttag

SEQ ID NO: 13473 - DNA, 18 bp, Artificial Sequence
  Synthetic
gggacctgtttcagcgtg

SEQ ID NO: 13474 - DNA, 20 bp, Artificial Sequence
  Synthetic
gcgtaaatctgcgggatagc

SEQ ID NO: 13475 - DNA, 16 bp, Artificial Sequence
  Synthetic
tcgcctcgacagagcc

SEQ ID NO: 13476 - DNA, 17 bp, Artificial Sequence
  Synthetic
aagttcacgtcgcgtcc

SEQ ID NO: 13477 - DNA, 16 bp, Artificial Sequence
  Synthetic
tccggcatggtgctgc

SEQ ID NO: 13478 - DNA, 20 bp, Artificial Sequence
  Synthetic
ataacgccatgggatcctca

SEQ ID NO: 13479 - DNA, 19 bp, Artificial Sequence
  Synthetic
cctgaacagaccgctaacc

SEQ ID NO: 13480 - DNA, 19 bp, Artificial Sequence
  Synthetic
ctgatgctgttgtcgtgca

SEQ ID NO: 13481 - DNA, 18 bp, Artificial Sequence
  Synthetic
ccaccaccgcattaaccg

SEQ ID NO: 13482 - DNA, 18 bp, Artificial Sequence
  Synthetic
ggaccttctgggaccagt

SEQ ID NO: 13483 - DNA, 20 bp, Artificial Sequence
  Synthetic
ataggcagcgacgtgtatgg

SEQ ID NO: 13484 - DNA, 16 bp, Artificial Sequence
  Synthetic
ggacgcccgacatcca

SEQ ID NO: 13485 - DNA, 18 bp, Artificial Sequence
  Synthetic
ctttgtgcgacagtgctt

SEQ ID NO: 13486 - DNA, 19 bp, Artificial Sequence
  Synthetic
tggacagtggtgaatagca

SEQ ID NO: 13487 - DNA, 20 bp, Artificial Sequence
  Synthetic
taagacaggaaatggcaagc

SEQ ID NO: 13488 - DNA, 21 bp, Artificial Sequence
  Synthetic
aaacaagccaattaatgtggg

SEQ ID NO: 13489 - DNA, 20 bp, Artificial Sequence
  Synthetic
gattcgagctggatagaact

SEQ ID NO: 13490 - DNA, 23 bp, Artificial Sequence
  Synthetic
gttcattataaaaggaaggtccc

SEQ ID NO: 13491 - DNA, 20 bp, Artificial Sequence
  Synthetic
ctgccttcttcaatctcttc

SEQ ID NO: 13492 - DNA, 22 bp, Artificial Sequence
  Synthetic
gatcctatgaacagatggaaac

SEQ ID NO: 13493 - DNA, 20 bp, Artificial Sequence
  Synthetic
aggtccaatttacaggagaa

SEQ ID NO: 13494 - DNA, 19 bp, Artificial Sequence
  Synthetic
atggaactgattcggatga

SEQ ID NO: 13495 - DNA, 21 bp, Artificial Sequence
  Synthetic
attagagggacaagaatggtc

SEQ ID NO: 13496 - DNA, 20 bp, Artificial Sequence
  Synthetic
gaaatgatgttttttgggcg

SEQ ID NO: 13497 - DNA, 18 bp, Artificial Sequence
  Synthetic
ggcgccattatgagaact

SEQ ID NO: 13498 - DNA, 19 bp, Artificial Sequence
  Synthetic
cacaactgcaccctgaaga

SEQ ID NO: 13499 - DNA, 18 bp, Artificial Sequence
  Synthetic
gaagtgcggttccagaag

SEQ ID NO: 13500 - DNA, 22 bp, Artificial Sequence
  Synthetic
tcttagtaatggagttggaaac

SEQ ID NO: 13501 - DNA, 20 bp, Artificial Sequence
  Synthetic
acatgtcaatgcagctgtgg

SEQ ID NO: 13502 - DNA, 19 bp, Artificial Sequence
  Synthetic
gcttttgctaaattggcct

SEQ ID NO: 13503 - DNA, 24 bp, Artificial Sequence
  Synthetic
gtgtacttgctttaattgtagagg

SEQ ID NO: 13504 - DNA, 20 bp, Artificial Sequence
  Synthetic
gtaacttcagccactcaaac

SEQ ID NO: 13505 - DNA, 20 bp, Artificial Sequence
  Synthetic
aggatctacagtggacggtc

SEQ ID NO: 13506 - DNA, 18 bp, Artificial Sequence
  Synthetic
gtaagctcttgaccaccg

SEQ ID NO: 13507 - DNA, 23 bp, Artificial Sequence
  Synthetic
tgattgtattttgagattggcaa

SEQ ID NO: 13508 - DNA, 20 bp, Artificial Sequence
  Synthetic
acagtttctggagcaggtgt

SEQ ID NO: 13509 - DNA, 18 bp, Artificial Sequence
  Synthetic
gcttcagcagttgcaagc

SEQ ID NO: 13510 - DNA, 19 bp, Artificial Sequence
  Synthetic
aagacaaagcctctgtagc

SEQ ID NO: 13511 - DNA, 22 bp, Artificial Sequence
  Synthetic
tccgtatacagatttaaggggt

SEQ ID NO: 13512 - DNA, 19 bp, Artificial Sequence
  Synthetic
cttggtcttcatcgctttc

SEQ ID NO: 13513 - DNA, 20 bp, Artificial Sequence
  Synthetic
ttgcggcaatattgagttgc

SEQ ID NO: 13514 - DNA, 18 bp, Artificial Sequence
  Synthetic
gcccgctcataggggtta

SEQ ID NO: 13515 - DNA, 21 bp, Artificial Sequence
  Synthetic
aggtattcctccttatccttc

SEQ ID NO: 13516 - DNA, 23 bp, Artificial Sequence
  Synthetic
aaataatattttgccagctcttg

SEQ ID NO: 13517 - DNA, 22 bp, Artificial Sequence
  Synthetic
tgtaagcggtttctataggtac

SEQ ID NO: 13518 - DNA, 20 bp, Artificial Sequence
  Synthetic
aagtagaaatctcgtcggcg

SEQ ID NO: 13519 - DNA, 19 bp, Artificial Sequence
  Synthetic
tgcattgccactaccgttt

SEQ ID NO: 13520 - DNA, 16 bp, Artificial Sequence
  Synthetic
acggttccacggtgca

SEQ ID NO: 13521 - DNA, 23 bp, Artificial Sequence
  Synthetic
gttatcttggtaggcaatttctg

SEQ ID NO: 13522 - DNA, 19 bp, Artificial Sequence
  Synthetic
gtgggggttgtcttcttcg

SEQ ID NO: 13523 - DNA, 18 bp, Artificial Sequence
  Synthetic
cagtcacagtcacaaggt

SEQ ID NO: 13524 - DNA, 18 bp, Artificial Sequence
  Synthetic
caagcactgcctgttgaa

SEQ ID NO: 13525 - DNA, 19 bp, Artificial Sequence
  Synthetic
cttccaacatgaggcggtg

SEQ ID NO: 13526 - DNA, 20 bp, Artificial Sequence
  Synthetic
ccgtggtttggtggaaaagt

SEQ ID NO: 13527 - DNA, 17 bp, Artificial Sequence
  Synthetic
ctcctgagcgtcaccca

SEQ ID NO: 13528 - DNA, 18 bp, Artificial Sequence
  Synthetic
gcacactaatagcgcgag

SEQ ID NO: 13529 - DNA, 18 bp, Artificial Sequence
  Synthetic
gacgggagcaggaacaga

SEQ ID NO: 13530 - DNA, 18 bp, Artificial Sequence
  Synthetic
cagtagtgccgtctcgta

SEQ ID NO: 13531 - DNA, 18 bp, Artificial Sequence
  Synthetic
gccttgcgactaatggtt

SEQ ID NO: 13532 - DNA, 19 bp, Artificial Sequence
  Synthetic
tcgagctttcattaatcgc

SEQ ID NO: 13533 - DNA, 20 bp, Artificial Sequence
  Synthetic
gaatgggaggaaagacagcc

SEQ ID NO: 13534 - DNA, 20 bp, Artificial Sequence
  Synthetic
tggcacgcaaactattaact

SEQ ID NO: 13535 - DNA, 19 bp, Artificial Sequence
  Synthetic
tgctggaaagtgacattgg

SEQ ID NO: 13536 - DNA, 23 bp, Artificial Sequence
  Synthetic
ccttaaataaggctgctaggatt

SEQ ID NO: 13537 - DNA, 18 bp, Artificial Sequence
  Synthetic
gtaacaacacgggctggg

SEQ ID NO: 13538 - DNA, 16 bp, Artificial Sequence
  Synthetic
cggccagagcgttggt

SEQ ID NO: 13539 - DNA, 20 bp, Artificial Sequence
  Synthetic
caagcgcgatatcaagcatg

SEQ ID NO: 13540 - DNA, 19 bp, Artificial Sequence
  Synthetic
ttaaaagggaagccatgga

SEQ ID NO: 13541 - DNA, 18 bp, Artificial Sequence
  Synthetic
gggtaccgtgggacaact

SEQ ID NO: 13542 - DNA, 18 bp, Artificial Sequence
  Synthetic
gcccgacgaggtaatggt

SEQ ID NO: 13543 - DNA, 20 bp, Artificial Sequence
  Synthetic
cctatgttagcgccagagga

SEQ ID NO: 13544 - DNA, 18 bp, Artificial Sequence
  Synthetic
ctttacgctggctgtggg

SEQ ID NO: 13545 - DNA, 20 bp, Artificial Sequence
  Synthetic
gacaatccaaggatgacaac

SEQ ID NO: 13546 - DNA, 20 bp, Artificial Sequence
  Synthetic
cagttaatgctggatgcttt

SEQ ID NO: 13547 - DNA, 22 bp, Artificial Sequence
  Synthetic
gaagcttcttgtactcaaatgt

SEQ ID NO: 13548 - DNA, 18 bp, Artificial Sequence
  Synthetic
cccggttcctacacttac

SEQ ID NO: 13549 - DNA, 18 bp, Artificial Sequence
  Synthetic
ctgggttcagggtttgac

SEQ ID NO: 13550 - DNA, 18 bp, Artificial Sequence
  Synthetic
gagtaggcaagttgtgga

SEQ ID NO: 13551 - DNA, 18 bp, Artificial Sequence
  Synthetic
ccctcccagactgctgta

SEQ ID NO: 13552 - DNA, 20 bp, Artificial Sequence
  Synthetic
taccctagaaaagtcaaccc

SEQ ID NO: 13553 - DNA, 18 bp, Artificial Sequence
  Synthetic
ggttggtgggcagggata

SEQ ID NO: 13554 - DNA, 18 bp, Artificial Sequence
  Synthetic
cactggcataaggagacg

SEQ ID NO: 13555 - DNA, 20 bp, Artificial Sequence
  Synthetic
caccatctccattccatgca

SEQ ID NO: 13556 - DNA, 18 bp, Artificial Sequence
  Synthetic
gcttccatgcctttttcc

SEQ ID NO: 13557 - DNA, 20 bp, Artificial Sequence
  Synthetic
ctactcataccccaagacgc

SEQ ID NO: 13558 - DNA, 18 bp, Artificial Sequence
  Synthetic
agtttttgcagtgccaga

SEQ ID NO: 13559 - DNA, 20 bp, Artificial Sequence
  Synthetic
tgagcgcagtgatgaatcag

SEQ ID NO: 13560 - DNA, 20 bp, Artificial Sequence
  Synthetic
ctgcatttaccttttcctgt

SEQ ID NO: 13561 - DNA, 23 bp, Artificial Sequence
  Synthetic
actgaactattaagtgaaagtca

SEQ ID NO: 13562 - DNA, 20 bp, Artificial Sequence
  Synthetic
ttccatcacctttgtgtgct

SEQ ID NO: 13563 - DNA, 20 bp, Artificial Sequence
  Synthetic
tgggacaccattgaaaccag

SEQ ID NO: 13564 - DNA, 20 bp, Artificial Sequence
  Synthetic
gaaaacgcatttttcccact

SEQ ID NO: 13565 - DNA, 19 bp, Artificial Sequence
  Synthetic
ccccacatgatttccaggg

SEQ ID NO: 13566 - DNA, 21 bp, Artificial Sequence
  Synthetic
gctattggtggaaaaagatca

SEQ ID NO: 13567 - DNA, 22 bp, Artificial Sequence
  Synthetic
atttcaacctattaacctggga

SEQ ID NO: 13568 - DNA, 22 bp, Artificial Sequence
  Synthetic
ctaacttgtttctagtgcaaca

SEQ ID NO: 13569 - DNA, 23 bp, Artificial Sequence
  Synthetic
ttgtcacattacaattaactgca

SEQ ID NO: 13570 - DNA, 24 bp, Artificial Sequence
  Synthetic
tttctaaaacagaacctcttatgc

SEQ ID NO: 13571 - DNA, 24 bp, Artificial Sequence
  Synthetic
ctcctctgtagtttctttacaact

SEQ ID NO: 13572 - DNA, 20 bp, Artificial Sequence
  Synthetic
aaaaggacttttttgcctgg

SEQ ID NO: 13573 - DNA, 18 bp, Artificial Sequence
  Synthetic
catggtctccgtgtactc

SEQ ID NO: 13574 - DNA, 21 bp, Artificial Sequence
  Synthetic
cggaataaaacttaatgccca

SEQ ID NO: 13575 - DNA, 20 bp, Artificial Sequence
  Synthetic
tgtaaattctagcggtgccc

SEQ ID NO: 13576 - DNA, 21 bp, Artificial Sequence
  Synthetic
gggtcatgaaagtaaacgttg

SEQ ID NO: 13577 - DNA, 25 bp, Artificial Sequence
  Synthetic
cctaaatatccaaagtactactacc

SEQ ID NO: 13578 - DNA, 21 bp, Artificial Sequence
  Synthetic
aaatcagcctttctctacacc

SEQ ID NO: 13579 - DNA, 18 bp, Artificial Sequence
  Synthetic
gtcactcaagcggcattc

SEQ ID NO: 13580 - DNA, 22 bp, Artificial Sequence
  Synthetic
acaccttttgttaattaaggcg

SEQ ID NO: 13581 - DNA, 24 bp, Artificial Sequence
  Synthetic
atgtaaagtcagactattacactc

SEQ ID NO: 13582 - DNA, 25 bp, Artificial Sequence
  Synthetic
caaggtagaggcataaaaacttaat

SEQ ID NO: 13583 - DNA, 21 bp, Artificial Sequence
  Synthetic
agatttacattaggctccaca

SEQ ID NO: 13584 - DNA, 18 bp, Artificial Sequence
  Synthetic
gttccgtaaagactccgg

SEQ ID NO: 13585 - DNA, 23 bp, Artificial Sequence
  Synthetic
ccatgtggaggtataacaaaatt

SEQ ID NO: 13586 - DNA, 20 bp, Artificial Sequence
  Synthetic
ccggtacccttgtatacgct

SEQ ID NO: 13587 - DNA, 20 bp, Artificial Sequence
  Synthetic
tttctcaagacccgtccaag

SEQ ID NO: 13588 - DNA, 18 bp, Artificial Sequence
  Synthetic
gccatggggagatctgga

SEQ ID NO: 13589 - DNA, 22 bp, Artificial Sequence
  Synthetic
tccattgctcctatcaaatcag

SEQ ID NO: 13590 - DNA, 20 bp, Artificial Sequence
  Synthetic
gccttcaatcatcatgtcac

SEQ ID NO: 13591 - DNA, 22 bp, Artificial Sequence
  Synthetic
aatgaatgataacacaaatgcc

SEQ ID NO: 13592 - DNA, 21 bp, Artificial Sequence
  Synthetic
gctaagccaaaacatacaaca

SEQ ID NO: 13593 - DNA, 19 bp, Artificial Sequence
  Synthetic
ggtgaaggaccatgttctc

SEQ ID NO: 13594 - DNA, 22 bp, Artificial Sequence
  Synthetic
tggttgaaaaagtttactgagt

SEQ ID NO: 13595 - DNA, 18 bp, Artificial Sequence
  Synthetic
tggctacaaccaacagga

SEQ ID NO: 13596 - DNA, 20 bp, Artificial Sequence
  Synthetic
agtgtgtggagtacaatctc

SEQ ID NO: 13597 - DNA, 21 bp, Artificial Sequence
  Synthetic
agtagaggacacaattctgat

SEQ ID NO: 13598 - DNA, 20 bp, Artificial Sequence
  Synthetic
taaagcctatcaacacacca

SEQ ID NO: 13599 - DNA, 20 bp, Artificial Sequence
  Synthetic
agggaaaacaagagctatcg

SEQ ID NO: 13600 - DNA, 21 bp, Artificial Sequence
  Synthetic
tgatgtgatagcttcataccc

SEQ ID NO: 13601 - DNA, 22 bp, Artificial Sequence
  Synthetic
acagtgcatttctactaaatcc

SEQ ID NO: 13602 - DNA, 21 bp, Artificial Sequence
  Synthetic
aaatgacttagtgttaccagc

SEQ ID NO: 13603 - DNA, 22 bp, Artificial Sequence
  Synthetic
aagaagtcttaacagaaatggc

SEQ ID NO: 13604 - DNA, 23 bp, Artificial Sequence
  Synthetic
cgaaagtataacaaaagtccaga

SEQ ID NO: 13605 - DNA, 24 bp, Artificial Sequence
  Synthetic
atatcaaatgttatgtgatcctcc

SEQ ID NO: 13606 - DNA, 20 bp, Artificial Sequence
  Synthetic
cctgaagaggaaaacaatgg

SEQ ID NO: 13607 - DNA, 22 bp, Artificial Sequence
  Synthetic
cgggagaaagagcttattttac

SEQ ID NO: 13608 - DNA, 18 bp, Artificial Sequence
  Synthetic
ccaccacgtcccctgaaa

SEQ ID NO: 13609 - DNA, 20 bp, Artificial Sequence
  Synthetic
tattgttaaagggcacagca

SEQ ID NO: 13610 - DNA, 19 bp, Artificial Sequence
  Synthetic
gcaattgcctacctgatgt

SEQ ID NO: 13611 - DNA, 19 bp, Artificial Sequence
  Synthetic
tacagtgcctgtggaaagt

SEQ ID NO: 13612 - DNA, 18 bp, Artificial Sequence
  Synthetic
taacgccattgcagtgtt

SEQ ID NO: 13613 - DNA, 20 bp, Artificial Sequence
  Synthetic
caccacgtgacgttttaaat

SEQ ID NO: 13614 - DNA, 19 bp, Artificial Sequence
  Synthetic
tttcagagacagatgctgg

SEQ ID NO: 13615 - DNA, 23 bp, Artificial Sequence
  Synthetic
cacaaagtattagttcctaaggt

SEQ ID NO: 13616 - DNA, 21 bp, Artificial Sequence
  Synthetic
attgccacagtttgtaaatgg

SEQ ID NO: 13617 - DNA, 25 bp, Artificial Sequence
  Synthetic
tcctaatattttggataattggcag

SEQ ID NO: 13618 - DNA, 25 bp, Artificial Sequence
  Synthetic
tgtgaactatagtgaaataaactgc

SEQ ID NO: 13619 - DNA, 19 bp, Artificial Sequence
  Synthetic
tgtccacgacctactcacc

SEQ ID NO: 13620 - DNA, 21 bp, Artificial Sequence
  Synthetic
ttggtaatggtcattcagttc

SEQ ID NO: 13621 - DNA, 23 bp, Artificial Sequence
  Synthetic
aacctgataaatactcatgaagg

SEQ ID NO: 13622 - DNA, 17 bp, Artificial Sequence
  Synthetic
cgcgccttcagacctga

SEQ ID NO: 13623 - DNA, 22 bp, Artificial Sequence
  Synthetic
tcaacccatatttgatgtttct

SEQ ID NO: 13624 - DNA, 21 bp, Artificial Sequence
  Synthetic
ttgatatcagttccttgttgg

SEQ ID NO: 13625 - DNA, 21 bp, Artificial Sequence
  Synthetic
gtgagaaattgaaagaaagcg

SEQ ID NO: 13626 - DNA, 20 bp, Artificial Sequence
  Synthetic
tgtccaatcttgctatggaa

SEQ ID NO: 13627 - DNA, 24 bp, Artificial Sequence
  Synthetic
accctattgaatacagatatgaga

SEQ ID NO: 13628 - DNA, 20 bp, Artificial Sequence
  Synthetic
gccctaaaatttagcaaacg

SEQ ID NO: 13629 - DNA, 20 bp, Artificial Sequence
  Synthetic
gtgctgcctagaatttcatg

SEQ ID NO: 13630 - DNA, 22 bp, Artificial Sequence
  Synthetic
aggatattgtattagacctgca

SEQ ID NO: 13631 - DNA, 19 bp, Artificial Sequence
  Synthetic
ggacgattcaggtacagaa

SEQ ID NO: 13632 - DNA, 25 bp, Artificial Sequence
  Synthetic
gaaagtatttaggtagtccatatgt

SEQ ID NO: 13633 - DNA, 18 bp, Artificial Sequence
  Synthetic
aagggacatagaggggga

SEQ ID NO: 13634 - DNA, 20 bp, Artificial Sequence
  Synthetic
ggcagacagtcagtttaaat

SEQ ID NO: 13635 - DNA, 23 bp, Artificial Sequence
  Synthetic
ggaaatgtttttttgaaagactg

SEQ ID NO: 13636 - DNA, 18 bp, Artificial Sequence
  Synthetic
gtccgaagcaaaaggaca

SEQ ID NO: 13637 - DNA, 18 bp, Artificial Sequence
  Synthetic
gagtccaacagtcccctt

SEQ ID NO: 13638 - DNA, 20 bp, Artificial Sequence
  Synthetic
aaacatgccattgtaactgt

SEQ ID NO: 13639 - DNA, 25 bp, Artificial Sequence
  Synthetic
atggatatctgagtttattgtgtac

SEQ ID NO: 13640 - DNA, 20 bp, Artificial Sequence
  Synthetic
tcatctagtgatagcggtcc

SEQ ID NO: 13641 - DNA, 18 bp, Artificial Sequence
  Synthetic
ggggtaacaccacagttc

SEQ ID NO: 13642 - DNA, 18 bp, Artificial Sequence
  Synthetic
cctcctcctaaccctgta

SEQ ID NO: 13643 - DNA, 18 bp, Artificial Sequence
  Synthetic
acaggatggcgatatggt

SEQ ID NO: 13644 - DNA, 18 bp, Artificial Sequence
  Synthetic
ggctctttggtgtcctct

SEQ ID NO: 13645 - DNA, 18 bp, Artificial Sequence
  Synthetic
ccaagttgcttgccaagt

SEQ ID NO: 13646 - DNA, 19 bp, Artificial Sequence
  Synthetic
gtgttgtacagcctccagg

SEQ ID NO: 13647 - DNA, 20 bp, Artificial Sequence
  Synthetic
aatggacgttaagttcccgg

SEQ ID NO: 13648 - DNA, 18 bp, Artificial Sequence
  Synthetic
cgccgacctcatgggata

SEQ ID NO: 13649 - DNA, 15 bp, Artificial Sequence
  Synthetic
ttgcgtgccctgcgt

SEQ ID NO: 13650 - DNA, 19 bp, Artificial Sequence
  Synthetic
accttagttctcgcccagg

SEQ ID NO: 13651 - DNA, 19 bp, Artificial Sequence
  Synthetic
acagctcagggtgttccga

SEQ ID NO: 13652 - DNA, 20 bp, Artificial Sequence
  Synthetic
ttttgaactcgaccagaccg

SEQ ID NO: 13653 - DNA, 18 bp, Artificial Sequence
  Synthetic
ggcatgcaactggaccag

SEQ ID NO: 13654 - DNA, 20 bp, Artificial Sequence
  Synthetic
tctgcattgtctggcatgtc

SEQ ID NO: 13655 - DNA, 20 bp, Artificial Sequence
  Synthetic
tatagctaggaccgaggctg

SEQ ID NO: 13656 - DNA, 18 bp, Artificial Sequence
  Synthetic
gtgttcacgcccatggag

SEQ ID NO: 13657 - DNA, 20 bp, Artificial Sequence
  Synthetic
agaattgtggcgaagtgcag

SEQ ID NO: 13658 - DNA, 16 bp, Artificial Sequence
  Synthetic
gcgccggcatattccg

SEQ ID NO: 13659 - DNA, 20 bp, Artificial Sequence
  Synthetic
acatgtccaaggcatatggc

SEQ ID NO: 13660 - DNA, 18 bp, Artificial Sequence
  Synthetic
gccaacaacgggggaaat

SEQ ID NO: 13661 - DNA, 20 bp, Artificial Sequence
  Synthetic
gattacaaccgttccccagg

SEQ ID NO: 13662 - DNA, 20 bp, Artificial Sequence
  Synthetic
atcgggtgagaatttcccgt

SEQ ID NO: 13663 - DNA, 20 bp, Artificial Sequence
  Synthetic
gtgattgttgggagagtcgt

SEQ ID NO: 13664 - DNA, 20 bp, Artificial Sequence
  Synthetic
cattgcttccctcatgtcct

SEQ ID NO: 13665 - DNA, 18 bp, Artificial Sequence
  Synthetic
cattctatcgcccggagc

SEQ ID NO: 13666 - DNA, 20 bp, Artificial Sequence
  Synthetic
tgctgagtgacttcaagacg

SEQ ID NO: 13667 - DNA, 20 bp, Artificial Sequence
  Synthetic
acaacatcaagttcccctgc

SEQ ID NO: 13668 - DNA, 18 bp, Artificial Sequence
  Synthetic
cgaccctcgctagctagt

SEQ ID NO: 13669 - DNA, 20 bp, Artificial Sequence
  Synthetic
aagcagcaggactaccaagc

SEQ ID NO: 13670 - DNA, 20 bp, Artificial Sequence
  Synthetic
tcagactcttggtccactgt

SEQ ID NO: 13671 - DNA, 18 bp, Artificial Sequence
  Synthetic
ccccactcagccagatca

SEQ ID NO: 13672 - DNA, 20 bp, Artificial Sequence
  Synthetic
agcgggtggaatttcttctg

SEQ ID NO: 13673 - DNA, 16 bp, Artificial Sequence
  Synthetic
gcggcgctgagagact

SEQ ID NO: 13674 - DNA, 20 bp, Artificial Sequence
  Synthetic
tacctctttaactgggcggt

SEQ ID NO: 13675 - DNA, 19 bp, Artificial Sequence
  Synthetic
tcgtaatgagcaattccgg

SEQ ID NO: 13676 - DNA, 22 bp, Artificial Sequence
  Synthetic
agaaccagttaaagatctcatg

SEQ ID NO: 13677 - DNA, 21 bp, Artificial Sequence
  Synthetic
ttggatagtaagacatggaca

SEQ ID NO: 13678 - DNA, 23 bp, Artificial Sequence
  Synthetic
agttacctcataccactaaatgc

SEQ ID NO: 13679 - DNA, 20 bp, Artificial Sequence
  Synthetic
agcaatgctaggtactcatg

SEQ ID NO: 13680 - DNA, 23 bp, Artificial Sequence
  Synthetic
ttaggctgatgaaagatactcaa

SEQ ID NO: 13681 - DNA, 19 bp, Artificial Sequence
  Synthetic
aagccatgtatgttccaca

SEQ ID NO: 13682 - DNA, 18 bp, Artificial Sequence
  Synthetic
ttatcacagggcaaagct

SEQ ID NO: 13683 - DNA, 19 bp, Artificial Sequence
  Synthetic
tagtctcaacaggaggaca

SEQ ID NO: 13684 - DNA, 19 bp, Artificial Sequence
  Synthetic
atgcatacatggtcccatt

SEQ ID NO: 13685 - DNA, 21 bp, Artificial Sequence
  Synthetic
agaaatcatgatgacttggtc

SEQ ID NO: 13686 - DNA, 22 bp, Artificial Sequence
  Synthetic
agtgtgtgtattaatccatggt

SEQ ID NO: 13687 - DNA, 24 bp, Artificial Sequence
  Synthetic
ccaatggctagtttagataacaag

SEQ ID NO: 13688 - DNA, 25 bp, Artificial Sequence
  Synthetic
actttaccaacactatcttagaagt

SEQ ID NO: 13689 - DNA, 23 bp, Artificial Sequence
  Synthetic
ggagtttaacataaatccagtca

SEQ ID NO: 13690 - DNA, 21 bp, Artificial Sequence
  Synthetic
aaagtccgattagggaaaagt

SEQ ID NO: 13691 - DNA, 18 bp, Artificial Sequence
  Synthetic
tggatccacaagtgttgg

SEQ ID NO: 13692 - DNA, 18 bp, Artificial Sequence
  Synthetic
tgcaaagccgctatgtcc

SEQ ID NO: 13693 - DNA, 20 bp, Artificial Sequence
  Synthetic
accacaaaagatgctcgact

SEQ ID NO: 13694 - DNA, 18 bp, Artificial Sequence
  Synthetic
acgcgtctcggaaaaacg

SEQ ID NO: 13695 - DNA, 19 bp, Artificial Sequence
  Synthetic
aaaccaaattcttccgcgc

SEQ ID NO: 13696 - DNA, 18 bp, Artificial Sequence
  Synthetic
caccatgtccaccccatg

SEQ ID NO: 13697 - DNA, 19 bp, Artificial Sequence
  Synthetic
tactgcgactacttcaaca

SEQ ID NO: 13698 - DNA, 19 bp, Artificial Sequence
  Synthetic
ccagaggaggagttactgt

SEQ ID NO: 13699 - DNA, 22 bp, Artificial Sequence
  Synthetic
tggaagcaattagtctttctcc

SEQ ID NO: 13700 - DNA, 20 bp, Artificial Sequence
  Synthetic
cggctgcgctatatttttac

SEQ ID NO: 13701 - DNA, 25 bp, Artificial Sequence
  Synthetic
agaggtaaagtagtatcatacatga

SEQ ID NO: 13702 - DNA, 19 bp, Artificial Sequence
  Synthetic
gtcttcacctgtctccccg

SEQ ID NO: 13703 - DNA, 20 bp, Artificial Sequence
  Synthetic
agaacgtcatatcctctctg

SEQ ID NO: 13704 - DNA, 19 bp, Artificial Sequence
  Synthetic
tgcaaacagtaatcaacgc

SEQ ID NO: 13705 - DNA, 20 bp, Artificial Sequence
  Synthetic
acttgggtattggtacggga

SEQ ID NO: 13706 - DNA, 22 bp, Artificial Sequence
  Synthetic
acattggtgatccagaatacat

SEQ ID NO: 13707 - DNA, 24 bp, Artificial Sequence
  Synthetic
ggtgatttgacagacatattcaat

SEQ ID NO: 13708 - DNA, 19 bp, Artificial Sequence
  Synthetic
aaactgggtgacactgaaa

SEQ ID NO: 13709 - DNA, 22 bp, Artificial Sequence
  Synthetic
tttagtactttttcagcgagtc

SEQ ID NO: 13710 - DNA, 24 bp, Artificial Sequence
  Synthetic
cctaaaaatggattagggaatcac

SEQ ID NO: 13711 - DNA, 24 bp, Artificial Sequence
  Synthetic
ccatataagggcttaaatttttgg

SEQ ID NO: 13712 - DNA, 24 bp, Artificial Sequence
  Synthetic
ggtttctatttgaagtttgtacac

SEQ ID NO: 13713 - DNA, 18 bp, Artificial Sequence
  Synthetic
ctctagcagcggccaact

SEQ ID NO: 13714 - DNA, 20 bp, Artificial Sequence
  Synthetic
aaccctaatgtggtccaccg

SEQ ID NO: 13715 - DNA, 18 bp, Artificial Sequence
  Synthetic
cgaggctatgttccgcca

SEQ ID NO: 13716 - DNA, 18 bp, Artificial Sequence
  Synthetic
gccattggctgccacttt

SEQ ID NO: 13717 - DNA, 20 bp, Artificial Sequence
  Synthetic
gctacaaggttactgtgggc

SEQ ID NO: 13718 - DNA, 18 bp, Artificial Sequence
  Synthetic
tacgctcagtgtaggcgc

SEQ ID NO: 13719 - DNA, 17 bp, Artificial Sequence
  Synthetic
atgtcgaccccgctgaa

SEQ ID NO: 13720 - DNA, 20 bp, Artificial Sequence
  Synthetic
ttttgatgccagtcagagca

SEQ ID NO: 13721 - DNA, 17 bp, Artificial Sequence
  Synthetic
ccggccataacccacca

SEQ ID NO: 13722 - DNA, 19 bp, Artificial Sequence
  Synthetic
atacattaaccccccggcc

SEQ ID NO: 13723 - DNA, 18 bp, Artificial Sequence
  Synthetic
ccaataggccgacctgcc

SEQ ID NO: 13724 - DNA, 17 bp, Artificial Sequence
  Synthetic
cggcttcgctgctttca

SEQ ID NO: 13725 - DNA, 20 bp, Artificial Sequence
  Synthetic
ctgcggatgtatgtgagctg

SEQ ID NO: 13726 - DNA, 18 bp, Artificial Sequence
  Synthetic
gcgccacactgagaagtg

SEQ ID NO: 13727 - DNA, 20 bp, Artificial Sequence
  Synthetic
ttgtacgagctagtggaggc

SEQ ID NO: 13728 - DNA, 16 bp, Artificial Sequence
  Synthetic
ccttggcgcgcttcct

SEQ ID NO: 13729 - DNA, 16 bp, Artificial Sequence
  Synthetic
gggctggacctcgtgt

SEQ ID NO: 13730 - DNA, 20 bp, Artificial Sequence
  Synthetic
ctttgccctcgaacttgagt

SEQ ID NO: 13731 - DNA, 20 bp, Artificial Sequence
  Synthetic
tgtgctttggctttctctca

SEQ ID NO: 13732 - DNA, 20 bp, Artificial Sequence
  Synthetic
actgctagtgaccaactgct

SEQ ID NO: 13733 - DNA, 20 bp, Artificial Sequence
  Synthetic
aacaatataccaaaacggcg

SEQ ID NO: 13734 - DNA, 19 bp, Artificial Sequence
  Synthetic
taccgaaagacacagtgtt

SEQ ID NO: 13735 - DNA, 25 bp, Artificial Sequence
  Synthetic
gggttgtttattaagtttaaatcgg

SEQ ID NO: 13736 - DNA, 24 bp, Artificial Sequence
  Synthetic
gattcgggctatagagtattttac

SEQ ID NO: 13737 - DNA, 19 bp, Artificial Sequence
  Synthetic
gtggaaacgaaaaaccgtc

SEQ ID NO: 13738 - DNA, 20 bp, Artificial Sequence
  Synthetic
tgtttactgctattggacga

SEQ ID NO: 13739 - DNA, 18 bp, Artificial Sequence
  Synthetic
ggctatgttacctgcact

SEQ ID NO: 13740 - DNA, 20 bp, Artificial Sequence
  Synthetic
aggggtatgtatattagcgc

SEQ ID NO: 13741 - DNA, 21 bp, Artificial Sequence
  Synthetic
tttttcatcgtcgttacttcc

SEQ ID NO: 13742 - DNA, 21 bp, Artificial Sequence
  Synthetic
ttgctgggttatttaacatcc

SEQ ID NO: 13743 - DNA, 20 bp, Artificial Sequence
  Synthetic
cagaaactatccgacagaga

SEQ ID NO: 13744 - DNA, 18 bp, Artificial Sequence
  Synthetic
cgtttcctccttgcagac

SEQ ID NO: 13745 - DNA, 18 bp, Artificial Sequence
  Synthetic
acgaaccgtgttccgtcg

SEQ ID NO: 13746 - DNA, 18 bp, Artificial Sequence
  Synthetic
cccagaccccgagactgt

SEQ ID NO: 13747 - DNA, 18 bp, Artificial Sequence
  Synthetic
catcctcccagtgaccct

SEQ ID NO: 13748 - DNA, 17 bp, Artificial Sequence
  Synthetic
tctaggtttgccccccg

SEQ ID NO: 13749 - DNA, 24 bp, Artificial Sequence
  Synthetic
attagatcgatgggaaaaaattcg

SEQ ID NO: 13750 - DNA, 23 bp, Artificial Sequence
  Synthetic
tttagacaagatagaggaagagc

SEQ ID NO: 13751 - DNA, 19 bp, Artificial Sequence
  Synthetic
ccatcaatgaggaagctgc

SEQ ID NO: 13752 - DNA, 18 bp, Artificial Sequence
  Synthetic
gagcaagcttcacaggag

SEQ ID NO: 13753 - DNA, 21 bp, Artificial Sequence
  Synthetic
caccagggattagatatcagt

SEQ ID NO: 13754 - DNA, 21 bp, Artificial Sequence
  Synthetic
ccatcctgataaatggacagt

SEQ ID NO: 13755 - DNA, 20 bp, Artificial Sequence
  Synthetic
atatgcaagaatgaggggtg

SEQ ID NO: 13756 - DNA, 25 bp, Artificial Sequence
  Synthetic
tcaggaaagtactatttttagatgg

SEQ ID NO: 13757 - DNA, 22 bp, Artificial Sequence
  Synthetic
tagaagcagaagttattccagc

SEQ ID NO: 13758 - DNA, 18 bp, Artificial Sequence
  Synthetic
ggaaagctaggggatggt

SEQ ID NO: 13759 - DNA, 21 bp, Artificial Sequence
  Synthetic
attaggacacatagttagccc

SEQ ID NO: 13760 - DNA, 24 bp, Artificial Sequence
  Synthetic
cttagggcaacatatctatgaaac

SEQ ID NO: 13761 - DNA, 22 bp, Artificial Sequence
  Synthetic
tgtagtgctacagaaaaattgt

SEQ ID NO: 13762 - DNA, 20 bp, Artificial Sequence
  Synthetic
tggaacaggaccatgtacaa

SEQ ID NO: 13763 - DNA, 18 bp, Artificial Sequence
  Synthetic
caatgtatgcccctccca

SEQ ID NO: 13764 - DNA, 19 bp, Artificial Sequence
  Synthetic
caatgacgctgacggtaca

SEQ ID NO: 13765 - DNA, 20 bp, Artificial Sequence
  Synthetic
tggatggcctactgtaaggg

SEQ ID NO: 13766 - DNA, 20 bp, Artificial Sequence
  Synthetic
tagcatttcatcacgtggcc

SEQ ID NO: 13767 - DNA, 18 bp, Artificial Sequence
  Synthetic
caacgacatgcagtggct

SEQ ID NO: 13768 - DNA, 19 bp, Artificial Sequence
  Synthetic
gtttaggcgcaggtttccg

SEQ ID NO: 13769 - DNA, 16 bp, Artificial Sequence
  Synthetic
gagccggtcagcagct

SEQ ID NO: 13770 - DNA, 18 bp, Artificial Sequence
  Synthetic
cttcgagggcgtagtggc

SEQ ID NO: 13771 - DNA, 17 bp, Artificial Sequence
  Synthetic
gcgaactccaccgaggt

SEQ ID NO: 13772 - DNA, 20 bp, Artificial Sequence
  Synthetic
acacaacaaactccccctcg

SEQ ID NO: 13773 - DNA, 20 bp, Artificial Sequence
  Synthetic
taacgtacatgttctgcgcc

SEQ ID NO: 13774 - DNA, 18 bp, Artificial Sequence
  Synthetic
agtacatccccgcgtacg

SEQ ID NO: 13775 - DNA, 18 bp, Artificial Sequence
  Synthetic
ggacctccgggacttcga

SEQ ID NO: 13776 - DNA, 20 bp, Artificial Sequence
  Synthetic
tcctgaacacgctaatgtgc

SEQ ID NO: 13777 - DNA, 19 bp, Artificial Sequence
  Synthetic
ctctcctccacccaaacga

SEQ ID NO: 13778 - DNA, 16 bp, Artificial Sequence
  Synthetic
accgcgtcctccgaca

SEQ ID NO: 13779 - DNA, 18 bp, Artificial Sequence
  Synthetic
cagacggaacagctccca

SEQ ID NO: 13780 - DNA, 18 bp, Artificial Sequence
  Synthetic
atgggcgtaaagacgggc

SEQ ID NO: 13781 - DNA, 18 bp, Artificial Sequence
  Synthetic
ctaaggcccaccgtcacg

SEQ ID NO: 13782 - DNA, 16 bp, Artificial Sequence
  Synthetic
tgggcggtcagcgaga

SEQ ID NO: 13783 - DNA, 18 bp, Artificial Sequence
  Synthetic
cgctaaccagcagctcca

SEQ ID NO: 13784 - DNA, 16 bp, Artificial Sequence
  Synthetic
cacgatctggcgctgc

SEQ ID NO: 13785 - DNA, 19 bp, Artificial Sequence
  Synthetic
catcatctctaagcgcgcg

SEQ ID NO: 13786 - DNA, 19 bp, Artificial Sequence
  Synthetic
tacagcgtcctgaacacgt

SEQ ID NO: 13787 - DNA, 16 bp, Artificial Sequence
  Synthetic
cgggtggaccacgtca

SEQ ID NO: 13788 - DNA, 18 bp, Artificial Sequence
  Synthetic
gccagcgcgtgtatgagt

SEQ ID NO: 13789 - DNA, 19 bp, Artificial Sequence
  Synthetic
cggaaagaccactagcccg

SEQ ID NO: 13790 - DNA, 16 bp, Artificial Sequence
  Synthetic
ccaggggcaggacgaa

SEQ ID NO: 13791 - DNA, 18 bp, Artificial Sequence
  Synthetic
cttgggggattcgcaggc

SEQ ID NO: 13792 - DNA, 20 bp, Artificial Sequence
  Synthetic
taggtgataaacagcgggcg

SEQ ID NO: 13793 - DNA, 17 bp, Artificial Sequence
  Synthetic
cagggcgttgtagtgcg

SEQ ID NO: 13794 - DNA, 17 bp, Artificial Sequence
  Synthetic
cgccggccaattcttcc

SEQ ID NO: 13795 - DNA, 19 bp, Artificial Sequence
  Synthetic
gtcctgtctctgcagtcgt

SEQ ID NO: 13796 - DNA, 16 bp, Artificial Sequence
  Synthetic
tgcttcggcggctcct

SEQ ID NO: 13797 - DNA, 18 bp, Artificial Sequence
  Synthetic
gtgtagacctccaggggc

SEQ ID NO: 13798 - DNA, 17 bp, Artificial Sequence
  Synthetic
ccaatcagcgcccgaac

SEQ ID NO: 13799 - DNA, 20 bp, Artificial Sequence
  Synthetic
acgcgatggtctctatgtcc

SEQ ID NO: 13800 - DNA, 17 bp, Artificial Sequence
  Synthetic
tttgccccccacaaccc

SEQ ID NO: 13801 - DNA, 17 bp, Artificial Sequence
  Synthetic
tggtaccgcctcaagcc

SEQ ID NO: 13802 - DNA, 18 bp, Artificial Sequence
  Synthetic
agacgaactcgaaggcgg

SEQ ID NO: 13803 - DNA, 17 bp, Artificial Sequence
  Synthetic
catgaacgactgggccg

SEQ ID NO: 13804 - DNA, 16 bp, Artificial Sequence
  Synthetic
acgacgtcaaggggcg

SEQ ID NO: 13805 - DNA, 18 bp, Artificial Sequence
  Synthetic
cacaacaggtgggtgctt

SEQ ID NO: 13806 - DNA, 16 bp, Artificial Sequence
  Synthetic
gatgcgacgcctgtgc

SEQ ID NO: 13807 - DNA, 16 bp, Artificial Sequence
  Synthetic
ggcgttcaacgacgcc

SEQ ID NO: 13808 - DNA, 16 bp, Artificial Sequence
  Synthetic
aacccacgccccagtg

SEQ ID NO: 13809 - DNA, 16 bp, Artificial Sequence
  Synthetic
acagcgctccgatcgg

SEQ ID NO: 13810 - DNA, 17 bp, Artificial Sequence
  Synthetic
caaccaccttcgctccc

SEQ ID NO: 13811 - DNA, 17 bp, Artificial Sequence
  Synthetic
cagctcggcgatggtca

SEQ ID NO: 13812 - DNA, 17 bp, Artificial Sequence
  Synthetic
ccttgtcgcggtggttc

SEQ ID NO: 13813 - DNA, 17 bp, Artificial Sequence
  Synthetic
cgatggcgtccaccaga

SEQ ID NO: 13814 - DNA, 17 bp, Artificial Sequence
  Synthetic
tccagacggacagcacc

SEQ ID NO: 13815 - DNA, 18 bp, Artificial Sequence
  Synthetic
actgcgatcacgaagggc

SEQ ID NO: 13816 - DNA, 16 bp, Artificial Sequence
  Synthetic
tcctgcgccgacaaga

SEQ ID NO: 13817 - DNA, 17 bp, Artificial Sequence
  Synthetic
cccatgttttccgcggc

SEQ ID NO: 13818 - DNA, 17 bp, Artificial Sequence
  Synthetic
ctgcgcttcaagcacgg

SEQ ID NO: 13819 - DNA, 17 bp, Artificial Sequence
  Synthetic
gacacccagatgcgcct

SEQ ID NO: 13820 - DNA, 18 bp, Artificial Sequence
  Synthetic
acacgaaaatcacccgcc

SEQ ID NO: 13821 - DNA, 20 bp, Artificial Sequence
  Synthetic
tcgaacctgtttttacgggc

SEQ ID NO: 13822 - DNA, 16 bp, Artificial Sequence
  Synthetic
catgcccagcccccaa

SEQ ID NO: 13823 - DNA, 16 bp, Artificial Sequence
  Synthetic
gcggaaggaaacgggc

SEQ ID NO: 13824 - DNA, 16 bp, Artificial Sequence
  Synthetic
ccaccggggtgttgca

SEQ ID NO: 13825 - DNA, 16 bp, Artificial Sequence
  Synthetic
gtcgccccatgcacgt

SEQ ID NO: 13826 - DNA, 16 bp, Artificial Sequence
  Synthetic
gtttccgggagcgctg

SEQ ID NO: 13827 - DNA, 16 bp, Artificial Sequence
  Synthetic
tgggactccgcgtcgt

SEQ ID NO: 13828 - DNA, 20 bp, Artificial Sequence
  Synthetic
cccgatcactgtgtactacg

SEQ ID NO: 13829 - DNA, 18 bp, Artificial Sequence
  Synthetic
cggtctgtatgtcctgcg

SEQ ID NO: 13830 - DNA, 18 bp, Artificial Sequence
  Synthetic
gctggttgggtgggggta

SEQ ID NO: 13831 - DNA, 20 bp, Artificial Sequence
  Synthetic
acttatcctggggagaaggg

SEQ ID NO: 13832 - DNA, 18 bp, Artificial Sequence
  Synthetic
gatctggaggggaacttg

SEQ ID NO: 13833 - DNA, 20 bp, Artificial Sequence
  Synthetic
tcagtgtccattttgccagg

SEQ ID NO: 13834 - DNA, 20 bp, Artificial Sequence
  Synthetic
gacaaaacaacatcacagca

SEQ ID NO: 13835 - DNA, 24 bp, Artificial Sequence
  Synthetic
tgctgctttattcttctatcatag

SEQ ID NO: 13836 - DNA, 18 bp, Artificial Sequence
  Synthetic
agacactacaagacagcg

SEQ ID NO: 13837 - DNA, 23 bp, Artificial Sequence
  Synthetic
cttaacaaatttttggatggaca

SEQ ID NO: 13838 - DNA, 18 bp, Artificial Sequence
  Synthetic
ggcagccagttaccctaa

SEQ ID NO: 13839 - DNA, 18 bp, Artificial Sequence
  Synthetic
cagcgccctggtaaatgt

SEQ ID NO: 13840 - DNA, 22 bp, Artificial Sequence
  Synthetic
caagattcctaaaaacattggg

SEQ ID NO: 13841 - DNA, 17 bp, Artificial Sequence
  Synthetic
gggcattggcacaggac

SEQ ID NO: 13842 - DNA, 20 bp, Artificial Sequence
  Synthetic
ccgtaggtgacaatgctgaa

SEQ ID NO: 13843 - DNA, 19 bp, Artificial Sequence
  Synthetic
cgtagtgacacagacctgc

SEQ ID NO: 13844 - DNA, 20 bp, Artificial Sequence
  Synthetic
gaactagatgtactgggtga

SEQ ID NO: 13845 - DNA, 20 bp, Artificial Sequence
  Synthetic
atacaacggacattgaacac

SEQ ID NO: 13846 - DNA, 20 bp, Artificial Sequence
  Synthetic
gattgaggtttctaggggac

SEQ ID NO: 13847 - DNA, 20 bp, Artificial Sequence
  Synthetic
aagcagatgacaaatgtcct

SEQ ID NO: 13848 - DNA, 22 bp, Artificial Sequence
  Synthetic
ctaactttaccatcagtgttcc

SEQ ID NO: 13849 - DNA, 20 bp, Artificial Sequence
  Synthetic
aaatgtccctctaaggatgc

SEQ ID NO: 13850 - DNA, 20 bp, Artificial Sequence
  Synthetic
ccaacattggcaaacgtctc

SEQ ID NO: 13851 - DNA, 23 bp, Artificial Sequence
  Synthetic
tatgccaattaatttactgtgtg

SEQ ID NO: 13852 - DNA, 22 bp, Artificial Sequence
  Synthetic
cgaaagtatgtgataagtccac

SEQ ID NO: 13853 - DNA, 19 bp, Artificial Sequence
  Synthetic
tggaaacacaacagacact

SEQ ID NO: 13854 - DNA, 25 bp, Artificial Sequence
  Synthetic
tataggaattgtcaaatatctggtg

SEQ ID NO: 13855 - DNA, 23 bp, Artificial Sequence
  Synthetic
tattcagcaagttaaaacaacca

SEQ ID NO: 13856 - DNA, 22 bp, Artificial Sequence
  Synthetic
taagggaactattcataccaga

SEQ ID NO: 13857 - DNA, 22 bp, Artificial Sequence
  Synthetic
gaatctggaaaattgtatctgc

SEQ ID NO: 13858 - DNA, 25 bp, Artificial Sequence
  Synthetic
atcctaatagagaacgtttagtctg

SEQ ID NO: 13859 - DNA, 25 bp, Artificial Sequence
  Synthetic
ctctttacaatgtatattttgtggc

SEQ ID NO: 13860 - DNA, 21 bp, Artificial Sequence
  Synthetic
atggcaatgttagatcttgtt

SEQ ID NO: 13861 - DNA, 18 bp, Artificial Sequence
  Synthetic
acacctgttgtcacactt

SEQ ID NO: 13862 - DNA, 23 bp, Artificial Sequence
  Synthetic
atgcgtagattttaattctctgg

SEQ ID NO: 13863 - DNA, 21 bp, Artificial Sequence
  Synthetic
ttaaactttcaggacagtgga

SEQ ID NO: 13864 - DNA, 22 bp, Artificial Sequence
  Synthetic
atatggtgagtttccatcatgg

SEQ ID NO: 13865 - DNA, 25 bp, Artificial Sequence
  Synthetic
tttccaaataaattacctgtcactg

SEQ ID NO: 13866 - DNA, 20 bp, Artificial Sequence
  Synthetic
gggaacccaccaaaaggaaa

SEQ ID NO: 13867 - DNA, 18 bp, Artificial Sequence
  Synthetic
gccaactgctgtcccaac

SEQ ID NO: 13868 - DNA, 20 bp, Artificial Sequence
  Synthetic
ttaaacctccaaaacacacg

SEQ ID NO: 13869 - DNA, 18 bp, Artificial Sequence
  Synthetic
ggtccggaagaggatcag

SEQ ID NO: 13870 - DNA, 18 bp, Artificial Sequence
  Synthetic
cttcctgatccagcactt

SEQ ID NO: 13871 - DNA, 22 bp, Artificial Sequence
  Synthetic
tccggactttaatgtatttgtg

SEQ ID NO: 13872 - DNA, 21 bp, Artificial Sequence
  Synthetic
tttgaatttgaaaatcccgcg

SEQ ID NO: 13873 - DNA, 19 bp, Artificial Sequence
  Synthetic
gaccctgatgtgtctgatg

SEQ ID NO: 13874 - DNA, 20 bp, Artificial Sequence
  Synthetic
gagggtaagaggtatccaaa

SEQ ID NO: 13875 - DNA, 20 bp, Artificial Sequence
  Synthetic
tgattgtcctccaattcagc

SEQ ID NO: 13876 - DNA, 22 bp, Artificial Sequence
  Synthetic
actgtgaactagtatactgtga

SEQ ID NO: 13877 - DNA, 18 bp, Artificial Sequence
  Synthetic
cctagggctactttccga

SEQ ID NO: 13878 - DNA, 22 bp, Artificial Sequence
  Synthetic
aaggaatacaaaagactatgcc

SEQ ID NO: 13879 - DNA, 18 bp, Artificial Sequence
  Synthetic
ggcccatgctactcaaga

SEQ ID NO: 13880 - DNA, 23 bp, Artificial Sequence
  Synthetic
tctctgataatcttgaagcattt

SEQ ID NO: 13881 - DNA, 21 bp, Artificial Sequence
  Synthetic
gtcatggaatagcgataaggg

SEQ ID NO: 13882 - DNA, 20 bp, Artificial Sequence
  Synthetic
ctaggctttctgctaggtat

SEQ ID NO: 13883 - DNA, 25 bp, Artificial Sequence
  Synthetic
aatgatctagaaataaagctggaag

SEQ ID NO: 13884 - DNA, 18 bp, Artificial Sequence
  Synthetic
taagcgccctaaaacgaa

SEQ ID NO: 13885 - DNA, 20 bp, Artificial Sequence
  Synthetic
ctttcttacagggtgttcca

SEQ ID NO: 13886 - DNA, 19 bp, Artificial Sequence
  Synthetic
cacaggaaactctgacaga

SEQ ID NO: 13887 - DNA, 19 bp, Artificial Sequence
  Synthetic
cggcccacaatcttcgatc

SEQ ID NO: 13888 - DNA, 24 bp, Artificial Sequence
  Synthetic
gaatttgtatagacactgtaaagc

SEQ ID NO: 13889 - DNA, 19 bp, Artificial Sequence
  Synthetic
cagtccctatgaacctcct

SEQ ID NO: 13890 - DNA, 23 bp, Artificial Sequence
  Synthetic
gttacattcaacaaatcagaaca

SEQ ID NO: 13891 - DNA, 19 bp, Artificial Sequence
  Synthetic
ttagtaccagaagcggtac

SEQ ID NO: 13892 - DNA, 21 bp, Artificial Sequence
  Synthetic
tgttttgatgttttgcagatg

SEQ ID NO: 13893 - DNA, 20 bp, Artificial Sequence
  Synthetic
ccaatatcgagtgtttaggc

SEQ ID NO: 13894 - DNA, 21 bp, Artificial Sequence
  Synthetic
tattgggatgttgctaaacca

SEQ ID NO: 13895 - DNA, 24 bp, Artificial Sequence
  Synthetic
gatgtttatggcgataaatgtttc

SEQ ID NO: 13896 - DNA, 21 bp, Artificial Sequence
  Synthetic
gaatggcaattagcttttgtg

SEQ ID NO: 13897 - DNA, 20 bp, Artificial Sequence
  Synthetic
gctggacaggtagtattgtc

SEQ ID NO: 13898 - DNA, 18 bp, Artificial Sequence
  Synthetic
tcgttggatgatgctgaa

SEQ ID NO: 13899 - DNA, 18 bp, Artificial Sequence
  Synthetic
tggagccagcaaatcctt

SEQ ID NO: 13900 - DNA, 23 bp, Artificial Sequence
  Synthetic
agtttaacagctttagatgactt

SEQ ID NO: 13901 - DNA, 22 bp, Artificial Sequence
  Synthetic
gtggaattgtagaagatgaagc

SEQ ID NO: 13902 - DNA, 18 bp, Artificial Sequence
  Synthetic
ggtcctctccagtctctc

SEQ ID NO: 13903 - DNA, 21 bp, Artificial Sequence
  Synthetic
tttggcaatttaggaataggg

SEQ ID NO: 13904 - DNA, 21 bp, Artificial Sequence
  Synthetic
agaagaaattgaattaggccc

SEQ ID NO: 13905 - DNA, 19 bp, Artificial Sequence
  Synthetic
gatcgcctcttaacagtgg

SEQ ID NO: 13906 - DNA, 23 bp, Artificial Sequence
  Synthetic
aattagttgatgtagaaaaccct

SEQ ID NO: 13907 - DNA, 25 bp, Artificial Sequence
  Synthetic
tccttataaagacctaaagttttgg

SEQ ID NO: 13908 - DNA, 22 bp, Artificial Sequence
  Synthetic
atttccatcaagcaatactgac

SEQ ID NO: 13909 - DNA, 21 bp, Artificial Sequence
  Synthetic
cgacaaaacagtcaaatcaac

SEQ ID NO: 13910 - DNA, 19 bp, Artificial Sequence
  Synthetic
cgtccgtagaaatgaaggg

SEQ ID NO: 13911 - DNA, 21 bp, Artificial Sequence
  Synthetic
aagaagatctgtggatacctc

SEQ ID NO: 13912 - DNA, 20 bp, Artificial Sequence
  Synthetic
ccctccactagtttggtcga

SEQ ID NO: 13913 - DNA, 20 bp, Artificial Sequence
  Synthetic
tccatctaagttcacagagc

SEQ ID NO: 13914 - DNA, 19 bp, Artificial Sequence
  Synthetic
aaagctacttccaaaggct

SEQ ID NO: 13915 - DNA, 19 bp, Artificial Sequence
  Synthetic
atccaggagatcgaggtat

SEQ ID NO: 13916 - DNA, 18 bp, Artificial Sequence
  Synthetic
acccactggatcttctcc

SEQ ID NO: 13917 - DNA, 21 bp, Artificial Sequence
  Synthetic
caaattacctcataccactgc

SEQ ID NO: 13918 - DNA, 21 bp, Artificial Sequence
  Synthetic
gtggtccagaagatagaaagg

SEQ ID NO: 13919 - DNA, 19 bp, Artificial Sequence
  Synthetic
gatgtagagagcttcctcg

SEQ ID NO: 13920 - DNA, 18 bp, Artificial Sequence
  Synthetic
aggcaatgtatgtgcctc

SEQ ID NO: 13921 - DNA, 21 bp, Artificial Sequence
  Synthetic
tgatgttcataccacgattgt

SEQ ID NO: 13922 - DNA, 18 bp, Artificial Sequence
  Synthetic
ctactggagcacatggag

SEQ ID NO: 13923 - DNA, 20 bp, Artificial Sequence
  Synthetic
tagatgtatacatggcccca

SEQ ID NO: 13924 - DNA, 18 bp, Artificial Sequence
  Synthetic
aagccagggaaaagcttg

SEQ ID NO: 13925 - DNA, 19 bp, Artificial Sequence
  Synthetic
aaagaactgagccagtgtg

SEQ ID NO: 13926 - DNA, 25 bp, Artificial Sequence
  Synthetic
gttgtttactagtaactttgtgttg

SEQ ID NO: 13927 - DNA, 18 bp, Artificial Sequence
  Synthetic
caccacagagaaagggga

SEQ ID NO: 13928 - DNA, 21 bp, Artificial Sequence
  Synthetic
ctactttagtagtgcactcca

SEQ ID NO: 13929 - DNA, 25 bp, Artificial Sequence
  Synthetic
attgtatctaaacaaaaggtgagag

SEQ ID NO: 13930 - DNA, 18 bp, Artificial Sequence
  Synthetic
attttgtgcgacaatgct

SEQ ID NO: 13931 - DNA, 23 bp, Artificial Sequence
  Synthetic
gaagtaaatgctagaattgaacc

SEQ ID NO: 13932 - DNA, 19 bp, Artificial Sequence
  Synthetic
gctggatagagcttgatga

SEQ ID NO: 13933 - DNA, 20 bp, Artificial Sequence
  Synthetic
atcccacttaaggaatgaca

SEQ ID NO: 13934 - DNA, 18 bp, Artificial Sequence
  Synthetic
cgttgtctcctccagtca

SEQ ID NO: 13935 - DNA, 18 bp, Artificial Sequence
  Synthetic
cactcgcgagatactgac

SEQ ID NO: 13936 - DNA, 21 bp, Artificial Sequence
  Synthetic
caagcacagtccattatccaa

SEQ ID NO: 13937 - DNA, 21 bp, Artificial Sequence
  Synthetic
acatcagagtcacagttaacg

SEQ ID NO: 13938 - DNA, 24 bp, Artificial Sequence
  Synthetic
gctgctagaaatattgttagaaga

SEQ ID NO: 13939 - DNA, 19 bp, Artificial Sequence
  Synthetic
aggcaacctccaaacattg

SEQ ID NO: 13940 - DNA, 18 bp, Artificial Sequence
  Synthetic
aaaccagcggctaaatcc

SEQ ID NO: 13941 - DNA, 18 bp, Artificial Sequence
  Synthetic
cagaggggaaacgtactc

SEQ ID NO: 13942 - DNA, 19 bp, Artificial Sequence
  Synthetic
cgtactgggaacatttgac

SEQ ID NO: 13943 - DNA, 23 bp, Artificial Sequence
  Synthetic
accattgcatcaaatttacatga

SEQ ID NO: 13944 - DNA, 23 bp, Artificial Sequence
  Synthetic
attgtatggatgacatagagact

SEQ ID NO: 13945 - DNA, 23 bp, Artificial Sequence
  Synthetic
aagaaagacaaagtaaaaggaga

SEQ ID NO: 13946 - DNA, 18 bp, Artificial Sequence
  Synthetic
aacagcaacggtcggagg

SEQ ID NO: 13947 - DNA, 18 bp, Artificial Sequence
  Synthetic
tgctgaggaagttggaag

SEQ ID NO: 13948 - DNA, 23 bp, Artificial Sequence
  Synthetic
ttggaagtattctttatttgggt

SEQ ID NO: 13949 - DNA, 18 bp, Artificial Sequence
  Synthetic
gtcctggtttgcctacag

SEQ ID NO: 13950 - DNA, 24 bp, Artificial Sequence
  Synthetic
cagcaatattttacctcttactcc

SEQ ID NO: 13951 - DNA, 22 bp, Artificial Sequence
  Synthetic
tctttattttcatgccaattcg

SEQ ID NO: 13952 - DNA, 18 bp, Artificial Sequence
  Synthetic
cctctaggcataggaacg

SEQ ID NO: 13953 - DNA, 19 bp, Artificial Sequence
  Synthetic
tcactcccctgtgaggaac

SEQ ID NO: 13954 - DNA, 20 bp, Artificial Sequence
  Synthetic
aaagaaacaccaaccgtcgc

SEQ ID NO: 13955 - DNA, 18 bp, Artificial Sequence
  Synthetic
tagtgctggaagcggagg

SEQ ID NO: 13956 - DNA, 20 bp, Artificial Sequence
  Synthetic
atgatgatgaactggtcgcc

SEQ ID NO: 13957 - DNA, 20 bp, Artificial Sequence
  Synthetic
accgcagcaatttcaactcc

SEQ ID NO: 13958 - DNA, 19 bp, Artificial Sequence
  Synthetic
tcatgctagagagcctgcg

SEQ ID NO: 13959 - DNA, 20 bp, Artificial Sequence
  Synthetic
gtcccctcctcttttcaacc

SEQ ID NO: 13960 - DNA, 17 bp, Artificial Sequence
  Synthetic
cggcaaggtcgaagcag

SEQ ID NO: 13961 - DNA, 17 bp, Artificial Sequence
  Synthetic
gccgtagctgttgagcc

SEQ ID NO: 13962 - DNA, 20 bp, Artificial Sequence
  Synthetic
aacagccactcagagtttcc

SEQ ID NO: 13963 - DNA, 20 bp, Artificial Sequence
  Synthetic
ccatcagggcacgtagtagg

SEQ ID NO: 13964 - DNA, 20 bp, Artificial Sequence
  Synthetic
atatgggaagtttctggccg

SEQ ID NO: 13965 - DNA, 20 bp, Artificial Sequence
  Synthetic
ttaggtctcaatgctgtcgc

SEQ ID NO: 13966 - DNA, 19 bp, Artificial Sequence
  Synthetic
aaagccgggggtgtatagg

SEQ ID NO: 13967 - DNA, 20 bp, Artificial Sequence
  Synthetic
gggacgtgatgtggaaatgt

SEQ ID NO: 13968 - DNA, 20 bp, Artificial Sequence
  Synthetic
gctctaagcacatcccctac

SEQ ID NO: 13969 - DNA, 19 bp, Artificial Sequence
  Synthetic
tcaacatattgggcggctg

SEQ ID NO: 13970 - DNA, 19 bp, Artificial Sequence
  Synthetic
atagcctttgcctccaggg

SEQ ID NO: 13971 - DNA, 19 bp, Artificial Sequence
  Synthetic
gtgtgtcacaccacttgct

SEQ ID NO: 13972 - DNA, 20 bp, Artificial Sequence
  Synthetic
aggatacatcgttatgcgcc

SEQ ID NO: 13973 - DNA, 20 bp, Artificial Sequence
  Synthetic
tcctcgactcgtttgatcct

SEQ ID NO: 13974 - DNA, 20 bp, Artificial Sequence
  Synthetic
caacagctggctgataaggt

SEQ ID NO: 13975 - DNA, 20 bp, Artificial Sequence
  Synthetic
agtcttctgtgtagacccgt

SEQ ID NO: 13976 - DNA, 18 bp, Artificial Sequence
  Synthetic
ccctcacagaacgcctct

SEQ ID NO: 13977 - DNA, 20 bp, Artificial Sequence
  Synthetic
aacatcatgctcgtccaacg

SEQ ID NO: 13978 - DNA, 20 bp, Artificial Sequence
  Synthetic
tggtatggcagctttttccc

SEQ ID NO: 13979 - DNA, 19 bp, Artificial Sequence
  Synthetic
gtcaaaacagaaagacgcc

SEQ ID NO: 13980 - DNA, 20 bp, Artificial Sequence
  Synthetic
gattccattgggatcagact

SEQ ID NO: 13981 - DNA, 20 bp, Artificial Sequence
  Synthetic
tctgctgaattgttcactct

SEQ ID NO: 13982 - DNA, 23 bp, Artificial Sequence
  Synthetic
gtaaaagcaaactacaatgatgc

SEQ ID NO: 13983 - DNA, 22 bp, Artificial Sequence
  Synthetic
gtattaatgatggcatgctttg

SEQ ID NO: 13984 - DNA, 21 bp, Artificial Sequence
  Synthetic
acaccctttctttttcgaatt

SEQ ID NO: 13985 - DNA, 18 bp, Artificial Sequence
  Synthetic
aacgtttggggtatcgtt

SEQ ID NO: 13986 - DNA, 18 bp, Artificial Sequence
  Synthetic
gaggaggagcagcaagaa

SEQ ID NO: 13987 - DNA, 25 bp, Artificial Sequence
  Synthetic
actttatcatctagaaagcaaactc

SEQ ID NO: 13988 - DNA, 22 bp, Artificial Sequence
  Synthetic
aaaattcgtagtgtacctgttg

SEQ ID NO: 13989 - DNA, 22 bp, Artificial Sequence
  Synthetic
agatagtaaacatagacagcct

SEQ ID NO: 13990 - DNA, 18 bp, Artificial Sequence
  Synthetic
cacgtcagcaaggcatta

SEQ ID NO: 13991 - DNA, 18 bp, Artificial Sequence
  Synthetic
tacagagccatcagggga

SEQ ID NO: 13992 - DNA, 20 bp, Artificial Sequence
  Synthetic
tctgtctagacttagagcgt

SEQ ID NO: 13993 - DNA, 19 bp, Artificial Sequence
  Synthetic
ggtacaggaggttctatgg

SEQ ID NO: 13994 - DNA, 20 bp, Artificial Sequence
  Synthetic
aatcaaagggaggagtttca

SEQ ID NO: 13995 - DNA, 18 bp, Artificial Sequence
  Synthetic
gttgatcagcttgccgaa

SEQ ID NO: 13996 - DNA, 23 bp, Artificial Sequence
  Synthetic
ttcattctgctactgatagactc

SEQ ID NO: 13997 - DNA, 23 bp, Artificial Sequence
  Synthetic
atggcctgatttacttaaaatgt

SEQ ID NO: 13998 - DNA, 25 bp, Artificial Sequence
  Synthetic
aacattatctcagacatgtagaaga

SEQ ID NO: 13999 - DNA, 24 bp, Artificial Sequence
  Synthetic
gattactactgtgaaactactctg

SEQ ID NO: 14000 - DNA, 19 bp, Artificial Sequence
  Synthetic
cctcaatgggaatggagat

SEQ ID NO: 14001 - DNA, 18 bp, Artificial Sequence
  Synthetic
ttgccgcgagtatcattg

SEQ ID NO: 14002 - DNA, 19 bp, Artificial Sequence
  Synthetic
ggtacgggatgtaatggat

SEQ ID NO: 14003 - DNA, 23 bp, Artificial Sequence
  Synthetic
aaaaaggagattatttgaaagcg

SEQ ID NO: 14004 - DNA, 18 bp, Artificial Sequence
  Synthetic
gaggacgaggacaaggaa

SEQ ID NO: 14005 - DNA, 20 bp, Artificial Sequence
  Synthetic
acattacaagacgttagcct

SEQ ID NO: 14006 - DNA, 21 bp, Artificial Sequence
  Synthetic
aacatctgtaccttccattcc

SEQ ID NO: 14007 - DNA, 21 bp, Artificial Sequence
  Synthetic
tttttcagatgtctctttggc

SEQ ID NO: 14008 - DNA, 20 bp, Artificial Sequence
  Synthetic
aagtttggttttcctgacac

SEQ ID NO: 14009 - DNA, 18 bp, Artificial Sequence
  Synthetic
aaggatccccatgtacca

SEQ ID NO: 14010 - DNA, 25 bp, Artificial Sequence
  Synthetic
ttagacatttatttaatagggctgg

SEQ ID NO: 14011 - DNA, 24 bp, Artificial Sequence
  Synthetic
ccccttaaaaaatacactttttgg

SEQ ID NO: 14012 - DNA, 18 bp, Artificial Sequence
  Synthetic
cggttgcatgctttttgg

SEQ ID NO: 14013 - DNA, 22 bp, Artificial Sequence
  Synthetic
caaaagagaactgcaatgtttc

SEQ ID NO: 14014 - DNA, 22 bp, Artificial Sequence
  Synthetic
gtgtattaactgtcaaaagcca

SEQ ID NO: 14015 - DNA, 23 bp, Artificial Sequence
  Synthetic
actgttatgagcaattaaatgac

SEQ ID NO: 14016 - DNA, 20 bp, Artificial Sequence
  Synthetic
gcttcaatccaatgatcgtc

SEQ ID NO: 14017 - DNA, 21 bp, Artificial Sequence
  Synthetic
ggtgaatagtatctgcaacac

SEQ ID NO: 14018 - DNA, 18 bp, Artificial Sequence
  Synthetic
ggtgctagcagaacttca

SEQ ID NO: 14019 - DNA, 21 bp, Artificial Sequence
  Synthetic
agaacttgatgaaatagggga

SEQ ID NO: 14020 - DNA, 21 bp, Artificial Sequence
  Synthetic
atttgaggaatgataccgacg

SEQ ID NO: 14021 - DNA, 22 bp, Artificial Sequence
  Synthetic
cagattgagagcatgattgaag

SEQ ID NO: 14022 - DNA, 22 bp, Artificial Sequence
  Synthetic
gattacaacacatttccagagg

SEQ ID NO: 14023 - DNA, 18 bp, Artificial Sequence
  Synthetic
cgaggagcatctgtgaga

SEQ ID NO: 14024 - DNA, 19 bp, Artificial Sequence
  Synthetic
tgttctcaaacaagatggc

SEQ ID NO: 14025 - DNA, 18 bp, Artificial Sequence
  Synthetic
atctcgggcagaagaagt

SEQ ID NO: 14026 - DNA, 20 bp, Artificial Sequence
  Synthetic
agtgtccgggattaatgagt

SEQ ID NO: 14027 - DNA, 18 bp, Artificial Sequence
  Synthetic
agggccaaacctgtacaa

SEQ ID NO: 14028 - DNA, 21 bp, Artificial Sequence
  Synthetic
gttctaacacgaacgtttacg

SEQ ID NO: 14029 - DNA, 18 bp, Artificial Sequence
  Synthetic
ttgcttgttgtcagtgct

SEQ ID NO: 14030 - DNA, 20 bp, Artificial Sequence
  Synthetic
agagcagccaaatataggtg

SEQ ID NO: 14031 - DNA, 18 bp, Artificial Sequence
  Synthetic
ctgtgtgccattcgacac

SEQ ID NO: 14032 - DNA, 18 bp, Artificial Sequence
  Synthetic
cagaacgagcaggaccta

SEQ ID NO: 14033 - DNA, 18 bp, Artificial Sequence
  Synthetic
gtacagtctctgggaggt

SEQ ID NO: 14034 - DNA, 22 bp, Artificial Sequence
  Synthetic
gcattttccttaacagacatca

SEQ ID NO: 14035 - DNA, 18 bp, Artificial Sequence
  Synthetic
caagttgtgccttccctt

SEQ ID NO: 14036 - DNA, 20 bp, Artificial Sequence
  Synthetic
aggacaatccacccaaactg

SEQ ID NO: 14037 - DNA, 22 bp, Artificial Sequence
  Synthetic
ttctgttattttaggggcattt

SEQ ID NO: 14038 - DNA, 21 bp, Artificial Sequence
  Synthetic
atctagttcagctgttcttca

SEQ ID NO: 14039 - DNA, 22 bp, Artificial Sequence
  Synthetic
aactgagttcacaactagtaca

SEQ ID NO: 14040 - DNA, 22 bp, Artificial Sequence
  Synthetic
gaagtggtgttactataggtgc

SEQ ID NO: 14041 - DNA, 23 bp, Artificial Sequence
  Synthetic
tttagataattcaacaggggatt

SEQ ID NO: 14042 - DNA, 19 bp, Artificial Sequence
  Synthetic
ccgtgcaaatgataacact

SEQ ID NO: 14043 - DNA, 21 bp, Artificial Sequence
  Synthetic
caaaatgttgcttttgatgca

SEQ ID NO: 14044 - DNA, 18 bp, Artificial Sequence
  Synthetic
ttcctttaggccgcaaat

SEQ ID NO: 14045 - DNA, 23 bp, Artificial Sequence
  Synthetic
ttgttaataaacgtttatgctgc

SEQ ID NO: 14046 - DNA, 23 bp, Artificial Sequence
  Synthetic
gatcatatgaacaaatggagact

SEQ ID NO: 14047 - DNA, 23 bp, Artificial Sequence
  Synthetic
gaacaatagcaatggagttaatc

SEQ ID NO: 14048 - DNA, 19 bp, Artificial Sequence
  Synthetic
tgaggggatcagttgcaca

SEQ ID NO: 14049 - DNA, 25 bp, Artificial Sequence
  Synthetic
caagtttcataagaggaaagaaagt

SEQ ID NO: 14050 - DNA, 23 bp, Artificial Sequence
  Synthetic
aagacaatagcataagaattggt

SEQ ID NO: 14051 - DNA, 19 bp, Artificial Sequence
  Synthetic
catgggctggctaacaatc

SEQ ID NO: 14052 - DNA, 23 bp, Artificial Sequence
  Synthetic
aattctcactatgaggaatgttc

SEQ ID NO: 14053 - DNA, 19 bp, Artificial Sequence
  Synthetic
tggtgtttggataggaagg

SEQ ID NO: 14054 - DNA, 20 bp, Artificial Sequence
  Synthetic
cagattgtgtattggaagca

SEQ ID NO: 14055 - DNA, 21 bp, Artificial Sequence
  Synthetic
tactttgtcgaaacactagcg

SEQ ID NO: 14056 - DNA, 24 bp, Artificial Sequence
  Synthetic
gtttagaaatgtcttaagcattgc

SEQ ID NO: 14057 - DNA, 21 bp, Artificial Sequence
  Synthetic
agtcttaggagtttcaatcct

SEQ ID NO: 14058 - DNA, 20 bp, Artificial Sequence
  Synthetic
agccaacttcagtatggagc

SEQ ID NO: 14059 - DNA, 25 bp, Artificial Sequence
  Synthetic
cgaaaacggtgtatataaaagatgt

SEQ ID NO: 14060 - DNA, 19 bp, Artificial Sequence
  Synthetic
tgctgcatgccataaatgt

SEQ ID NO: 14061 - DNA, 25 bp, Artificial Sequence
  Synthetic
aatattaagtatgcatggacctaag

SEQ ID NO: 14062 - DNA, 19 bp, Artificial Sequence
  Synthetic
aacattttgtgaacaggca

SEQ ID NO: 14063 - DNA, 18 bp, Artificial Sequence
  Synthetic
tgttctgaagtggaagca

SEQ ID NO: 14064 - DNA, 18 bp, Artificial Sequence
  Synthetic
gtgccacaatgtgcaaac

SEQ ID NO: 14065 - DNA, 22 bp, Artificial Sequence
  Synthetic
gacatagacagccaaatacagt

SEQ ID NO: 14066 - DNA, 22 bp, Artificial Sequence
  Synthetic
ggcaacaaagacaattgtatga

SEQ ID NO: 14067 - DNA, 19 bp, Artificial Sequence
  Synthetic
cggtatccgctactcagct

SEQ ID NO: 14068 - DNA, 23 bp, Artificial Sequence
  Synthetic
acagtttaaaatgtttacggtac

SEQ ID NO: 14069 - DNA, 18 bp, Artificial Sequence
  Synthetic
tatgtgtgctgccatgtc

SEQ ID NO: 14070 - DNA, 25 bp, Artificial Sequence
  Synthetic
tcctctttaattacatatgacaacc

SEQ ID NO: 14071 - DNA, 19 bp, Artificial Sequence
  Synthetic
tgcagcctttagtatctgc

SEQ ID NO: 14072 - DNA, 18 bp, Artificial Sequence
  Synthetic
tgaggacgttagggacaa

SEQ ID NO: 14073 - DNA, 20 bp, Artificial Sequence
  Synthetic
gggattccatgtttttttgc

SEQ ID NO: 14074 - DNA, 20 bp, Artificial Sequence
  Synthetic
tgtttgctggcataatcaat

SEQ ID NO: 14075 - DNA, 20 bp, Artificial Sequence
  Synthetic
atttgtgtttgtggtatggg

SEQ ID NO: 14076 - DNA, 18 bp, Artificial Sequence
  Synthetic
ggatgtcaatccgacctt

SEQ ID NO: 14077 - DNA, 20 bp, Artificial Sequence
  Synthetic
acagattgtgtattggaagc

SEQ ID NO: 14078 - DNA, 18 bp, Artificial Sequence
  Synthetic
ttgagacactggcaagga

SEQ ID NO: 14079 - DNA, 18 bp, Artificial Sequence
  Synthetic
ttaggcgtctccatcctg

SEQ ID NO: 14080 - DNA, 19 bp, Artificial Sequence
  Synthetic
tttgttgccaatttcagca

SEQ ID NO: 14081 - DNA, 22 bp, Artificial Sequence
  Synthetic
tgaatacaagtcaaagaggagt

SEQ ID NO: 14082 - DNA, 16 bp, Artificial Sequence
  Synthetic
cgccccaccacctcaa

SEQ ID NO: 14083 - DNA, 17 bp, Artificial Sequence
  Synthetic
tcggggacagctatgcg

SEQ ID NO: 14084 - DNA, 17 bp, Artificial Sequence
  Synthetic
tggagttgctacgcggc

SEQ ID NO: 14085 - DNA, 18 bp, Artificial Sequence
  Synthetic
ttggtgttggagcaacgc

SEQ ID NO: 14086 - DNA, 20 bp, Artificial Sequence
  Synthetic
ccgagagggaactgtgtgga

SEQ ID NO: 14087 - DNA, 20 bp, Artificial Sequence
  Synthetic
aaggccaaaatacctgggtc

SEQ ID NO: 14088 - DNA, 18 bp, Artificial Sequence
  Synthetic
gcgtggacgtctgcaatg

SEQ ID NO: 14089 - DNA, 19 bp, Artificial Sequence
  Synthetic
ccccactgtcaagcctttg

SEQ ID NO: 14090 - DNA, 19 bp, Artificial Sequence
  Synthetic
tggggttcctagcagtgtg

SEQ ID NO: 14091 - DNA, 19 bp, Artificial Sequence
  Synthetic
ctggtgcgtgttctaccaa

SEQ ID NO: 14092 - DNA, 16 bp, Artificial Sequence
  Synthetic
cagcggcagagcggtt

SEQ ID NO: 14093 - DNA, 19 bp, Artificial Sequence
  Synthetic
tcatggcactaacgggagg

SEQ ID NO: 14094 - DNA, 18 bp, Artificial Sequence
  Synthetic
tcttgtgtgacgagggcc

SEQ ID NO: 14095 - DNA, 20 bp, Artificial Sequence
  Synthetic
ggccatgacgtggtgatctg

SEQ ID NO: 14096 - DNA, 19 bp, Artificial Sequence
  Synthetic
ttgcaagatacgccactgg

SEQ ID NO: 14097 - DNA, 18 bp, Artificial Sequence
  Synthetic
tgaggatgcaacgcaggg

SEQ ID NO: 14098 - DNA, 16 bp, Artificial Sequence
  Synthetic
tgggcccccagctgat

SEQ ID NO: 14099 - DNA, 16 bp, Artificial Sequence
  Synthetic
cggcgaggagtcccaa

SEQ ID NO: 14100 - DNA, 19 bp, Artificial Sequence
  Synthetic
tttcaccaatggtcgctcg

SEQ ID NO: 14101 - DNA, 20 bp, Artificial Sequence
  Synthetic
ttgacctcctttctggcaag

SEQ ID NO: 14102 - DNA, 18 bp, Artificial Sequence
  Synthetic
gccttggtcgctacctgt

SEQ ID NO: 14103 - DNA, 17 bp, Artificial Sequence
  Synthetic
ccagcttggttgcgcag

SEQ ID NO: 14104 - DNA, 20 bp, Artificial Sequence
  Synthetic
ttgaggctatagggtctgca

SEQ ID NO: 14105 - DNA, 19 bp, Artificial Sequence
  Synthetic
atccgtgatgaggtgaggg

SEQ ID NO: 14106 - DNA, 20 bp, Artificial Sequence
  Synthetic
ccaaaccagcgtgtaaaagc

SEQ ID NO: 14107 - DNA, 20 bp, Artificial Sequence
  Synthetic
ttaaggctgctttggctgac

SEQ ID NO: 14108 - DNA, 19 bp, Artificial Sequence
  Synthetic
acccagtggtgagatacgt

SEQ ID NO: 14109 - DNA, 25 bp, Artificial Sequence
  Synthetic
tacctttaagtattagagacttagc

SEQ ID NO: 14110 - DNA, 22 bp, Artificial Sequence
  Synthetic
tagaaaagttagattgctgtgg

SEQ ID NO: 14111 - DNA, 25 bp, Artificial Sequence
  Synthetic
acaattatttgagagagatacagac

SEQ ID NO: 14112 - DNA, 18 bp, Artificial Sequence
  Synthetic
gtggaggtaccggctatt

SEQ ID NO: 14113 - DNA, 23 bp, Artificial Sequence
  Synthetic
catgatgatctatttgaaagctc

SEQ ID NO: 14114 - DNA, 23 bp, Artificial Sequence
  Synthetic
ggcaagtacttttgatttttcag

SEQ ID NO: 14115 - DNA, 23 bp, Artificial Sequence
  Synthetic
ttgcattttaatttatggtcctc

SEQ ID NO: 14116 - DNA, 23 bp, Artificial Sequence
  Synthetic
tatgaaagcagataatacacctc

SEQ ID NO: 14117 - DNA, 16 bp, Artificial Sequence
  Synthetic
cagctccacgcctcca

SEQ ID NO: 14118 - DNA, 17 bp, Artificial Sequence
  Synthetic
tcgggcccttacaagca

SEQ ID NO: 14119 - DNA, 18 bp, Artificial Sequence
  Synthetic
gagggtcacttcgatcag

SEQ ID NO: 14120 - DNA, 21 bp, Artificial Sequence
  Synthetic
aggagagattttgatgaagcg

SEQ ID NO: 14121 - DNA, 20 bp, Artificial Sequence
  Synthetic
tctaactgagtccacaggcg

SEQ ID NO: 14122 - DNA, 23 bp, Artificial Sequence
  Synthetic
ttcgttttgcatttgataatcct

SEQ ID NO: 14123 - DNA, 24 bp, Artificial Sequence
  Synthetic
catactatacacaagacacaaagg

SEQ ID NO: 14124 - DNA, 23 bp, Artificial Sequence
  Synthetic
aaagatacagaaaacagtaatgc

SEQ ID NO: 14125 - DNA, 24 bp, Artificial Sequence
  Synthetic
caaaaatcagttttacattccagg

SEQ ID NO: 14126 - DNA, 18 bp, Artificial Sequence
  Synthetic
ccaagctgggttacaaca

SEQ ID NO: 14127 - DNA, 23 bp, Artificial Sequence
  Synthetic
gacaatatgtttactcatgcaga

SEQ ID NO: 14128 - DNA, 20 bp, Artificial Sequence
  Synthetic
ctttctccaaggacaactca

SEQ ID NO: 14129 - DNA, 18 bp, Artificial Sequence
  Synthetic
atagcatggtccagctca

SEQ ID NO: 14130 - DNA, 18 bp, Artificial Sequence
  Synthetic
cacattggtccactgtca

SEQ ID NO: 14131 - DNA, 18 bp, Artificial Sequence
  Synthetic
ggtgggcctttgacaatg

SEQ ID NO: 14132 - DNA, 22 bp, Artificial Sequence
  Synthetic
gcttcgagcactaataaaactg

SEQ ID NO: 14133 - DNA, 22 bp, Artificial Sequence
  Synthetic
agagataaagaagagcgtctac

SEQ ID NO: 14134 - DNA, 22 bp, Artificial Sequence
  Synthetic
tgattcaatggcaaagaaaacc

SEQ ID NO: 14135 - DNA, 20 bp, Artificial Sequence
  Synthetic
aaacctttaagttttggcgc

SEQ ID NO: 14136 - DNA, 23 bp, Artificial Sequence
  Synthetic
aattgattgttgttatgctgaac

SEQ ID NO: 14137 - DNA, 18 bp, Artificial Sequence
  Synthetic
cttgtggagcaggtgtac

SEQ ID NO: 14138 - DNA, 20 bp, Artificial Sequence
  Synthetic
actgatggatctgatgtctc

SEQ ID NO: 14139 - DNA, 18 bp, Artificial Sequence
  Synthetic
gtcatgagtcagctgcta

SEQ ID NO: 14140 - DNA, 22 bp, Artificial Sequence
  Synthetic
acagatgtagtacattttggtt

SEQ ID NO: 14141 - DNA, 23 bp, Artificial Sequence
  Synthetic
tactaataaaacctggacatgtt

SEQ ID NO: 14142 - DNA, 20 bp, Artificial Sequence
  Synthetic
ctccggatctcttcaagggt

SEQ ID NO: 14143 - DNA, 22 bp, Artificial Sequence
  Synthetic
accagatacaatagtgacaact

SEQ ID NO: 14144 - DNA, 23 bp, Artificial Sequence
  Synthetic
taacatttggtgaggaaatacca

SEQ ID NO: 14145 - DNA, 23 bp, Artificial Sequence
  Synthetic
tacctctaatacctggaagatcc

SEQ ID NO: 14146 - DNA, 22 bp, Artificial Sequence
  Synthetic
ttaccgatgagtctaaagtagc

SEQ ID NO: 14147 - DNA, 23 bp, Artificial Sequence
  Synthetic
taataagtatgtggatgctgaga

SEQ ID NO: 14148 - DNA, 20 bp, Artificial Sequence
  Synthetic
tggaaatgcaaactttgagc

SEQ ID NO: 14149 - DNA, 18 bp, Artificial Sequence
  Synthetic
agtggctcacttgtctcc

SEQ ID NO: 14150 - DNA, 25 bp, Artificial Sequence
  Synthetic
taaacttgagtgaaaagttaactgg

SEQ ID NO: 14151 - DNA, 21 bp, Artificial Sequence
  Synthetic
gatgtcaatccgactctactg

SEQ ID NO: 14152 - DNA, 19 bp, Artificial Sequence
  Synthetic
acaaacagactgtgtcctg

SEQ ID NO: 14153 - DNA, 21 bp, Artificial Sequence
  Synthetic
aggatgtgatggaatcaatgg

SEQ ID NO: 14154 - DNA, 22 bp, Artificial Sequence
  Synthetic
cgttgaaactttagctagaagc

SEQ ID NO: 14155 - DNA, 20 bp, Artificial Sequence
  Synthetic
catcgcaccaataatgttct

SEQ ID NO: 14156 - DNA, 20 bp, Artificial Sequence
  Synthetic
agtctcggtactgaatcttg

SEQ ID NO: 14157 - DNA, 20 bp, Artificial Sequence
  Synthetic
tggagtgtctggaataaacg

SEQ ID NO: 14158 - DNA, 19 bp, Artificial Sequence
  Synthetic
ccaatcaagggcaggacta

SEQ ID NO: 14159 - DNA, 20 bp, Artificial Sequence
  Synthetic
tagccaaaggggaattcttg

SEQ ID NO: 14160 - DNA, 18 bp, Artificial Sequence
  Synthetic
agacgtgacaaccgacta

SEQ ID NO: 14161 - DNA, 23 bp, Artificial Sequence
  Synthetic
cctgatattgttttagaagagct

SEQ ID NO: 14162 - DNA, 18 bp, Artificial Sequence
  Synthetic
aagttttatgccaccccg

SEQ ID NO: 14163 - DNA, 18 bp, Artificial Sequence
  Synthetic
ttcaacctgatgccactg

SEQ ID NO: 14164 - DNA, 18 bp, Artificial Sequence
  Synthetic
gttgtagctctgcatgga

SEQ ID NO: 14165 - DNA, 21 bp, Artificial Sequence
  Synthetic
aatttgaaggcaacacaatcg

SEQ ID NO: 14166 - DNA, 24 bp, Artificial Sequence
  Synthetic
tcaatagttccattagtagaaggc

SEQ ID NO: 14167 - DNA, 23 bp, Artificial Sequence
  Synthetic
tgttaatgtattagttgacccca

SEQ ID NO: 14168 - DNA, 25 bp, Artificial Sequence
  Synthetic
tgttcagtttgaatatagaaatccc

SEQ ID NO: 14169 - DNA, 18 bp, Artificial Sequence
  Synthetic
aagtactcctgttgccag

SEQ ID NO: 14170 - DNA, 24 bp, Artificial Sequence
  Synthetic
ttggaaactagtaggtatagaagt

SEQ ID NO: 14171 - DNA, 20 bp, Artificial Sequence
  Synthetic
aagtgtcctccaatacaact

SEQ ID NO: 14172 - DNA, 23 bp, Artificial Sequence
  Synthetic
aggttgatattaaggacattgtc

SEQ ID NO: 14173 - DNA, 20 bp, Artificial Sequence
  Synthetic
agatgtagatttgagtccgc

SEQ ID NO: 14174 - DNA, 20 bp, Artificial Sequence
  Synthetic
gacgaagacccagatcatcc

SEQ ID NO: 14175 - DNA, 18 bp, Artificial Sequence
  Synthetic
ctacaagaagaggctcgg

SEQ ID NO: 14176 - DNA, 18 bp, Artificial Sequence
  Synthetic
ggaggtggtggaagagtc

SEQ ID NO: 14177 - DNA, 18 bp, Artificial Sequence
  Synthetic
cccgctgtttctacaact

SEQ ID NO: 14178 - DNA, 23 bp, Artificial Sequence
  Synthetic
aggaatttaatattgaagagcca

SEQ ID NO: 14179 - DNA, 19 bp, Artificial Sequence
  Synthetic
gaaaacagtgatgcacctt

SEQ ID NO: 14180 - DNA, 23 bp, Artificial Sequence
  Synthetic
gtattacatcccagtcatatccc

SEQ ID NO: 14181 - DNA, 23 bp, Artificial Sequence
  Synthetic
agacggtttgtttatcaaattgg

SEQ ID NO: 14182 - DNA, 22 bp, Artificial Sequence
  Synthetic
ttttccaatcttctcatctgac

SEQ ID NO: 14183 - DNA, 22 bp, Artificial Sequence
  Synthetic
ctactcctgtaactattaccga

SEQ ID NO: 14184 - DNA, 19 bp, Artificial Sequence
  Synthetic
acgaagttttgtcaccaga

SEQ ID NO: 14185 - DNA, 20 bp, Artificial Sequence
  Synthetic
gcagacatagatttgagtcc

SEQ ID NO: 14186 - DNA, 23 bp, Artificial Sequence
  Synthetic
tattcaaattatgtgtgaccctc

SEQ ID NO: 14187 - DNA, 24 bp, Artificial Sequence
  Synthetic
gtattcactaatacgttttctgga

SEQ ID NO: 14188 - DNA, 19 bp, Artificial Sequence
  Synthetic
ctcaccagaagaagagcag

SEQ ID NO: 14189 - DNA, 21 bp, Artificial Sequence
  Synthetic
ttgatgaaaaagcacaaacct

SEQ ID NO: 14190 - DNA, 25 bp, Artificial Sequence
  Synthetic
atgggtagattatgatagtagtagc

SEQ ID NO: 14191 - DNA, 19 bp, Artificial Sequence
  Synthetic
tggatcctttgggacctac

SEQ ID NO: 14192 - DNA, 20 bp, Artificial Sequence
  Synthetic
ctaaggcttttcaaagagca

SEQ ID NO: 14193 - DNA, 21 bp, Artificial Sequence
  Synthetic
atcacaatgccaactattcct

SEQ ID NO: 14194 - DNA, 18 bp, Artificial Sequence
  Synthetic
acaaggttgtggtgccta

SEQ ID NO: 14195 - DNA, 21 bp, Artificial Sequence
  Synthetic
gtgtacctttggacatagtgg

SEQ ID NO: 14196 - DNA, 19 bp, Artificial Sequence
  Synthetic
ttcctctggaacctgatgt

SEQ ID NO: 14197 - DNA, 19 bp, Artificial Sequence
  Synthetic
acatgttttgagcctctcc

SEQ ID NO: 14198 - DNA, 18 bp, Artificial Sequence
  Synthetic
acagtctttggctgcaac

SEQ ID NO: 14199 - DNA, 20 bp, Artificial Sequence
  Synthetic
ccatctcgggggtctctagc

SEQ ID NO: 14200 - DNA, 17 bp, Artificial Sequence
  Synthetic
atgctctggggcacaca

SEQ ID NO: 14201 - DNA, 16 bp, Artificial Sequence
  Synthetic
tggggctggacgttcg

SEQ ID NO: 14202 - DNA, 16 bp, Artificial Sequence
  Synthetic
gccacgtacgcgctgt

SEQ ID NO: 14203 - DNA, 18 bp, Artificial Sequence
  Synthetic
tgttggtgttgacgacgg

SEQ ID NO: 14204 - DNA, 16 bp, Artificial Sequence
  Synthetic
gccacgaccagctgct

SEQ ID NO: 14205 - DNA, 18 bp, Artificial Sequence
  Synthetic
cgtaagcacggggagggt

SEQ ID NO: 14206 - DNA, 16 bp, Artificial Sequence
  Synthetic
tctggcggacggaaca

SEQ ID NO: 14207 - DNA, 19 bp, Artificial Sequence
  Synthetic
ttctccctgttcaacccca

SEQ ID NO: 14208 - DNA, 18 bp, Artificial Sequence
  Synthetic
cagttgccactgggtcct

SEQ ID NO: 14209 - DNA, 18 bp, Artificial Sequence
  Synthetic
tgcttttggccatctgca

SEQ ID NO: 14210 - DNA, 18 bp, Artificial Sequence
  Synthetic
tcgaacaccagctgcatg

SEQ ID NO: 14211 - DNA, 16 bp, Artificial Sequence
  Synthetic
gtggtcacgtccccga

SEQ ID NO: 14212 - DNA, 18 bp, Artificial Sequence
  Synthetic
acactcgtgtccggagag

SEQ ID NO: 14213 - DNA, 19 bp, Artificial Sequence
  Synthetic
gcagatcaccgtcctgttg

SEQ ID NO: 14214 - DNA, 18 bp, Artificial Sequence
  Synthetic
cgttgtttcggcagcagc

SEQ ID NO: 14215 - DNA, 16 bp, Artificial Sequence
  Synthetic
ttgctgggtcctgcgg

SEQ ID NO: 14216 - DNA, 16 bp, Artificial Sequence
  Synthetic
gcccggggcttttcgt

SEQ ID NO: 14217 - DNA, 16 bp, Artificial Sequence
  Synthetic
acacaggcgggacacc

SEQ ID NO: 14218 - DNA, 16 bp, Artificial Sequence
  Synthetic
cagaccccccgaagct

SEQ ID NO: 14219 - DNA, 17 bp, Artificial Sequence
  Synthetic
tcgctgcttcctcgagt

SEQ ID NO: 14220 - DNA, 16 bp, Artificial Sequence
  Synthetic
cgcgcgggactttagc

SEQ ID NO: 14221 - DNA, 16 bp, Artificial Sequence
  Synthetic
tcgggggtttcctccg

SEQ ID NO: 14222 - DNA, 19 bp, Artificial Sequence
  Synthetic
gggcgcgtcagatacagaa

SEQ ID NO: 14223 - DNA, 16 bp, Artificial Sequence
  Synthetic
ccgtggccgagatcgt

SEQ ID NO: 14224 - DNA, 18 bp, Artificial Sequence
  Synthetic
ggccgattccttcatgca

SEQ ID NO: 14225 - DNA, 17 bp, Artificial Sequence
  Synthetic
tcccccaacactgacgt

SEQ ID NO: 14226 - DNA, 18 bp, Artificial Sequence
  Synthetic
gtctcctagttggcccgc

SEQ ID NO: 14227 - DNA, 16 bp, Artificial Sequence
  Synthetic
cggggtttctggggct

SEQ ID NO: 14228 - DNA, 16 bp, Artificial Sequence
  Synthetic
ctgtacgtcgctggcg

SEQ ID NO: 14229 - DNA, 16 bp, Artificial Sequence
  Synthetic
tggagctggcccagga

SEQ ID NO: 14230 - DNA, 16 bp, Artificial Sequence
  Synthetic
gttcacgaacgccgcg

SEQ ID NO: 14231 - DNA, 20 bp, Artificial Sequence
  Synthetic
tgcatcggcaacaacaaagc

SEQ ID NO: 14232 - DNA, 20 bp, Artificial Sequence
  Synthetic
agctccggaaacttggtaca

SEQ ID NO: 14233 - DNA, 16 bp, Artificial Sequence
  Synthetic
ggtgggcggcagcatt

SEQ ID NO: 14234 - DNA, 16 bp, Artificial Sequence
  Synthetic
acccacgcccacatcc

SEQ ID NO: 14235 - DNA, 17 bp, Artificial Sequence
  Synthetic
ggcgttgtagtgtgccc

SEQ ID NO: 14236 - DNA, 16 bp, Artificial Sequence
  Synthetic
gcagaccgcgccgttt

SEQ ID NO: 14237 - DNA, 16 bp, Artificial Sequence
  Synthetic
cgaatcgcggccagca

SEQ ID NO: 14238 - DNA, 16 bp, Artificial Sequence
  Synthetic
acgaagccatacgcgc

SEQ ID NO: 14239 - DNA, 16 bp, Artificial Sequence
  Synthetic
tcttctgcgtgcccgt

SEQ ID NO: 14240 - DNA, 19 bp, Artificial Sequence
  Synthetic
gacgtctgggaacacaggc

SEQ ID NO: 14241 - DNA, 20 bp, Artificial Sequence
  Synthetic
accatcacggactttcccct

SEQ ID NO: 14242 - DNA, 16 bp, Artificial Sequence
  Synthetic
tgcgctccatggcaga

SEQ ID NO: 14243 - DNA, 20 bp, Artificial Sequence
  Synthetic
caaactcgtgatcctccagc

SEQ ID NO: 14244 - DNA, 16 bp, Artificial Sequence
  Synthetic
acgtcgccgagcatcc

SEQ ID NO: 14245 - DNA, 19 bp, Artificial Sequence
  Synthetic
cgatcagaaagcccccatt

SEQ ID NO: 14246 - DNA, 19 bp, Artificial Sequence
  Synthetic
tggatatggcgtcggaaga

SEQ ID NO: 14247 - DNA, 17 bp, Artificial Sequence
  Synthetic
gccgtccagaaccactg

SEQ ID NO: 14248 - DNA, 18 bp, Artificial Sequence
  Synthetic
ccgacagaaacccgttgt

SEQ ID NO: 14249 - DNA, 16 bp, Artificial Sequence
  Synthetic
gcctcgcggttggtga

SEQ ID NO: 14250 - DNA, 17 bp, Artificial Sequence
  Synthetic
tgaacagctgcaacggg

SEQ ID NO: 14251 - DNA, 16 bp, Artificial Sequence
  Synthetic
ttcggacggacacgcg

SEQ ID NO: 14252 - DNA, 16 bp, Artificial Sequence
  Synthetic
ttcgaggcggaggtgg

SEQ ID NO: 14253 - DNA, 18 bp, Artificial Sequence
  Synthetic
agagcctcctcagcatcc

SEQ ID NO: 14254 - DNA, 20 bp, Artificial Sequence
  Synthetic
actccatctttgtgctgtgc

SEQ ID NO: 14255 - DNA, 16 bp, Artificial Sequence
  Synthetic
tagtgcaggtgggcgg

SEQ ID NO: 14256 - DNA, 17 bp, Artificial Sequence
  Synthetic
gggcggcacacctatca

SEQ ID NO: 14257 - DNA, 16 bp, Artificial Sequence
  Synthetic
ctcggcgacctggaca

SEQ ID NO: 14258 - DNA, 18 bp, Artificial Sequence
  Synthetic
taatgtcgcggatgctgc

SEQ ID NO: 14259 - DNA, 18 bp, Artificial Sequence
  Synthetic
ccctagggggccaatggt

SEQ ID NO: 14260 - DNA, 18 bp, Artificial Sequence
  Synthetic
gcatgcacgataccgacc

SEQ ID NO: 14261 - DNA, 17 bp, Artificial Sequence
  Synthetic
ggagatagcccagccca

SEQ ID NO: 14262 - DNA, 18 bp, Artificial Sequence
  Synthetic
tctatgcgctggaggtgc

SEQ ID NO: 14263 - DNA, 18 bp, Artificial Sequence
  Synthetic
tgtgtatacggacgcgcc

SEQ ID NO: 14264 - DNA, 19 bp, Artificial Sequence
  Synthetic
actcaggacatcggtgtgt

SEQ ID NO: 14265 - DNA, 16 bp, Artificial Sequence
  Synthetic
acaaggcgaccctgcg

SEQ ID NO: 14266 - DNA, 19 bp, Artificial Sequence
  Synthetic
tgttcaaagacgcggtgaa

SEQ ID NO: 14267 - DNA, 18 bp, Artificial Sequence
  Synthetic
tccttgtagaacgcgggt

SEQ ID NO: 14268 - DNA, 18 bp, Artificial Sequence
  Synthetic
agagctgggtctggagtc

SEQ ID NO: 14269 - DNA, 19 bp, Artificial Sequence
  Synthetic
ccggggcatccttatccat

SEQ ID NO: 14270 - DNA, 16 bp, Artificial Sequence
  Synthetic
tgacgaggccgcagct

SEQ ID NO: 14271 - DNA, 20 bp, Artificial Sequence
  Synthetic
ggtgtgtgatgatttcgcca

SEQ ID NO: 14272 - DNA, 17 bp, Artificial Sequence
  Synthetic
ggagggtcagccgttca

SEQ ID NO: 14273 - DNA, 16 bp, Artificial Sequence
  Synthetic
cgtacaggggctgggt

SEQ ID NO: 14274 - DNA, 18 bp, Artificial Sequence
  Synthetic
cgccgtctaagtggagct

SEQ ID NO: 14275 - DNA, 16 bp, Artificial Sequence
  Synthetic
ggaccggacggacctt

SEQ ID NO: 14276 - DNA, 16 bp, Artificial Sequence
  Synthetic
cgcagaacgccctcga

SEQ ID NO: 14277 - DNA, 17 bp, Artificial Sequence
  Synthetic
tgcgcggacaattaggc

SEQ ID NO: 14278 - DNA, 16 bp, Artificial Sequence
  Synthetic
tcctgatgggccgcca

SEQ ID NO: 14279 - DNA, 18 bp, Artificial Sequence
  Synthetic
cgacaagatcggactgcg

SEQ ID NO: 14280 - DNA, 16 bp, Artificial Sequence
  Synthetic
ttaagcacggccgggc

SEQ ID NO: 14281 - DNA, 17 bp, Artificial Sequence
  Synthetic
tccctgcagcacctctc

SEQ ID NO: 14282 - DNA, 17 bp, Artificial Sequence
  Synthetic
gtgcgtctggtggtcgt

SEQ ID NO: 14283 - DNA, 17 bp, Artificial Sequence
  Synthetic
tggacctctccgacagc

SEQ ID NO: 14284 - DNA, 16 bp, Artificial Sequence
  Synthetic
cgggccccggacataa

SEQ ID NO: 14285 - DNA, 16 bp, Artificial Sequence
  Synthetic
cgcgcccgagttttgc

SEQ ID NO: 14286 - DNA, 18 bp, Artificial Sequence
  Synthetic
attggcacggacaacagg

SEQ ID NO: 14287 - DNA, 16 bp, Artificial Sequence
  Synthetic
ggatgcgccccaaagc

SEQ ID NO: 14288 - DNA, 19 bp, Artificial Sequence
  Synthetic
cttcacccccagtaccctc

SEQ ID NO: 14289 - DNA, 16 bp, Artificial Sequence
  Synthetic
aggatgaagccccccg

SEQ ID NO: 14290 - DNA, 20 bp, Artificial Sequence
  Synthetic
accggatagcagatgtgagg

SEQ ID NO: 14291 - DNA, 16 bp, Artificial Sequence
  Synthetic
cggtgcagcagtcgga

SEQ ID NO: 14292 - DNA, 16 bp, Artificial Sequence
  Synthetic
tggccggacgaacgac

SEQ ID NO: 14293 - DNA, 17 bp, Artificial Sequence
  Synthetic
tacgggggggtaggtca

SEQ ID NO: 14294 - DNA, 16 bp, Artificial Sequence
  Synthetic
gccgtcccgggtgttt

SEQ ID NO: 14295 - DNA, 18 bp, Artificial Sequence
  Synthetic
ccccccggtatacgacga

SEQ ID NO: 14296 - DNA, 18 bp, Artificial Sequence
  Synthetic
tcggaggggtgtgtcttt

SEQ ID NO: 14297 - DNA, 20 bp, Artificial Sequence
  Synthetic
tctggtcctccccaagtacc

SEQ ID NO: 14298 - DNA, 17 bp, Artificial Sequence
  Synthetic
actgccgtccacaacgc

SEQ ID NO: 14299 - DNA, 18 bp, Artificial Sequence
  Synthetic
tcgtccctcgcatgaagc

SEQ ID NO: 14300 - DNA, 16 bp, Artificial Sequence
  Synthetic
cggggcggtcattgga

SEQ ID NO: 14301 - DNA, 17 bp, Artificial Sequence
  Synthetic
gcgcagtctggcatctg

SEQ ID NO: 14302 - DNA, 18 bp, Artificial Sequence
  Synthetic
ccccccaaaccatgtccg

SEQ ID NO: 14303 - DNA, 17 bp, Artificial Sequence
  Synthetic
ccagcctggttgtccgt

SEQ ID NO: 14304 - DNA, 17 bp, Artificial Sequence
  Synthetic
gcaacgcgggactatgc

SEQ ID NO: 14305 - DNA, 16 bp, Artificial Sequence
  Synthetic
gcggccgtggttaacc

SEQ ID NO: 14306 - DNA, 16 bp, Artificial Sequence
  Synthetic
tcagcgcgatccgaca

SEQ ID NO: 14307 - DNA, 18 bp, Artificial Sequence
  Synthetic
gatcgcctgtctcctcgt

SEQ ID NO: 14308 - DNA, 25 bp, Artificial Sequence
  Synthetic
atcagaagataataaccattggatc

SEQ ID NO: 14309 - DNA, 18 bp, Artificial Sequence
  Synthetic
aggtttgagtctgttgct

SEQ ID NO: 14310 - DNA, 25 bp, Artificial Sequence
  Synthetic
gaaaaagggaaagtagttaaatcag

SEQ ID NO: 14311 - DNA, 23 bp, Artificial Sequence
  Synthetic
aaagggttttcatttaaatacgg

SEQ ID NO: 14312 - DNA, 20 bp, Artificial Sequence
  Synthetic
tgtatccctcctgttgctgt

SEQ ID NO: 14313 - DNA, 23 bp, Artificial Sequence
  Synthetic
ctttgggtatacatttaaaccct

SEQ ID NO: 14314 - DNA, 20 bp, Artificial Sequence
  Synthetic
cgtctgtgccttctcatctg

SEQ ID NO: 14315 - DNA, 20 bp, Artificial Sequence
  Synthetic
ttagagtctcctgagcattg

SEQ ID NO: 14316 - DNA, 20 bp, Artificial Sequence
  Synthetic
gaaacaacacatagcgcctc

SEQ ID NO: 14317 - DNA, 22 bp, Artificial Sequence
  Synthetic
aataaaagaactacggaacctg

SEQ ID NO: 14318 - DNA, 19 bp, Artificial Sequence
  Synthetic
gatcagatcgagtgatggt

SEQ ID NO: 14319 - DNA, 19 bp, Artificial Sequence
  Synthetic
ctaattattgcggccagga

SEQ ID NO: 14320 - DNA, 18 bp, Artificial Sequence
  Synthetic
aagcgggtcatcagtcaa

SEQ ID NO: 14321 - DNA, 20 bp, Artificial Sequence
  Synthetic
gacctgaatttcgtcaacag

SEQ ID NO: 14322 - DNA, 20 bp, Artificial Sequence
  Synthetic
tgatcggtttttgagagttc

SEQ ID NO: 14323 - DNA, 18 bp, Artificial Sequence
  Synthetic
ccaaggccattagaagcc

SEQ ID NO: 14324 - DNA, 18 bp, Artificial Sequence
  Synthetic
gaaaagatgccggcactt

SEQ ID NO: 14325 - DNA, 23 bp, Artificial Sequence
  Synthetic
tattttgatgttactcctgatgt

SEQ ID NO: 14326 - DNA, 21 bp, Artificial Sequence
  Synthetic
aagagttaaatgtgaggtgtc

SEQ ID NO: 14327 - DNA, 24 bp, Artificial Sequence
  Synthetic
aggagcatccagtatataaagttg

SEQ ID NO: 14328 - DNA, 25 bp, Artificial Sequence
  Synthetic
gtggatgatatacaatgtattgatg

SEQ ID NO: 14329 - DNA, 20 bp, Artificial Sequence
  Synthetic
ttgaattttcaggacagtgg

SEQ ID NO: 14330 - DNA, 24 bp, Artificial Sequence
  Synthetic
tggactcccaaataaattattgga

SEQ ID NO: 14331 - DNA, 20 bp, Artificial Sequence
  Synthetic
cagctctgcaagttccttct

SEQ ID NO: 14332 - DNA, 19 bp, Artificial Sequence
  Synthetic
cgactcttgctgatcgatt

SEQ ID NO: 14333 - DNA, 23 bp, Artificial Sequence
  Synthetic
caacattaattgaatcaggagga

SEQ ID NO: 14334 - DNA, 19 bp, Artificial Sequence
  Synthetic
ctttagcactgacgtcact

SEQ ID NO: 14335 - DNA, 19 bp, Artificial Sequence
  Synthetic
ctataggttctgacgctgc

SEQ ID NO: 14336 - DNA, 18 bp, Artificial Sequence
  Synthetic
caagaccaatcgccagag

SEQ ID NO: 14337 - DNA, 23 bp, Artificial Sequence
  Synthetic
ttaagaggtattgaaataggtcg

SEQ ID NO: 14338 - DNA, 24 bp, Artificial Sequence
  Synthetic
tccacctgtgcaattaattaattc

SEQ ID NO: 14339 - DNA, 19 bp, Artificial Sequence
  Synthetic
ctaagtgtcctactgctgc

SEQ ID NO: 14340 - DNA, 25 bp, Artificial Sequence
  Synthetic
attgtgataaaatactgtgaatccc

SEQ ID NO: 14341 - DNA, 18 bp, Artificial Sequence
  Synthetic
gagggtcgatactgccaa

SEQ ID NO: 14342 - DNA, 22 bp, Artificial Sequence
  Synthetic
gggagataaggctactattcct

SEQ ID NO: 14343 - DNA, 21 bp, Artificial Sequence
  Synthetic
acagatctcagagctaagtcc

SEQ ID NO: 14344 - DNA, 20 bp, Artificial Sequence
  Synthetic
ccgagagaatctggaaccac

SEQ ID NO: 14345 - DNA, 23 bp, Artificial Sequence
  Synthetic
tttggaagtttggtatattttgg

SEQ ID NO: 14346 - DNA, 23 bp, Artificial Sequence
  Synthetic
gggcctgatatatcttttattgc

SEQ ID NO: 14347 - DNA, 25 bp, Artificial Sequence
  Synthetic
gtgatactaatgtgtttgtagatcc

SEQ ID NO: 14348 - DNA, 20 bp, Artificial Sequence
  Synthetic
tttgagtttgaaaatcccgc

SEQ ID NO: 14349 - DNA, 19 bp, Artificial Sequence
  Synthetic
cctactgctgaaccagaag

SEQ ID NO: 14350 - DNA, 21 bp, Artificial Sequence
  Synthetic
tgaatattttaccgtggtgtc

SEQ ID NO: 14351 - DNA, 20 bp, Artificial Sequence
  Synthetic
aggaggagacatagaatcct

SEQ ID NO: 14352 - DNA, 18 bp, Artificial Sequence
  Synthetic
ctgaggctgcagggactt

SEQ ID NO: 14353 - DNA, 20 bp, Artificial Sequence
  Synthetic
tctgttaggacccttctcgc

SEQ ID NO: 14354 - DNA, 18 bp, Artificial Sequence
  Synthetic
gcgagaaactccgtcttg

SEQ ID NO: 14355 - DNA, 20 bp, Artificial Sequence
  Synthetic
acaagtagaccaacagcacc

SEQ ID NO: 14356 - DNA, 19 bp, Artificial Sequence
  Synthetic
caagagggtctgacatagc

SEQ ID NO: 14357 - DNA, 18 bp, Artificial Sequence
  Synthetic
ggaccaagccctatccca

SEQ ID NO: 14358 - DNA, 21 bp, Artificial Sequence
  Synthetic
accataatgacaggagatacc

SEQ ID NO: 14359 - DNA, 24 bp, Artificial Sequence
  Synthetic
aaataaggtgactcaagatttcac

SEQ ID NO: 14360 - DNA, 19 bp, Artificial Sequence
  Synthetic
gacaggacaggtttagagc

SEQ ID NO: 14361 - DNA, 18 bp, Artificial Sequence
  Synthetic
cagaagaagtgcagtgga

SEQ ID NO: 14362 - DNA, 21 bp, Artificial Sequence
  Synthetic
gagtgggactttgtatctacc

SEQ ID NO: 14363 - DNA, 19 bp, Artificial Sequence
  Synthetic
agtctatgttgcatgggtc

SEQ ID NO: 14364 - DNA, 20 bp, Artificial Sequence
  Synthetic
gaagcagaagtcatcccaca

SEQ ID NO: 14365 - DNA, 19 bp, Artificial Sequence
  Synthetic
aagaaggggaggaataggg

SEQ ID NO: 14366 - DNA, 21 bp, Artificial Sequence
  Synthetic
gaacctaacaccagaaaaagg

SEQ ID NO: 14367 - DNA, 21 bp, Artificial Sequence
  Synthetic
ccatagaagccttaaacaggg

SEQ ID NO: 14368 - DNA, 20 bp, Artificial Sequence
  Synthetic
aggaagaagccttaagacat

SEQ ID NO: 14369 - DNA, 18 bp, Artificial Sequence
  Synthetic
agacgaagaaggactcca

SEQ ID NO: 14370 - DNA, 22 bp, Artificial Sequence
  Synthetic
tggaataatacagtgacagaac

SEQ ID NO: 14371 - DNA, 22 bp, Artificial Sequence
  Synthetic
catggtatttagaagatgtggt

SEQ ID NO: 14372 - DNA, 23 bp, Artificial Sequence
  Synthetic
gtaagagaccaggaaataagaca

SEQ ID NO: 14373 - DNA, 21 bp, Artificial Sequence
  Synthetic
caattgggtagaagacaagaa

SEQ ID NO: 14374 - DNA, 19 bp, Artificial Sequence
  Synthetic
aagagtcactgctatcgag

SEQ ID NO: 14375 - DNA, 20 bp, Artificial Sequence
  Synthetic
actatccaagaactccccga

SEQ ID NO: 14376 - DNA, 18 bp, Artificial Sequence
  Synthetic
agagtacatgaacagccc

SEQ ID NO: 14377 - DNA, 21 bp, Artificial Sequence
  Synthetic
aacaagcagacatgatgatga

SEQ ID NO: 14378 - DNA, 18 bp, Artificial Sequence
  Synthetic
gagaggctggcagatcga

SEQ ID NO: 14379 - DNA, 24 bp, Artificial Sequence
  Synthetic
gaaggcaataattgtactactcat

SEQ ID NO: 14380 - DNA, 19 bp, Artificial Sequence
  Synthetic
cctaggcagaccaaaatgc

SEQ ID NO: 14381 - DNA, 18 bp, Artificial Sequence
  Synthetic
atgggaacggcttcttca

SEQ ID NO: 14382 - DNA, 20 bp, Artificial Sequence
  Synthetic
ccaaatcaaacagaagacga

SEQ ID NO: 14383 - DNA, 20 bp, Artificial Sequence
  Synthetic
ccaatatgggtgaaaacacc

SEQ ID NO: 14384 - DNA, 18 bp, Artificial Sequence
  Synthetic
cggagcaatgaatgagct

SEQ ID NO: 14385 - DNA, 19 bp, Artificial Sequence
  Synthetic
tgctttgaaaccaaacaca

SEQ ID NO: 14386 - DNA, 22 bp, Artificial Sequence
  Synthetic
tggagatccaaacaatatggat

SEQ ID NO: 14387 - DNA, 20 bp, Artificial Sequence
  Synthetic
tgagaacagaatggtgctgg

SEQ ID NO: 14388 - DNA, 18 bp, Artificial Sequence
  Synthetic
gcagcgattcaagtgatc

SEQ ID NO: 14389 - DNA, 19 bp, Artificial Sequence
  Synthetic
gtgtaagggtttgtgttgc

SEQ ID NO: 14390 - DNA, 24 bp, Artificial Sequence
  Synthetic
ctaacgtttcccaattaatagacg

SEQ ID NO: 14391 - DNA, 22 bp, Artificial Sequence
  Synthetic
aaaattactgatgctgaatgga

SEQ ID NO: 14392 - DNA, 22 bp, Artificial Sequence
  Synthetic
tgggattggatatactatcagg

SEQ ID NO: 14393 - DNA, 25 bp, Artificial Sequence
  Synthetic
tgacagtttataatgtatagagctg

SEQ ID NO: 14394 - DNA, 19 bp, Artificial Sequence
  Synthetic
gaggtacaacaaggcctat

SEQ ID NO: 14395 - DNA, 25 bp, Artificial Sequence
  Synthetic
atgatactgcagctatattagatgt

SEQ ID NO: 14396 - DNA, 22 bp, Artificial Sequence
  Synthetic
tggctgaatttgaaataatgga

SEQ ID NO: 14397 - DNA, 25 bp, Artificial Sequence
  Synthetic
attacataggcctacttatactaca

SEQ ID NO: 14398 - DNA, 25 bp, Artificial Sequence
  Synthetic
catcagatgactattttctacatcc

SEQ ID NO: 14399 - DNA, 22 bp, Artificial Sequence
  Synthetic
gaacacagtctgtagtagtacc

SEQ ID NO: 14400 - DNA, 25 bp, Artificial Sequence
  Synthetic
gatgaaaatgatcacagattgaatg

SEQ ID NO: 14401 - DNA, 19 bp, Artificial Sequence
  Synthetic
agatctggtgttcctttgg

SEQ ID NO: 14402 - DNA, 21 bp, Artificial Sequence
  Synthetic
tttgcaaagtttctctggatc

SEQ ID NO: 14403 - DNA, 20 bp, Artificial Sequence
  Synthetic
cgccgctttctatatcaaac

SEQ ID NO: 14404 - DNA, 18 bp, Artificial Sequence
  Synthetic
aaacagctgagtctggtt

SEQ ID NO: 14405 - DNA, 19 bp, Artificial Sequence
  Synthetic
agcccatctattgtgtgaa

SEQ ID NO: 14406 - DNA, 23 bp, Artificial Sequence
  Synthetic
ttggaagcaataagaatttctcc

SEQ ID NO: 14407 - DNA, 25 bp, Artificial Sequence
  Synthetic
ctgggaaatcatatatttatggaac

SEQ ID NO: 14408 - DNA, 21 bp, Artificial Sequence
  Synthetic
acccgaagataatgaatcaga

SEQ ID NO: 14409 - DNA, 20 bp, Artificial Sequence
  Synthetic
gtctctatccgactcccctg

SEQ ID NO: 14410 - DNA, 21 bp, Artificial Sequence
  Synthetic
taaacgaataaagcgagcttc

SEQ ID NO: 14411 - DNA, 20 bp, Artificial Sequence
  Synthetic
ccccaagaccttctattcca

SEQ ID NO: 14412 - DNA, 18 bp, Artificial Sequence
  Synthetic
agggccctttaaggagta

SEQ ID NO: 14413 - DNA, 20 bp, Artificial Sequence
  Synthetic
tataggagggttcagggatg

SEQ ID NO: 14414 - DNA, 23 bp, Artificial Sequence
  Synthetic
taataatgtccaagttccaaagg

SEQ ID NO: 14415 - DNA, 25 bp, Artificial Sequence
  Synthetic
attaattctacatgtaaatggccag

SEQ ID NO: 14416 - DNA, 19 bp, Artificial Sequence
  Synthetic
cctttagaggctgatgtgt

SEQ ID NO: 14417 - DNA, 23 bp, Artificial Sequence
  Synthetic
tttacatatcagtcgttcaaagg

SEQ ID NO: 14418 - DNA, 18 bp, Artificial Sequence
  Synthetic
cactcgcgagatactgac

SEQ ID NO: 14419 - DNA, 18 bp, Artificial Sequence
  Synthetic
gctggatcagacagggta

SEQ ID NO: 14420 - DNA, 20 bp, Artificial Sequence
  Synthetic
gtcgttttcccaaatgaagt

SEQ ID NO: 14421 - DNA, 22 bp, Artificial Sequence
  Synthetic
gggaggtaagaaatgatgatgt

SEQ ID NO: 14422 - DNA, 21 bp, Artificial Sequence
  Synthetic
aagagaggaagaagtgcttac

SEQ ID NO: 14423 - DNA, 20 bp, Artificial Sequence
  Synthetic
ccgaggtgatttgaatttcg

SEQ ID NO: 14424 - DNA, 18 bp, Artificial Sequence
  Synthetic
cgtttcttaagggtccga

SEQ ID NO: 14425 - DNA, 20 bp, Artificial Sequence
  Synthetic
gccagaagccaatatagtgg

SEQ ID NO: 14426 - DNA, 21 bp, Artificial Sequence
  Synthetic
ttacaatacttgggaaggacg

SEQ ID NO: 14427 - DNA, 20 bp, Artificial Sequence
  Synthetic
gcgatcattccaacaaatgc

SEQ ID NO: 14428 - DNA, 22 bp, Artificial Sequence
  Synthetic
ccgatttaattattgagaggcg

SEQ ID NO: 14429 - DNA, 19 bp, Artificial Sequence
  Synthetic
gggatccatcattccgtat

SEQ ID NO: 14430 - DNA, 18 bp, Artificial Sequence
  Synthetic
tccagagtggagtacagg

SEQ ID NO: 14431 - DNA, 18 bp, Artificial Sequence
  Synthetic
tttggtgctatagcgggt

SEQ ID NO: 14432 - DNA, 20 bp, Artificial Sequence
  Synthetic
ctgaactcttggtagcaatg

SEQ ID NO: 14433 - DNA, 19 bp, Artificial Sequence
  Synthetic
ggtttaaccgaaaacggtg

SEQ ID NO: 14434 - DNA, 22 bp, Artificial Sequence
  Synthetic
attttggcatacagtagaacaa

SEQ ID NO: 14435 - DNA, 22 bp, Artificial Sequence
  Synthetic
aatttgacacctcagatgaaga

SEQ ID NO: 14436 - DNA, 18 bp, Artificial Sequence
  Synthetic
acgggagtatgggtaacg

SEQ ID NO: 14437 - DNA, 22 bp, Artificial Sequence
  Synthetic
catacaatggttaacctgtacc

SEQ ID NO: 14438 - DNA, 25 bp, Artificial Sequence
  Synthetic
gcatatgataatgatttaaccgaag

SEQ ID NO: 14439 - DNA, 22 bp, Artificial Sequence
  Synthetic
gaatttcaagaatcagaggacg

SEQ ID NO: 14440 - DNA, 19 bp, Artificial Sequence
  Synthetic
ccatggacattgcaagaga

SEQ ID NO: 14441 - DNA, 20 bp, Artificial Sequence
  Synthetic
cacctacacccacaaccatc

SEQ ID NO: 14442 - DNA, 22 bp, Artificial Sequence
  Synthetic
ttactgtgagtccactattgtg

SEQ ID NO: 14443 - DNA, 25 bp, Artificial Sequence
  Synthetic
ttgtacatacgtgataatatggtac

SEQ ID NO: 14444 - DNA, 22 bp, Artificial Sequence
  Synthetic
attgattctagcataccagtgc

SEQ ID NO: 14445 - DNA, 18 bp, Artificial Sequence
  Synthetic
gggctcgtattgggtcta

SEQ ID NO: 14446 - DNA, 23 bp, Artificial Sequence
  Synthetic
taccatatttttttgcagatgtc

SEQ ID NO: 14447 - DNA, 18 bp, Artificial Sequence
  Synthetic
ctgcttgctctgcacaat

SEQ ID NO: 14448 - DNA, 25 bp, Artificial Sequence
  Synthetic
tgcaaaattacattatctgtagagg

SEQ ID NO: 14449 - DNA, 23 bp, Artificial Sequence
  Synthetic
caatcctccattttagtacatgc

SEQ ID NO: 14450 - DNA, 19 bp, Artificial Sequence
  Synthetic
gtgtgttacctgaatgggt

SEQ ID NO: 14451 - DNA, 22 bp, Artificial Sequence
  Synthetic
acaggtcaagtttgtaaaagac

SEQ ID NO: 14452 - DNA, 19 bp, Artificial Sequence
  Synthetic
ctgaatcccagagcaacgg

SEQ ID NO: 14453 - DNA, 19 bp, Artificial Sequence
  Synthetic
ctgctgacattactgctga

SEQ ID NO: 14454 - DNA, 18 bp, Artificial Sequence
  Synthetic
gcccaggtcttgatgttg

SEQ ID NO: 14455 - DNA, 23 bp, Artificial Sequence
  Synthetic
acttttcagcattttcagaaagt

SEQ ID NO: 14456 - DNA, 18 bp, Artificial Sequence
  Synthetic
gacaatgctacacctcca

SEQ ID NO: 14457 - DNA, 19 bp, Artificial Sequence
  Synthetic
tttgaagtggagcttgtga

SEQ ID NO: 14458 - DNA, 23 bp, Artificial Sequence
  Synthetic
atttgcgagataaatttacctcc

SEQ ID NO: 14459 - DNA, 23 bp, Artificial Sequence
  Synthetic
aacatatggtgctatgtatcctg

SEQ ID NO: 14460 - DNA, 21 bp, Artificial Sequence
  Synthetic
ttgaacttagaccgaatttgg

SEQ ID NO: 14461 - DNA, 18 bp, Artificial Sequence
  Synthetic
ggcagatggcgactacca

SEQ ID NO: 14462 - DNA, 20 bp, Artificial Sequence
  Synthetic
gcaaatgcagagattcaagt

SEQ ID NO: 14463 - DNA, 22 bp, Artificial Sequence
  Synthetic
tggataatgagaaacaacatgc

SEQ ID NO: 14464 - DNA, 21 bp, Artificial Sequence
  Synthetic
tcaacaattgaagaccttgtc

SEQ ID NO: 14465 - DNA, 21 bp, Artificial Sequence
  Synthetic
caactatcctgccatatggag

SEQ ID NO: 14466 - DNA, 20 bp, Artificial Sequence
  Synthetic
tttagagtttgcttgcaact

SEQ ID NO: 14467 - DNA, 20 bp, Artificial Sequence
  Synthetic
gaaactgtacagagaggacc

SEQ ID NO: 14468 - DNA, 23 bp, Artificial Sequence
  Synthetic
gaaaatctcaaaaacaacaacca

SEQ ID NO: 14469 - DNA, 25 bp, Artificial Sequence
  Synthetic
gaaaagatcaagaaaactaggtttg

SEQ ID NO: 14470 - DNA, 22 bp, Artificial Sequence
  Synthetic
atacacattcccagaatcatca

SEQ ID NO: 14471 - DNA, 23 bp, Artificial Sequence
  Synthetic
ataaaaccagaactatacccatg

SEQ ID NO: 14472 - DNA, 21 bp, Artificial Sequence
  Synthetic
caagagtggatgcaattttcc

SEQ ID NO: 14473 - DNA, 22 bp, Artificial Sequence
  Synthetic
tagaagactctaactcttgtgg

SEQ ID NO: 14474 - DNA, 21 bp, Artificial Sequence
  Synthetic
tgattactcaatcaccctcca

SEQ ID NO: 14475 - DNA, 21 bp, Artificial Sequence
  Synthetic
tgcaaactgtataacaaccac

SEQ ID NO: 14476 - DNA, 24 bp, Artificial Sequence
  Synthetic
aatccaactctactcatacaattg

SEQ ID NO: 14477 - DNA, 25 bp, Artificial Sequence
  Synthetic
taacacatgatgtaggtataaaacc

SEQ ID NO: 14478 - DNA, 20 bp, Artificial Sequence
  Synthetic
tatgctgcactatacccatc

SEQ ID NO: 14479 - DNA, 18 bp, Artificial Sequence
  Synthetic
cacagggagcattgtgtc

SEQ ID NO: 14480 - DNA, 18 bp, Artificial Sequence
  Synthetic
gcctcctgtgacattacc

SEQ ID NO: 14481 - DNA, 25 bp, Artificial Sequence
  Synthetic
tagcaaaagaatctattatgatggg

SEQ ID NO: 14482 - DNA, 23 bp, Artificial Sequence
  Synthetic
atcaatccaactataacacagaa

SEQ ID NO: 14483 - DNA, 25 bp, Artificial Sequence
  Synthetic
atcagatatgaagatatgtgttcag

SEQ ID NO: 14484 - DNA, 21 bp, Artificial Sequence
  Synthetic
atgggcatttggtaatgatga

SEQ ID NO: 14485 - DNA, 22 bp, Artificial Sequence
  Synthetic
gactttgtgtctacttttctca

SEQ ID NO: 14486 - DNA, 20 bp, Artificial Sequence
  Synthetic
aatttctgcaaatggctgtt

SEQ ID NO: 14487 - DNA, 20 bp, Artificial Sequence
  Synthetic
ttatggcagtttgttgacca

SEQ ID NO: 14488 - DNA, 21 bp, Artificial Sequence
  Synthetic
tctcctgttatgacaaatggt

SEQ ID NO: 14489 - DNA, 20 bp, Artificial Sequence
  Synthetic
agagtgattgctcttcagag

SEQ ID NO: 14490 - DNA, 21 bp, Artificial Sequence
  Synthetic
tgcctgagaagtttttgaatg

SEQ ID NO: 14491 - DNA, 23 bp, Artificial Sequence
  Synthetic
aaagttaagtatgcaacagttgt

SEQ ID NO: 14492 - DNA, 23 bp, Artificial Sequence
  Synthetic
actttatgtgagagactatgttg

SEQ ID NO: 14493 - DNA, 18 bp, Artificial Sequence
  Synthetic
gaacatgtgcaaagcgtt

SEQ ID NO: 14494 - DNA, 25 bp, Artificial Sequence
  Synthetic
caggattaagtcttttagtactttc

SEQ ID NO: 14495 - DNA, 23 bp, Artificial Sequence
  Synthetic
tgagtttgaagatgaaaaacttg

SEQ ID NO: 14496 - DNA, 25 bp, Artificial Sequence
  Synthetic
tactcaaacaattggataacaactg

SEQ ID NO: 14497 - DNA, 21 bp, Artificial Sequence
  Synthetic
aaatgtagttgtaccagtggt

SEQ ID NO: 14498 - DNA, 23 bp, Artificial Sequence
  Synthetic
aagttgaaatatctgttacacca

SEQ ID NO: 14499 - DNA, 22 bp, Artificial Sequence
  Synthetic
aaggttaaggattttgtgtctg

SEQ ID NO: 14500 - DNA, 22 bp, Artificial Sequence
  Synthetic
gttctgttgttgtctacatgtg

SEQ ID NO: 14501 - DNA, 22 bp, Artificial Sequence
  Synthetic
taaggacaaagatctttctggt

SEQ ID NO: 14502 - DNA, 18 bp, Artificial Sequence
  Synthetic
tgtgctagtgtcaaacgt

SEQ ID NO: 14503 - DNA, 22 bp, Artificial Sequence
  Synthetic
gttaaaataatggccaaagcac

SEQ ID NO: 14504 - DNA, 22 bp, Artificial Sequence
  Synthetic
tcaaggatgattactgtgatgg

SEQ ID NO: 14505 - DNA, 19 bp, Artificial Sequence
  Synthetic
tgtgctttttggttgtgaa

SEQ ID NO: 14506 - DNA, 19 bp, Artificial Sequence
  Synthetic
tatgtctttagccgagtgc

SEQ ID NO: 14507 - DNA, 24 bp, Artificial Sequence
  Synthetic
cgcaagtatattgtaaaaactagc

SEQ ID NO: 14508 - DNA, 21 bp, Artificial Sequence
  Synthetic
ggcttcacacctttaaacaag

SEQ ID NO: 14509 - DNA, 21 bp, Artificial Sequence
  Synthetic
caaggctttggttttagaaca

SEQ ID NO: 14510 - DNA, 25 bp, Artificial Sequence
  Synthetic
attgtatttctttgctactagaagc

SEQ ID NO: 14511 - DNA, 22 bp, Artificial Sequence
  Synthetic
cttttcgcgtgatcataatgac

SEQ ID NO: 14512 - DNA, 23 bp, Artificial Sequence
  Synthetic
tgcatggagtaactcttaaaatt

SEQ ID NO: 14513 - DNA, 21 bp, Artificial Sequence
  Synthetic
ggttttgaagaccaacctaat

SEQ ID NO: 14514 - DNA, 22 bp, Artificial Sequence
  Synthetic
aatccataagcttatttgctgg

SEQ ID NO: 14515 - DNA, 21 bp, Artificial Sequence
  Synthetic
atttgtctttttgttgcactg

SEQ ID NO: 14516 - DNA, 23 bp, Artificial Sequence
  Synthetic
gctgtatgtactatggtttgttg

SEQ ID NO: 14517 - DNA, 20 bp, Artificial Sequence
  Synthetic
acaaacgtcgttctaatggg

SEQ ID NO: 14518 - DNA, 22 bp, Artificial Sequence
  Synthetic
ttgaagaaggctatgaatgttg

SEQ ID NO: 14519 - DNA, 23 bp, Artificial Sequence
  Synthetic
aaatgatggtagatggttttgtg

SEQ ID NO: 14520 - DNA, 18 bp, Artificial Sequence
  Synthetic
ggtggacgtgcattcatg

SEQ ID NO: 14521 - DNA, 18 bp, Artificial Sequence
  Synthetic
cagctgcagcctatcttg

SEQ ID NO: 14522 - DNA, 22 bp, Artificial Sequence
  Synthetic
taatcatggctgtacatgtgac

SEQ ID NO: 14523 - DNA, 23 bp, Artificial Sequence
  Synthetic
tatggtaatgttagtagacagga

SEQ ID NO: 14524 - DNA, 25 bp, Artificial Sequence
  Synthetic
tcttaatgggaatttctatgacttc

SEQ ID NO: 14525 - DNA, 19 bp, Artificial Sequence
  Synthetic
tcttcgcaaccacaattcc

SEQ ID NO: 14526 - DNA, 23 bp, Artificial Sequence
  Synthetic
gctttgagtacaggattaacatc

SEQ ID NO: 14527 - DNA, 25 bp, Artificial Sequence
  Synthetic
tgactcagttaaatcttaaatacgc

SEQ ID NO: 14528 - DNA, 23 bp, Artificial Sequence
  Synthetic
gcaaaagcatttttctatgatga

SEQ ID NO: 14529 - DNA, 20 bp, Artificial Sequence
  Synthetic
catcactaagactgatgctg

SEQ ID NO: 14530 - DNA, 20 bp, Artificial Sequence
  Synthetic
accacaaaccacatctttca

SEQ ID NO: 14531 - DNA, 23 bp, Artificial Sequence
  Synthetic
catgcttccaaattacaaaagac

SEQ ID NO: 14532 - DNA, 18 bp, Artificial Sequence
  Synthetic
tcctcctggtagtggaaa

SEQ ID NO: 14533 - DNA, 22 bp, Artificial Sequence
  Synthetic
tctatgtgcactaactatgact

SEQ ID NO: 14534 - DNA, 25 bp, Artificial Sequence
  Synthetic
agcgatttatacataaaaactccac

SEQ ID NO: 14535 - DNA, 19 bp, Artificial Sequence
  Synthetic
gtttaaggattgtgcacgt

SEQ ID NO: 14536 - DNA, 20 bp, Artificial Sequence
  Synthetic
tcatgtcagaggttggttag

SEQ ID NO: 14537 - DNA, 18 bp, Artificial Sequence
  Synthetic
ggtgtttgtactttgggc

SEQ ID NO: 14538 - DNA, 23 bp, Artificial Sequence
  Synthetic
gtatgactgctttgttaagaatg

SEQ ID NO: 14539 - DNA, 22 bp, Artificial Sequence
  Synthetic
tgaattctcaattgtttgcagg

SEQ ID NO: 14540 - DNA, 23 bp, Artificial Sequence
  Synthetic
ataacatttttactcaagctggt

SEQ ID NO: 14541 - DNA, 21 bp, Artificial Sequence
  Synthetic
ttgtcgccacatataagtttg

SEQ ID NO: 14542 - DNA, 22 bp, Artificial Sequence
  Synthetic
ttaactggtttgtttacgtacg

SEQ ID NO: 14543 - DNA, 22 bp, Artificial Sequence
  Synthetic
tcctagttctaagactgtttgt

SEQ ID NO: 14544 - DNA, 25 bp, Artificial Sequence
  Synthetic
tgtgtcaatattttaacagtaccac

SEQ ID NO: 14545 - DNA, 23 bp, Artificial Sequence
  Synthetic
gttgtcggaattaactatcttgg

SEQ ID NO: 14546 - DNA, 19 bp, Artificial Sequence
  Synthetic
tgccttgttgcatattgct

SEQ ID NO: 14547 - DNA, 20 bp, Artificial Sequence
  Synthetic
gatgctcacataccatttgg

SEQ ID NO: 14548 - DNA, 23 bp, Artificial Sequence
  Synthetic
agatggtttttattctacaagcc

SEQ ID NO: 14549 - DNA, 25 bp, Artificial Sequence
  Synthetic
aatatttatgatgtatctggtgtgg

SEQ ID NO: 14550 - DNA, 25 bp, Artificial Sequence
  Synthetic
gttttaacttattctagttttggcg

SEQ ID NO: 14551 - DNA, 20 bp, Artificial Sequence
  Synthetic
ctgcagatgttagtgagatg

SEQ ID NO: 14552 - DNA, 22 bp, Artificial Sequence
  Synthetic
ttctttaattggtggaattgct

SEQ ID NO: 14553 - DNA, 22 bp, Artificial Sequence
  Synthetic
tctatgacagacttgacactat

SEQ ID NO: 14554 - DNA, 18 bp, Artificial Sequence
  Synthetic
ggttgtgcgttgatggta

SEQ ID NO: 14555 - DNA, 22 bp, Artificial Sequence
  Synthetic
tacaaattgccaaattacactg

SEQ ID NO: 14556 - DNA, 20 bp, Artificial Sequence
  Synthetic
ggcttctttagttgttttgc

SEQ ID NO: 14557 - DNA, 24 bp, Artificial Sequence
  Synthetic
ttctaatccttttcgtttatgtgc

SEQ ID NO: 14558 - DNA, 19 bp, Artificial Sequence
  Synthetic
agctagtggatgatcatgc

SEQ ID NO: 14559 - DNA, 20 bp, Artificial Sequence
  Synthetic
ttgaagatgcttgtactgtg

SEQ ID NO: 14560 - DNA, 24 bp, Artificial Sequence
  Synthetic
taatttatagtagagtcggaaggt

SEQ ID NO: 14561 - DNA, 21 bp, Artificial Sequence
  Synthetic
tacccatcaacaagaaagaca

SEQ ID NO: 14562 - DNA, 20 bp, Artificial Sequence
  Synthetic
ggaatccttcaagtgacaga

SEQ ID NO: 14563 - DNA, 18 bp, Artificial Sequence
  Synthetic
aaatgcaaaagccacggt

SEQ ID NO: 14564 - DNA, 22 bp, Artificial Sequence
  Synthetic
attcactagagaaatgcaacaa

SEQ ID NO: 14565 - DNA, 24 bp, Artificial Sequence
  Synthetic
tcagagctgcttttaattaacatg

SEQ ID NO: 14566 - DNA, 20 bp, Artificial Sequence
  Synthetic
ctcatgtcctgtttctgtgt

SEQ ID NO: 14567 - DNA, 19 bp, Artificial Sequence
  Synthetic
gcgatgagtgtctagactc

SEQ ID NO: 14568 - DNA, 20 bp, Artificial Sequence
  Synthetic
aaaagacggctgtttgaggg

SEQ ID NO: 14569 - DNA, 18 bp, Artificial Sequence
  Synthetic
ccgcggcataaaagtgtt

SEQ ID NO: 14570 - DNA, 22 bp, Artificial Sequence
  Synthetic
gcatggctaaaaagtaacaatc

SEQ ID NO: 14571 - DNA, 22 bp, Artificial Sequence
  Synthetic
agtcatgaactgtatacaacac

SEQ ID NO: 14572 - DNA, 21 bp, Artificial Sequence
  Synthetic
agaaagaaaacatagatcgcg

SEQ ID NO: 14573 - DNA, 24 bp, Artificial Sequence
  Synthetic
atatatatagacattgtgtggggt

SEQ ID NO: 14574 - DNA, 19 bp, Artificial Sequence
  Synthetic
cttaggccaagtgtggtgg

SEQ ID NO: 14575 - DNA, 18 bp, Artificial Sequence
  Synthetic
cacttccacgcctaaacg

SEQ ID NO: 14576 - DNA, 18 bp, Artificial Sequence
  Synthetic
tccaaagggcaagggacc

SEQ ID NO: 14577 - DNA, 23 bp, Artificial Sequence
  Synthetic
ttagaagatacttatgctgagga

SEQ ID NO: 14578 - DNA, 19 bp, Artificial Sequence
  Synthetic
cttggtacgtaaacgcaaa

SEQ ID NO: 14579 - DNA, 20 bp, Artificial Sequence
  Synthetic
atctgggaatcagtacagag

SEQ ID NO: 14580 - DNA, 19 bp, Artificial Sequence
  Synthetic
tgccatgtttttctttggt

SEQ ID NO: 14581 - DNA, 25 bp, Artificial Sequence
  Synthetic
tctcatattaatgtaatggatccag

SEQ ID NO: 14582 - DNA, 17 bp, Artificial Sequence
  Synthetic
gtccgcggaaatccagc

SEQ ID NO: 14583 - DNA, 19 bp, Artificial Sequence
  Synthetic
gcatggacatctctccgtc

SEQ ID NO: 14584 - DNA, 20 bp, Artificial Sequence
  Synthetic
agtgtcgttggatctgaggg

SEQ ID NO: 14585 - DNA, 16 bp, Artificial Sequence
  Synthetic
gcctggtgacctgcct

SEQ ID NO: 14586 - DNA, 19 bp, Artificial Sequence
  Synthetic
aacatgtacccggcagtcc

SEQ ID NO: 14587 - DNA, 18 bp, Artificial Sequence
  Synthetic
aacattagcatcccggcg

SEQ ID NO: 14588 - DNA, 19 bp, Artificial Sequence
  Synthetic
accatccttttgccaatca

SEQ ID NO: 14589 - DNA, 20 bp, Artificial Sequence
  Synthetic
ccaggggggactttatgtga

SEQ ID NO: 14590 - DNA, 16 bp, Artificial Sequence
  Synthetic
gtcgctgactccgcca

SEQ ID NO: 14591 - DNA, 19 bp, Artificial Sequence
  Synthetic
cagctcctaagaaggcacc

SEQ ID NO: 14592 - DNA, 16 bp, Artificial Sequence
  Synthetic
accctaggcgtcccct

SEQ ID NO: 14593 - DNA, 17 bp, Artificial Sequence
  Synthetic
cacacacccacccgtct

SEQ ID NO: 14594 - DNA, 18 bp, Artificial Sequence
  Synthetic
aaaggtcagggcccaagg

SEQ ID NO: 14595 - DNA, 17 bp, Artificial Sequence
  Synthetic
acacccaggcacacact

SEQ ID NO: 14596 - DNA, 20 bp, Artificial Sequence
  Synthetic
ccaaaattggtgccttgctc

SEQ ID NO: 14597 - DNA, 16 bp, Artificial Sequence
  Synthetic
acacgttagggggcgc

SEQ ID NO: 14598 - DNA, 18 bp, Artificial Sequence
  Synthetic
ttgtcggaggtggagagg

SEQ ID NO: 14599 - DNA, 20 bp, Artificial Sequence
  Synthetic
aaactctaggcctgtggagc

SEQ ID NO: 14600 - DNA, 19 bp, Artificial Sequence
  Synthetic
gctccagggaatctttggg

SEQ ID NO: 14601 - DNA, 16 bp, Artificial Sequence
  Synthetic
tccccgctgaccagtc

SEQ ID NO: 14602 - DNA, 19 bp, Artificial Sequence
  Synthetic
gcagcttgtccttgaggag

SEQ ID NO: 14603 - DNA, 16 bp, Artificial Sequence
  Synthetic
tcgggagaggcgcctt

SEQ ID NO: 14604 - DNA, 16 bp, Artificial Sequence
  Synthetic
agagggccggtctcga

SEQ ID NO: 14605 - DNA, 16 bp, Artificial Sequence
  Synthetic
gccgaggccaccttgt

SEQ ID NO: 14606 - DNA, 17 bp, Artificial Sequence
  Synthetic
cctgttgtctggccacg

SEQ ID NO: 14607 - DNA, 20 bp, Artificial Sequence
  Synthetic
tctaggtcagacaggtagcg

SEQ ID NO: 14608 - DNA, 18 bp, Artificial Sequence
  Synthetic
gagaatggccgcgagttt

SEQ ID NO: 14609 - DNA, 18 bp, Artificial Sequence
  Synthetic
ctggatgccctccacgac

SEQ ID NO: 14610 - DNA, 16 bp, Artificial Sequence
  Synthetic
agctgcccccgtcaag

SEQ ID NO: 14611 - DNA, 18 bp, Artificial Sequence
  Synthetic
agctcgttggagaggacc

SEQ ID NO: 14612 - DNA, 19 bp, Artificial Sequence
  Synthetic
gagaaccacgagaggtgcc

SEQ ID NO: 14613 - DNA, 20 bp, Artificial Sequence
  Synthetic
gacagcgggcaagttttgtg

SEQ ID NO: 14614 - DNA, 16 bp, Artificial Sequence
  Synthetic
gtgctgcagccctcga

SEQ ID NO: 14615 - DNA, 17 bp, Artificial Sequence
  Synthetic
gccttcactggccctgt

SEQ ID NO: 14616 - DNA, 18 bp, Artificial Sequence
  Synthetic
cacctccgccacctccta

SEQ ID NO: 14617 - DNA, 20 bp, Artificial Sequence
  Synthetic
acgtgacatggagaaactgg

SEQ ID NO: 14618 - DNA, 16 bp, Artificial Sequence
  Synthetic
ccaggcccgcatgagt

SEQ ID NO: 14619 - DNA, 16 bp, Artificial Sequence
  Synthetic
cagccgcttcttgggc

SEQ ID NO: 14620 - DNA, 18 bp, Artificial Sequence
  Synthetic
ggggtactgggggtggtt

SEQ ID NO: 14621 - DNA, 19 bp, Artificial Sequence
  Synthetic
caacatgagacgtgaccgg

SEQ ID NO: 14622 - DNA, 18 bp, Artificial Sequence
  Synthetic
cacctggcttctgaccgg

SEQ ID NO: 14623 - DNA, 20 bp, Artificial Sequence
  Synthetic
tatagcctcagccatctacc

SEQ ID NO: 14624 - DNA, 18 bp, Artificial Sequence
  Synthetic
agcagctcagggaatggc

SEQ ID NO: 14625 - DNA, 16 bp, Artificial Sequence
  Synthetic
gcattagacgcgcgcg

SEQ ID NO: 14626 - DNA, 20 bp, Artificial Sequence
  Synthetic
tttgtcaatccatggcaggc

SEQ ID NO: 14627 - DNA, 18 bp, Artificial Sequence
  Synthetic
gtatgggttaccgcacgc

SEQ ID NO: 14628 - DNA, 20 bp, Artificial Sequence
  Synthetic
caacttagcagttcggcacc

SEQ ID NO: 14629 - DNA, 17 bp, Artificial Sequence
  Synthetic
cgagtcactgctgctgg

SEQ ID NO: 14630 - DNA, 20 bp, Artificial Sequence
  Synthetic
gcatcgcttaagtatgagtg

SEQ ID NO: 14631 - DNA, 19 bp, Artificial Sequence
  Synthetic
agggaatgaaagctcacgg

SEQ ID NO: 14632 - DNA, 18 bp, Artificial Sequence
  Synthetic
tgagggcagtgatagcga

SEQ ID NO: 14633 - DNA, 16 bp, Artificial Sequence
  Synthetic
gcagttcgcccagctc

SEQ ID NO: 14634 - DNA, 17 bp, Artificial Sequence
  Synthetic
gcgttccagcttcgtcc

SEQ ID NO: 14635 - DNA, 16 bp, Artificial Sequence
  Synthetic
cgccgctggagttcct

SEQ ID NO: 14636 - DNA, 19 bp, Artificial Sequence
  Synthetic
aggagcgacgagtatgtgg

SEQ ID NO: 14637 - DNA, 18 bp, Artificial Sequence
  Synthetic
cgaaaatactgccccgcg

SEQ ID NO: 14638 - DNA, 20 bp, Artificial Sequence
  Synthetic
ttctacaatgccagggggga

SEQ ID NO: 14639 - DNA, 17 bp, Artificial Sequence
  Synthetic
gcttggtgcctctgtgg

SEQ ID NO: 14640 - DNA, 18 bp, Artificial Sequence
  Synthetic
ggcatgtctgttccccct

SEQ ID NO: 14641 - DNA, 21 bp, Artificial Sequence
  Synthetic
actggaccctttaaaacatcc

SEQ ID NO: 14642 - DNA, 20 bp, Artificial Sequence
  Synthetic
attgtctgcgtacgctttcc

SEQ ID NO: 14643 - DNA, 18 bp, Artificial Sequence
  Synthetic
gacagcacctccaacagc

SEQ ID NO: 14644 - DNA, 20 bp, Artificial Sequence
  Synthetic
aatgcctctatgttggcaca

SEQ ID NO: 14645 - DNA, 17 bp, Artificial Sequence
  Synthetic
gcaccgagctgatgggt

SEQ ID NO: 14646 - DNA, 19 bp, Artificial Sequence
  Synthetic
aatctggttgtcggcctcc

SEQ ID NO: 14647 - DNA, 19 bp, Artificial Sequence
  Synthetic
cagacggatgtcaggtcgg

SEQ ID NO: 14648 - DNA, 19 bp, Artificial Sequence
  Synthetic
ctcaagtgtaagcagcccg

SEQ ID NO: 14649 - DNA, 19 bp, Artificial Sequence
  Synthetic
gtgctctcatccctgcaac

SEQ ID NO: 14650 - DNA, 20 bp, Artificial Sequence
  Synthetic
aaccagaaagatacccagag

SEQ ID NO: 14651 - DNA, 19 bp, Artificial Sequence
  Synthetic
cacgcatccctgtcttctc

SEQ ID NO: 14652 - DNA, 16 bp, Artificial Sequence
  Synthetic
ggctagcccccgcaaa

SEQ ID NO: 14653 - DNA, 17 bp, Artificial Sequence
  Synthetic
gaaaagggggtggcggt

SEQ ID NO: 14654 - DNA, 19 bp, Artificial Sequence
  Synthetic
ggtgtcttgggcatcatcc

SEQ ID NO: 14655 - DNA, 16 bp, Artificial Sequence
  Synthetic
gccccaagccttcgca

SEQ ID NO: 14656 - DNA, 20 bp, Artificial Sequence
  Synthetic
gacaaggcagtagaggacac

SEQ ID NO: 14657 - DNA, 20 bp, Artificial Sequence
  Synthetic
caggcaccgtctgtatacgt

SEQ ID NO: 14658 - DNA, 18 bp, Artificial Sequence
  Synthetic
gccaccacagcacaagtg

SEQ ID NO: 14659 - DNA, 18 bp, Artificial Sequence
  Synthetic
ccttccccgggaatgtgt

SEQ ID NO: 14660 - DNA, 19 bp, Artificial Sequence
  Synthetic
tctcctaggaatgccgagc

SEQ ID NO: 14661 - DNA, 17 bp, Artificial Sequence
  Synthetic
gttgcgctcgacgaact

SEQ ID NO: 14662 - DNA, 16 bp, Artificial Sequence
  Synthetic
cgtcagcacccccaca

SEQ ID NO: 14663 - DNA, 18 bp, Artificial Sequence
  Synthetic
gggaaagaggccgttggc

SEQ ID NO: 14664 - DNA, 18 bp, Artificial Sequence
  Synthetic
cccagtaggtgcctggct

SEQ ID NO: 14665 - DNA, 19 bp, Artificial Sequence
  Synthetic
accccctctatgtcttcgc

SEQ ID NO: 14666 - DNA, 19 bp, Artificial Sequence
  Synthetic
gaaggcccgtctgtagagg

SEQ ID NO: 14667 - DNA, 18 bp, Artificial Sequence
  Synthetic
gtcccctctgccgtggaa

SEQ ID NO: 14668 - DNA, 16 bp, Artificial Sequence
  Synthetic
gccgcatccacgtcct

SEQ ID NO: 14669 - DNA, 19 bp, Artificial Sequence
  Synthetic
gcaaagatctgcgtggaca

SEQ ID NO: 14670 - DNA, 16 bp, Artificial Sequence
  Synthetic
acctgtggcccgcgta

SEQ ID NO: 14671 - DNA, 18 bp, Artificial Sequence
  Synthetic
cgatgtcggctgtcctgc

SEQ ID NO: 14672 - DNA, 16 bp, Artificial Sequence
  Synthetic
cgggaggccgtgcttt

SEQ ID NO: 14673 - DNA, 20 bp, Artificial Sequence
  Synthetic
gagcggtctgtataaaaacg

SEQ ID NO: 14674 - DNA, 25 bp, Artificial Sequence
  Synthetic
agacaaatatgattggaaatagacc

SEQ ID NO: 14675 - DNA, 23 bp, Artificial Sequence
  Synthetic
gttagtgcaagattccaataacg

SEQ ID NO: 14676 - DNA, 23 bp, Artificial Sequence
  Synthetic
actgtactgaattccaaatgatt

SEQ ID NO: 14677 - DNA, 25 bp, Artificial Sequence
  Synthetic
agtttatgaaataactaatgccacc

SEQ ID NO: 14678 - DNA, 20 bp, Artificial Sequence
  Synthetic
tattttgaggatgcaaacgg

SEQ ID NO: 14679 - DNA, 18 bp, Artificial Sequence
  Synthetic
aacaattgcaccgactcg

SEQ ID NO: 14680 - DNA, 24 bp, Artificial Sequence
  Synthetic
tggagaagaaattcctttagatcc

SEQ ID NO: 14681 - DNA, 19 bp, Artificial Sequence
  Synthetic
atcttccacctcaaaagcc

SEQ ID NO: 14682 - DNA, 23 bp, Artificial Sequence
  Synthetic
gagattgtcctcctattgaatta

SEQ ID NO: 14683 - DNA, 19 bp, Artificial Sequence
  Synthetic
gggaacttgcctttgtacc

SEQ ID NO: 14684 - DNA, 25 bp, Artificial Sequence
  Synthetic
cacgtatattttatttttcaaccgc

SEQ ID NO: 14685 - DNA, 20 bp, Artificial Sequence
  Synthetic
ctactggtcctgttatgtgc

SEQ ID NO: 14686 - DNA, 18 bp, Artificial Sequence
  Synthetic
ctgcttccagtgagatca

SEQ ID NO: 14687 - DNA, 18 bp, Artificial Sequence
  Synthetic
atttgctatggctgacgg

SEQ ID NO: 14688 - DNA, 18 bp, Artificial Sequence
  Synthetic
ttgctaaaacccggagac

SEQ ID NO: 14689 - DNA, 22 bp, Artificial Sequence
  Synthetic
gttacaggactaaggaacattc

SEQ ID NO: 14690 - DNA, 25 bp, Artificial Sequence
  Synthetic
tgattatcccaaatattcagaagag

SEQ ID NO: 14691 - DNA, 18 bp, Artificial Sequence
  Synthetic
caaggttcgttggcagac

SEQ ID NO: 14692 - DNA, 23 bp, Artificial Sequence
  Synthetic
tgagctacttaattttgatcaca

SEQ ID NO: 14693 - DNA, 25 bp, Artificial Sequence
  Synthetic
taagttattagacttagtggagaag

SEQ ID NO: 14694 - DNA, 21 bp, Artificial Sequence
  Synthetic
cgtgcttgctacaaatttagg

SEQ ID NO: 14695 - DNA, 19 bp, Artificial Sequence
  Synthetic
atttgacgaagggacagac

SEQ ID NO: 14696 - DNA, 23 bp, Artificial Sequence
  Synthetic
aaatgaagctgaagatctttctg

SEQ ID NO: 14697 - DNA, 23 bp, Artificial Sequence
  Synthetic
tgaatgatgacttaattgaaagc

SEQ ID NO: 14698 - DNA, 21 bp, Artificial Sequence
  Synthetic
tcctgaatggatacttacaca

SEQ ID NO: 14699 - DNA, 21 bp, Artificial Sequence
  Synthetic
cagcagagttaaatcctttgc

SEQ ID NO: 14700 - DNA, 22 bp, Artificial Sequence
  Synthetic
agactttaagacaagagcaaat

SEQ ID NO: 14701 - DNA, 18 bp, Artificial Sequence
  Synthetic
tcttcgccaccaactgga

SEQ ID NO: 14702 - DNA, 16 bp, Artificial Sequence
  Synthetic
aaaggggaggggagcg

SEQ ID NO: 14703 - DNA, 18 bp, Artificial Sequence
  Synthetic
cacgattactggctgagg

SEQ ID NO: 14704 - DNA, 23 bp, Artificial Sequence
  Synthetic
atgatctgtaagctttactaacg

SEQ ID NO: 14705 - DNA, 19 bp, Artificial Sequence
  Synthetic
ataagtacaggccgtggca

SEQ ID NO: 14706 - DNA, 22 bp, Artificial Sequence
  Synthetic
agaatcaattgctgagatacac

SEQ ID NO: 14707 - DNA, 24 bp, Artificial Sequence
  Synthetic
tgaggtcacacaaatatttgaaag

SEQ ID NO: 14708 - DNA, 20 bp, Artificial Sequence
  Synthetic
gaaatgcaattattggggga

SEQ ID NO: 14709 - DNA, 19 bp, Artificial Sequence
  Synthetic
cagtggcgagagttcaaag

SEQ ID NO: 14710 - DNA, 18 bp, Artificial Sequence
  Synthetic
gtttgggcctgtagaggt

SEQ ID NO: 14711 - DNA, 22 bp, Artificial Sequence
  Synthetic
ttatgttagaggaggttcagtt

SEQ ID NO: 14712 - DNA, 20 bp, Artificial Sequence
  Synthetic
agatcactgaaagccagaga

SEQ ID NO: 14713 - DNA, 20 bp, Artificial Sequence
  Synthetic
ctttcttctagcatggacca

SEQ ID NO: 14714 - DNA, 20 bp, Artificial Sequence
  Synthetic
ctcaagggcgttatattgga

SEQ ID NO: 14715 - DNA, 18 bp, Artificial Sequence
  Synthetic
gcaagaagcttgtggatg

SEQ ID NO: 14716 - DNA, 18 bp, Artificial Sequence
  Synthetic
ggcaggagaaatcccatc

SEQ ID NO: 14717 - DNA, 18 bp, Artificial Sequence
  Synthetic
atgggggttaaagggaga

SEQ ID NO: 14718 - DNA, 19 bp, Artificial Sequence
  Synthetic
gcatggtatcaacagtggg

SEQ ID NO: 14719 - DNA, 18 bp, Artificial Sequence
  Synthetic
gtgtagctgcttctggtg

SEQ ID NO: 14720 - DNA, 19 bp, Artificial Sequence
  Synthetic
cagttagtctggacggatg

SEQ ID NO: 14721 - DNA, 24 bp, Artificial Sequence
  Synthetic
ctaccttcctttagtaaagaatgt

SEQ ID NO: 14722 - DNA, 19 bp, Artificial Sequence
  Synthetic
attgggttgattggtttgg

SEQ ID NO: 14723 - DNA, 20 bp, Artificial Sequence
  Synthetic
ttctcaaaagggattgacgg

SEQ ID NO: 14724 - DNA, 20 bp, Artificial Sequence
  Synthetic
tgaagctaacagaacattgc

SEQ ID NO: 14725 - DNA, 20 bp, Artificial Sequence
  Synthetic
catcgcaatcgtaagtatcc

SEQ ID NO: 14726 - DNA, 19 bp, Artificial Sequence
  Synthetic
cctctttgtgaacagtgtc

SEQ ID NO: 14727 - DNA, 20 bp, Artificial Sequence
  Synthetic
tacagggtgttatgttttgc

SEQ ID NO: 14728 - DNA, 22 bp, Artificial Sequence
  Synthetic
aactttttggatatctgccttc

SEQ ID NO: 14729 - DNA, 25 bp, Artificial Sequence
  Synthetic
gaagaagataaaactaagaatcagg

SEQ ID NO: 14730 - DNA, 20 bp, Artificial Sequence
  Synthetic
ggctcttttgttgagtttga

SEQ ID NO: 14731 - DNA, 22 bp, Artificial Sequence
  Synthetic
caatgttctgttatctccagat

SEQ ID NO: 14732 - DNA, 19 bp, Artificial Sequence
  Synthetic
atgcggttttaaagatggc

SEQ ID NO: 14733 - DNA, 22 bp, Artificial Sequence
  Synthetic
tctgattgagggacttctatca

SEQ ID NO: 14734 - DNA, 21 bp, Artificial Sequence
  Synthetic
gtttctcggaaatcacaaact

SEQ ID NO: 14735 - DNA, 21 bp, Artificial Sequence
  Synthetic
ctgaataggaattcctcgacc

SEQ ID NO: 14736 - DNA, 18 bp, Artificial Sequence
  Synthetic
cttcgccaagctttgagt

SEQ ID NO: 14737 - DNA, 22 bp, Artificial Sequence
  Synthetic
cttcgcattcttattaccaatg

SEQ ID NO: 14738 - DNA, 19 bp, Artificial Sequence
  Synthetic
ttacagtttgtggagggtt

SEQ ID NO: 14739 - DNA, 22 bp, Artificial Sequence
  Synthetic
taaacaatatgctcaatacggg

SEQ ID NO: 14740 - DNA, 19 bp, Artificial Sequence
  Synthetic
ctttcggaacaacaactgc

SEQ ID NO: 14741 - DNA, 22 bp, Artificial Sequence
  Synthetic
aaagcctgtacagaatacaaga

SEQ ID NO: 14742 - DNA, 23 bp, Artificial Sequence
  Synthetic
gtttaacagtagatcaactttcc

SEQ ID NO: 14743 - DNA, 19 bp, Artificial Sequence
  Synthetic
cttgccctttatgtggtct

SEQ ID NO: 14744 - DNA, 25 bp, Artificial Sequence
  Synthetic
tcctacttaacctattttacagatg

SEQ ID NO: 14745 - DNA, 19 bp, Artificial Sequence
  Synthetic
tggctatggcttttatggg

SEQ ID NO: 14746 - DNA, 19 bp, Artificial Sequence
  Synthetic
aagcactcctcctatcaca

SEQ ID NO: 14747 - DNA, 21 bp, Artificial Sequence
  Synthetic
ccaacaacattatactcccct

SEQ ID NO: 14748 - DNA, 19 bp, Artificial Sequence
  Synthetic
ctgttgaagtacgtccctt

SEQ ID NO: 14749 - DNA, 20 bp, Artificial Sequence
  Synthetic
aggctgataaatgttttcgg

SEQ ID NO: 14750 - DNA, 18 bp, Artificial Sequence
  Synthetic
ttgtcgcgaatagtcaca

SEQ ID NO: 14751 - DNA, 23 bp, Artificial Sequence
  Synthetic
tttgattttctctactaagtcgt

SEQ ID NO: 14752 - DNA, 18 bp, Artificial Sequence
  Synthetic
gttatccccaggcatgac

SEQ ID NO: 14753 - DNA, 18 bp, Artificial Sequence
  Synthetic
gtttggcaagcaaacaac

SEQ ID NO: 14754 - DNA, 19 bp, Artificial Sequence
  Synthetic
cctcttacaaaccgcattt

SEQ ID NO: 14755 - DNA, 21 bp, Artificial Sequence
  Synthetic
attgcttctctcttttccaaa

SEQ ID NO: 14756 - DNA, 18 bp, Artificial Sequence
  Synthetic
gagcctgtgcagaatgtg

SEQ ID NO: 14757 - DNA, 22 bp, Artificial Sequence
  Synthetic
taaagtaacaggactatcccct

SEQ ID NO: 14758 - DNA, 18 bp, Artificial Sequence
  Synthetic
accggtactttgcaacac

SEQ ID NO: 14759 - DNA, 25 bp, Artificial Sequence
  Synthetic
gaaacaagaagttctttttcaacac

SEQ ID NO: 14760 - DNA, 23 bp, Artificial Sequence
  Synthetic
gaccttatctttgggatacagat

SEQ ID NO: 14761 - DNA, 18 bp, Artificial Sequence
  Synthetic
agaaaacaggcaagccat

SEQ ID NO: 14762 - DNA, 21 bp, Artificial Sequence
  Synthetic
ccaacataaaactggagttct

SEQ ID NO: 14763 - DNA, 23 bp, Artificial Sequence
  Synthetic
atatcattctctgtaacaacctc

SEQ ID NO: 14764 - DNA, 25 bp, Artificial Sequence
  Synthetic
cggtcttaattccattaataagact

SEQ ID NO: 14765 - DNA, 18 bp, Artificial Sequence
  Synthetic
gcagacactacatgccaa

SEQ ID NO: 14766 - DNA, 18 bp, Artificial Sequence
  Synthetic
ttgttgtgtccttccgtt

SEQ ID NO: 14767 - DNA, 19 bp, Artificial Sequence
  Synthetic
cgtagcaaaaatctcccca

SEQ ID NO: 14768 - DNA, 20 bp, Artificial Sequence
  Synthetic
tcttcccaaaagacttcaga

SEQ ID NO: 14769 - DNA, 18 bp, Artificial Sequence
  Synthetic
aactgacaaaagctgccg

SEQ ID NO: 14770 - DNA, 18 bp, Artificial Sequence
  Synthetic
ccgtagtggttcgggatt

SEQ ID NO: 14771 - DNA, 18 bp, Artificial Sequence
  Synthetic
aaacggtgcaactcgatc

SEQ ID NO: 14772 - DNA, 25 bp, Artificial Sequence
  Synthetic
caaaaataggattagaagaacttcc

SEQ ID NO: 14773 - DNA, 23 bp, Artificial Sequence
  Synthetic
gctggattcacaatagtaaatgc

SEQ ID NO: 14774 - DNA, 21 bp, Artificial Sequence
  Synthetic
cagaacacatcacttcagaag

SEQ ID NO: 14775 - DNA, 21 bp, Artificial Sequence
  Synthetic
taatccagactcttcctcatc

SEQ ID NO: 14776 - DNA, 19 bp, Artificial Sequence
  Synthetic
aaggcagaaggatcttgtt

SEQ ID NO: 14777 - DNA, 19 bp, Artificial Sequence
  Synthetic
cttgcttgcgttattttcg

SEQ ID NO: 14778 - DNA, 21 bp, Artificial Sequence
  Synthetic
cctttaattacagctgggatg

SEQ ID NO: 14779 - DNA, 21 bp, Artificial Sequence
  Synthetic
atttcaacattgcgatcatca

SEQ ID NO: 14780 - DNA, 21 bp, Artificial Sequence
  Synthetic
ttaaacacgtacagaaagcaa

SEQ ID NO: 14781 - DNA, 18 bp, Artificial Sequence
  Synthetic
tgactgcgctatgaggat

SEQ ID NO: 14782 - DNA, 23 bp, Artificial Sequence
  Synthetic
tcaaatcaatgatttccacttca

SEQ ID NO: 14783 - DNA, 19 bp, Artificial Sequence
  Synthetic
ttggacaataaaatgcgcg

SEQ ID NO: 14784 - DNA, 24 bp, Artificial Sequence
  Synthetic
taccgaatctctaataatggatca

SEQ ID NO: 14785 - DNA, 18 bp, Artificial Sequence
  Synthetic
gtgctgctatccccgata

SEQ ID NO: 14786 - DNA, 18 bp, Artificial Sequence
  Synthetic
atccaccatccctgcttc

SEQ ID NO: 14787 - DNA, 20 bp, Artificial Sequence
  Synthetic
aaattcactgctttagcctg

SEQ ID NO: 14788 - DNA, 18 bp, Artificial Sequence
  Synthetic
aaaacgacgaggacccta

SEQ ID NO: 14789 - DNA, 21 bp, Artificial Sequence
  Synthetic
gtgctgcttgagaattcttac

SEQ ID NO: 14790 - DNA, 22 bp, Artificial Sequence
  Synthetic
gaaaactcgaatccaaactttc

SEQ ID NO: 14791 - DNA, 20 bp, Artificial Sequence
  Synthetic
gacgctgtagcataatcaat

SEQ ID NO: 14792 - DNA, 20 bp, Artificial Sequence
  Synthetic
agaacgcaaagattttcacg

SEQ ID NO: 14793 - DNA, 19 bp, Artificial Sequence
  Synthetic
gtgtgcccaatcatttcag

SEQ ID NO: 14794 - DNA, 22 bp, Artificial Sequence
  Synthetic
atatgctgatcaaattttggct

SEQ ID NO: 14795 - DNA, 25 bp, Artificial Sequence
  Synthetic
agaatccccttagaagttacttaaa

SEQ ID NO: 14796 - DNA, 21 bp, Artificial Sequence
  Synthetic
aggattaaccagcaaatacac

SEQ ID NO: 14797 - DNA, 19 bp, Artificial Sequence
  Synthetic
ttcctgctttcatcatggg

SEQ ID NO: 14798 - DNA, 19 bp, Artificial Sequence
  Synthetic
aaaattgggatagcgctct

SEQ ID NO: 14799 - DNA, 20 bp, Artificial Sequence
  Synthetic
ttgattaaccaaaagagcgc

SEQ ID NO: 14800 - DNA, 19 bp, Artificial Sequence
  Synthetic
tagctttcgatgctcaacc

SEQ ID NO: 14801 - DNA, 20 bp, Artificial Sequence
  Synthetic
atcgcagaagaaaaattccc

SEQ ID NO: 14802 - DNA, 19 bp, Artificial Sequence
  Synthetic
acctatgaagaagctcgtc

SEQ ID NO: 14803 - DNA, 20 bp, Artificial Sequence
  Synthetic
agactttaggagatcgtgtg

SEQ ID NO: 14804 - DNA, 25 bp, Artificial Sequence
  Synthetic
ttatcctttatctaacagtctctct

SEQ ID NO: 14805 - DNA, 25 bp, Artificial Sequence
  Synthetic
gtctctttactattaggaattaacg

SEQ ID NO: 14806 - DNA, 21 bp, Artificial Sequence
  Synthetic
tcaatgaccttcctatgtctc

SEQ ID NO: 14807 - DNA, 19 bp, Artificial Sequence
  Synthetic
catcgacaagattccctcc

SEQ ID NO: 14808 - DNA, 19 bp, Artificial Sequence
  Synthetic
aaagcagtgaaaacttgcc

SEQ ID NO: 14809 - DNA, 20 bp, Artificial Sequence
  Synthetic
ctttcaatcttcgggacaac

SEQ ID NO: 14810 - DNA, 19 bp, Artificial Sequence
  Synthetic
tcgtgcaagtatgttcaac

SEQ ID NO: 14811 - DNA, 24 bp, Artificial Sequence
  Synthetic
acgtttagaaattctagaagatgc

SEQ ID NO: 14812 - DNA, 22 bp, Artificial Sequence
  Synthetic
ctaaaaattcgtctaactgctg

SEQ ID NO: 14813 - DNA, 20 bp, Artificial Sequence
  Synthetic
aacttctacaatagcgtgca

SEQ ID NO: 14814 - DNA, 18 bp, Artificial Sequence
  Synthetic
tcttgaacgcaacgagaa

SEQ ID NO: 14815 - DNA, 19 bp, Artificial Sequence
  Synthetic
aacaggaaaatggagaggt

SEQ ID NO: 14816 - DNA, 18 bp, Artificial Sequence
  Synthetic
ccatttgttcgcgagtca

SEQ ID NO: 14817 - DNA, 18 bp, Artificial Sequence
  Synthetic
ttgtctcggacgttttgc

SEQ ID NO: 14818 - DNA, 21 bp, Artificial Sequence
  Synthetic
acatttctcgcatatgaacag

SEQ ID NO: 14819 - DNA, 21 bp, Artificial Sequence
  Synthetic
tgtgcgatcaaaaatacgttt

SEQ ID NO: 14820 - DNA, 21 bp, Artificial Sequence
  Synthetic
ccattttcaccatttcacaga

SEQ ID NO: 14821 - DNA, 22 bp, Artificial Sequence
  Synthetic
tatcacagatacatcaagagct

SEQ ID NO: 14822 - DNA, 18 bp, Artificial Sequence
  Synthetic
ccaaagcgacgaagaact

SEQ ID NO: 14823 - DNA, 19 bp, Artificial Sequence
  Synthetic
caagagatgcaaccagaag

SEQ ID NO: 14824 - DNA, 21 bp, Artificial Sequence
  Synthetic
tcggacaataaactcgtaacg

SEQ ID NO: 14825 - DNA, 19 bp, Artificial Sequence
  Synthetic
agcttcatcttgagcttct

SEQ ID NO: 14826 - DNA, 21 bp, Artificial Sequence
  Synthetic
gtcattttctgttcatttcgg

SEQ ID NO: 14827 - DNA, 18 bp, Artificial Sequence
  Synthetic
cgctatcgtcaacagcat

SEQ ID NO: 14828 - DNA, 18 bp, Artificial Sequence
  Synthetic
tttagtgcaccgttacga

SEQ ID NO: 14829 - DNA, 23 bp, Artificial Sequence
  Synthetic
tcgtctattaatccttctaacga

SEQ ID NO: 14830 - DNA, 21 bp, Artificial Sequence
  Synthetic
ttacgctcttttgaacatgtc

SEQ ID NO: 14831 - DNA, 22 bp, Artificial Sequence
  Synthetic
attagttgctatgtctacctct

SEQ ID NO: 14832 - DNA, 18 bp, Artificial Sequence
  Synthetic
agctctgtttggttcctt

SEQ ID NO: 14833 - DNA, 19 bp, Artificial Sequence
  Synthetic
ccaagaggttccttctcaa

SEQ ID NO: 14834 - DNA, 22 bp, Artificial Sequence
  Synthetic
aaggaattcgatacttggattc

SEQ ID NO: 14835 - DNA, 23 bp, Artificial Sequence
  Synthetic
atgacttttttcaagctaacatc

SEQ ID NO: 14836 - DNA, 25 bp, Artificial Sequence
  Synthetic
tcttagatagtcgcttattagtgaa

SEQ ID NO: 14837 - DNA, 18 bp, Artificial Sequence
  Synthetic
gttgacaatggcttgagc

SEQ ID NO: 14838 - DNA, 23 bp, Artificial Sequence
  Synthetic
ttttcaggttgagtatatggaag

SEQ ID NO: 14839 - DNA, 25 bp, Artificial Sequence
  Synthetic
tagaaactattgatcaaagtatccg

SEQ ID NO: 14840 - DNA, 21 bp, Artificial Sequence
  Synthetic
agagttagtggtcatacaagg

SEQ ID NO: 14841 - DNA, 22 bp, Artificial Sequence
  Synthetic
caaaaaaattatcaggacgctt

SEQ ID NO: 14842 - DNA, 20 bp, Artificial Sequence
  Synthetic
ccatcacacacagcttttac

SEQ ID NO: 14843 - DNA, 22 bp, Artificial Sequence
  Synthetic
actggaatatacacttcttccg

SEQ ID NO: 14844 - DNA, 21 bp, Artificial Sequence
  Synthetic
aaggaagtgatgattcgaaga

SEQ ID NO: 14845 - DNA, 18 bp, Artificial Sequence
  Synthetic
agaaatccccgccagaaa

SEQ ID NO: 14846 - DNA, 19 bp, Artificial Sequence
  Synthetic
cccatggatcgtttagagc

SEQ ID NO: 14847 - DNA, 21 bp, Artificial Sequence
  Synthetic
ctagctttgatcaattccgta

SEQ ID NO: 14848 - DNA, 18 bp, Artificial Sequence
  Synthetic
tttggcagtcattgagga

SEQ ID NO: 14849 - DNA, 20 bp, Artificial Sequence
  Synthetic
ttgctgattttgtggttctt

SEQ ID NO: 14850 - DNA, 18 bp, Artificial Sequence
  Synthetic
agcagagcaatacgttgg

SEQ ID NO: 14851 - DNA, 19 bp, Artificial Sequence
  Synthetic
tattcccccttaggtctgg

SEQ ID NO: 14852 - DNA, 22 bp, Artificial Sequence
  Synthetic
agcttttcttctttcagttctg

SEQ ID NO: 14853 - DNA, 19 bp, Artificial Sequence
  Synthetic
tattcatgcttcgatccca

SEQ ID NO: 14854 - DNA, 19 bp, Artificial Sequence
  Synthetic
tttctcggaagggagttgt

SEQ ID NO: 14855 - DNA, 18 bp, Artificial Sequence
  Synthetic
tttttgggcttctctgcg

SEQ ID NO: 14856 - DNA, 19 bp, Artificial Sequence
  Synthetic
gtgaaagcacaggttcatg

SEQ ID NO: 14857 - DNA, 21 bp, Artificial Sequence
  Synthetic
atgacaatgctctttatcgac

SEQ ID NO: 14858 - DNA, 25 bp, Artificial Sequence
  Synthetic
agaattattaagcaaggatttaccg

SEQ ID NO: 14859 - DNA, 20 bp, Artificial Sequence
  Synthetic
ttgcaaccgatagattctga

SEQ ID NO: 14860 - DNA, 18 bp, Artificial Sequence
  Synthetic
ccggaagtggctactacc

SEQ ID NO: 14861 - DNA, 21 bp, Artificial Sequence
  Synthetic
aatgtttgttcctttcgatcg

SEQ ID NO: 14862 - DNA, 18 bp, Artificial Sequence
  Synthetic
ttatgcctttgttgctgc

SEQ ID NO: 14863 - DNA, 21 bp, Artificial Sequence
  Synthetic
tcaaagagcatcatacgaaga

SEQ ID NO: 14864 - DNA, 19 bp, Artificial Sequence
  Synthetic
tgtcgttcggaaaatctcc

SEQ ID NO: 14865 - DNA, 18 bp, Artificial Sequence
  Synthetic
ccttatggctcagcttca

SEQ ID NO: 14866 - DNA, 18 bp, Artificial Sequence
  Synthetic
atttgttttcctccggga

SEQ ID NO: 14867 - DNA, 20 bp, Artificial Sequence
  Synthetic
ttggagattgaaagacacga

SEQ ID NO: 14868 - DNA, 21 bp, Artificial Sequence
  Synthetic
gtgtcagtcttttttctggat

SEQ ID NO: 14869 - DNA, 22 bp, Artificial Sequence
  Synthetic
tccgaataattacatctgttgc

SEQ ID NO: 14870 - DNA, 22 bp, Artificial Sequence
  Synthetic
gtgctttggttaaaattgctac

SEQ ID NO: 14871 - DNA, 18 bp, Artificial Sequence
  Synthetic
accacaggatacggcata

SEQ ID NO: 14872 - DNA, 25 bp, Artificial Sequence
  Synthetic
agcttagtctatttgtaaagtagtg

SEQ ID NO: 14873 - DNA, 19 bp, Artificial Sequence
  Synthetic
tagtttggttggtgagtga

SEQ ID NO: 14874 - DNA, 19 bp, Artificial Sequence
  Synthetic
tgaaatggcgttatgttcc

SEQ ID NO: 14875 - DNA, 25 bp, Artificial Sequence
  Synthetic
gataagactatcatgattaaagctg

SEQ ID NO: 14876 - DNA, 23 bp, Artificial Sequence
  Synthetic
gcccattaaagataatcattgga

SEQ ID NO: 14877 - DNA, 20 bp, Artificial Sequence
  Synthetic
aactctggatcagtttcctt

SEQ ID NO: 14878 - DNA, 18 bp, Artificial Sequence
  Synthetic
gcgagtagcttctttggt

SEQ ID NO: 14879 - DNA, 18 bp, Artificial Sequence
  Synthetic
atttgttcggagatgcgt

SEQ ID NO: 14880 - DNA, 18 bp, Artificial Sequence
  Synthetic
gcttccggactatcgaag

SEQ ID NO: 14881 - DNA, 23 bp, Artificial Sequence
  Synthetic
acagccttgtttttattaaaccc

SEQ ID NO: 14882 - DNA, 22 bp, Artificial Sequence
  Synthetic
aatgcaagaagatataatcgcc

SEQ ID NO: 14883 - DNA, 19 bp, Artificial Sequence
  Synthetic
agatggaaactgatgggga

SEQ ID NO: 14884 - DNA, 21 bp, Artificial Sequence
  Synthetic
aggacccatatacaagagagt

SEQ ID NO: 14885 - DNA, 19 bp, Artificial Sequence
  Synthetic
gacaatggtgatggagttg

SEQ ID NO: 14886 - DNA, 24 bp, Artificial Sequence
  Synthetic
caaatgaaaacatggatactatgg

SEQ ID NO: 14887 - DNA, 18 bp, Artificial Sequence
  Synthetic
ctctgccctgttagtgga

SEQ ID NO: 14888 - DNA, 19 bp, Artificial Sequence
  Synthetic
caagtgcttgtcatgatgg

SEQ ID NO: 14889 - DNA, 25 bp, Artificial Sequence
  Synthetic
gaaaagggaaagatagtcaaatcag

SEQ ID NO: 14890 - DNA, 22 bp, Artificial Sequence
  Synthetic
ggagtaaaagggttttcattca

SEQ ID NO: 14891 - DNA, 21 bp, Artificial Sequence
  Synthetic
tattgtggattcttgatcgtc

SEQ ID NO: 14892 - DNA, 25 bp, Artificial Sequence
  Synthetic
agaggctgaaaaaataaagatatgc

SEQ ID NO: 14893 - DNA, 19 bp, Artificial Sequence
  Synthetic
tctttgtctggtggatcct

SEQ ID NO: 14894 - DNA, 18 bp, Artificial Sequence
  Synthetic
cttggtgaatgccttgga

SEQ ID NO: 14895 - DNA, 21 bp, Artificial Sequence
  Synthetic
tgtgacaactactttcaagtg

SEQ ID NO: 14896 - DNA, 21 bp, Artificial Sequence
  Synthetic
catacattggagaagctgatg

SEQ ID NO: 14897 - DNA, 21 bp, Artificial Sequence
  Synthetic
aatccattccaaaaatcccag

SEQ ID NO: 14898 - DNA, 24 bp, Artificial Sequence
  Synthetic
gaatgacagaatttctcatgatga

SEQ ID NO: 14899 - DNA, 23 bp, Artificial Sequence
  Synthetic
tattttcaagttcaacgaaactg

SEQ ID NO: 14900 - DNA, 22 bp, Artificial Sequence
  Synthetic
atacaagaagctcaaaagagaa

SEQ ID NO: 14901 - DNA, 19 bp, Artificial Sequence
  Synthetic
tagcactacggcaaaggct

SEQ ID NO: 14902 - DNA, 21 bp, Artificial Sequence
  Synthetic
gccatagaaaaacacgtaacc

SEQ ID NO: 14903 - DNA, 20 bp, Artificial Sequence
  Synthetic
ggaaacaggctactatacca

SEQ ID NO: 14904 - DNA, 21 bp, Artificial Sequence
  Synthetic
gcaaaaatggcagataaaggt

SEQ ID NO: 14905 - DNA, 23 bp, Artificial Sequence
  Synthetic
aagtattttagtcctaaagctgt

SEQ ID NO: 14906 - DNA, 18 bp, Artificial Sequence
  Synthetic
aaatgttggggatgcaca

SEQ ID NO: 14907 - DNA, 21 bp, Artificial Sequence
  Synthetic
ggcaattagatctaagtgacc

SEQ ID NO: 14908 - DNA, 24 bp, Artificial Sequence
  Synthetic
tatcatggtgcctattttatggat

SEQ ID NO: 14909 - DNA, 20 bp, Artificial Sequence
  Synthetic
tctaaaggaaggtacgggcg

SEQ ID NO: 14910 - DNA, 18 bp, Artificial Sequence
  Synthetic
cgggagcaggagaaggag

SEQ ID NO: 14911 - DNA, 24 bp, Artificial Sequence
  Synthetic
aatactcttaagtgttatcgctac

SEQ ID NO: 14912 - DNA, 18 bp, Artificial Sequence
  Synthetic
ggtgaagggacgagtgta

SEQ ID NO: 14913 - DNA, 20 bp, Artificial Sequence
  Synthetic
acaaaaacttggtaggccta

SEQ ID NO: 14914 - DNA, 25 bp, Artificial Sequence
  Synthetic
gataataccccaacagtaataattc

SEQ ID NO: 14915 - DNA, 22 bp, Artificial Sequence
  Synthetic
gttggacacccttattttgaag

SEQ ID NO: 14916 - DNA, 21 bp, Artificial Sequence
  Synthetic
caatactggaacaaaggatga

SEQ ID NO: 14917 - DNA, 23 bp, Artificial Sequence
  Synthetic
ttggatatagtagactccacatg

SEQ ID NO: 14918 - DNA, 24 bp, Artificial Sequence
  Synthetic
aaattgccagttctatctatttcc

SEQ ID NO: 14919 - DNA, 25 bp, Artificial Sequence
  Synthetic
aaactttataaaaacatccactccc

SEQ ID NO: 14920 - DNA, 21 bp, Artificial Sequence
  Synthetic
aaaatcatgtgatggtggatt

SEQ ID NO: 14921 - DNA, 18 bp, Artificial Sequence
  Synthetic
gtgtctgtcttggtgcag

SEQ ID NO: 14922 - DNA, 19 bp, Artificial Sequence
  Synthetic
tcctacttggagtcaggaa

SEQ ID NO: 14923 - DNA, 20 bp, Artificial Sequence
  Synthetic
ggttttgttatgcagtttgg

SEQ ID NO: 14924 - DNA, 20 bp, Artificial Sequence
  Synthetic
gttttaggttgcaaggctat

SEQ ID NO: 14925 - DNA, 19 bp, Artificial Sequence
  Synthetic
gcacaagcatttcagagtg

SEQ ID NO: 14926 - DNA, 21 bp, Artificial Sequence
  Synthetic
attctgaaccacctaaagttg

SEQ ID NO: 14927 - DNA, 23 bp, Artificial Sequence
  Synthetic
tcctgaagatgatgactttcttg

SEQ ID NO: 14928 - DNA, 23 bp, Artificial Sequence
  Synthetic
ataaaaatttgcaggatctttgg

SEQ ID NO: 14929 - DNA, 23 bp, Artificial Sequence
  Synthetic
ccgatatggttaagtctaaagga

SEQ ID NO: 14930 - DNA, 18 bp, Artificial Sequence
  Synthetic
gggcactaagaaattggc

SEQ ID NO: 14931 - DNA, 23 bp, Artificial Sequence
  Synthetic
aagccttgtttttggataaagtg

SEQ ID NO: 14932 - DNA, 19 bp, Artificial Sequence
  Synthetic
gcaggttgttgttaatggt

SEQ ID NO: 14933 - DNA, 21 bp, Artificial Sequence
  Synthetic
atgtaaatgtggtgtaaagca

SEQ ID NO: 14934 - DNA, 23 bp, Artificial Sequence
  Synthetic
aatattattgtgacggaggtaag

SEQ ID NO: 14935 - DNA, 23 bp, Artificial Sequence
  Synthetic
taatagaccttcattggttgatg

SEQ ID NO: 14936 - DNA, 21 bp, Artificial Sequence
  Synthetic
tgcccttatcagtattcagat

SEQ ID NO: 14937 - DNA, 22 bp, Artificial Sequence
  Synthetic
actggcttttgttcaaaacatc

SEQ ID NO: 14938 - DNA, 19 bp, Artificial Sequence
  Synthetic
gcatgtgcagggtaatgtt

SEQ ID NO: 14939 - DNA, 23 bp, Artificial Sequence
  Synthetic
gctgtaatagatcaggattttgg

SEQ ID NO: 14940 - DNA, 21 bp, Artificial Sequence
  Synthetic
atgctaaaggttttatccgtt

SEQ ID NO: 14941 - DNA, 18 bp, Artificial Sequence
  Synthetic
gcctgtggattttttggc

SEQ ID NO: 14942 - DNA, 18 bp, Artificial Sequence
  Synthetic
tgcatatagggaggctgc

SEQ ID NO: 14943 - DNA, 20 bp, Artificial Sequence
  Synthetic
tttagctgcttataacggca

SEQ ID NO: 14944 - DNA, 25 bp, Artificial Sequence
  Synthetic
gtgttctgtagaagattttaatgtg

SEQ ID NO: 14945 - DNA, 21 bp, Artificial Sequence
  Synthetic
ttgtgttataagtttggccat

SEQ ID NO: 14946 - DNA, 22 bp, Artificial Sequence
  Synthetic
aagggttctaacttagaggaag

SEQ ID NO: 14947 - DNA, 23 bp, Artificial Sequence
  Synthetic
ccctcctaagaatagttttgaag

SEQ ID NO: 14948 - DNA, 19 bp, Artificial Sequence
  Synthetic
cgatgattacgcaaaggac

SEQ ID NO: 14949 - DNA, 19 bp, Artificial Sequence
  Synthetic
tggcagcaaatactctgaa

SEQ ID NO: 14950 - DNA, 23 bp, Artificial Sequence
  Synthetic
ttttgtaaaaggttgtaacacac

SEQ ID NO: 14951 - DNA, 21 bp, Artificial Sequence
  Synthetic
tctgtttgtatatattgccgc

SEQ ID NO: 14952 - DNA, 23 bp, Artificial Sequence
  Synthetic
aagggcatttgatatttacaatg

SEQ ID NO: 14953 - DNA, 18 bp, Artificial Sequence
  Synthetic
ccctagttagcgctactg

SEQ ID NO: 14954 - DNA, 22 bp, Artificial Sequence
  Synthetic
attgtgatgaatatggatgtgg

SEQ ID NO: 14955 - DNA, 25 bp, Artificial Sequence
  Synthetic
agtattttgagatttatgatggtgg

SEQ ID NO: 14956 - DNA, 23 bp, Artificial Sequence
  Synthetic
aaatgtttgaaaagtatagcagc

SEQ ID NO: 14957 - DNA, 20 bp, Artificial Sequence
  Synthetic
gccaatgtatgtgccttaat

SEQ ID NO: 14958 - DNA, 21 bp, Artificial Sequence
  Synthetic
gttgggttgaacatgacataa

SEQ ID NO: 14959 - DNA, 21 bp, Artificial Sequence
  Synthetic
atcttggatagctacagtgtt

SEQ ID NO: 14960 - DNA, 25 bp, Artificial Sequence
  Synthetic
taatcgtatagctagttgtaaatgg

SEQ ID NO: 14961 - DNA, 22 bp, Artificial Sequence
  Synthetic
agctaatttaagtgctcctacg

SEQ ID NO: 14962 - DNA, 18 bp, Artificial Sequence
  Synthetic
tattgttccggccaaggt

SEQ ID NO: 14963 - DNA, 24 bp, Artificial Sequence
  Synthetic
taataagtttttgaaggctaaccc

SEQ ID NO: 14964 - DNA, 21 bp, Artificial Sequence
  Synthetic
ccttagataaagtgccacagg

SEQ ID NO: 14965 - DNA, 18 bp, Artificial Sequence
  Synthetic
gcgtgatagcattgggac

SEQ ID NO: 14966 - DNA, 18 bp, Artificial Sequence
  Synthetic
agttacatgggcagccaa

SEQ ID NO: 14967 - DNA, 23 bp, Artificial Sequence
  Synthetic
actttgtgttatgatattggcaa

SEQ ID NO: 14968 - DNA, 18 bp, Artificial Sequence
  Synthetic
ggcagcctttgagcattt

SEQ ID NO: 14969 - DNA, 22 bp, Artificial Sequence
  Synthetic
tcaagactggtcattatacagg

SEQ ID NO: 14970 - DNA, 22 bp, Artificial Sequence
  Synthetic
aattgaatgtcctttttgatgg

SEQ ID NO: 14971 - DNA, 23 bp, Artificial Sequence
  Synthetic
tattcagaagtatggtttggagg

SEQ ID NO: 14972 - DNA, 23 bp, Artificial Sequence
  Synthetic
gtaacgatgagaaagttatgact

SEQ ID NO: 14973 - DNA, 25 bp, Artificial Sequence
  Synthetic
acatacatttgtcatatgattcgag

SEQ ID NO: 14974 - DNA, 23 bp, Artificial Sequence
  Synthetic
aggtttacaatttcaaattctcg

SEQ ID NO: 14975 - DNA, 18 bp, Artificial Sequence
  Synthetic
gatgcagcactgtccatt

SEQ ID NO: 14976 - DNA, 20 bp, Artificial Sequence
  Synthetic
aggagttttcactttaccga

SEQ ID NO: 14977 - DNA, 21 bp, Artificial Sequence
  Synthetic
ccctctggtaattatttagcc

SEQ ID NO: 14978 - DNA, 24 bp, Artificial Sequence
  Synthetic
gtgagttccctgctataactatag

SEQ ID NO: 14979 - DNA, 24 bp, Artificial Sequence
  Synthetic
gtttaatgtttatttaggcatggc

SEQ ID NO: 14980 - DNA, 22 bp, Artificial Sequence
  Synthetic
cgtaaacctaatcttcccaatt

SEQ ID NO: 14981 - DNA, 21 bp, Artificial Sequence
  Synthetic
ctgctaatgtttctgttagca

SEQ ID NO: 14982 - DNA, 19 bp, Artificial Sequence
  Synthetic
acttataagtgcccccaaa

SEQ ID NO: 14983 - DNA, 23 bp, Artificial Sequence
  Synthetic
caaacagaacttttatgattcgt

SEQ ID NO: 14984 - DNA, 24 bp, Artificial Sequence
  Synthetic
accttcagagtttactataggtaa

SEQ ID NO: 14985 - DNA, 25 bp, Artificial Sequence
  Synthetic
gttgaggcttataataattgtacag

SEQ ID NO: 14986 - DNA, 25 bp, Artificial Sequence
  Synthetic
caagaaattctatctagacttgatg

SEQ ID NO: 14987 - DNA, 18 bp, Artificial Sequence
  Synthetic
tatgtcacagcgagggtt

SEQ ID NO: 14988 - DNA, 21 bp, Artificial Sequence
  Synthetic
tgttacattcttggacctaca

SEQ ID NO: 14989 - DNA, 22 bp, Artificial Sequence
  Synthetic
agacctgagaagaaatatctcc

SEQ ID NO: 14990 - DNA, 22 bp, Artificial Sequence
  Synthetic
attagaactggaagtttttgga

SEQ ID NO: 14991 - DNA, 18 bp, Artificial Sequence
  Synthetic
ccaaaagggttctggcat

SEQ ID NO: 14992 - DNA, 19 bp, Artificial Sequence
  Synthetic
gaacaggaccgcatgctaa

SEQ ID NO: 14993 - DNA, 18 bp, Artificial Sequence
  Synthetic
cgcgtagtagagccaatt

SEQ ID NO: 14994 - DNA, 19 bp, Artificial Sequence
  Synthetic
tatctgggaatcctgacga

SEQ ID NO: 14995 - DNA, 21 bp, Artificial Sequence
  Synthetic
atactgaagacacctcagaaa

SEQ ID NO: 14996 - DNA, 21 bp, Artificial Sequence
  Synthetic
aactgacatgactattgagga

SEQ ID NO: 14997 - DNA, 23 bp, Artificial Sequence
  Synthetic
ttttccaggacatactattgagg

SEQ ID NO: 14998 - DNA, 20 bp, Artificial Sequence
  Synthetic
ctgctttctttggcatgtcc

SEQ ID NO: 14999 - DNA, 21 bp, Artificial Sequence
  Synthetic
gctacctaactgaaatgactc

SEQ ID NO: 15000 - DNA, 19 bp, Artificial Sequence
  Synthetic
cttccaggacatactgacg

SEQ ID NO: 15001 - DNA, 20 bp, Artificial Sequence
  Synthetic
gatcactcccctgtgaggaa

SEQ ID NO: 15002 - DNA, 20 bp, Artificial Sequence
  Synthetic
aaagaaacaccatccgtcgc

SEQ ID NO: 15003 - DNA, 18 bp, Artificial Sequence
  Synthetic
ggaggtcccgcaatttgg

SEQ ID NO: 15004 - DNA, 18 bp, Artificial Sequence
  Synthetic
cattctgcacacacccgg

SEQ ID NO: 15005 - DNA, 19 bp, Artificial Sequence
  Synthetic
ggacatcgaatggcttggg

SEQ ID NO: 15006 - DNA, 18 bp, Artificial Sequence
  Synthetic
agctgcaagcccatcact

SEQ ID NO: 15007 - DNA, 17 bp, Artificial Sequence
  Synthetic
gcgtgccaacctacacc

SEQ ID NO: 15008 - DNA, 20 bp, Artificial Sequence
  Synthetic
tgaacatcgatttaccgccg

SEQ ID NO: 15009 - DNA, 19 bp, Artificial Sequence
  Synthetic
ccctttggctgatgctgat

SEQ ID NO: 15010 - DNA, 20 bp, Artificial Sequence
  Synthetic
acctatacgaccacctagcg

SEQ ID NO: 15011 - DNA, 20 bp, Artificial Sequence
  Synthetic
gagacaagaacgtggtgacc

SEQ ID NO: 15012 - DNA, 19 bp, Artificial Sequence
  Synthetic
gctcagtcctaggcctctc

SEQ ID NO: 15013 - DNA, 19 bp, Artificial Sequence
  Synthetic
ccacattaggcttcggctc

SEQ ID NO: 15014 - DNA, 20 bp, Artificial Sequence
  Synthetic
accttttccattgagacccg

SEQ ID NO: 15015 - DNA, 19 bp, Artificial Sequence
  Synthetic
agactaagcagcagggact

SEQ ID NO: 15016 - DNA, 18 bp, Artificial Sequence
  Synthetic
tcggctgcgttgtgattg

SEQ ID NO: 15017 - DNA, 17 bp, Artificial Sequence
  Synthetic
ttgcctggcaaccctgc

SEQ ID NO: 15018 - DNA, 19 bp, Artificial Sequence
  Synthetic
gcccgccatactatctccg

SEQ ID NO: 15019 - DNA, 18 bp, Artificial Sequence
  Synthetic
ccgacttcaaggcatggc

SEQ ID NO: 15020 - DNA, 18 bp, Artificial Sequence
  Synthetic
gggtgggggacttccatt

SEQ ID NO: 15021 - DNA, 19 bp, Artificial Sequence
  Synthetic
atccgccagccaactatca

SEQ ID NO: 15022 - DNA, 20 bp, Artificial Sequence
  Synthetic
tgtaccaccaactgtccatg

SEQ ID NO: 15023 - DNA, 19 bp, Artificial Sequence
  Synthetic
accgttagtgacagcgagg

SEQ ID NO: 15024 - DNA, 18 bp, Artificial Sequence
  Synthetic
tcactctgcccgatcgaa

SEQ ID NO: 15025 - DNA, 20 bp, Artificial Sequence
  Synthetic
cactgaacaggacatcaggg

SEQ ID NO: 15026 - DNA, 18 bp, Artificial Sequence
  Synthetic
caaaggccgcaaacctcc

SEQ ID NO: 15027 - DNA, 25 bp, Artificial Sequence
  Synthetic
aaagaactaagaaatctaatgtcgc

SEQ ID NO: 15028 - DNA, 18 bp, Artificial Sequence
  Synthetic
ggatcagaccgagtgatg

SEQ ID NO: 15029 - DNA, 21 bp, Artificial Sequence
  Synthetic
aagttgttttccctaacgaag

SEQ ID NO: 15030 - DNA, 22 bp, Artificial Sequence
  Synthetic
aatgatgatgttgatcaaagct

SEQ ID NO: 15031 - DNA, 18 bp, Artificial Sequence
  Synthetic
acaagcggatcatcagtc

SEQ ID NO: 15032 - DNA, 22 bp, Artificial Sequence
  Synthetic
gatctgaatttcgtcaataggg

SEQ ID NO: 15033 - DNA, 19 bp, Artificial Sequence
  Synthetic
attgaccggttcttgagag

SEQ ID NO: 15034 - DNA, 22 bp, Artificial Sequence
  Synthetic
tagtacctaaggccattagagg

SEQ ID NO: 15035 - DNA, 20 bp, Artificial Sequence
  Synthetic
ggcactttaaccgaagaccc

SEQ ID NO: 15036 - DNA, 20 bp, Artificial Sequence
  Synthetic
atgaaagccttaacaccggc

SEQ ID NO: 15037 - DNA, 20 bp, Artificial Sequence
  Synthetic
tccttaacaacaccaggcca

SEQ ID NO: 15038 - DNA, 16 bp, Artificial Sequence
  Synthetic
gcctgcaactggacgc

SEQ ID NO: 15039 - DNA, 20 bp, Artificial Sequence
  Synthetic
tactcaatgcagcatccctg

SEQ ID NO: 15040 - DNA, 20 bp, Artificial Sequence
  Synthetic
tgtgttgtacacccgactct

SEQ ID NO: 15041 - DNA, 17 bp, Artificial Sequence
  Synthetic
ctgcgagatctggccgt

SEQ ID NO: 15042 - DNA, 19 bp, Artificial Sequence
  Synthetic
caacgtgcatcaatggggt

SEQ ID NO: 15043 - DNA, 16 bp, Artificial Sequence
  Synthetic
ggtgtgcacccgtgga

SEQ ID NO: 15044 - DNA, 18 bp, Artificial Sequence
  Synthetic
gcagccccatcacgtact

SEQ ID NO: 15045 - DNA, 20 bp, Artificial Sequence
  Synthetic
tcaaagaagaagtgcgacga

SEQ ID NO: 15046 - DNA, 20 bp, Artificial Sequence
  Synthetic
tctacagatttgtggcaccg

SEQ ID NO: 15047 - DNA, 18 bp, Artificial Sequence
  Synthetic
ggccaacacccctgctat

SEQ ID NO: 15048 - DNA, 19 bp, Artificial Sequence
  Synthetic
aagggatgatgctcgctga

SEQ ID NO: 15049 - DNA, 16 bp, Artificial Sequence
  Synthetic
tgggcgctggcttagc

SEQ ID NO: 15050 - DNA, 19 bp, Artificial Sequence
  Synthetic
ggaaccatgtttcccccac

SEQ ID NO: 15051 - DNA, 20 bp, Artificial Sequence
  Synthetic
tggacatgtcaaaaacggga

SEQ ID NO: 15052 - DNA, 16 bp, Artificial Sequence
  Synthetic
tgctgcgggaggaggt

SEQ ID NO: 15053 - DNA, 17 bp, Artificial Sequence
  Synthetic
tcgatccgcttgtggca

SEQ ID NO: 15054 - DNA, 17 bp, Artificial Sequence
  Synthetic
ggcattacgggcgacaa

SEQ ID NO: 15055 - DNA, 20 bp, Artificial Sequence
  Synthetic
attaccaggacgtgctcaag

SEQ ID NO: 15056 - DNA, 18 bp, Artificial Sequence
  Synthetic
cctgagaaggggggtcgt

SEQ ID NO: 15057 - DNA, 19 bp, Artificial Sequence
  Synthetic
ttatgttgggggccctctt

SEQ ID NO: 15058 - DNA, 18 bp, Artificial Sequence
  Synthetic
gcgctggaaagagggtct

SEQ ID NO: 15059 - DNA, 20 bp, Artificial Sequence
  Synthetic
tgaaatcaatagggtggccg

SEQ ID NO: 15060 - DNA, 24 bp, Artificial Sequence
  Synthetic
cgaatggggtacatataaaacaag

SEQ ID NO: 15061 - DNA, 25 bp, Artificial Sequence
  Synthetic
tattcatattatgtagaaggtgtgg

SEQ ID NO: 15062 - DNA, 21 bp, Artificial Sequence
  Synthetic
ggatatccctgtatgcaatgt

SEQ ID NO: 15063 - DNA, 18 bp, Artificial Sequence
  Synthetic
atttcagccccgtgtgtg

SEQ ID NO: 15064 - DNA, 22 bp, Artificial Sequence
  Synthetic
gcataaagaccctaatacaacc

SEQ ID NO: 15065 - DNA, 22 bp, Artificial Sequence
  Synthetic
aggagtaccaaaaaaaagttgt

SEQ ID NO: 15066 - DNA, 19 bp, Artificial Sequence
  Synthetic
tgacaacacaaggagaacc

SEQ ID NO: 15067 - DNA, 22 bp, Artificial Sequence
  Synthetic
ttatgtgcagaactatagtgac

SEQ ID NO: 15068 - DNA, 19 bp, Artificial Sequence
  Synthetic
aaagcgacagcgactcgag

SEQ ID NO: 15069 - DNA, 22 bp, Artificial Sequence
  Synthetic
tggatttttacttgtgtcgact

SEQ ID NO: 15070 - DNA, 19 bp, Artificial Sequence
  Synthetic
ataggacctgcaaggcctc

SEQ ID NO: 15071 - DNA, 18 bp, Artificial Sequence
  Synthetic
agggtccaccatacctac

SEQ ID NO: 15072 - DNA, 20 bp, Artificial Sequence
  Synthetic
cccgggtacattactatcag

SEQ ID NO: 15073 - DNA, 18 bp, Artificial Sequence
  Synthetic
gcgctctagtgacaactt

SEQ ID NO: 15074 - DNA, 22 bp, Artificial Sequence
  Synthetic
ctattcaggatggtgatatggt

SEQ ID NO: 15075 - DNA, 22 bp, Artificial Sequence
  Synthetic
aggaatatgatttgcagttcat

SEQ ID NO: 15076 - DNA, 21 bp, Artificial Sequence
  Synthetic
tgttatgagcatgtatgtgtg

SEQ ID NO: 15077 - DNA, 18 bp, Artificial Sequence
  Synthetic
ctgaggaggaggagcaat

SEQ ID NO: 15078 - DNA, 20 bp, Artificial Sequence
  Synthetic
cactctggaggatttgtttg

SEQ ID NO: 15079 - DNA, 21 bp, Artificial Sequence
  Synthetic
tttcaaaaaacatggctacac

SEQ ID NO: 15080 - DNA, 20 bp, Artificial Sequence
  Synthetic
tctagttctaccaggcagcc

SEQ ID NO: 15081 - DNA, 18 bp, Artificial Sequence
  Synthetic
acgaaccaccgagacaga

SEQ ID NO: 15082 - DNA, 18 bp, Artificial Sequence
  Synthetic
atttgggcaacttgggta

SEQ ID NO: 15083 - DNA, 20 bp, Artificial Sequence
  Synthetic
gagctcttcaattgttcctt

SEQ ID NO: 15084 - DNA, 19 bp, Artificial Sequence
  Synthetic
attttgtaaggcaaccgtc

SEQ ID NO: 15085 - DNA, 21 bp, Artificial Sequence
  Synthetic
acattggcctctaatattcct

SEQ ID NO: 15086 - DNA, 22 bp, Artificial Sequence
  Synthetic
aatcgtggaaagttatatctgc

SEQ ID NO: 15087 - DNA, 24 bp, Artificial Sequence
  Synthetic
gttggtttggaaattgataggatt

SEQ ID NO: 15088 - DNA, 20 bp, Artificial Sequence
  Synthetic
aaaggtttgcgaaaatgtcc

SEQ ID NO: 15089 - DNA, 19 bp, Artificial Sequence
  Synthetic
tttacgcgaggcactttta

SEQ ID NO: 15090 - DNA, 18 bp, Artificial Sequence
  Synthetic
atgctgccttttaagcca

SEQ ID NO: 15091 - DNA, 20 bp, Artificial Sequence
  Synthetic
actaaagcagctgttaaggg

SEQ ID NO: 15092 - DNA, 20 bp, Artificial Sequence
  Synthetic
ttcaatagcagcagttacct

SEQ ID NO: 15093 - DNA, 23 bp, Artificial Sequence
  Synthetic
aataccaagagaatctacttgga

SEQ ID NO: 15094 - DNA, 19 bp, Artificial Sequence
  Synthetic
atgattgtagcttgcagga

SEQ ID NO: 15095 - DNA, 18 bp, Artificial Sequence
  Synthetic
tatgggacggagaagagg

SEQ ID NO: 15096 - DNA, 18 bp, Artificial Sequence
  Synthetic
gccaacttttatccccca

SEQ ID NO: 15097 - DNA, 22 bp, Artificial Sequence
  Synthetic
gaagttataatgggagccaatg

SEQ ID NO: 15098 - DNA, 20 bp, Artificial Sequence
  Synthetic
ggtcagtacagtggatttgc

SEQ ID NO: 15099 - DNA, 18 bp, Artificial Sequence
  Synthetic
atggggaatgcagtactg

SEQ ID NO: 15100 - DNA, 22 bp, Artificial Sequence
  Synthetic
gtctatcagcttacgatctctt

SEQ ID NO: 15101 - DNA, 18 bp, Artificial Sequence
  Synthetic
gttatgcccctctactgg

SEQ ID NO: 15102 - DNA, 25 bp, Artificial Sequence
  Synthetic
gataattgtgatttttatggttggg

SEQ ID NO: 15103 - DNA, 22 bp, Artificial Sequence
  Synthetic
ttatgttcaatgtaagtgtggt

SEQ ID NO: 15104 - DNA, 21 bp, Artificial Sequence
  Synthetic
tgagtattgtcaaccacctaa

SEQ ID NO: 15105 - DNA, 21 bp, Artificial Sequence
  Synthetic
acctcaattgtatggtttgtg

SEQ ID NO: 15106 - DNA, 23 bp, Artificial Sequence
  Synthetic
cggtccatttttttcttttgaac

SEQ ID NO: 15107 - DNA, 21 bp, Artificial Sequence
  Synthetic
ttggtacattagcaaagactg

SEQ ID NO: 15108 - DNA, 23 bp, Artificial Sequence
  Synthetic
ttaaaccatttgctaaagttgac

SEQ ID NO: 15109 - DNA, 23 bp, Artificial Sequence
  Synthetic
cggttttatatagttgttactgc

SEQ ID NO: 15110 - DNA, 20 bp, Artificial Sequence
  Synthetic
gggtgtgcaattagaaaagg

SEQ ID NO: 15111 - DNA, 25 bp, Artificial Sequence
  Synthetic
ctttgtgtactatgtttaaaagagg

SEQ ID NO: 15112 - DNA, 19 bp, Artificial Sequence
  Synthetic
taatgtctggtcggatgag

SEQ ID NO: 15113 - DNA, 22 bp, Artificial Sequence
  Synthetic
ttatggtccatatagagatgct

SEQ ID NO: 15114 - DNA, 21 bp, Artificial Sequence
  Synthetic
tgtatgaacgtgataaagctg

SEQ ID NO: 15115 - DNA, 20 bp, Artificial Sequence
  Synthetic
atcatgctggtactggtatg

SEQ ID NO: 15116 - DNA, 21 bp, Artificial Sequence
  Synthetic
tactgtcatttttgcagacac

SEQ ID NO: 15117 - DNA, 21 bp, Artificial Sequence
  Synthetic
ccgtttgttgtttctattggt

SEQ ID NO: 15118 - DNA, 22 bp, Artificial Sequence
  Synthetic
aagccagactttattatgaggc

SEQ ID NO: 15119 - DNA, 19 bp, Artificial Sequence
  Synthetic
cctgttcttatgggttggg

SEQ ID NO: 15120 - DNA, 24 bp, Artificial Sequence
  Synthetic
tccagatccttctagaattttagg

SEQ ID NO: 15121 - DNA, 18 bp, Artificial Sequence
  Synthetic
aatcttgcacgggttcac

SEQ ID NO: 15122 - DNA, 18 bp, Artificial Sequence
  Synthetic
gtgcacctacacttgtcc

SEQ ID NO: 15123 - DNA, 18 bp, Artificial Sequence
  Synthetic
tgttagaggttgggttgg

SEQ ID NO: 15124 - DNA, 18 bp, Artificial Sequence
  Synthetic
ggttattgcagcgtgtca

SEQ ID NO: 15125 - DNA, 25 bp, Artificial Sequence
  Synthetic
ccttttttctattattcagatacgc

SEQ ID NO: 15126 - DNA, 25 bp, Artificial Sequence
  Synthetic
agtaggttatcaatgattaaaggtc

SEQ ID NO: 15127 - DNA, 20 bp, Artificial Sequence
  Synthetic
acaggctgtatgatgaatgt

SEQ ID NO: 15128 - DNA, 20 bp, Artificial Sequence
  Synthetic
aaccttcttttgcttcaagt

SEQ ID NO: 15129 - DNA, 24 bp, Artificial Sequence
  Synthetic
ctgattattctgtttcttcttgtg

SEQ ID NO: 15130 - DNA, 25 bp, Artificial Sequence
  Synthetic
ttacaagaaattttatctcgtctcg

SEQ ID NO: 15131 - DNA, 22 bp, Artificial Sequence
  Synthetic
attgatatgaaaggcaagatgt

SEQ ID NO: 15132 - DNA, 19 bp, Artificial Sequence
  Synthetic
cggtcattatgctggaagt

SEQ ID NO: 15133 - DNA, 22 bp, Artificial Sequence
  Synthetic
gtaaagattctaaacctcagca

SEQ ID NO: 15134 - DNA, 21 bp, Artificial Sequence
  Synthetic
cagaacactgattctgattcg

SEQ ID NO: 15135 - DNA, 19 bp, Artificial Sequence
  Synthetic
agattttgtgcgacaatgc

SEQ ID NO: 15136 - DNA, 18 bp, Artificial Sequence
  Synthetic
gaaagcagggctaggatt

SEQ ID NO: 15137 - DNA, 20 bp, Artificial Sequence
  Synthetic
atgtccaaagaagtgaatgc

SEQ ID NO: 15138 - DNA, 20 bp, Artificial Sequence
  Synthetic
tggaagcaagtattgtcaga

SEQ ID NO: 15139 - DNA, 21 bp, Artificial Sequence
  Synthetic
gatagagctcgatgaaattgg

SEQ ID NO: 15140 - DNA, 21 bp, Artificial Sequence
  Synthetic
cacagatgtggtaaactttgt

SEQ ID NO: 15141 - DNA, 19 bp, Artificial Sequence
  Synthetic
tcgagagcatgattgaagc

SEQ ID NO: 15142 - DNA, 18 bp, Artificial Sequence
  Synthetic
gaaactggtggagaacgc

SEQ ID NO: 15143 - DNA, 20 bp, Artificial Sequence
  Synthetic
gggacaatggtaatggaact

SEQ ID NO: 15144 - DNA, 20 bp, Artificial Sequence
  Synthetic
agcagaaatcctgggaatgc

SEQ ID NO: 15145 - DNA, 18 bp, Artificial Sequence
  Synthetic
catgccattctgcagcat

SEQ ID NO: 15146 - DNA, 23 bp, Artificial Sequence
  Synthetic
gatacttattgctttgattgctc

SEQ ID NO: 15147 - DNA, 19 bp, Artificial Sequence
  Synthetic
tctcaaggtccgttccaga

SEQ ID NO: 15148 - DNA, 18 bp, Artificial Sequence
  Synthetic
gggcaggaactagatcag

SEQ ID NO: 15149 - DNA, 20 bp, Artificial Sequence
  Synthetic
ctttaccaaaaggcacatca

SEQ ID NO: 15150 - DNA, 23 bp, Artificial Sequence
  Synthetic
ctggtggttcattaggatatagg

SEQ ID NO: 15151 - DNA, 19 bp, Artificial Sequence
  Synthetic
ggtgattcaatagggggga

SEQ ID NO: 15152 - DNA, 19 bp, Artificial Sequence
  Synthetic
ggactcaggatttggtcag

SEQ ID NO: 15153 - DNA, 21 bp, Artificial Sequence
  Synthetic
ccaatgaagattttgctgaca

SEQ ID NO: 15154 - DNA, 18 bp, Artificial Sequence
  Synthetic
cagaacagcggatggatt

SEQ ID NO: 15155 - DNA, 20 bp, Artificial Sequence
  Synthetic
gcaggaagacagatctagtg

SEQ ID NO: 15156 - DNA, 21 bp, Artificial Sequence
  Synthetic
atgtaaggtaaagcttgaacc

SEQ ID NO: 15157 - DNA, 23 bp, Artificial Sequence
  Synthetic
aacggttttcttcagatttaagc

SEQ ID NO: 15158 - DNA, 25 bp, Artificial Sequence
  Synthetic
tgtcataatacactataaaaggctg

SEQ ID NO: 15159 - DNA, 22 bp, Artificial Sequence
  Synthetic
aaaggcaatgaaagaatatggg

SEQ ID NO: 15160 - DNA, 23 bp, Artificial Sequence
  Synthetic
tggtgaacagtatatgtaacaca

SEQ ID NO: 15161 - DNA, 25 bp, Artificial Sequence
  Synthetic
cttttcactataagacaagaaatgg

SEQ ID NO: 15162 - DNA, 20 bp, Artificial Sequence
  Synthetic
agatcccaaggacaaagaac

SEQ ID NO: 15163 - DNA, 23 bp, Artificial Sequence
  Synthetic
tgatgaaataggagaagatgttg

SEQ ID NO: 15164 - DNA, 23 bp, Artificial Sequence
  Synthetic
tgaactttgtaagtatggagttc

SEQ ID NO: 15165 - DNA, 19 bp, Artificial Sequence
  Synthetic
ttgagagcatgattgaggc

SEQ ID NO: 15166 - DNA, 19 bp, Artificial Sequence
  Synthetic
cgataacctcgtttcaggt

SEQ ID NO: 15167 - DNA, 21 bp, Artificial Sequence
  Synthetic
ggtatatcaccgatatgagca

SEQ ID NO: 15168 - DNA, 22 bp, Artificial Sequence
  Synthetic
ttacagaggatgtcaaaaatgc

SEQ ID NO: 15169 - DNA, 24 bp, Artificial Sequence
  Synthetic
gtaatggaatcaatggataaggaa

SEQ ID NO: 15170 - DNA, 18 bp, Artificial Sequence
  Synthetic
aggattcgtgcactttgt

SEQ ID NO: 15171 - DNA, 25 bp, Artificial Sequence
  Synthetic
ttaggagtctcaatcttaaatcttg

SEQ ID NO: 15172 - DNA, 18 bp, Artificial Sequence
  Synthetic
tagccaacttcagcatgg

SEQ ID NO: 15173 - DNA, 19 bp, Artificial Sequence
  Synthetic
attcccaagagaaatcgct

SEQ ID NO: 15174 - DNA, 24 bp, Artificial Sequence
  Synthetic
gaaatcggtgcatatatataaccc

SEQ ID NO: 15175 - DNA, 18 bp, Artificial Sequence
  Synthetic
ccgcagagaaacacaagt

SEQ ID NO: 15176 - DNA, 25 bp, Artificial Sequence
  Synthetic
ctagtaatacaaattatatgcaggc

SEQ ID NO: 15177 - DNA, 23 bp, Artificial Sequence
  Synthetic
gcactatattggtataggacagg

SEQ ID NO: 15178 - DNA, 25 bp, Artificial Sequence
  Synthetic
gtagggtaacagtatttacatttcc

SEQ ID NO: 15179 - DNA, 25 bp, Artificial Sequence
  Synthetic
gtctggaaaatgcaatatattatgc

SEQ ID NO: 15180 - DNA, 25 bp, Artificial Sequence
  Synthetic
tacaatgttctgaatctatgtacag

SEQ ID NO: 15181 - DNA, 19 bp, Artificial Sequence
  Synthetic
gtggcagacctaatactgt

SEQ ID NO: 15182 - DNA, 18 bp, Artificial Sequence
  Synthetic
tgcatttaccgacccttc

SEQ ID NO: 15183 - DNA, 25 bp, Artificial Sequence
  Synthetic
atagacactacattaaccttttcac

SEQ ID NO: 15184 - DNA, 18 bp, Artificial Sequence
  Synthetic
cgcaagcaagacattcct

SEQ ID NO: 15185 - DNA, 19 bp, Artificial Sequence
  Synthetic
cccatgttgctacttctgt

SEQ ID NO: 15186 - DNA, 21 bp, Artificial Sequence
  Synthetic
aggttcccttagacatttgtc

SEQ ID NO: 15187 - DNA, 20 bp, Artificial Sequence
  Synthetic
ggcacatatatgggaaagac

SEQ ID NO: 15188 - DNA, 20 bp, Artificial Sequence
  Synthetic
gtggtcaagtactagttgcc

SEQ ID NO: 15189 - DNA, 20 bp, Artificial Sequence
  Synthetic
actggaactgctaagcatat

SEQ ID NO: 15190 - DNA, 21 bp, Artificial Sequence
  Synthetic
gagtcaagggattctcatacc

SEQ ID NO: 15191 - DNA, 19 bp, Artificial Sequence
  Synthetic
agatctaatgtcgcagtcc

SEQ ID NO: 15192 - DNA, 18 bp, Artificial Sequence
  Synthetic
gtatcacctctggccgta

SEQ ID NO: 15193 - DNA, 25 bp, Artificial Sequence
  Synthetic
ataacaaaagagaagaaagaagagc

SEQ ID NO: 15194 - DNA, 21 bp, Artificial Sequence
  Synthetic
agtttgattatcgctgctaga

SEQ ID NO: 15195 - DNA, 21 bp, Artificial Sequence
  Synthetic
aagaagaagaagtgctaacgg

SEQ ID NO: 15196 - DNA, 20 bp, Artificial Sequence
  Synthetic
gaacgtactattgtctcccg

SEQ ID NO: 15197 - DNA, 18 bp, Artificial Sequence
  Synthetic
ggacactgttccagcaaa

SEQ ID NO: 15198 - DNA, 18 bp, Artificial Sequence
  Synthetic
gatgaaggcacatctggg

SEQ ID NO: 15199 - DNA, 18 bp, Artificial Sequence
  Synthetic
atttgtgaccgggagaga

SEQ ID NO: 15200 - DNA, 22 bp, Artificial Sequence
  Synthetic
ttaagcaatgaatctctgtcac

SEQ ID NO: 15201 - DNA, 18 bp, Artificial Sequence
  Synthetic
ggatcgctcatttgcaga

SEQ ID NO: 15202 - DNA, 19 bp, Artificial Sequence
  Synthetic
acaacaaggagaacgttcc

SEQ ID NO: 15203 - DNA, 19 bp, Artificial Sequence
  Synthetic
tttgggaattggatctggg

SEQ ID NO: 15204 - DNA, 23 bp, Artificial Sequence
  Synthetic
tttagattttgtagctcctgatg

SEQ ID NO: 15205 - DNA, 19 bp, Artificial Sequence
  Synthetic
aatttgaaaatgccgccta

SEQ ID NO: 15206 - DNA, 21 bp, Artificial Sequence
  Synthetic
agaattgcagactatagctgg

SEQ ID NO: 15207 - DNA, 23 bp, Artificial Sequence
  Synthetic
tatcaggtgtagaaattaaacgt

SEQ ID NO: 15208 - DNA, 22 bp, Artificial Sequence
  Synthetic
taatagccctattcaggatggt

SEQ ID NO: 15209 - DNA, 25 bp, Artificial Sequence
  Synthetic
ttcattaacctgctatgtatttgtc

SEQ ID NO: 15210 - DNA, 19 bp, Artificial Sequence
  Synthetic
gtggtgacagattgcaagt

SEQ ID NO: 15211 - DNA, 18 bp, Artificial Sequence
  Synthetic
aggtggaaaaggtagcgt

SEQ ID NO: 15212 - DNA, 25 bp, Artificial Sequence
  Synthetic
atgtagagatactgtacaaaaactg

SEQ ID NO: 15213 - DNA, 22 bp, Artificial Sequence
  Synthetic
ccactaacagatgctaaattgg

SEQ ID NO: 15214 - DNA, 20 bp, Artificial Sequence
  Synthetic
ccaaatacaacactgggatc

SEQ ID NO: 15215 - DNA, 25 bp, Artificial Sequence
  Synthetic
atatattatcaagatgcagatgagc

SEQ ID NO: 15216 - DNA, 21 bp, Artificial Sequence
  Synthetic
cattgaaatgttggaggtaca

SEQ ID NO: 15217 - DNA, 19 bp, Artificial Sequence
  Synthetic
actttgggggtctgggtat

SEQ ID NO: 15218 - DNA, 18 bp, Artificial Sequence
  Synthetic
aaagggtctctgtaggca

SEQ ID NO: 15219 - DNA, 21 bp, Artificial Sequence
  Synthetic
ctgaaggccacattagactaa

SEQ ID NO: 15220 - DNA, 25 bp, Artificial Sequence
  Synthetic
actacattttatttacatcctggac

SEQ ID NO: 15221 - DNA, 21 bp, Artificial Sequence
  Synthetic
gacaaagtgtctctatggacc

SEQ ID NO: 15222 - DNA, 23 bp, Artificial Sequence
  Synthetic
attacattggttgataacacaca

SEQ ID NO: 15223 - DNA, 20 bp, Artificial Sequence
  Synthetic
tacagaacgtttgtcctctg

SEQ ID NO: 15224 - DNA, 21 bp, Artificial Sequence
  Synthetic
tcaacaacaagattactcagc

SEQ ID NO: 15225 - DNA, 21 bp, Artificial Sequence
  Synthetic
tttacctgtcagtcttttagc

SEQ ID NO: 15226 - DNA, 18 bp, Artificial Sequence
  Synthetic
ctgtttgaggtgctccag

SEQ ID NO: 15227 - DNA, 25 bp, Artificial Sequence
  Synthetic
gttaactaaaacacctttgaaaagc

SEQ ID NO: 15228 - DNA, 22 bp, Artificial Sequence
  Synthetic
aaagaatactttggtgtagcat

SEQ ID NO: 15229 - DNA, 24 bp, Artificial Sequence
  Synthetic
atggaaatagagcatattttctcc

SEQ ID NO: 15230 - DNA, 20 bp, Artificial Sequence
  Synthetic
tctctagctctaccacgtcg

SEQ ID NO: 15231 - DNA, 18 bp, Artificial Sequence
  Synthetic
cagatgtggtcggtgttg

SEQ ID NO: 15232 - DNA, 19 bp, Artificial Sequence
  Synthetic
aggccctattaatcagcct

SEQ ID NO: 15233 - DNA, 18 bp, Artificial Sequence
  Synthetic
gccagaccaggattttgc

SEQ ID NO: 15234 - DNA, 24 bp, Artificial Sequence
  Synthetic
aatacctgacaatatactagagga

SEQ ID NO: 15235 - DNA, 24 bp, Artificial Sequence
  Synthetic
tatggcagtagatgtttatgatga

SEQ ID NO: 15236 - DNA, 23 bp, Artificial Sequence
  Synthetic
gtagtggaaatcagtttagagtt

SEQ ID NO: 15237 - DNA, 20 bp, Artificial Sequence
  Synthetic
ccgcatatcctttaaagcag

SEQ ID NO: 15238 - DNA, 21 bp, Artificial Sequence
  Synthetic
ggggtctacatttttgtctac

SEQ ID NO: 15239 - DNA, 18 bp, Artificial Sequence
  Synthetic
ccgcggaaatccagcaat

SEQ ID NO: 15240 - DNA, 19 bp, Artificial Sequence
  Synthetic
aacatgtacccggcagtcc

SEQ ID NO: 15241 - DNA, 20 bp, Artificial Sequence
  Synthetic
tccactaaccatccttttgc

SEQ ID NO: 15242 - DNA, 20 bp, Artificial Sequence
  Synthetic
ggggggactttatgtgaccc

SEQ ID NO: 15243 - DNA, 16 bp, Artificial Sequence
  Synthetic
gtcgctgactccgcca

SEQ ID NO: 15244 - DNA, 16 bp, Artificial Sequence
  Synthetic
tccaaggactcgggcc

SEQ ID NO: 15245 - DNA, 18 bp, Artificial Sequence
  Synthetic
gccacttcctgggtcatg

SEQ ID NO: 15246 - DNA, 18 bp, Artificial Sequence
  Synthetic
caatccaacacgaggcaa

SEQ ID NO: 15247 - DNA, 16 bp, Artificial Sequence
  Synthetic
tatgcgccgaggcctt

SEQ ID NO: 15248 - DNA, 19 bp, Artificial Sequence
  Synthetic
cgagttacgctccttggag

SEQ ID NO: 15249 - DNA, 18 bp, Artificial Sequence
  Synthetic
aagctgtgtgacggtccc

SEQ ID NO: 15250 - DNA, 19 bp, Artificial Sequence
  Synthetic
cgatcgtaagccgcaatgt

SEQ ID NO: 15251 - DNA, 19 bp, Artificial Sequence
  Synthetic
cctgagaggaggcttgtgt

SEQ ID NO: 15252 - DNA, 16 bp, Artificial Sequence
  Synthetic
ctcgtttcggccccga

SEQ ID NO: 15253 - DNA, 20 bp, Artificial Sequence
  Synthetic
gagtccgacaggaggtctcc

SEQ ID NO: 15254 - DNA, 18 bp, Artificial Sequence
  Synthetic
tgtagttgagcggctcct

SEQ ID NO: 15255 - DNA, 17 bp, Artificial Sequence
  Synthetic
ttcgtcgcgtgacctgg

SEQ ID NO: 15256 - DNA, 19 bp, Artificial Sequence
  Synthetic
gggtgttccagtcatcggg

SEQ ID NO: 15257 - DNA, 20 bp, Artificial Sequence
  Synthetic
tttcagccagcatcttagca

SEQ ID NO: 15258 - DNA, 16 bp, Artificial Sequence
  Synthetic
acgcagttgctgacgc

SEQ ID NO: 15259 - DNA, 16 bp, Artificial Sequence
  Synthetic
gggcgtttgtcccacg

SEQ ID NO: 15260 - DNA, 18 bp, Artificial Sequence
  Synthetic
gcggggggaggatgaaac

SEQ ID NO: 15261 - DNA, 18 bp, Artificial Sequence
  Synthetic
cctttatgcgctttgccg

SEQ ID NO: 15262 - DNA, 20 bp, Artificial Sequence
  Synthetic
ttctctatcgtcaactgcgc

SEQ ID NO: 15263 - DNA, 18 bp, Artificial Sequence
  Synthetic
ccaacatctgcctcccgc

SEQ ID NO: 15264 - DNA, 17 bp, Artificial Sequence
  Synthetic
gagtcccgctgagcaga

SEQ ID NO: 15265 - DNA, 16 bp, Artificial Sequence
  Synthetic
ccgttgaggcccacgt

SEQ ID NO: 15266 - DNA, 18 bp, Artificial Sequence
  Synthetic
caaggccagagacaccct

SEQ ID NO: 15267 - DNA, 16 bp, Artificial Sequence
  Synthetic
acgtgtctgggaggcg

SEQ ID NO: 15268 - DNA, 19 bp, Artificial Sequence
  Synthetic
aaaagcctcggtctgctcc

SEQ ID NO: 15269 - DNA, 18 bp, Artificial Sequence
  Synthetic
gaactgggcctcgtggga

SEQ ID NO: 15270 - DNA, 17 bp, Artificial Sequence
  Synthetic
acgagagaacccgccac

SEQ ID NO: 15271 - DNA, 18 bp, Artificial Sequence
  Synthetic
gatctcggccgttgtctc

SEQ ID NO: 15272 - DNA, 18 bp, Artificial Sequence
  Synthetic
ggggggtggcatatctga

SEQ ID NO: 15273 - DNA, 16 bp, Artificial Sequence
  Synthetic
ctggctcgcctggagt

SEQ ID NO: 15274 - DNA, 16 bp, Artificial Sequence
  Synthetic
gtcatgtcgggggcct

SEQ ID NO: 15275 - DNA, 19 bp, Artificial Sequence
  Synthetic
attggtttcagcaatcgga

SEQ ID NO: 15276 - DNA, 18 bp, Artificial Sequence
  Synthetic
caggcagcgtcttcagga

SEQ ID NO: 15277 - DNA, 16 bp, Artificial Sequence
  Synthetic
cgggcttcaggggcat

SEQ ID NO: 15278 - DNA, 19 bp, Artificial Sequence
  Synthetic
tgtcgctgcagtactacga

SEQ ID NO: 15279 - DNA, 18 bp, Artificial Sequence
  Synthetic
ggaagaggacgaggacga

SEQ ID NO: 15280 - DNA, 18 bp, Artificial Sequence
  Synthetic
cggggtcgaggaggtagt

SEQ ID NO: 15281 - DNA, 20 bp, Artificial Sequence
  Synthetic
gaggttcagggacttgtcct

SEQ ID NO: 15282 - DNA, 17 bp, Artificial Sequence
  Synthetic
ccatagctgcccctggt

SEQ ID NO: 15283 - DNA, 18 bp, Artificial Sequence
  Synthetic
ccatgactgctgacccgc

SEQ ID NO: 15284 - DNA, 17 bp, Artificial Sequence
  Synthetic
catccggcaagcaccat

SEQ ID NO: 15285 - DNA, 20 bp, Artificial Sequence
  Synthetic
ttcgtgccaaaccaaaaagg

SEQ ID NO: 15286 - DNA, 18 bp, Artificial Sequence
  Synthetic
tcctctgaaggatgggcg

SEQ ID NO: 15287 - DNA, 19 bp, Artificial Sequence
  Synthetic
atcaacaggtgggggttgt

SEQ ID NO: 15288 - DNA, 19 bp, Artificial Sequence
  Synthetic
gtagcagaatagggcccct

SEQ ID NO: 15289 - DNA, 16 bp, Artificial Sequence
  Synthetic
tgcccatacctgcggg

SEQ ID NO: 15290 - DNA, 16 bp, Artificial Sequence
  Synthetic
tggccaggtggacgca

SEQ ID NO: 15291 - DNA, 18 bp, Artificial Sequence
  Synthetic
agaccctcgtgagacccg

SEQ ID NO: 15292 - DNA, 18 bp, Artificial Sequence
  Synthetic
tgtcggatctcggtccag

SEQ ID NO: 15293 - DNA, 17 bp, Artificial Sequence
  Synthetic
gtagcctgagccgcact

SEQ ID NO: 15294 - DNA, 20 bp, Artificial Sequence
  Synthetic
cctaacagggtcatcgtcct

SEQ ID NO: 15295 - DNA, 18 bp, Artificial Sequence
  Synthetic
agccggtcaacacgacat

SEQ ID NO: 15296 - DNA, 17 bp, Artificial Sequence
  Synthetic
caccagcccgttcacca

SEQ ID NO: 15297 - DNA, 18 bp, Artificial Sequence
  Synthetic
gcagaacgttgtcggtga

SEQ ID NO: 15298 - DNA, 18 bp, Artificial Sequence
  Synthetic
aagcggggtcttttggac

SEQ ID NO: 15299 - DNA, 20 bp, Artificial Sequence
  Synthetic
cgggacagattgtcttccac

SEQ ID NO: 15300 - DNA, 18 bp, Artificial Sequence
  Synthetic
cccccttttccgcatcag

SEQ ID NO: 15301 - DNA, 18 bp, Artificial Sequence
  Synthetic
attgccaaaacaacgtgt

SEQ ID NO: 15302 - DNA, 16 bp, Artificial Sequence
  Synthetic
ggcggtggacagcagt

SEQ ID NO: 15303 - DNA, 19 bp, Artificial Sequence
  Synthetic
caaaagaccctccccacct

SEQ ID NO: 15304 - DNA, 17 bp, Artificial Sequence
  Synthetic
taccacccccacccaca

SEQ ID NO: 15305 - DNA, 18 bp, Artificial Sequence
  Synthetic
cgggaggacaccaaccct

SEQ ID NO: 15306 - DNA, 18 bp, Artificial Sequence
  Synthetic
ttctggagtgcctttcgc

SEQ ID NO: 15307 - DNA, 19 bp, Artificial Sequence
  Synthetic
aggaaggcgctgtaggatt

SEQ ID NO: 15308 - DNA, 18 bp, Artificial Sequence
  Synthetic
tttctcgcccccttcact

SEQ ID NO: 15309 - DNA, 17 bp, Artificial Sequence
  Synthetic
ggtgatgcggaccttgg

SEQ ID NO: 15310 - DNA, 16 bp, Artificial Sequence
  Synthetic
ccttgccgtgccctct

SEQ ID NO: 15311 - DNA, 20 bp, Artificial Sequence
  Synthetic
ctggccatatcagggaagtc

SEQ ID NO: 15312 - DNA, 20 bp, Artificial Sequence
  Synthetic
cagggtctgggtaaacaggt

SEQ ID NO: 15313 - DNA, 16 bp, Artificial Sequence
  Synthetic
ccagcctgccggactt

SEQ ID NO: 15314 - DNA, 16 bp, Artificial Sequence
  Synthetic
gtcggcaaacaggggc

SEQ ID NO: 15315 - DNA, 20 bp, Artificial Sequence
  Synthetic
cacctccttgtcgtagagcg

SEQ ID NO: 15316 - DNA, 18 bp, Artificial Sequence
  Synthetic
cctgtgcagagccttgac

SEQ ID NO: 15317 - DNA, 17 bp, Artificial Sequence
  Synthetic
cacgtcacggggaactg

SEQ ID NO: 15318 - DNA, 16 bp, Artificial Sequence
  Synthetic
ctgagccgcgaccagt

SEQ ID NO: 15319 - DNA, 20 bp, Artificial Sequence
  Synthetic
gcaaaggcaggtctttctca

SEQ ID NO: 15320 - DNA, 16 bp, Artificial Sequence
  Synthetic
ggctgaccccggcaaa

SEQ ID NO: 15321 - DNA, 18 bp, Artificial Sequence
  Synthetic
gttttccgtttgctgcat

SEQ ID NO: 15322 - DNA, 20 bp, Artificial Sequence
  Synthetic
aaagacattgtcctgcagct

SEQ ID NO: 15323 - DNA, 22 bp, Artificial Sequence
  Synthetic
tgttaaactccagtaatcgaag

SEQ ID NO: 15324 - DNA, 22 bp, Artificial Sequence
  Synthetic
gtgtgctaaaaacagagatacc

SEQ ID NO: 15325 - DNA, 22 bp, Artificial Sequence
  Synthetic
tggctgatgtagatagtaatgc

SEQ ID NO: 15326 - DNA, 22 bp, Artificial Sequence
  Synthetic
tgtttagtattttatgggcctg

SEQ ID NO: 15327 - DNA, 25 bp, Artificial Sequence
  Synthetic
agaactgtatgaaaaagatagtgac

SEQ ID NO: 15328 - DNA, 19 bp, Artificial Sequence
  Synthetic
tatagcaacgaacgatgga

SEQ ID NO: 15329 - DNA, 20 bp, Artificial Sequence
  Synthetic
gtacatgtgggttcaagggt

SEQ ID NO: 15330 - DNA, 19 bp, Artificial Sequence
  Synthetic
atgatagtgtggaacagcg

SEQ ID NO: 15331 - DNA, 24 bp, Artificial Sequence
  Synthetic
gtttctagcactatatatacaggc

SEQ ID NO: 15332 - DNA, 18 bp, Artificial Sequence
  Synthetic
ggagcagatgttccagtg

SEQ ID NO: 15333 - DNA, 25 bp, Artificial Sequence
  Synthetic
atgctggtagttctagattacttac

SEQ ID NO: 15334 - DNA, 18 bp, Artificial Sequence
  Synthetic
cggacagcctttaggaat

SEQ ID NO: 15335 - DNA, 18 bp, Artificial Sequence
  Synthetic
cacaggttttggggcaat

SEQ ID NO: 15336 - DNA, 19 bp, Artificial Sequence
  Synthetic
tctttatgcatccacacct

SEQ ID NO: 15337 - DNA, 20 bp, Artificial Sequence
  Synthetic
catggatgctacattactgg

SEQ ID NO: 15338 - DNA, 20 bp, Artificial Sequence
  Synthetic
tgcgtgtcatgtatgtgtgt

SEQ ID NO: 15339 - DNA, 18 bp, Artificial Sequence
  Synthetic
tgcctggcagttatttgg

SEQ ID NO: 15340 - DNA, 25 bp, Artificial Sequence
  Synthetic
gtttctggtattgttagaaagatgg

SEQ ID NO: 15341 - DNA, 20 bp, Artificial Sequence
  Synthetic
gcctactgctgaaaatttgg

SEQ ID NO: 15342 - DNA, 18 bp, Artificial Sequence
  Synthetic
acgatgcttcacagggaa

SEQ ID NO: 15343 - DNA, 25 bp, Artificial Sequence
  Synthetic
actgtaggattatatgctttaatgc

SEQ ID NO: 15344 - DNA, 25 bp, Artificial Sequence
  Synthetic
caaagcaataatcaagctaaacatg

SEQ ID NO: 15345 - DNA, 18 bp, Artificial Sequence
  Synthetic
cgtatgcagcagaaacct

SEQ ID NO: 15346 - DNA, 18 bp, Artificial Sequence
  Synthetic
cgccacaccttccacatc

SEQ ID NO: 15347 - DNA, 23 bp, Artificial Sequence
  Synthetic
atttggcagtgttatttatttgg

SEQ ID NO: 15348 - DNA, 21 bp, Artificial Sequence
  Synthetic
atgtatttgaggacttgtcca

SEQ ID NO: 15349 - DNA, 20 bp, Artificial Sequence
  Synthetic
gtttggtacgttttagcaga

SEQ ID NO: 15350 - DNA, 22 bp, Artificial Sequence
  Synthetic
ctaactctataccgtacacacc

SEQ ID NO: 15351 - DNA, 19 bp, Artificial Sequence
  Synthetic
gccgatacagaaaatccca

SEQ ID NO: 15352 - DNA, 18 bp, Artificial Sequence
  Synthetic
acgagatgtcctccagaa

SEQ ID NO: 15353 - DNA, 21 bp, Artificial Sequence
  Synthetic
atcttcctattgtgcaaagtc

SEQ ID NO: 15354 - DNA, 20 bp, Artificial Sequence
  Synthetic
ctgtgcagtgaggaaaagga

SEQ ID NO: 15355 - DNA, 19 bp, Artificial Sequence
  Synthetic
cctacagaaccagcacagc

SEQ ID NO: 15356 - DNA, 20 bp, Artificial Sequence
  Synthetic
tagtgatgaggacgaggagg

SEQ ID NO: 15357 - DNA, 20 bp, Artificial Sequence
  Synthetic
acgtagactgtttgagctgc

SEQ ID NO: 15358 - DNA, 21 bp, Artificial Sequence
  Synthetic
aaaagtaataggaccacgtgt

SEQ ID NO: 15359 - DNA, 20 bp, Artificial Sequence
  Synthetic
ccaaaataagacatccagcg

SEQ ID NO: 15360 - DNA, 22 bp, Artificial Sequence
  Synthetic
gccaagcaaaatatgtaaagga

SEQ ID NO: 15361 - DNA, 22 bp, Artificial Sequence
  Synthetic
atacttttgtatgagcctgttg

SEQ ID NO: 15362 - DNA, 19 bp, Artificial Sequence
  Synthetic
tagaggaagacaggtggaa

SEQ ID NO: 15363 - DNA, 19 bp, Artificial Sequence
  Synthetic
acgttaagtttgatggcga

SEQ ID NO: 15364 - DNA, 15 bp, Artificial Sequence
  Synthetic
aacccgacgccacca

SEQ ID NO: 15365 - DNA, 23 bp, Artificial Sequence
  Synthetic
ttaaggtatagattgcacaaaca

SEQ ID NO: 15366 - DNA, 21 bp, Artificial Sequence
  Synthetic
agtgtggagacctttatttgc

SEQ ID NO: 15367 - DNA, 19 bp, Artificial Sequence
  Synthetic
cttgtgttgtagtgtgcaa

SEQ ID NO: 15368 - DNA, 18 bp, Artificial Sequence
  Synthetic
ttctttgggggtttgggc

SEQ ID NO: 15369 - DNA, 20 bp, Artificial Sequence
  Synthetic
ccaacaagtacatgtacagg

SEQ ID NO: 15370 - DNA, 19 bp, Artificial Sequence
  Synthetic
ttcccgactgttaactgtt

SEQ ID NO: 15371 - DNA, 20 bp, Artificial Sequence
  Synthetic
tgacactgaaaacaccaatt

SEQ ID NO: 15372 - DNA, 24 bp, Artificial Sequence
  Synthetic
gatgtgcctttagatattgtaacc

SEQ ID NO: 15373 - DNA, 20 bp, Artificial Sequence
  Synthetic
atcccagttgtttaacaagc

SEQ ID NO: 15374 - DNA, 19 bp, Artificial Sequence
  Synthetic
ccaaacgttcctaagcatg

SEQ ID NO: 15375 - DNA, 20 bp, Artificial Sequence
  Synthetic
gtggtgtcctgtatgtgacc

SEQ ID NO: 15376 - DNA, 19 bp, Artificial Sequence
  Synthetic
gccatgaatcactcccctg

SEQ ID NO: 15377 - DNA, 19 bp, Artificial Sequence
  Synthetic
aagaaacaccaaccgtcgc

SEQ ID NO: 15378 - DNA, 15 bp, Artificial Sequence
  Synthetic
tcgcgcaacgtgggt

SEQ ID NO: 15379 - DNA, 17 bp, Artificial Sequence
  Synthetic
gctgctgtcctccacgt

SEQ ID NO: 15380 - DNA, 20 bp, Artificial Sequence
  Synthetic
cacggctaccatgatcttgg

SEQ ID NO: 15381 - DNA, 18 bp, Artificial Sequence
  Synthetic
ccttgcacaccggcttta

SEQ ID NO: 15382 - DNA, 18 bp, Artificial Sequence
  Synthetic
gtcatggttcggctgcac

SEQ ID NO: 15383 - DNA, 18 bp, Artificial Sequence
  Synthetic
ttcactcgtggggatcgt

SEQ ID NO: 15384 - DNA, 18 bp, Artificial Sequence
  Synthetic
cagctagctgcaatggct

SEQ ID NO: 15385 - DNA, 19 bp, Artificial Sequence
  Synthetic
ccgtcgccatattctaccc

SEQ ID NO: 15386 - DNA, 19 bp, Artificial Sequence
  Synthetic
agacagctgcttgtgggga

SEQ ID NO: 15387 - DNA, 18 bp, Artificial Sequence
  Synthetic
tctcgggggttttgtgga

SEQ ID NO: 15388 - DNA, 20 bp, Artificial Sequence
  Synthetic
tttcatccccgttgagacac

SEQ ID NO: 15389 - DNA, 20 bp, Artificial Sequence
  Synthetic
atatggcaaattcctcgccg

SEQ ID NO: 15390 - DNA, 18 bp, Artificial Sequence
  Synthetic
tcggggtatgggcttgaa

SEQ ID NO: 15391 - DNA, 20 bp, Artificial Sequence
  Synthetic
gtgtagtgctctgtgagtgc

SEQ ID NO: 15392 - DNA, 16 bp, Artificial Sequence
  Synthetic
acactcgtgggcccca

SEQ ID NO: 15393 - DNA, 18 bp, Artificial Sequence
  Synthetic
gccgagatgctgaagtcc

SEQ ID NO: 15394 - DNA, 20 bp, Artificial Sequence
  Synthetic
aggtaaggtgctagtggaca

SEQ ID NO: 15395 - DNA, 18 bp, Artificial Sequence
  Synthetic
catgagaatcacggggcc

SEQ ID NO: 15396 - DNA, 17 bp, Artificial Sequence
  Synthetic
cagcttccttgcgaccc

SEQ ID NO: 15397 - DNA, 20 bp, Artificial Sequence
  Synthetic
cgaccttgagccttcgatac

SEQ ID NO: 15398 - DNA, 20 bp, Artificial Sequence
  Synthetic
cctgatgagttggccctttc

SEQ ID NO: 15399 - DNA, 20 bp, Artificial Sequence
  Synthetic
tgataggatgcaagtgctcg

SEQ ID NO: 15400 - DNA, 18 bp, Artificial Sequence
  Synthetic
tttaccctgacctcggcg

SEQ ID NO: 15401 - DNA, 20 bp, Artificial Sequence
  Synthetic
ggtgctcaccactagcatgg

SEQ ID NO: 15402 - DNA, 20 bp, Artificial Sequence
  Synthetic
tcctcaaatgtgtctgtggc

SEQ ID NO: 15403 - DNA, 20 bp, Artificial Sequence
  Synthetic
ctctgcacacatacactccc

SEQ ID NO: 15404 - DNA, 18 bp, Artificial Sequence
  Synthetic
gttgagggcagccagttg

SEQ ID NO: 15405 - DNA, 19 bp, Artificial Sequence
  Synthetic
gcggtaatgaggccgaagt

SEQ ID NO: 15406 - DNA, 20 bp, Artificial Sequence
  Synthetic
tcttcgtcaacggtcaagtc

SEQ ID NO: 15407 - DNA, 20 bp, Artificial Sequence
  Synthetic
agaggatgcggttttgttcg

SEQ ID NO: 15408 - DNA, 20 bp, Artificial Sequence
  Synthetic
cgaaaagaaaatcgccctcc

SEQ ID NO: 15409 - DNA, 20 bp, Artificial Sequence
  Synthetic
tggacggcttggattttcag

SEQ ID NO: 15410 - DNA, 20 bp, Artificial Sequence
  Synthetic
atgtcgcccaagttttcaga

SEQ ID NO: 15411 - DNA, 16 bp, Artificial Sequence
  Synthetic
acgaagccgccctggt

SEQ ID NO: 15412 - DNA, 18 bp, Artificial Sequence
  Synthetic
ggcttcgatgcccttgtt

SEQ ID NO: 15413 - DNA, 16 bp, Artificial Sequence
  Synthetic
cggctgccgtcttggt

SEQ ID NO: 15414 - DNA, 19 bp, Artificial Sequence
  Synthetic
ccgaacaggcggtatttgc

SEQ ID NO: 15415 - DNA, 20 bp, Artificial Sequence
  Synthetic
ttgttgcgatgtgatgacgc

SEQ ID NO: 15416 - DNA, 20 bp, Artificial Sequence
  Synthetic
cgggttctgccttttcaaac

SEQ ID NO: 15417 - DNA, 18 bp, Artificial Sequence
  Synthetic
aggcggacaccttgttgc

SEQ ID NO: 15418 - DNA, 20 bp, Artificial Sequence
  Synthetic
acaatttcagccacaactgc

SEQ ID NO: 15419 - DNA, 16 bp, Artificial Sequence
  Synthetic
cacaccagcgcaccga

SEQ ID NO: 15420 - DNA, 20 bp, Artificial Sequence
  Synthetic
gcaagataaaccacgtcgcc

SEQ ID NO: 15421 - DNA, 19 bp, Artificial Sequence
  Synthetic
ttccaatgcctgcgtttca

SEQ ID NO: 15422 - DNA, 17 bp, Artificial Sequence
  Synthetic
aactcttgccgcgttcc

SEQ ID NO: 15423 - DNA, 16 bp, Artificial Sequence
  Synthetic
tcagcggtgcaggcga

SEQ ID NO: 15424 - DNA, 17 bp, Artificial Sequence
  Synthetic
gtaacgcgcaaaccccg

SEQ ID NO: 15425 - DNA, 20 bp, Artificial Sequence
  Synthetic
aggttttgtggacataggcg

SEQ ID NO: 15426 - DNA, 17 bp, Artificial Sequence
  Synthetic
ttttgggcggcaggacg

SEQ ID NO: 15427 - DNA, 20 bp, Artificial Sequence
  Synthetic
gttcatgttcgtgccttccg

SEQ ID NO: 15428 - DNA, 18 bp, Artificial Sequence
  Synthetic
gttttccagtgcgaacgc

SEQ ID NO: 15429 - DNA, 15 bp, Artificial Sequence
  Synthetic
tttcttgggcgcggc

SEQ ID NO: 15430 - DNA, 17 bp, Artificial Sequence
  Synthetic
ggcatcggacggcaaag

SEQ ID NO: 15431 - DNA, 16 bp, Artificial Sequence
  Synthetic
cgaagctgcgttgggc

SEQ ID NO: 15432 - DNA, 17 bp, Artificial Sequence
  Synthetic
cataccgggttcgccga

SEQ ID NO: 15433 - DNA, 16 bp, Artificial Sequence
  Synthetic
gcacgcctgccgctat

SEQ ID NO: 15434 - DNA, 15 bp, Artificial Sequence
  Synthetic
ttcggcggcggcaat

SEQ ID NO: 15435 - DNA, 19 bp, Artificial Sequence
  Synthetic
cgccttgttctttcaggga

SEQ ID NO: 15436 - DNA, 18 bp, Artificial Sequence
  Synthetic
gggtttgaccgccgtaat

SEQ ID NO: 15437 - DNA, 18 bp, Artificial Sequence
  Synthetic
ccgcacctgtcagaatcg

SEQ ID NO: 15438 - DNA, 19 bp, Artificial Sequence
  Synthetic
atggacagatggatgtgcg

SEQ ID NO: 15439 - DNA, 20 bp, Artificial Sequence
  Synthetic
agaaaatcaccgccatcagc

SEQ ID NO: 15440 - DNA, 17 bp, Artificial Sequence
  Synthetic
cgccttaagccttgccg

SEQ ID NO: 15441 - DNA, 18 bp, Artificial Sequence
  Synthetic
gaacacctgccccggtat

SEQ ID NO: 15442 - DNA, 17 bp, Artificial Sequence
  Synthetic
attgcgccgcttccaac

SEQ ID NO: 15443 - DNA, 18 bp, Artificial Sequence
  Synthetic
tgctgcaaggctacgact

SEQ ID NO: 15444 - DNA, 20 bp, Artificial Sequence
  Synthetic
tcgttttcgaaccccaaccc

SEQ ID NO: 15445 - DNA, 19 bp, Artificial Sequence
  Synthetic
aatcgaacacagctacgcc

SEQ ID NO: 15446 - DNA, 19 bp, Artificial Sequence
  Synthetic
aaaaagccgaagccgaact

SEQ ID NO: 15447 - DNA, 18 bp, Artificial Sequence
  Synthetic
tgcctgcctcaacatcgg

SEQ ID NO: 15448 - DNA, 16 bp, Artificial Sequence
  Synthetic
aggcagtcggcgcagt

SEQ ID NO: 15449 - DNA, 18 bp, Artificial Sequence
  Synthetic
gcgttggcggctttttgg

SEQ ID NO: 15450 - DNA, 20 bp, Artificial Sequence
  Synthetic
cgaacttcaccaaacccacg

SEQ ID NO: 15451 - DNA, 16 bp, Artificial Sequence
  Synthetic
ccttttgggcgagccg

SEQ ID NO: 15452 - DNA, 20 bp, Artificial Sequence
  Synthetic
taatgttggggaacggcatt

SEQ ID NO: 15453 - DNA, 16 bp, Artificial Sequence
  Synthetic
tcgcggattgcctgct

SEQ ID NO: 15454 - DNA, 15 bp, Artificial Sequence
  Synthetic
tcagcgtcgggtgca

SEQ ID NO: 15455 - DNA, 20 bp, Artificial Sequence
  Synthetic
aaacggcatcggcttcttct

SEQ ID NO: 15456 - DNA, 20 bp, Artificial Sequence
  Synthetic
tgtgcatataaagcggcagg

SEQ ID NO: 15457 - DNA, 18 bp, Artificial Sequence
  Synthetic
cgatcggacgcgttttgc

SEQ ID NO: 15458 - DNA, 17 bp, Artificial Sequence
  Synthetic
caaggtttgccagcgcg

SEQ ID NO: 15459 - DNA, 19 bp, Artificial Sequence
  Synthetic
cggcatagtattcgcggac

SEQ ID NO: 15460 - DNA, 16 bp, Artificial Sequence
  Synthetic
gacgttgagccgggga

SEQ ID NO: 15461 - DNA, 20 bp, Artificial Sequence
  Synthetic
tcaatctgttcgggtgtcag

SEQ ID NO: 15462 - DNA, 17 bp, Artificial Sequence
  Synthetic
ccttgcgaggctttgcg

SEQ ID NO: 15463 - DNA, 20 bp, Artificial Sequence
  Synthetic
ccagttgttcggacaaacgc

SEQ ID NO: 15464 - DNA, 20 bp, Artificial Sequence
  Synthetic
tgcttttgtcttcttcgccc

SEQ ID NO: 15465 - DNA, 19 bp, Artificial Sequence
  Synthetic
ctacgagcttttgggcgag

SEQ ID NO: 15466 - DNA, 16 bp, Artificial Sequence
  Synthetic
ctgcccgcctgcatga

SEQ ID NO: 15467 - DNA, 17 bp, Artificial Sequence
  Synthetic
ggcgcgcaccataacca

SEQ ID NO: 15468 - DNA, 16 bp, Artificial Sequence
  Synthetic
cgttttcaggcggccc

SEQ ID NO: 15469 - DNA, 18 bp, Artificial Sequence
  Synthetic
ctggagctgttcgtcggt

SEQ ID NO: 15470 - DNA, 19 bp, Artificial Sequence
  Synthetic
cgaaatccgtgtcgatgca

SEQ ID NO: 15471 - DNA, 16 bp, Artificial Sequence
  Synthetic
cgctgcacgacacgct

SEQ ID NO: 15472 - DNA, 18 bp, Artificial Sequence
  Synthetic
aaaggccgaagtcatggc

SEQ ID NO: 15473 - DNA, 19 bp, Artificial Sequence
  Synthetic
gccaagctcgaagaagact

SEQ ID NO: 15474 - DNA, 16 bp, Artificial Sequence
  Synthetic
cgcctgacggatgctg

SEQ ID NO: 15475 - DNA, 16 bp, Artificial Sequence
  Synthetic
gcgtatcatcggcgcg

SEQ ID NO: 15476 - DNA, 16 bp, Artificial Sequence
  Synthetic
gcgtgggtcatgccgt

SEQ ID NO: 15477 - DNA, 17 bp, Artificial Sequence
  Synthetic
aaacctgcctcgtcggg

SEQ ID NO: 15478 - DNA, 18 bp, Artificial Sequence
  Synthetic
tctcggcaaagaacgtac

SEQ ID NO: 15479 - DNA, 17 bp, Artificial Sequence
  Synthetic
tttcggcggcacagaag

SEQ ID NO: 15480 - DNA, 20 bp, Artificial Sequence
  Synthetic
tttggaactgtggccaaaca

SEQ ID NO: 15481 - DNA, 20 bp, Artificial Sequence
  Synthetic
tgtttgagccagatttcgga

SEQ ID NO: 15482 - DNA, 19 bp, Artificial Sequence
  Synthetic
agacccaatgcgaggtagc

SEQ ID NO: 15483 - DNA, 20 bp, Artificial Sequence
  Synthetic
atacacgggataatcagcgc

SEQ ID NO: 15484 - DNA, 19 bp, Artificial Sequence
  Synthetic
caagcgtggcgataatcga

SEQ ID NO: 15485 - DNA, 16 bp, Artificial Sequence
  Synthetic
aatcgccgtctgccca

SEQ ID NO: 15486 - DNA, 20 bp, Artificial Sequence
  Synthetic
ttcatggcaacgtcaatcgg

SEQ ID NO: 15487 - DNA, 19 bp, Artificial Sequence
  Synthetic
tgtattccatcacgccgtc

SEQ ID NO: 15488 - DNA, 20 bp, Artificial Sequence
  Synthetic
acctgtcgttttattggggc

SEQ ID NO: 15489 - DNA, 17 bp, Artificial Sequence
  Synthetic
cgtttggcgcaggttgg

SEQ ID NO: 15490 - DNA, 16 bp, Artificial Sequence
  Synthetic
gggcgcaggtcatcga

SEQ ID NO: 15491 - DNA, 16 bp, Artificial Sequence
  Synthetic
ccgcaaaaagccgccg

SEQ ID NO: 15492 - DNA, 18 bp, Artificial Sequence
  Synthetic
aaaaaccgaccgttgggc

SEQ ID NO: 15493 - DNA, 17 bp, Artificial Sequence
  Synthetic
aatccggcatcgacgct

SEQ ID NO: 15494 - DNA, 16 bp, Artificial Sequence
  Synthetic
gccgagggcgaatgtg

SEQ ID NO: 15495 - DNA, 16 bp, Artificial Sequence
  Synthetic
ctgctgcgcgggttca

SEQ ID NO: 15496 - DNA, 20 bp, Artificial Sequence
  Synthetic
cctatcaggctcatacggcg

SEQ ID NO: 15497 - DNA, 20 bp, Artificial Sequence
  Synthetic
agttgctgttcaaaccacgg

SEQ ID NO: 15498 - DNA, 17 bp, Artificial Sequence
  Synthetic
gcatcccttgccgtcca

SEQ ID NO: 15499 - DNA, 19 bp, Artificial Sequence
  Synthetic
cggcactctgcatttttgc

SEQ ID NO: 15500 - DNA, 19 bp, Artificial Sequence
  Synthetic
ggatgacggtcagtgtgtg

SEQ ID NO: 15501 - DNA, 18 bp, Artificial Sequence
  Synthetic
ttggacggcgttatgggt

SEQ ID NO: 15502 - DNA, 16 bp, Artificial Sequence
  Synthetic
gcgggcaagctgacgt

SEQ ID NO: 15503 - DNA, 16 bp, Artificial Sequence
  Synthetic
tcgggacaggggtgga

SEQ ID NO: 15504 - DNA, 19 bp, Artificial Sequence
  Synthetic
ggattgcgctgaacagcct

SEQ ID NO: 15505 - DNA, 18 bp, Artificial Sequence
  Synthetic
ctttgacggatgcctggc

SEQ ID NO: 15506 - DNA, 20 bp, Artificial Sequence
  Synthetic
cgggggaaaaggagttaacc

SEQ ID NO: 15507 - DNA, 17 bp, Artificial Sequence
  Synthetic
tgtacgacaggtgcggc

SEQ ID NO: 15508 - DNA, 16 bp, Artificial Sequence
  Synthetic
ctgcaaccggggatgc

SEQ ID NO: 15509 - DNA, 20 bp, Artificial Sequence
  Synthetic
cgggttttttgacggttcag

SEQ ID NO: 15510 - DNA, 18 bp, Artificial Sequence
  Synthetic
tcggcaatggcatgcatg

SEQ ID NO: 15511 - DNA, 17 bp, Artificial Sequence
  Synthetic
gcgcaatgcctgctcga

SEQ ID NO: 15512 - DNA, 18 bp, Artificial Sequence
  Synthetic
gacgttactttgcgccaa

SEQ ID NO: 15513 - DNA, 18 bp, Artificial Sequence
  Synthetic
ttgaccgatggcacgacc

SEQ ID NO: 15514 - DNA, 16 bp, Artificial Sequence
  Synthetic
cgggtcggcgtggatt

SEQ ID NO: 15515 - DNA, 18 bp, Artificial Sequence
  Synthetic
atttcgaccgcccattcc

SEQ ID NO: 15516 - DNA, 19 bp, Artificial Sequence
  Synthetic
tgatgctgactttgtccgc

SEQ ID NO: 15517 - DNA, 15 bp, Artificial Sequence
  Synthetic
tgctgcgcttgggca

SEQ ID NO: 15518 - DNA, 16 bp, Artificial Sequence
  Synthetic
ccgcgagacaggtcgt

SEQ ID NO: 15519 - DNA, 19 bp, Artificial Sequence
  Synthetic
aaaccttccaatacgcccg

SEQ ID NO: 15520 - DNA, 20 bp, Artificial Sequence
  Synthetic
gatgccttcgatgacgaggt

SEQ ID NO: 15521 - DNA, 18 bp, Artificial Sequence
  Synthetic
ggatagcgtccggcaagt

SEQ ID NO: 15522 - DNA, 20 bp, Artificial Sequence
  Synthetic
cgtccgatgtgtattcccaa

SEQ ID NO: 15523 - DNA, 17 bp, Artificial Sequence
  Synthetic
gtaaacgacgacgcgcg

SEQ ID NO: 15524 - DNA, 19 bp, Artificial Sequence
  Synthetic
cgctgaatcggataggtcg

SEQ ID NO: 15525 - DNA, 18 bp, Artificial Sequence
  Synthetic
ggggtgaggatgtagcgt

SEQ ID NO: 15526 - DNA, 16 bp, Artificial Sequence
  Synthetic
gcctgttggacgggga

SEQ ID NO: 15527 - DNA, 17 bp, Artificial Sequence
  Synthetic
cggattcaaacgcgcca

SEQ ID NO: 15528 - DNA, 17 bp, Artificial Sequence
  Synthetic
tggaaaacccgcccagc

SEQ ID NO: 15529 - DNA, 20 bp, Artificial Sequence
  Synthetic
tcggctttgaataactgcgt

SEQ ID NO: 15530 - DNA, 18 bp, Artificial Sequence
  Synthetic
cggaaagggtaacggtcg

SEQ ID NO: 15531 - DNA, 16 bp, Artificial Sequence
  Synthetic
ccgtcagccagagggt

SEQ ID NO: 15532 - DNA, 20 bp, Artificial Sequence
  Synthetic
caaggcattggctttttcca

SEQ ID NO: 15533 - DNA, 18 bp, Artificial Sequence
  Synthetic
tcgcgttcgatttcgctg

SEQ ID NO: 15534 - DNA, 19 bp, Artificial Sequence
  Synthetic
ctcgggatggtttcgttcc

SEQ ID NO: 15535 - DNA, 19 bp, Artificial Sequence
  Synthetic
ggtcggcgaaaccaaatgg

SEQ ID NO: 15536 - DNA, 16 bp, Artificial Sequence
  Synthetic
cgttgcggctgactgc

SEQ ID NO: 15537 - DNA, 19 bp, Artificial Sequence
  Synthetic
cgaacggtattgcgcttcg

SEQ ID NO: 15538 - DNA, 20 bp, Artificial Sequence
  Synthetic
tgcaaagtgtgtatcaggct

SEQ ID NO: 15539 - DNA, 16 bp, Artificial Sequence
  Synthetic
ggtttgcgccccgatt

SEQ ID NO: 15540 - DNA, 20 bp, Artificial Sequence
  Synthetic
atgtattgaatgccgcgagc

SEQ ID NO: 15541 - DNA, 19 bp, Artificial Sequence
  Synthetic
cgctatgccgaaatgagcg

SEQ ID NO: 15542 - DNA, 20 bp, Artificial Sequence
  Synthetic
tgaattccgctttatcggcg

SEQ ID NO: 15543 - DNA, 18 bp, Artificial Sequence
  Synthetic
ccaacctcaaaccgccag

SEQ ID NO: 15544 - DNA, 17 bp, Artificial Sequence
  Synthetic
aacccgttttggcgcaa

SEQ ID NO: 15545 - DNA, 17 bp, Artificial Sequence
  Synthetic
tttctgcctgcccgtcc

SEQ ID NO: 15546 - DNA, 16 bp, Artificial Sequence
  Synthetic
gggcgggcgagttgaa

SEQ ID NO: 15547 - DNA, 17 bp, Artificial Sequence
  Synthetic
ttcaaaccgaccaccgc

SEQ ID NO: 15548 - DNA, 18 bp, Artificial Sequence
  Synthetic
tggcggggtcttttttgc

SEQ ID NO: 15549 - DNA, 19 bp, Artificial Sequence
  Synthetic
caaatcgtaggcaagcgca

SEQ ID NO: 15550 - DNA, 16 bp, Artificial Sequence
  Synthetic
cggcggcagaaggctt

SEQ ID NO: 15551 - DNA, 19 bp, Artificial Sequence
  Synthetic
agcgtccgggattttcaac

SEQ ID NO: 15552 - DNA, 17 bp, Artificial Sequence
  Synthetic
ccgcgccgattacttcg

SEQ ID NO: 15553 - DNA, 20 bp, Artificial Sequence
  Synthetic
ttggacgacctgataacaag

SEQ ID NO: 15554 - DNA, 23 bp, Artificial Sequence
  Synthetic
attggccgtaataaaaagtatgg

SEQ ID NO: 15555 - DNA, 16 bp, Artificial Sequence
  Synthetic
ggcaactggacgggga

SEQ ID NO: 15556 - DNA, 19 bp, Artificial Sequence
  Synthetic
tacatcgaatgctcgctcg

SEQ ID NO: 15557 - DNA, 16 bp, Artificial Sequence
  Synthetic
ggcggctttgccccaa

SEQ ID NO: 15558 - DNA, 16 bp, Artificial Sequence
  Synthetic
cgcaaaccgccgttgc

SEQ ID NO: 15559 - DNA, 16 bp, Artificial Sequence
  Synthetic
attcggcttgccgctg

SEQ ID NO: 15560 - DNA, 16 bp, Artificial Sequence
  Synthetic
tcggcagatacgccgt

SEQ ID NO: 15561 - DNA, 20 bp, Artificial Sequence
  Synthetic
ccttcctgaatcaggtcggc

SEQ ID NO: 15562 - DNA, 16 bp, Artificial Sequence
  Synthetic
cggtttgttgggcggt

SEQ ID NO: 15563 - DNA, 16 bp, Artificial Sequence
  Synthetic
aaggtaggcgggcagc

SEQ ID NO: 15564 - DNA, 16 bp, Artificial Sequence
  Synthetic
ggcgcatcagcagcat

SEQ ID NO: 15565 - DNA, 20 bp, Artificial Sequence
  Synthetic
aacgacgattcctgtgatgg

SEQ ID NO: 15566 - DNA, 16 bp, Artificial Sequence
  Synthetic
ccagccgttgcgtgca

SEQ ID NO: 15567 - DNA, 19 bp, Artificial Sequence
  Synthetic
gcaaaaatggttatcggcc

SEQ ID NO: 15568 - DNA, 21 bp, Artificial Sequence
  Synthetic
aaaagaagatttggctgaagt

SEQ ID NO: 15569 - DNA, 21 bp, Artificial Sequence
  Synthetic
aaaaagcggtaataaagggaa

SEQ ID NO: 15570 - DNA, 19 bp, Artificial Sequence
  Synthetic
ccgaacaacgccttttcct

SEQ ID NO: 15571 - DNA, 20 bp, Artificial Sequence
  Synthetic
acgcagttgttcggaaaacg

SEQ ID NO: 15572 - DNA, 20 bp, Artificial Sequence
  Synthetic
aggttgatgctgtcgaactg

SEQ ID NO: 15573 - DNA, 18 bp, Artificial Sequence
  Synthetic
catggcggcgacaaatgc

SEQ ID NO: 15574 - DNA, 20 bp, Artificial Sequence
  Synthetic
aaacagtttctcgaacggta

SEQ ID NO: 15575 - DNA, 16 bp, Artificial Sequence
  Synthetic
cgattgcggcatgggc

SEQ ID NO: 15576 - DNA, 18 bp, Artificial Sequence
  Synthetic
gctatctctctacgccac

SEQ ID NO: 15577 - DNA, 19 bp, Artificial Sequence
  Synthetic
tttctttttcggcgagcgt

SEQ ID NO: 15578 - DNA, 20 bp, Artificial Sequence
  Synthetic
ttcaaacccttgcccaaacc

SEQ ID NO: 15579 - DNA, 16 bp, Artificial Sequence
  Synthetic
ccgctccttcgcatgg

SEQ ID NO: 15580 - DNA, 23 bp, Artificial Sequence
  Synthetic
ttaaatcccaaaacagaaatgac

SEQ ID NO: 15581 - DNA, 16 bp, Artificial Sequence
  Synthetic
ggcaacgacagcgagg

SEQ ID NO: 15582 - DNA, 16 bp, Artificial Sequence
  Synthetic
ggtacgcgcatgacgg

SEQ ID NO: 15583 - DNA, 18 bp, Artificial Sequence
  Synthetic
cttctgctggcggaatcg

SEQ ID NO: 15584 - DNA, 18 bp, Artificial Sequence
  Synthetic
gatgtatctcggccggct

SEQ ID NO: 15585 - DNA, 16 bp, Artificial Sequence
  Synthetic
ggctacggacacggca

SEQ ID NO: 15586 - DNA, 25 bp, Artificial Sequence
  Synthetic
tcggattaatttgttcaatatcacc

SEQ ID NO: 15587 - DNA, 20 bp, Artificial Sequence
  Synthetic
cttcaggaaagctttgccgc

SEQ ID NO: 15588 - DNA, 20 bp, Artificial Sequence
  Synthetic
ccaatccgtgcaaaaacagg

SEQ ID NO: 15589 - DNA, 16 bp, Artificial Sequence
  Synthetic
gcattgtccgccacgc

SEQ ID NO: 15590 - DNA, 17 bp, Artificial Sequence
  Synthetic
tcggggatgatggcgac

SEQ ID NO: 15591 - DNA, 19 bp, Artificial Sequence
  Synthetic
attgtggctgccggtaatc

SEQ ID NO: 15592 - DNA, 16 bp, Artificial Sequence
  Synthetic
gttaggcggcgtggca

SEQ ID NO: 15593 - DNA, 16 bp, Artificial Sequence
  Synthetic
gccacgccgaagacga

SEQ ID NO: 15594 - DNA, 20 bp, Artificial Sequence
  Synthetic
gcttcccgattaccctgaaa

SEQ ID NO: 15595 - DNA, 16 bp, Artificial Sequence
  Synthetic
atgtcggtggcacggc

SEQ ID NO: 15596 - DNA, 18 bp, Artificial Sequence
  Synthetic
cgttcggcgcaataaagc

SEQ ID NO: 15597 - DNA, 18 bp, Artificial Sequence
  Synthetic
tcgaggtgtatgggcagg

SEQ ID NO: 15598 - DNA, 20 bp, Artificial Sequence
  Synthetic
ctttcagacggcattggtcg

SEQ ID NO: 15599 - DNA, 19 bp, Artificial Sequence
  Synthetic
ccgcccagccataaaacag

SEQ ID NO: 15600 - DNA, 18 bp, Artificial Sequence
  Synthetic
ttgggcggatatttcggc

SEQ ID NO: 15601 - DNA, 19 bp, Artificial Sequence
  Synthetic
attttgcgcctgattccga

SEQ ID NO: 15602 - DNA, 17 bp, Artificial Sequence
  Synthetic
gccttaccacatcgcgc

SEQ ID NO: 15603 - DNA, 19 bp, Artificial Sequence
  Synthetic
cgtcagcgtaaccatgtcg

SEQ ID NO: 15604 - DNA, 17 bp, Artificial Sequence
  Synthetic
ttgccggcaacaacgac

SEQ ID NO: 15605 - DNA, 20 bp, Artificial Sequence
  Synthetic
cgcatccccttcctttatgc

SEQ ID NO: 15606 - DNA, 18 bp, Artificial Sequence
  Synthetic
cgctcgttgatgtagcgg

SEQ ID NO: 15607 - DNA, 17 bp, Artificial Sequence
  Synthetic
gccaagcctttgcctgc

SEQ ID NO: 15608 - DNA, 20 bp, Artificial Sequence
  Synthetic
acaattacccgcaaacacgt

SEQ ID NO: 15609 - DNA, 18 bp, Artificial Sequence
  Synthetic
ccacaacaaccgcatcct

SEQ ID NO: 15610 - DNA, 20 bp, Artificial Sequence
  Synthetic
tatcgcgacgacttccatca

SEQ ID NO: 15611 - DNA, 16 bp, Artificial Sequence
  Synthetic
cgttggaacaggcgca

SEQ ID NO: 15612 - DNA, 20 bp, Artificial Sequence
  Synthetic
ggcaaatgtggcgacatagc

SEQ ID NO: 15613 - DNA, 19 bp, Artificial Sequence
  Synthetic
aactcaaacaggttgcggg

SEQ ID NO: 15614 - DNA, 18 bp, Artificial Sequence
  Synthetic
ggtcaaactcgaaggcgg

SEQ ID NO: 15615 - DNA, 16 bp, Artificial Sequence
  Synthetic
cagtgggcgaacgggt

SEQ ID NO: 15616 - DNA, 17 bp, Artificial Sequence
  Synthetic
ccgcagggattacgcca

SEQ ID NO: 15617 - DNA, 19 bp, Artificial Sequence
  Synthetic
ggcaggattttatgtgctg

SEQ ID NO: 15618 - DNA, 18 bp, Artificial Sequence
  Synthetic
tgtgatgaatgtcgcgca

SEQ ID NO: 15619 - DNA, 17 bp, Artificial Sequence
  Synthetic
cgcgaacatcatgcccg

SEQ ID NO: 15620 - DNA, 20 bp, Artificial Sequence
  Synthetic
cgatgtagtaggcgtgttcc

SEQ ID NO: 15621 - DNA, 18 bp, Artificial Sequence
  Synthetic
gggtaagaaggaacaggg

SEQ ID NO: 15622 - DNA, 18 bp, Artificial Sequence
  Synthetic
ttccgatacctttgcgcc

SEQ ID NO: 15623 - DNA, 19 bp, Artificial Sequence
  Synthetic
caatcggggtctgacaggt

SEQ ID NO: 15624 - DNA, 19 bp, Artificial Sequence
  Synthetic
ataagcggtttcgggatgg

SEQ ID NO: 15625 - DNA, 19 bp, Artificial Sequence
  Synthetic
gatggtacagaccgtgcgc

SEQ ID NO: 15626 - DNA, 16 bp, Artificial Sequence
  Synthetic
cggttgccaagcgtcc

SEQ ID NO: 15627 - DNA, 18 bp, Artificial Sequence
  Synthetic
ggacggtcgcagaaaagc

SEQ ID NO: 15628 - DNA, 16 bp, Artificial Sequence
  Synthetic
gcctgtggacgcaacc

SEQ ID NO: 15629 - DNA, 16 bp, Artificial Sequence
  Synthetic
ggcgcggttgccgtat

SEQ ID NO: 15630 - DNA, 16 bp, Artificial Sequence
  Synthetic
ccgcaacaagaggccg

SEQ ID NO: 15631 - DNA, 17 bp, Artificial Sequence
  Synthetic
gtccttgaccgcgaacc

SEQ ID NO: 15632 - DNA, 21 bp, Artificial Sequence
  Synthetic
aaaacgctaatcataagaggg

SEQ ID NO: 15633 - DNA, 17 bp, Artificial Sequence
  Synthetic
caggcatcgggagggat

SEQ ID NO: 15634 - DNA, 16 bp, Artificial Sequence
  Synthetic
cgcggcaggggttgtt

SEQ ID NO: 15635 - DNA, 19 bp, Artificial Sequence
  Synthetic
ccgcctgaaagaatcccat

SEQ ID NO: 15636 - DNA, 18 bp, Artificial Sequence
  Synthetic
cgagatgcacggctcaaa

SEQ ID NO: 15637 - DNA, 19 bp, Artificial Sequence
  Synthetic
gttccgcccgaaaatctgc

SEQ ID NO: 15638 - DNA, 19 bp, Artificial Sequence
  Synthetic
gcaggacaatccgaacctg

SEQ ID NO: 15639 - DNA, 20 bp, Artificial Sequence
  Synthetic
gacgatttcttcctcagcgt

SEQ ID NO: 15640 - DNA, 20 bp, Artificial Sequence
  Synthetic
tcgatacgaacgtccgttac

SEQ ID NO: 15641 - DNA, 20 bp, Artificial Sequence
  Synthetic
tcggcaacatgaacgaagtg

SEQ ID NO: 15642 - DNA, 18 bp, Artificial Sequence
  Synthetic
cgcccgattacaggcttg

SEQ ID NO: 15643 - DNA, 20 bp, Artificial Sequence
  Synthetic
tgacgtgaaatccgacatcg

SEQ ID NO: 15644 - DNA, 18 bp, Artificial Sequence
  Synthetic
cctgacggctggttttcg

SEQ ID NO: 15645 - DNA, 18 bp, Artificial Sequence
  Synthetic
tgggcgtggaaatttcgg

SEQ ID NO: 15646 - DNA, 16 bp, Artificial Sequence
  Synthetic
cgtcgaggcagtccga

SEQ ID NO: 15647 - DNA, 19 bp, Artificial Sequence
  Synthetic
ttatcgtgaatgccgaccg

SEQ ID NO: 15648 - DNA, 17 bp, Artificial Sequence
  Synthetic
ttgccttgtgttgccgt

SEQ ID NO: 15649 - DNA, 19 bp, Artificial Sequence
  Synthetic
ggggtcgaaggcaagatgg

SEQ ID NO: 15650 - DNA, 17 bp, Artificial Sequence
  Synthetic
ggactggtatcgcgcca

SEQ ID NO: 15651 - DNA, 16 bp, Artificial Sequence
  Synthetic
ccggcgcgtggcaata

SEQ ID NO: 15652 - DNA, 17 bp, Artificial Sequence
  Synthetic
cgatgtgattcgggcgg

SEQ ID NO: 15653 - DNA, 17 bp, Artificial Sequence
  Synthetic
ttcacgaagccgatgcc

SEQ ID NO: 15654 - DNA, 16 bp, Artificial Sequence
  Synthetic
acgcatcgcacttgcc

SEQ ID NO: 15655 - DNA, 18 bp, Artificial Sequence
  Synthetic
cccgattcttgccgttgc

SEQ ID NO: 15656 - DNA, 18 bp, Artificial Sequence
  Synthetic
gcggcaggcatattgagg

SEQ ID NO: 15657 - DNA, 16 bp, Artificial Sequence
  Synthetic
cggcgggaaaatgcgc

SEQ ID NO: 15658 - DNA, 18 bp, Artificial Sequence
  Synthetic
caagcactgccatcaccg

SEQ ID NO: 15659 - DNA, 21 bp, Artificial Sequence
  Synthetic
ctagatcgtcaaagtttagca

SEQ ID NO: 15660 - DNA, 18 bp, Artificial Sequence
  Synthetic
cggcgagattctgaactt

SEQ ID NO: 15661 - DNA, 17 bp, Artificial Sequence
  Synthetic
acaataccgccaagccg

SEQ ID NO: 15662 - DNA, 16 bp, Artificial Sequence
  Synthetic
cgccacgcgttttcgg

SEQ ID NO: 15663 - DNA, 16 bp, Artificial Sequence
  Synthetic
tgccttgtccgagccg

SEQ ID NO: 15664 - DNA, 16 bp, Artificial Sequence
  Synthetic
gcagcatcgcggtgga

SEQ ID NO: 15665 - DNA, 20 bp, Artificial Sequence
  Synthetic
atctgtggcgcatcaaaacc

SEQ ID NO: 15666 - DNA, 17 bp, Artificial Sequence
  Synthetic
gcacaaggtgcggcagt

SEQ ID NO: 15667 - DNA, 19 bp, Artificial Sequence
  Synthetic
gcgttgacgtgatccatcg

SEQ ID NO: 15668 - DNA, 20 bp, Artificial Sequence
  Synthetic
gaaaacgctgcaaaatgaac

SEQ ID NO: 15669 - DNA, 20 bp, Artificial Sequence
  Synthetic
atacacccaaagccacttcc

SEQ ID NO: 15670 - DNA, 16 bp, Artificial Sequence
  Synthetic
tcggcctggatgtggc

SEQ ID NO: 15671 - DNA, 20 bp, Artificial Sequence
  Synthetic
aaagtcgaaaacgtcgtgcg

SEQ ID NO: 15672 - DNA, 18 bp, Artificial Sequence
  Synthetic
gaagaggtcagcgcgatg

SEQ ID NO: 15673 - DNA, 18 bp, Artificial Sequence
  Synthetic
gccgcgatttgttcatcg

SEQ ID NO: 15674 - DNA, 17 bp, Artificial Sequence
  Synthetic
gacaccatcgagcagcg

SEQ ID NO: 15675 - DNA, 16 bp, Artificial Sequence
  Synthetic
agtgtccctcgtcgcc

SEQ ID NO: 15676 - DNA, 19 bp, Artificial Sequence
  Synthetic
ttgaccgaatgctgcatca

SEQ ID NO: 15677 - DNA, 16 bp, Artificial Sequence
  Synthetic
gacggcatcgacgtgg

SEQ ID NO: 15678 - DNA, 16 bp, Artificial Sequence
  Synthetic
cgcggtacaccacgct

SEQ ID NO: 15679 - DNA, 18 bp, Artificial Sequence
  Synthetic
acagaaagccggtgtgga

SEQ ID NO: 15680 - DNA, 17 bp, Artificial Sequence
  Synthetic
cgccggagagtgcaatc

SEQ ID NO: 15681 - DNA, 20 bp, Artificial Sequence
  Synthetic
tttgtaggcaataagcgcgg

SEQ ID NO: 15682 - DNA, 16 bp, Artificial Sequence
  Synthetic
ccggcggcagcagttt

SEQ ID NO: 15683 - DNA, 18 bp, Artificial Sequence
  Synthetic
cctgacggtcttcagccc

SEQ ID NO: 15684 - DNA, 19 bp, Artificial Sequence
  Synthetic
gggaacatctttgaccagt

SEQ ID NO: 15685 - DNA, 21 bp, Artificial Sequence
  Synthetic
ttgagcgtttttgaattcagc

SEQ ID NO: 15686 - DNA, 16 bp, Artificial Sequence
  Synthetic
cctgcgcgagtgttgc

SEQ ID NO: 15687 - DNA, 19 bp, Artificial Sequence
  Synthetic
gttcaggttgttgaggcgt

SEQ ID NO: 15688 - DNA, 16 bp, Artificial Sequence
  Synthetic
gcggtattgacggcgg

SEQ ID NO: 15689 - DNA, 19 bp, Artificial Sequence
  Synthetic
cgacctgcatcatttcgcc

SEQ ID NO: 15690 - DNA, 18 bp, Artificial Sequence
  Synthetic
gggaaatcggcgaaacgg

SEQ ID NO: 15691 - DNA, 15 bp, Artificial Sequence
  Synthetic
ttcggcggctttgcg

SEQ ID NO: 15692 - DNA, 16 bp, Artificial Sequence
  Synthetic
ccccgccaaaaacggc

SEQ ID NO: 15693 - DNA, 20 bp, Artificial Sequence
  Synthetic
ttccgaagatgaagttgccg

SEQ ID NO: 15694 - DNA, 20 bp, Artificial Sequence
  Synthetic
ttgttttcggtaatgctgcg

SEQ ID NO: 15695 - DNA, 16 bp, Artificial Sequence
  Synthetic
cgttggagggcgacga

SEQ ID NO: 15696 - DNA, 19 bp, Artificial Sequence
  Synthetic
cgttgatggtgtcggtgag

SEQ ID NO: 15697 - DNA, 18 bp, Artificial Sequence
  Synthetic
tcttcggtggtcatgcgg

SEQ ID NO: 15698 - DNA, 17 bp, Artificial Sequence
  Synthetic
cgccgagtttcagcgtg

SEQ ID NO: 15699 - DNA, 21 bp, Artificial Sequence
  Synthetic
catagtaacggatgtggaaag

SEQ ID NO: 15700 - DNA, 16 bp, Artificial Sequence
  Synthetic
gcaaactgcccacgcc

SEQ ID NO: 15701 - DNA, 20 bp, Artificial Sequence
  Synthetic
gaacaagcctgttttcctgc

SEQ ID NO: 15702 - DNA, 18 bp, Artificial Sequence
  Synthetic
acaaattcacacgggcgg

SEQ ID NO: 15703 - DNA, 20 bp, Artificial Sequence
  Synthetic
gctttatcaggcgatggagg

SEQ ID NO: 15704 - DNA, 20 bp, Artificial Sequence
  Synthetic
gtatcggcatcgttaccagt

SEQ ID NO: 15705 - DNA, 17 bp, Artificial Sequence
  Synthetic
gattgtctgtcgcggcg

SEQ ID NO: 15706 - DNA, 18 bp, Artificial Sequence
  Synthetic
atcatcggcttctgcgtg

SEQ ID NO: 15707 - DNA, 19 bp, Artificial Sequence
  Synthetic
cgccatatccgacgcttac

SEQ ID NO: 15708 - DNA, 18 bp, Artificial Sequence
  Synthetic
ggcgtttaccggttcgac

SEQ ID NO: 15709 - DNA, 17 bp, Artificial Sequence
  Synthetic
cgtttcaaacggcgcgg

SEQ ID NO: 15710 - DNA, 16 bp, Artificial Sequence
  Synthetic
gagcagggcgcatcga

SEQ ID NO: 15711 - DNA, 18 bp, Artificial Sequence
  Synthetic
gcacgatggaagcaggaa

SEQ ID NO: 15712 - DNA, 15 bp, Artificial Sequence
  Synthetic
ttggcggcctgcagt

SEQ ID NO: 15713 - DNA, 19 bp, Artificial Sequence
  Synthetic
tccgtatctggttaaacgg

SEQ ID NO: 15714 - DNA, 19 bp, Artificial Sequence
  Synthetic
agggtcagtccgatttcgt

SEQ ID NO: 15715 - DNA, 19 bp, Artificial Sequence
  Synthetic
tcttcggtcaacacgatgg

SEQ ID NO: 15716 - DNA, 20 bp, Artificial Sequence
  Synthetic
atatattcgagtgcgcgctc

SEQ ID NO: 15717 - DNA, 17 bp, Artificial Sequence
  Synthetic
tcgccatcgtgtgttcg

SEQ ID NO: 15718 - DNA, 20 bp, Artificial Sequence
  Synthetic
tttggcaatccttttacgcg

SEQ ID NO: 15719 - DNA, 18 bp, Artificial Sequence
  Synthetic
cggcaggcgttttctacc

SEQ ID NO: 15720 - DNA, 19 bp, Artificial Sequence
  Synthetic
gaccaaatccgcctgtacg

SEQ ID NO: 15721 - DNA, 17 bp, Artificial Sequence
  Synthetic
ccgggtcggtatggaca

SEQ ID NO: 15722 - DNA, 16 bp, Artificial Sequence
  Synthetic
cggtggaaggcgggaa

SEQ ID NO: 15723 - DNA, 18 bp, Artificial Sequence
  Synthetic
cgcgccgtctgaaaatcc

SEQ ID NO: 15724 - DNA, 16 bp, Artificial Sequence
  Synthetic
gccgccgccaaatcca

SEQ ID NO: 15725 - DNA, 17 bp, Artificial Sequence
  Synthetic
ggtgtggtgcaggagga

SEQ ID NO: 15726 - DNA, 16 bp, Artificial Sequence
  Synthetic
gcatacgcgccatcgt

SEQ ID NO: 15727 - DNA, 19 bp, Artificial Sequence
  Synthetic
atcgattcaaaacactggc

SEQ ID NO: 15728 - DNA, 18 bp, Artificial Sequence
  Synthetic
aacccaaactcaaagcca

SEQ ID NO: 15729 - DNA, 16 bp, Artificial Sequence
  Synthetic
ccccggcaggagcatt

SEQ ID NO: 15730 - DNA, 18 bp, Artificial Sequence
  Synthetic
cggctttgtgcagattgc

SEQ ID NO: 15731 - DNA, 18 bp, Artificial Sequence
  Synthetic
tgagcgacgctttaccga

SEQ ID NO: 15732 - DNA, 19 bp, Artificial Sequence
  Synthetic
agagggctttgagcatcgc

SEQ ID NO: 15733 - DNA, 17 bp, Artificial Sequence
  Synthetic
ggaagccggcgaagagt

SEQ ID NO: 15734 - DNA, 16 bp, Artificial Sequence
  Synthetic
tcagggcttcgggcgt

SEQ ID NO: 15735 - DNA, 19 bp, Artificial Sequence
  Synthetic
cgacgcagataaaatcgcg

SEQ ID NO: 15736 - DNA, 20 bp, Artificial Sequence
  Synthetic
cactcttggggtcctgaagc

SEQ ID NO: 15737 - DNA, 18 bp, Artificial Sequence
  Synthetic
gcgctcaaacctttcggt

SEQ ID NO: 15738 - DNA, 18 bp, Artificial Sequence
  Synthetic
cacccccatcgacctgat

SEQ ID NO: 15739 - DNA, 20 bp, Artificial Sequence
  Synthetic
tttccgatagattcctgccg

SEQ ID NO: 15740 - DNA, 18 bp, Artificial Sequence
  Synthetic
cggtcggctttttcctgc

SEQ ID NO: 15741 - DNA, 20 bp, Artificial Sequence
  Synthetic
tgaacaggatgttgcggatg

SEQ ID NO: 15742 - DNA, 16 bp, Artificial Sequence
  Synthetic
cgacacgctcgtccgt

SEQ ID NO: 15743 - DNA, 16 bp, Artificial Sequence
  Synthetic
cggcgggggtttctgt

SEQ ID NO: 15744 - DNA, 17 bp, Artificial Sequence
  Synthetic
caaggatgcgggcgatg

SEQ ID NO: 15745 - DNA, 18 bp, Artificial Sequence
  Synthetic
ttgctgacgctttcggtc

SEQ ID NO: 15746 - DNA, 18 bp, Artificial Sequence
  Synthetic
aggtgtcagtgcgttgtg

SEQ ID NO: 15747 - DNA, 19 bp, Artificial Sequence
  Synthetic
gcagcccgcatgtttttcc

SEQ ID NO: 15748 - DNA, 19 bp, Artificial Sequence
  Synthetic
acgccgttgtttttcacgt

SEQ ID NO: 15749 - DNA, 20 bp, Artificial Sequence
  Synthetic
cgaaacgttttttgcagcgg

SEQ ID NO: 15750 - DNA, 17 bp, Artificial Sequence
  Synthetic
cagacgcgttcggcaac

SEQ ID NO: 15751 - DNA, 17 bp, Artificial Sequence
  Synthetic
gcttcggcgacaacagc

SEQ ID NO: 15752 - DNA, 21 bp, Artificial Sequence
  Synthetic
agccgtattgtttcatcatct

SEQ ID NO: 15753 - DNA, 18 bp, Artificial Sequence
  Synthetic
cgcttcgattacggcgtt

SEQ ID NO: 15754 - DNA, 18 bp, Artificial Sequence
  Synthetic
ttggacatcgcgcattgg

SEQ ID NO: 15755 - DNA, 18 bp, Artificial Sequence
  Synthetic
gtaggggaggttgttctg

SEQ ID NO: 15756 - DNA, 22 bp, Artificial Sequence
  Synthetic
tatcggataacatctccttcaa

SEQ ID NO: 15757 - DNA, 24 bp, Artificial Sequence
  Synthetic
aagtaatcattaaattcggatccg

SEQ ID NO: 15758 - DNA, 19 bp, Artificial Sequence
  Synthetic
caaatgtgggtgacaatcg

SEQ ID NO: 15759 - DNA, 19 bp, Artificial Sequence
  Synthetic
attgggtatctaggccact

SEQ ID NO: 15760 - DNA, 23 bp, Artificial Sequence
  Synthetic
ttgaaaccacttctgatttacct

SEQ ID NO: 15761 - DNA, 21 bp, Artificial Sequence
  Synthetic
tcctgattcatttttctctgg

SEQ ID NO: 15762 - DNA, 19 bp, Artificial Sequence
  Synthetic
ctccaaagtaatcggttcg

SEQ ID NO: 15763 - DNA, 18 bp, Artificial Sequence
  Synthetic
cacgccaaatcgcaaggt

SEQ ID NO: 15764 - DNA, 16 bp, Artificial Sequence
  Synthetic
cctccgcgctgatgca

SEQ ID NO: 15765 - DNA, 18 bp, Artificial Sequence
  Synthetic
cgtgcgttgggtcaaaga

SEQ ID NO: 15766 - DNA, 19 bp, Artificial Sequence
  Synthetic
ctgaccgccattcacaacg

SEQ ID NO: 15767 - DNA, 18 bp, Artificial Sequence
  Synthetic
taccaaggccgctcgtac

SEQ ID NO: 15768 - DNA, 16 bp, Artificial Sequence
  Synthetic
cgtccgccaagatgcc

SEQ ID NO: 15769 - DNA, 17 bp, Artificial Sequence
  Synthetic
ggacgcgataccgacga

SEQ ID NO: 15770 - DNA, 18 bp, Artificial Sequence
  Synthetic
gcctgaacatccccacca

SEQ ID NO: 15771 - DNA, 16 bp, Artificial Sequence
  Synthetic
gacctgcggctcgtgt

SEQ ID NO: 15772 - DNA, 20 bp, Artificial Sequence
  Synthetic
gtcttattcggcaacatcgc

SEQ ID NO: 15773 - DNA, 17 bp, Artificial Sequence
  Synthetic
gggcggacttcatcgtg

SEQ ID NO: 15774 - DNA, 20 bp, Artificial Sequence
  Synthetic
ggaaacgccgaaattttccg

SEQ ID NO: 15775 - DNA, 20 bp, Artificial Sequence
  Synthetic
tccgaaccgtctttctgtgc

SEQ ID NO: 15776 - DNA, 20 bp, Artificial Sequence
  Synthetic
atgtccaacaagaaatgcgc

SEQ ID NO: 15777 - DNA, 20 bp, Artificial Sequence
  Synthetic
acatcggatgctcttccaga

SEQ ID NO: 15778 - DNA, 17 bp, Artificial Sequence
  Synthetic
tgtccaactcgagggcg

SEQ ID NO: 15779 - DNA, 20 bp, Artificial Sequence
  Synthetic
ggtctgaccgtctttgaagg

SEQ ID NO: 15780 - DNA, 18 bp, Artificial Sequence
  Synthetic
cgacaaacgtgccttccg

SEQ ID NO: 15781 - DNA, 18 bp, Artificial Sequence
  Synthetic
tccaaatcaaacgcgccc

SEQ ID NO: 15782 - DNA, 18 bp, Artificial Sequence
  Synthetic
cgtctgaacaccctcccg

SEQ ID NO: 15783 - DNA, 17 bp, Artificial Sequence
  Synthetic
catcgcttttgccgccg

SEQ ID NO: 15784 - DNA, 17 bp, Artificial Sequence
  Synthetic
gcacggacagggatcgt

SEQ ID NO: 15785 - DNA, 18 bp, Artificial Sequence
  Synthetic
cgaccaaccgaccgattc

SEQ ID NO: 15786 - DNA, 16 bp, Artificial Sequence
  Synthetic
ggcgcaacggccttac

SEQ ID NO: 15787 - DNA, 19 bp, Artificial Sequence
  Synthetic
gctttggcactgaaaagcg

SEQ ID NO: 15788 - DNA, 18 bp, Artificial Sequence
  Synthetic
tcgcctcgggattgaaca

SEQ ID NO: 15789 - DNA, 19 bp, Artificial Sequence
  Synthetic
ctatctgaagtccgagcgc

SEQ ID NO: 15790 - DNA, 19 bp, Artificial Sequence
  Synthetic
aaaactgtacagcaggcgc

SEQ ID NO: 15791 - DNA, 20 bp, Artificial Sequence
  Synthetic
ttttcgtcatccgttaccgc

SEQ ID NO: 15792 - DNA, 20 bp, Artificial Sequence
  Synthetic
cctactggtacatcgacacg

SEQ ID NO: 15793 - DNA, 18 bp, Artificial Sequence
  Synthetic
cccgaacacctgcaacaa

SEQ ID NO: 15794 - DNA, 20 bp, Artificial Sequence
  Synthetic
aaaaccgttcgttacctccg

SEQ ID NO: 15795 - DNA, 18 bp, Artificial Sequence
  Synthetic
gcgacaaataccccgttt

SEQ ID NO: 15796 - DNA, 20 bp, Artificial Sequence
  Synthetic
tcgtttatgctgatccctcg

SEQ ID NO: 15797 - DNA, 20 bp, Artificial Sequence
  Synthetic
ttcaatatagccaaggggat

SEQ ID NO: 15798 - DNA, 18 bp, Artificial Sequence
  Synthetic
gcgactgcgtgtccattg

SEQ ID NO: 15799 - DNA, 18 bp, Artificial Sequence
  Synthetic
tcgtcaacagcgtcgtcg

SEQ ID NO: 15800 - DNA, 17 bp, Artificial Sequence
  Synthetic
cacgcgctgaaggaggt

SEQ ID NO: 15801 - DNA, 17 bp, Artificial Sequence
  Synthetic
attgccgggaaacacgc

SEQ ID NO: 15802 - DNA, 18 bp, Artificial Sequence
  Synthetic
actgcccaaaagcgtacc

SEQ ID NO: 15803 - DNA, 18 bp, Artificial Sequence
  Synthetic
gttctttggcggcttcgt

SEQ ID NO: 15804 - DNA, 19 bp, Artificial Sequence
  Synthetic
gcggcgattatcatctgca

SEQ ID NO: 15805 - DNA, 18 bp, Artificial Sequence
  Synthetic
aaaatcggtgcggacgtg

SEQ ID NO: 15806 - DNA, 18 bp, Artificial Sequence
  Synthetic
atgagtccgaggctgtgg

SEQ ID NO: 15807 - DNA, 16 bp, Artificial Sequence
  Synthetic
gccattgcaggcggtt

SEQ ID NO: 15808 - DNA, 16 bp, Artificial Sequence
  Synthetic
ttgccgatgttgccgc

SEQ ID NO: 15809 - DNA, 16 bp, Artificial Sequence
  Synthetic
cgagtatggtggcgcg

SEQ ID NO: 15810 - DNA, 20 bp, Artificial Sequence
  Synthetic
tggtgttccaaagcagtacc

SEQ ID NO: 15811 - DNA, 20 bp, Artificial Sequence
  Synthetic
tgtattcctgatttccggcc

SEQ ID NO: 15812 - DNA, 23 bp, Artificial Sequence
  Synthetic
ctttgttatcgacttcaatttgg

SEQ ID NO: 15813 - DNA, 17 bp, Artificial Sequence
  Synthetic
gcgccgcataacctctt

SEQ ID NO: 15814 - DNA, 19 bp, Artificial Sequence
  Synthetic
agcagtagggtcatcaggc

SEQ ID NO: 15815 - DNA, 16 bp, Artificial Sequence
  Synthetic
gacagccagcgcatcg

SEQ ID NO: 15816 - DNA, 17 bp, Artificial Sequence
  Synthetic
tcgccctgatagccgtc

SEQ ID NO: 15817 - DNA, 18 bp, Artificial Sequence
  Synthetic
gatatgggcggcgagtcc

SEQ ID NO: 15818 - DNA, 16 bp, Artificial Sequence
  Synthetic
ggggcgaacaacaccg

SEQ ID NO: 15819 - DNA, 16 bp, Artificial Sequence
  Synthetic
tgctctgcggcggaca

SEQ ID NO: 15820 - DNA, 19 bp, Artificial Sequence
  Synthetic
ttgaacccgtataccaacc

SEQ ID NO: 15821 - DNA, 20 bp, Artificial Sequence
  Synthetic
cggtagctaagacgacgtcc

SEQ ID NO: 15822 - DNA, 16 bp, Artificial Sequence
  Synthetic
catttcgcgcgcaccc

SEQ ID NO: 15823 - DNA, 16 bp, Artificial Sequence
  Synthetic
acctcttcgcgacgct

SEQ ID NO: 15824 - DNA, 20 bp, Artificial Sequence
  Synthetic
acgagcaaatgaaactggcg

SEQ ID NO: 15825 - DNA, 20 bp, Artificial Sequence
  Synthetic
cggaatcgtacaggaagacg

SEQ ID NO: 15826 - DNA, 16 bp, Artificial Sequence
  Synthetic
cgcgtggcaggaacac

SEQ ID NO: 15827 - DNA, 15 bp, Artificial Sequence
  Synthetic
aaaaggccgcgctcg

SEQ ID NO: 15828 - DNA, 20 bp, Artificial Sequence
  Synthetic
gaaactggtcgaatgcaacg

SEQ ID NO: 15829 - DNA, 18 bp, Artificial Sequence
  Synthetic
gatgcgcgtttcggcata

SEQ ID NO: 15830 - DNA, 19 bp, Artificial Sequence
  Synthetic
cgtatccgcactacctcgc

SEQ ID NO: 15831 - DNA, 16 bp, Artificial Sequence
  Synthetic
ggctgctgctgtccct

SEQ ID NO: 15832 - DNA, 18 bp, Artificial Sequence
  Synthetic
tttcgcaccctcttccgt

SEQ ID NO: 15833 - DNA, 18 bp, Artificial Sequence
  Synthetic
ccaaggcttcgatgaaga

SEQ ID NO: 15834 - DNA, 16 bp, Artificial Sequence
  Synthetic
tcagacggcaggcagc

SEQ ID NO: 15835 - DNA, 20 bp, Artificial Sequence
  Synthetic
ccgatttgcacaaattaacc

SEQ ID NO: 15836 - DNA, 21 bp, Artificial Sequence
  Synthetic
atttcggatttaattgacccg

SEQ ID NO: 15837 - DNA, 18 bp, Artificial Sequence
  Synthetic
gcgatgaagcgtgggatt

SEQ ID NO: 15838 - DNA, 21 bp, Artificial Sequence
  Synthetic
ctaccattgatattgtgtgct

SEQ ID NO: 15839 - DNA, 19 bp, Artificial Sequence
  Synthetic
aatttgggcaaagaccccg

SEQ ID NO: 15840 - DNA, 24 bp, Artificial Sequence
  Synthetic
tctttgattgataatggtgaaacg

SEQ ID NO: 15841 - DNA, 19 bp, Artificial Sequence
  Synthetic
aaacaattactggcgtgtc

SEQ ID NO: 15842 - DNA, 18 bp, Artificial Sequence
  Synthetic
aaagggatacgcaaccat

SEQ ID NO: 15843 - DNA, 16 bp, Artificial Sequence
  Synthetic
cgccgtactgctggct

SEQ ID NO: 15844 - DNA, 16 bp, Artificial Sequence
  Synthetic
acaccgacgctgacct

SEQ ID NO: 15845 - DNA, 19 bp, Artificial Sequence
  Synthetic
aatatttccgttgccgtcc

SEQ ID NO: 15846 - DNA, 20 bp, Artificial Sequence
  Synthetic
tatctgccagttttccttgt

SEQ ID NO: 15847 - DNA, 17 bp, Artificial Sequence
  Synthetic
ccgaaatgcgtaccggc

SEQ ID NO: 15848 - DNA, 16 bp, Artificial Sequence
  Synthetic
ggctcgcccgaatcca

SEQ ID NO: 15849 - DNA, 21 bp, Artificial Sequence
  Synthetic
ttgttttgcagtaaatcgaga

SEQ ID NO: 15850 - DNA, 19 bp, Artificial Sequence
  Synthetic
ttgtcctttgtaagcggcg

SEQ ID NO: 15851 - DNA, 20 bp, Artificial Sequence
  Synthetic
aagcagtcgaaaatcaggcg

SEQ ID NO: 15852 - DNA, 20 bp, Artificial Sequence
  Synthetic
aaggtcgaaatcgccaaacg

SEQ ID NO: 15853 - DNA, 18 bp, Artificial Sequence
  Synthetic
tcggggaatcagaagcgg

SEQ ID NO: 15854 - DNA, 19 bp, Artificial Sequence
  Synthetic
tgacgaaagaggcggaaca

SEQ ID NO: 15855 - DNA, 18 bp, Artificial Sequence
  Synthetic
gccgtgtcaagatggaaa

SEQ ID NO: 15856 - DNA, 16 bp, Artificial Sequence
  Synthetic
tgcagacggcggaaca

SEQ ID NO: 15857 - DNA, 18 bp, Artificial Sequence
  Synthetic
gtcgagaccgcctgtttc

SEQ ID NO: 15858 - DNA, 20 bp, Artificial Sequence
  Synthetic
aatcggcgagatttccatcg

SEQ ID NO: 15859 - DNA, 17 bp, Artificial Sequence
  Synthetic
cgtaccacgctgctgac

SEQ ID NO: 15860 - DNA, 20 bp, Artificial Sequence
  Synthetic
ccgtcctattatgtccgtcg

SEQ ID NO: 15861 - DNA, 18 bp, Artificial Sequence
  Synthetic
cgtatcggacgggttgga

SEQ ID NO: 15862 - DNA, 16 bp, Artificial Sequence
  Synthetic
gtgctcctggcgcaga

SEQ ID NO: 15863 - DNA, 18 bp, Artificial Sequence
  Synthetic
acgcttggaaaacacccg

SEQ ID NO: 15864 - DNA, 20 bp, Artificial Sequence
  Synthetic
atctcgaaacccgtcattcc

SEQ ID NO: 15865 - DNA, 16 bp, Artificial Sequence
  Synthetic
gcccgcctgagcaaca

SEQ ID NO: 15866 - DNA, 19 bp, Artificial Sequence
  Synthetic
cgaagaaaaccacctgcgt

SEQ ID NO: 15867 - DNA, 16 bp, Artificial Sequence
  Synthetic
ggaagctgcccgaagc

SEQ ID NO: 15868 - DNA, 16 bp, Artificial Sequence
  Synthetic
gccgccgtttcccgtt

SEQ ID NO: 15869 - DNA, 20 bp, Artificial Sequence
  Synthetic
aaggaaccaccgtatccaca

SEQ ID NO: 15870 - DNA, 17 bp, Artificial Sequence
  Synthetic
gcgcgataatcggcagg

SEQ ID NO: 15871 - DNA, 16 bp, Artificial Sequence
  Synthetic
acgtccagcggcgtca

SEQ ID NO: 15872 - DNA, 19 bp, Artificial Sequence
  Synthetic
gccgcatagtcaaaatgcc

SEQ ID NO: 15873 - DNA, 16 bp, Artificial Sequence
  Synthetic
ccgcagcaattcccgc

SEQ ID NO: 15874 - DNA, 19 bp, Artificial Sequence
  Synthetic
ccctcataaaaccgctgcc

SEQ ID NO: 15875 - DNA, 20 bp, Artificial Sequence
  Synthetic
aaccaccaccagataatcgc

SEQ ID NO: 15876 - DNA, 19 bp, Artificial Sequence
  Synthetic
tcgcatcctcctccttcaa

SEQ ID NO: 15877 - DNA, 19 bp, Artificial Sequence
  Synthetic
gccaccagcgtgattttgc

SEQ ID NO: 15878 - DNA, 15 bp, Artificial Sequence
  Synthetic
aatccgccgccgcat

SEQ ID NO: 15879 - DNA, 20 bp, Artificial Sequence
  Synthetic
taagcctgtccaacacatcc

SEQ ID NO: 15880 - DNA, 19 bp, Artificial Sequence
  Synthetic
caaaccccaccgcagaatg

SEQ ID NO: 15881 - DNA, 17 bp, Artificial Sequence
  Synthetic
gcggcagggatttgacc

SEQ ID NO: 15882 - DNA, 16 bp, Artificial Sequence
  Synthetic
caccgtgcgccctgtt

SEQ ID NO: 15883 - DNA, 20 bp, Artificial Sequence
  Synthetic
caacacggttgtttcagggt

SEQ ID NO: 15884 - DNA, 19 bp, Artificial Sequence
  Synthetic
gtatcacgcgcattcccct

SEQ ID NO: 15885 - DNA, 20 bp, Artificial Sequence
  Synthetic
acggcgtagttttcaatccg

SEQ ID NO: 15886 - DNA, 17 bp, Artificial Sequence
  Synthetic
tcaacggcgcggattcg

SEQ ID NO: 15887 - DNA, 16 bp, Artificial Sequence
  Synthetic
cgccggccgatgatga

SEQ ID NO: 15888 - DNA, 20 bp, Artificial Sequence
  Synthetic
tccactccgaatgtctgacg

SEQ ID NO: 15889 - DNA, 16 bp, Artificial Sequence
  Synthetic
cgtgccggggttctca

SEQ ID NO: 15890 - DNA, 21 bp, Artificial Sequence
  Synthetic
atactggaatttctgcgtttg

SEQ ID NO: 15891 - DNA, 18 bp, Artificial Sequence
  Synthetic
tttggtggcggaggaaac

SEQ ID NO: 15892 - DNA, 19 bp, Artificial Sequence
  Synthetic
tggtcaggaacaatgcctg

SEQ ID NO: 15893 - DNA, 19 bp, Artificial Sequence
  Synthetic
ataaggcgtggcagaagga

SEQ ID NO: 15894 - DNA, 20 bp, Artificial Sequence
  Synthetic
agagatggttaacgaaggcg

SEQ ID NO: 15895 - DNA, 19 bp, Artificial Sequence
  Synthetic
gccacatcgacatccaaga

SEQ ID NO: 15896 - DNA, 19 bp, Artificial Sequence
  Synthetic
agctcgttaccgaacagct

SEQ ID NO: 15897 - DNA, 18 bp, Artificial Sequence
  Synthetic
gccgtttaccgcaacaac

SEQ ID NO: 15898 - DNA, 19 bp, Artificial Sequence
  Synthetic
gtatccatcccgattcggc

SEQ ID NO: 15899 - DNA, 19 bp, Artificial Sequence
  Synthetic
ttacctctacacggacggc

SEQ ID NO: 15900 - DNA, 23 bp, Artificial Sequence
  Synthetic
gatgtttcaaatttcgaagatgt

SEQ ID NO: 15901 - DNA, 19 bp, Artificial Sequence
  Synthetic
tagctacccggctatgcaa

SEQ ID NO: 15902 - DNA, 16 bp, Artificial Sequence
  Synthetic
cttttcctgccgcgcc

SEQ ID NO: 15903 - DNA, 16 bp, Artificial Sequence
  Synthetic
aacgctcaaaccgccg

SEQ ID NO: 15904 - DNA, 15 bp, Artificial Sequence
  Synthetic
gccatcgcgccgttt

SEQ ID NO: 15905 - DNA, 18 bp, Artificial Sequence
  Synthetic
ccctgaaatcgaacgccg

SEQ ID NO: 15906 - DNA, 20 bp, Artificial Sequence
  Synthetic
cttcctgattaccatcggcg

SEQ ID NO: 15907 - DNA, 18 bp, Artificial Sequence
  Synthetic
tcaacagtggcgcgaaac

SEQ ID NO: 15908 - DNA, 16 bp, Artificial Sequence
  Synthetic
gcggcggcttcagcta

SEQ ID NO: 15909 - DNA, 16 bp, Artificial Sequence
  Synthetic
ggcagcgttacgggca

SEQ ID NO: 15910 - DNA, 20 bp, Artificial Sequence
  Synthetic
ggtctggtcggacagattgc

SEQ ID NO: 15911 - DNA, 17 bp, Artificial Sequence
  Synthetic
tctacaccgcccaagca

SEQ ID NO: 15912 - DNA, 18 bp, Artificial Sequence
  Synthetic
ggcacgttctaccaaggc

SEQ ID NO: 15913 - DNA, 16 bp, Artificial Sequence
  Synthetic
cagctcgcccaagcca

SEQ ID NO: 15914 - DNA, 17 bp, Artificial Sequence
  Synthetic
cctcacccaagccgtct

SEQ ID NO: 15915 - DNA, 19 bp, Artificial Sequence
  Synthetic
cggcaaacacccattgacc

SEQ ID NO: 15916 - DNA, 20 bp, Artificial Sequence
  Synthetic
cgtaaacgctgtaatactgc

SEQ ID NO: 15917 - DNA, 20 bp, Artificial Sequence
  Synthetic
caatgactaccaccacgacg

SEQ ID NO: 15918 - DNA, 19 bp, Artificial Sequence
  Synthetic
aaactaccgccgcaatacg

SEQ ID NO: 15919 - DNA, 16 bp, Artificial Sequence
  Synthetic
cgaagcccagcgcatc

SEQ ID NO: 15920 - DNA, 17 bp, Artificial Sequence
  Synthetic
acgcggctacaacgtcg

SEQ ID NO: 15921 - DNA, 17 bp, Artificial Sequence
  Synthetic
cccgttgcgtttcggaa

SEQ ID NO: 15922 - DNA, 20 bp, Artificial Sequence
  Synthetic
gctgccgtagattttgacgg

SEQ ID NO: 15923 - DNA, 18 bp, Artificial Sequence
  Synthetic
ttcgggtttttgacggcg

SEQ ID NO: 15924 - DNA, 18 bp, Artificial Sequence
  Synthetic
tcgggagccagagtctct

SEQ ID NO: 15925 - DNA, 18 bp, Artificial Sequence
  Synthetic
gcgttgcgccataatggt

SEQ ID NO: 15926 - DNA, 16 bp, Artificial Sequence
  Synthetic
gcggcggctttgttca

SEQ ID NO: 15927 - DNA, 16 bp, Artificial Sequence
  Synthetic
cagctgacgggcgtgt

SEQ ID NO: 15928 - DNA, 16 bp, Artificial Sequence
  Synthetic
cgcagcaaaccgccga

SEQ ID NO: 15929 - DNA, 20 bp, Artificial Sequence
  Synthetic
tgcctgatacagtcggtaca

SEQ ID NO: 15930 - DNA, 19 bp, Artificial Sequence
  Synthetic
tttggaaggcaagagcgac

SEQ ID NO: 15931 - DNA, 17 bp, Artificial Sequence
  Synthetic
tgccgcctgcaaacctc

SEQ ID NO: 15932 - DNA, 15 bp, Artificial Sequence
  Synthetic
ccaaacgccgcgtgt

SEQ ID NO: 15933 - DNA, 17 bp, Artificial Sequence
  Synthetic
gcaacgacatcctcgcc

SEQ ID NO: 15934 - DNA, 16 bp, Artificial Sequence
  Synthetic
ccgcgctgtacggcat

SEQ ID NO: 15935 - DNA, 18 bp, Artificial Sequence
  Synthetic
atcgacgaccaccacacc

SEQ ID NO: 15936 - DNA, 20 bp, Artificial Sequence
  Synthetic
cttagggcaaatgggtctgc

SEQ ID NO: 15937 - DNA, 18 bp, Artificial Sequence
  Synthetic
atcagtacgggaatgagc

SEQ ID NO: 15938 - DNA, 19 bp, Artificial Sequence
  Synthetic
ttgaaagtgcgcgaactgt

SEQ ID NO: 15939 - DNA, 17 bp, Artificial Sequence
  Synthetic
gccaaagccgaactcgc

SEQ ID NO: 15940 - DNA, 20 bp, Artificial Sequence
  Synthetic
cccataccgattccaacacg

SEQ ID NO: 15941 - DNA, 19 bp, Artificial Sequence
  Synthetic
gcgtgggcgttttacttgt

SEQ ID NO: 15942 - DNA, 20 bp, Artificial Sequence
  Synthetic
cgtagccggcttctatttcg

SEQ ID NO: 15943 - DNA, 20 bp, Artificial Sequence
  Synthetic
gccaaacggcaaaaaaacgc

SEQ ID NO: 15944 - DNA, 22 bp, Artificial Sequence
  Synthetic
taaacttttggtgctttttccg

SEQ ID NO: 15945 - DNA, 22 bp, Artificial Sequence
  Synthetic
aaaagaaggttcaatatgtcgg

SEQ ID NO: 15946 - DNA, 16 bp, Artificial Sequence
  Synthetic
cggctgtgcgtgaggt

SEQ ID NO: 15947 - DNA, 19 bp, Artificial Sequence
  Synthetic
cctgttttttgacgctgaa

SEQ ID NO: 15948 - DNA, 17 bp, Artificial Sequence
  Synthetic
gcacatccgccacatcc

SEQ ID NO: 15949 - DNA, 18 bp, Artificial Sequence
  Synthetic
cagcaggctgatggcaat

SEQ ID NO: 15950 - DNA, 16 bp, Artificial Sequence
  Synthetic
cggcccagcaacacca

SEQ ID NO: 15951 - DNA, 17 bp, Artificial Sequence
  Synthetic
ctcccgcaacaatgggc

SEQ ID NO: 15952 - DNA, 17 bp, Artificial Sequence
  Synthetic
ggcacctgtatcggcgt

SEQ ID NO: 15953 - DNA, 16 bp, Artificial Sequence
  Synthetic
aaacccaagccgcacc

SEQ ID NO: 15954 - DNA, 18 bp, Artificial Sequence
  Synthetic
aaaagccgaaaccgcacc

SEQ ID NO: 15955 - DNA, 16 bp, Artificial Sequence
  Synthetic
tgagttcgggcgggag

SEQ ID NO: 15956 - DNA, 20 bp, Artificial Sequence
  Synthetic
aggaaaaccaacatgtccgc

SEQ ID NO: 15957 - DNA, 18 bp, Artificial Sequence
  Synthetic
acctgttcccgattggcg

SEQ ID NO: 15958 - DNA, 16 bp, Artificial Sequence
  Synthetic
cagcgtgcagagccac

SEQ ID NO: 15959 - DNA, 19 bp, Artificial Sequence
  Synthetic
gcgaagaaagccttgccaa

SEQ ID NO: 15960 - DNA, 18 bp, Artificial Sequence
  Synthetic
atggcggacggtataggc

SEQ ID NO: 15961 - DNA, 19 bp, Artificial Sequence
  Synthetic
cggagcatccaaatggcag

SEQ ID NO: 15962 - DNA, 17 bp, Artificial Sequence
  Synthetic
cgtaaaggcagacgcgg

SEQ ID NO: 15963 - DNA, 19 bp, Artificial Sequence
  Synthetic
caccagaggttcgtccact

SEQ ID NO: 15964 - DNA, 18 bp, Artificial Sequence
  Synthetic
aaagatgaagcggcaatg

SEQ ID NO: 15965 - DNA, 20 bp, Artificial Sequence
  Synthetic
ccaaacccaatgcttcaacc

SEQ ID NO: 15966 - DNA, 19 bp, Artificial Sequence
  Synthetic
gcggatccgggtttgatta

SEQ ID NO: 15967 - DNA, 20 bp, Artificial Sequence
  Synthetic
tttgccgaaaatatccccca

SEQ ID NO: 15968 - DNA, 18 bp, Artificial Sequence
  Synthetic
tgcctgtatttccgcgac

SEQ ID NO: 15969 - DNA, 20 bp, Artificial Sequence
  Synthetic
aactcaatgcggacgtatcc

SEQ ID NO: 15970 - DNA, 20 bp, Artificial Sequence
  Synthetic
cgcacaaaaccatgtttggg

SEQ ID NO: 15971 - DNA, 18 bp, Artificial Sequence
  Synthetic
gcgcgccatttgagtttc

SEQ ID NO: 15972 - DNA, 19 bp, Artificial Sequence
  Synthetic
tgcatcgatttgaccggtt

SEQ ID NO: 15973 - DNA, 18 bp, Artificial Sequence
  Synthetic
gcttgaaagcccacctcg

SEQ ID NO: 15974 - DNA, 17 bp, Artificial Sequence
  Synthetic
gactacggcttccacgc

SEQ ID NO: 15975 - DNA, 15 bp, Artificial Sequence
  Synthetic
tcaacgcgccgcaca

SEQ ID NO: 15976 - DNA, 20 bp, Artificial Sequence
  Synthetic
cctgacaggttgcttcgaag

SEQ ID NO: 15977 - DNA, 16 bp, Artificial Sequence
  Synthetic
cccgactttgagcgcg

SEQ ID NO: 15978 - DNA, 19 bp, Artificial Sequence
  Synthetic
gtcggggtggacttcaaag

SEQ ID NO: 15979 - DNA, 20 bp, Artificial Sequence
  Synthetic
atcaggtcggtcagatagct

SEQ ID NO: 15980 - DNA, 20 bp, Artificial Sequence
  Synthetic
ttgcacgtcgatttcagtgg

SEQ ID NO: 15981 - DNA, 18 bp, Artificial Sequence
  Synthetic
accgtatgttccgcaacc

SEQ ID NO: 15982 - DNA, 18 bp, Artificial Sequence
  Synthetic
gcggggttcagttcgatg

SEQ ID NO: 15983 - DNA, 17 bp, Artificial Sequence
  Synthetic
gcggatgaagccttcgc

SEQ ID NO: 15984 - DNA, 18 bp, Artificial Sequence
  Synthetic
tgaaacatctgccgcgtc

SEQ ID NO: 15985 - DNA, 20 bp, Artificial Sequence
  Synthetic
gcaaaaaccaccgtttaccg

SEQ ID NO: 15986 - DNA, 20 bp, Artificial Sequence
  Synthetic
ccatactgacggttctgcag

SEQ ID NO: 15987 - DNA, 16 bp, Artificial Sequence
  Synthetic
cggcaagcgtcccgtt

SEQ ID NO: 15988 - DNA, 18 bp, Artificial Sequence
  Synthetic
gttgacggtgcggacatt

SEQ ID NO: 15989 - DNA, 16 bp, Artificial Sequence
  Synthetic
ccgtcgtgcgaggcat

SEQ ID NO: 15990 - DNA, 19 bp, Artificial Sequence
  Synthetic
ggaagaaatccgcgctttg

SEQ ID NO: 15991 - DNA, 16 bp, Artificial Sequence
  Synthetic
cattgcagcacgccgg

SEQ ID NO: 15992 - DNA, 16 bp, Artificial Sequence
  Synthetic
cgttcgcgtggggcat

SEQ ID NO: 15993 - DNA, 20 bp, Artificial Sequence
  Synthetic
ttcggcaaaaaagaaaccgc

SEQ ID NO: 15994 - DNA, 17 bp, Artificial Sequence
  Synthetic
gtaccgacgcttccggt

SEQ ID NO: 15995 - DNA, 16 bp, Artificial Sequence
  Synthetic
cacgcgcccgaacaga

SEQ ID NO: 15996 - DNA, 20 bp, Artificial Sequence
  Synthetic
caaaatcagggtttgcgagc

SEQ ID NO: 15997 - DNA, 18 bp, Artificial Sequence
  Synthetic
gttcgggaagtcgctgac

SEQ ID NO: 15998 - DNA, 18 bp, Artificial Sequence
  Synthetic
catcggtgcgctctttgg

SEQ ID NO: 15999 - DNA, 16 bp, Artificial Sequence
  Synthetic
gatacgggcggcggtt

SEQ ID NO: 16000 - DNA, 19 bp, Artificial Sequence
  Synthetic
ctgatgagggcttcgagga

SEQ ID NO: 16001 - DNA, 20 bp, Artificial Sequence
  Synthetic
tactgcaaaaggtgatgccg

SEQ ID NO: 16002 - DNA, 20 bp, Artificial Sequence
  Synthetic
tccggcttcgaacaatctgt

SEQ ID NO: 16003 - DNA, 17 bp, Artificial Sequence
  Synthetic
tgccacatcgggttgcc

SEQ ID NO: 16004 - DNA, 18 bp, Artificial Sequence
  Synthetic
cctgcgtcagatcgggat

SEQ ID NO: 16005 - DNA, 18 bp, Artificial Sequence
  Synthetic
cggttcgacaccccattt

SEQ ID NO: 16006 - DNA, 18 bp, Artificial Sequence
  Synthetic
ctcaggcacgacatcacg

SEQ ID NO: 16007 - DNA, 18 bp, Artificial Sequence
  Synthetic
ggacttttctcccacgaa

SEQ ID NO: 16008 - DNA, 18 bp, Artificial Sequence
  Synthetic
aggctgggtcaaatccgg

SEQ ID NO: 16009 - DNA, 16 bp, Artificial Sequence
  Synthetic
gggcaagtgttcgccg

SEQ ID NO: 16010 - DNA, 16 bp, Artificial Sequence
  Synthetic
tacggctgcggacggt

SEQ ID NO: 16011 - DNA, 16 bp, Artificial Sequence
  Synthetic
gttgtggtagccgccg

SEQ ID NO: 16012 - DNA, 18 bp, Artificial Sequence
  Synthetic
atcacgaagacggctcgg

SEQ ID NO: 16013 - DNA, 18 bp, Artificial Sequence
  Synthetic
atgtcgaaaccgccgttg

SEQ ID NO: 16014 - DNA, 20 bp, Artificial Sequence
  Synthetic
attttccaacacctgcttgc

SEQ ID NO: 16015 - DNA, 20 bp, Artificial Sequence
  Synthetic
aaccaccacgtcgtaatcgt

SEQ ID NO: 16016 - DNA, 16 bp, Artificial Sequence
  Synthetic
ggcgcatacacgtcgg

SEQ ID NO: 16017 - DNA, 20 bp, Artificial Sequence
  Synthetic
aactacaccaaccgttctcc

SEQ ID NO: 16018 - DNA, 16 bp, Artificial Sequence
  Synthetic
cgcgcttgccagccaa

SEQ ID NO: 16019 - DNA, 20 bp, Artificial Sequence
  Synthetic
tatcggcaatttcctgctgg

SEQ ID NO: 16020 - DNA, 20 bp, Artificial Sequence
  Synthetic
gcaaacgcctcgatattggg

SEQ ID NO: 16021 - DNA, 20 bp, Artificial Sequence
  Synthetic
tacgcaaacactacgtctgc

SEQ ID NO: 16022 - DNA, 17 bp, Artificial Sequence
  Synthetic
gcgcggtgcaaatcttg

SEQ ID NO: 16023 - DNA, 16 bp, Artificial Sequence
  Synthetic
cccaacatcgcgcgca

SEQ ID NO: 16024 - DNA, 16 bp, Artificial Sequence
  Synthetic
ggctcgtcggcgaaga

SEQ ID NO: 16025 - DNA, 20 bp, Artificial Sequence
  Synthetic
gatacgcctttcaaacggct

SEQ ID NO: 16026 - DNA, 18 bp, Artificial Sequence
  Synthetic
agcttgcagaaacgcgag

SEQ ID NO: 16027 - DNA, 16 bp, Artificial Sequence
  Synthetic
cttcgagcgcgtccag

SEQ ID NO: 16028 - DNA, 20 bp, Artificial Sequence
  Synthetic
tagcgatgtcgtctgaaagc

SEQ ID NO: 16029 - DNA, 19 bp, Artificial Sequence
  Synthetic
cctgtacgggcagggattt

SEQ ID NO: 16030 - DNA, 16 bp, Artificial Sequence
  Synthetic
tgccacagttgcggcg

SEQ ID NO: 16031 - DNA, 16 bp, Artificial Sequence
  Synthetic
tcggcatgggcaagct

SEQ ID NO: 16032 - DNA, 20 bp, Artificial Sequence
  Synthetic
aatgggggcggtgtttaagc

SEQ ID NO: 16033 - DNA, 18 bp, Artificial Sequence
  Synthetic
tcggtgcgttcttctccg

SEQ ID NO: 16034 - DNA, 16 bp, Artificial Sequence
  Synthetic
tgcctgtccgacgacc

SEQ ID NO: 16035 - DNA, 18 bp, Artificial Sequence
  Synthetic
tatgccaaaagccccgtc

SEQ ID NO: 16036 - DNA, 16 bp, Artificial Sequence
  Synthetic
tgggaacaagccgcca

SEQ ID NO: 16037 - DNA, 18 bp, Artificial Sequence
  Synthetic
cgacaacacgctcgttct

SEQ ID NO: 16038 - DNA, 20 bp, Artificial Sequence
  Synthetic
ttgaaaccctgaccctctgc

SEQ ID NO: 16039 - DNA, 16 bp, Artificial Sequence
  Synthetic
gcgtccagggtcagct

SEQ ID NO: 16040 - DNA, 18 bp, Artificial Sequence
  Synthetic
acttcctgatcgcgcatc

SEQ ID NO: 16041 - DNA, 20 bp, Artificial Sequence
  Synthetic
gggtttgtaccaacagtccg

SEQ ID NO: 16042 - DNA, 20 bp, Artificial Sequence
  Synthetic
gtctacttcgcggttgaagg

SEQ ID NO: 16043 - DNA, 17 bp, Artificial Sequence
  Synthetic
aatggcggggaagtcgg

SEQ ID NO: 16044 - DNA, 17 bp, Artificial Sequence
  Synthetic
gcgcgtaggtcagttcc

SEQ ID NO: 16045 - DNA, 16 bp, Artificial Sequence
  Synthetic
cgcctaagccgatgcg

SEQ ID NO: 16046 - DNA, 18 bp, Artificial Sequence
  Synthetic
cgtacacgctccaaaccg

SEQ ID NO: 16047 - DNA, 23 bp, Artificial Sequence
  Synthetic
ttaacacagagtatgcaacttac

SEQ ID NO: 16048 - DNA, 21 bp, Artificial Sequence
  Synthetic
cagtatgacaatttgctgaac

SEQ ID NO: 16049 - DNA, 18 bp, Artificial Sequence
  Synthetic
tgctgattaccaccaaca

SEQ ID NO: 16050 - DNA, 18 bp, Artificial Sequence
  Synthetic
ttgggtcaaaatgggtgc

SEQ ID NO: 16051 - DNA, 19 bp, Artificial Sequence
  Synthetic
tgaaatgttcaacggcatt

SEQ ID NO: 16052 - DNA, 19 bp, Artificial Sequence
  Synthetic
ctgaaaatgcgcctgctca

SEQ ID NO: 16053 - DNA, 21 bp, Artificial Sequence
  Synthetic
ttcttgttttgatgttggcag

SEQ ID NO: 16054 - DNA, 18 bp, Artificial Sequence
  Synthetic
actttagcgcgaaaccat

SEQ ID NO: 16055 - DNA, 18 bp, Artificial Sequence
  Synthetic
cctgcatttcccaaaagc

SEQ ID NO: 16056 - DNA, 18 bp, Artificial Sequence
  Synthetic
caaccgcttgaaacactt

SEQ ID NO: 16057 - DNA, 21 bp, Artificial Sequence
  Synthetic
catacaggacataatgcctac

SEQ ID NO: 16058 - DNA, 22 bp, Artificial Sequence
  Synthetic
gcatatccggcaaataatcttg

SEQ ID NO: 16059 - DNA, 18 bp, Artificial Sequence
  Synthetic
gtcgtcaaagcaggcaaa

SEQ ID NO: 16060 - DNA, 19 bp, Artificial Sequence
  Synthetic
cggcaataatcgacagcgc

SEQ ID NO: 16061 - DNA, 17 bp, Artificial Sequence
  Synthetic
gcccgtagcgacttggt

SEQ ID NO: 16062 - DNA, 25 bp, Artificial Sequence
  Synthetic
agatagggagagaaataaatatcgt

SEQ ID NO: 16063 - DNA, 17 bp, Artificial Sequence
  Synthetic
gcctgatcgaatggccg

SEQ ID NO: 16064 - DNA, 16 bp, Artificial Sequence
  Synthetic
gccggcacactgttcg

SEQ ID NO: 16065 - DNA, 16 bp, Artificial Sequence
  Synthetic
gcgtgtcgccaaaggg

SEQ ID NO: 16066 - DNA, 19 bp, Artificial Sequence
  Synthetic
gcacccgatatgccgtcta

SEQ ID NO: 16067 - DNA, 20 bp, Artificial Sequence
  Synthetic
gccgagttcttctccaaact

SEQ ID NO: 16068 - DNA, 20 bp, Artificial Sequence
  Synthetic
gatgccttgttcttccagcc

SEQ ID NO: 16069 - DNA, 18 bp, Artificial Sequence
  Synthetic
cgaccaagcccaaatcgc

SEQ ID NO: 16070 - DNA, 19 bp, Artificial Sequence
  Synthetic
caacaccagctcgttcaca

SEQ ID NO: 16071 - DNA, 20 bp, Artificial Sequence
  Synthetic
gaagcagtcgtctatggtcg

SEQ ID NO: 16072 - DNA, 16 bp, Artificial Sequence
  Synthetic
gaccaggccctgcgta

SEQ ID NO: 16073 - DNA, 18 bp, Artificial Sequence
  Synthetic
aagcaagcgaaaacggca

SEQ ID NO: 16074 - DNA, 16 bp, Artificial Sequence
  Synthetic
gtgctcctggcgcaga

SEQ ID NO: 16075 - DNA, 20 bp, Artificial Sequence
  Synthetic
aaacacccgcttcaaaaccc

SEQ ID NO: 16076 - DNA, 18 bp, Artificial Sequence
  Synthetic
gggaatccggacctgtcc

SEQ ID NO: 16077 - DNA, 17 bp, Artificial Sequence
  Synthetic
caaccatacggacggcg

SEQ ID NO: 16078 - DNA, 20 bp, Artificial Sequence
  Synthetic
tgtcgatgacggtagtcgga

SEQ ID NO: 16079 - DNA, 16 bp, Artificial Sequence
  Synthetic
ccgctccggcatggtt

SEQ ID NO: 16080 - DNA, 16 bp, Artificial Sequence
  Synthetic
cctgacattcggcggc

SEQ ID NO: 16081 - DNA, 15 bp, Artificial Sequence
  Synthetic
gcgcgtaccggcaaa

SEQ ID NO: 16082 - DNA, 20 bp, Artificial Sequence
  Synthetic
cattggatggcgagatgtgg

SEQ ID NO: 16083 - DNA, 20 bp, Artificial Sequence
  Synthetic
cgcgggttggaagtattggt

SEQ ID NO: 16084 - DNA, 17 bp, Artificial Sequence
  Synthetic
ccggcgtcatgttggaa

SEQ ID NO: 16085 - DNA, 16 bp, Artificial Sequence
  Synthetic
atatcgggcaggcgca

SEQ ID NO: 16086 - DNA, 16 bp, Artificial Sequence
  Synthetic
ggcatggtcgccccaa

SEQ ID NO: 16087 - DNA, 16 bp, Artificial Sequence
  Synthetic
cggggtggtgtccgta

SEQ ID NO: 16088 - DNA, 17 bp, Artificial Sequence
  Synthetic
cagaaagccgcgtttgc

SEQ ID NO: 16089 - DNA, 16 bp, Artificial Sequence
  Synthetic
acgcagtcggtcaggt

SEQ ID NO: 16090 - DNA, 17 bp, Artificial Sequence
  Synthetic
gcggcggttcacaatgt

SEQ ID NO: 16091 - DNA, 19 bp, Artificial Sequence
  Synthetic
aatggcggtcagaatcagc

SEQ ID NO: 16092 - DNA, 18 bp, Artificial Sequence
  Synthetic
cgttcagacggcctttga

SEQ ID NO: 16093 - DNA, 19 bp, Artificial Sequence
  Synthetic
cgttgatgatgtcgtgcgg

SEQ ID NO: 16094 - DNA, 17 bp, Artificial Sequence
  Synthetic
cgactggtcaaggccgt

SEQ ID NO: 16095 - DNA, 20 bp, Artificial Sequence
  Synthetic
gtttgattgccgaaccaggt

SEQ ID NO: 16096 - DNA, 18 bp, Artificial Sequence
  Synthetic
agcgaaagttccaaacct

SEQ ID NO: 16097 - DNA, 19 bp, Artificial Sequence
  Synthetic
atgtcgcggaatttggcag

SEQ ID NO: 16098 - DNA, 19 bp, Artificial Sequence
  Synthetic
gtgctttcttgcgcactgc

SEQ ID NO: 16099 - DNA, 19 bp, Artificial Sequence
  Synthetic
acagaccttttccggattg

SEQ ID NO: 16100 - DNA, 17 bp, Artificial Sequence
  Synthetic
ggcgttgactttgccct

SEQ ID NO: 16101 - DNA, 16 bp, Artificial Sequence
  Synthetic
catccacgccatcggc

SEQ ID NO: 16102 - DNA, 16 bp, Artificial Sequence
  Synthetic
gatgcttgccgtgcgc

SEQ ID NO: 16103 - DNA, 16 bp, Artificial Sequence
  Synthetic
ggcgaagtcgtgtccg

SEQ ID NO: 16104 - DNA, 16 bp, Artificial Sequence
  Synthetic
gatgccagcatcggcg

SEQ ID NO: 16105 - DNA, 16 bp, Artificial Sequence
  Synthetic
gaccgaacttgccgcc

SEQ ID NO: 16106 - DNA, 18 bp, Artificial Sequence
  Synthetic
tcggtttcgacatcacgc

SEQ ID NO: 16107 - DNA, 18 bp, Artificial Sequence
  Synthetic
gccatgtacggtttgggt

SEQ ID NO: 16108 - DNA, 18 bp, Artificial Sequence
  Synthetic
aacgccaaggcaaccaaa

SEQ ID NO: 16109 - DNA, 16 bp, Artificial Sequence
  Synthetic
ggcttgcccgtcttgg

SEQ ID NO: 16110 - DNA, 19 bp, Artificial Sequence
  Synthetic
catcggaaaacacgtcgcc

SEQ ID NO: 16111 - DNA, 20 bp, Artificial Sequence
  Synthetic
acaaacgcaagacttcgtct

SEQ ID NO: 16112 - DNA, 20 bp, Artificial Sequence
  Synthetic
tcgatgcccgtaaacgttac

SEQ ID NO: 16113 - DNA, 16 bp, Artificial Sequence
  Synthetic
tttccggcggcgaacg

SEQ ID NO: 16114 - DNA, 20 bp, Artificial Sequence
  Synthetic
gacggaacagaacaaatgcc

SEQ ID NO: 16115 - DNA, 17 bp, Artificial Sequence
  Synthetic
gggcaaacggcaacagc

SEQ ID NO: 16116 - DNA, 21 bp, Artificial Sequence
  Synthetic
tcgtacaggttaatcaaatgg

SEQ ID NO: 16117 - DNA, 18 bp, Artificial Sequence
  Synthetic
taccccctaccctgaccg

SEQ ID NO: 16118 - DNA, 16 bp, Artificial Sequence
  Synthetic
cgaagccctgttccgc

SEQ ID NO: 16119 - DNA, 18 bp, Artificial Sequence
  Synthetic
cccgatacagctaccccg

SEQ ID NO: 16120 - DNA, 18 bp, Artificial Sequence
  Synthetic
gacagggcggttgtcatc

SEQ ID NO: 16121 - DNA, 20 bp, Artificial Sequence
  Synthetic
acaggaagcgtttcatctgg

SEQ ID NO: 16122 - DNA, 20 bp, Artificial Sequence
  Synthetic
ttgttcgacggtcattttgc

SEQ ID NO: 16123 - DNA, 16 bp, Artificial Sequence
  Synthetic
gtgtgccgcttccgca

SEQ ID NO: 16124 - DNA, 19 bp, Artificial Sequence
  Synthetic
aggcacggtagaagaagcc

SEQ ID NO: 16125 - DNA, 15 bp, Artificial Sequence
  Synthetic
tacgcgcgcggcatt

SEQ ID NO: 16126 - DNA, 19 bp, Artificial Sequence
  Synthetic
aatatttcaccgcccccga

SEQ ID NO: 16127 - DNA, 16 bp, Artificial Sequence
  Synthetic
tccccgaccgcgacat

SEQ ID NO: 16128 - DNA, 16 bp, Artificial Sequence
  Synthetic
cgcggacaagacctgc

SEQ ID NO: 16129 - DNA, 16 bp, Artificial Sequence
  Synthetic
cgcaggattgtgccgc

SEQ ID NO: 16130 - DNA, 17 bp, Artificial Sequence
  Synthetic
ccgaacgcgcctttctg

SEQ ID NO: 16131 - DNA, 16 bp, Artificial Sequence
  Synthetic
gccgcctttgtccgca

SEQ ID NO: 16132 - DNA, 18 bp, Artificial Sequence
  Synthetic
ttaaggcggctttgtcgg

SEQ ID NO: 16133 - DNA, 20 bp, Artificial Sequence
  Synthetic
gtaccgcttcaggaaatcgc

SEQ ID NO: 16134 - DNA, 18 bp, Artificial Sequence
  Synthetic
gcccagttgaacagggga

SEQ ID NO: 16135 - DNA, 20 bp, Artificial Sequence
  Synthetic
cttaccccgtatcggcaaac

SEQ ID NO: 16136 - DNA, 16 bp, Artificial Sequence
  Synthetic
cggctgtgcgtgaggt

SEQ ID NO: 16137 - DNA, 16 bp, Artificial Sequence
  Synthetic
cggcgcggcaaagtct

SEQ ID NO: 16138 - DNA, 16 bp, Artificial Sequence
  Synthetic
gcgaactcaacgccgc

SEQ ID NO: 16139 - DNA, 21 bp, Artificial Sequence
  Synthetic
gaaaagtaattcttggttgcc

SEQ ID NO: 16140 - DNA, 20 bp, Artificial Sequence
  Synthetic
ttccacataatgaagcggct

SEQ ID NO: 16141 - DNA, 20 bp, Artificial Sequence
  Synthetic
aaatcaaactgattgccgcc

SEQ ID NO: 16142 - DNA, 19 bp, Artificial Sequence
  Synthetic
tccgaaaaaggcctgaccg

SEQ ID NO: 16143 - DNA, 17 bp, Artificial Sequence
  Synthetic
tcgcggacgacgtttcc

SEQ ID NO: 16144 - DNA, 18 bp, Artificial Sequence
  Synthetic
catttgttgcaggcggga

SEQ ID NO: 16145 - DNA, 19 bp, Artificial Sequence
  Synthetic
gacggcacagtaaaggctg

SEQ ID NO: 16146 - DNA, 19 bp, Artificial Sequence
  Synthetic
gccttcgacgatttcggaa

SEQ ID NO: 16147 - DNA, 16 bp, Artificial Sequence
  Synthetic
cgccaaccgcaaccat

SEQ ID NO: 16148 - DNA, 16 bp, Artificial Sequence
  Synthetic
tccctgccgtccgcat

SEQ ID NO: 16149 - DNA, 17 bp, Artificial Sequence
  Synthetic
actggtggctgacccat

SEQ ID NO: 16150 - DNA, 18 bp, Artificial Sequence
  Synthetic
cccaatttcgcacaatgg

SEQ ID NO: 16151 - DNA, 16 bp, Artificial Sequence
  Synthetic
gctgatcggcgatgcg

SEQ ID NO: 16152 - DNA, 16 bp, Artificial Sequence
  Synthetic
ctgaccggcgttccct

SEQ ID NO: 16153 - DNA, 20 bp, Artificial Sequence
  Synthetic
cgaattgaacggcttatggc

SEQ ID NO: 16154 - DNA, 16 bp, Artificial Sequence
  Synthetic
tgaccgccctgacagg

SEQ ID NO: 16155 - DNA, 18 bp, Artificial Sequence
  Synthetic
aaccgaaaatgccgtctt

SEQ ID NO: 16156 - DNA, 18 bp, Artificial Sequence
  Synthetic
tcctcctcaaacccgacc

SEQ ID NO: 16157 - DNA, 16 bp, Artificial Sequence
  Synthetic
gccgcatccgcctaca

SEQ ID NO: 16158 - DNA, 20 bp, Artificial Sequence
  Synthetic
cggacggcaagaaataccgg

SEQ ID NO: 16159 - DNA, 19 bp, Artificial Sequence
  Synthetic
gatgcgctgtttgcacaaa

SEQ ID NO: 16160 - DNA, 15 bp, Artificial Sequence
  Synthetic
agcgcgtcccacctt

SEQ ID NO: 16161 - DNA, 19 bp, Artificial Sequence
  Synthetic
cctccatatacgccagccc

SEQ ID NO: 16162 - DNA, 17 bp, Artificial Sequence
  Synthetic
catgcccgacaacccca

SEQ ID NO: 16163 - DNA, 21 bp, Artificial Sequence
  Synthetic
aggtaatactgttcctctacc

SEQ ID NO: 16164 - DNA, 18 bp, Artificial Sequence
  Synthetic
ccgtaacggcgcattacg

SEQ ID NO: 16165 - DNA, 16 bp, Artificial Sequence
  Synthetic
gcaaggtcgtgcgcca

SEQ ID NO: 16166 - DNA, 20 bp, Artificial Sequence
  Synthetic
caaggcgatgtcctgatacg

SEQ ID NO: 16167 - DNA, 20 bp, Artificial Sequence
  Synthetic
atttgatgatgtgccagccg

SEQ ID NO: 16168 - DNA, 16 bp, Artificial Sequence
  Synthetic
tgcgaaatccgtgccg

SEQ ID NO: 16169 - DNA, 19 bp, Artificial Sequence
  Synthetic
atttcagcttcgctcacgc

SEQ ID NO: 16170 - DNA, 17 bp, Artificial Sequence
  Synthetic
ggataccgccctgctgt

SEQ ID NO: 16171 - DNA, 17 bp, Artificial Sequence
  Synthetic
tcgcccaacatttcggc

SEQ ID NO: 16172 - DNA, 17 bp, Artificial Sequence
  Synthetic
ttcggttctctcggggc

SEQ ID NO: 16173 - DNA, 20 bp, Artificial Sequence
  Synthetic
gcacactgatacccaaagca

SEQ ID NO: 16174 - DNA, 16 bp, Artificial Sequence
  Synthetic
cgcacttgccgcagaa

SEQ ID NO: 16175 - DNA, 18 bp, Artificial Sequence
  Synthetic
ctggcggtatgaacaggc

SEQ ID NO: 16176 - DNA, 16 bp, Artificial Sequence
  Synthetic
agaatccgcccgaccg

SEQ ID NO: 16177 - DNA, 16 bp, Artificial Sequence
  Synthetic
cgcgccccgatgaaac

SEQ ID NO: 16178 - DNA, 19 bp, Artificial Sequence
  Synthetic
ttcacgggcgcaaaacttc

SEQ ID NO: 16179 - DNA, 20 bp, Artificial Sequence
  Synthetic
acggctttgggcattttgtc

SEQ ID NO: 16180 - DNA, 16 bp, Artificial Sequence
  Synthetic
tcggcaaatacgcgcc

SEQ ID NO: 16181 - DNA, 19 bp, Artificial Sequence
  Synthetic
cgaagccgtctatgccaag

SEQ ID NO: 16182 - DNA, 19 bp, Artificial Sequence
  Synthetic
tttacgccaaactctgggc

SEQ ID NO: 16183 - DNA, 16 bp, Artificial Sequence
  Synthetic
gccgccgctacatcgt

SEQ ID NO: 16184 - DNA, 17 bp, Artificial Sequence
  Synthetic
cgcacgggattcgagga

SEQ ID NO: 16185 - DNA, 18 bp, Artificial Sequence
  Synthetic
ccgtccgacaacaccatc

SEQ ID NO: 16186 - DNA, 16 bp, Artificial Sequence
  Synthetic
tcccacacggcaagct

SEQ ID NO: 16187 - DNA, 18 bp, Artificial Sequence
  Synthetic
cagaaatcggagtcgggc

SEQ ID NO: 16188 - DNA, 18 bp, Artificial Sequence
  Synthetic
ggagagcgcccaatacca

SEQ ID NO: 16189 - DNA, 19 bp, Artificial Sequence
  Synthetic
cgacgtaaaccaccaccag

SEQ ID NO: 16190 - DNA, 20 bp, Artificial Sequence
  Synthetic
atgataaataccgacgccgc

SEQ ID NO: 16191 - DNA, 16 bp, Artificial Sequence
  Synthetic
ccgccgcctgtacgaa

SEQ ID NO: 16192 - DNA, 19 bp, Artificial Sequence
  Synthetic
caatgcgccgtctatgtgt

SEQ ID NO: 16193 - DNA, 20 bp, Artificial Sequence
  Synthetic
tcattatgggacaggtcgcc

SEQ ID NO: 16194 - DNA, 17 bp, Artificial Sequence
  Synthetic
gccctgctgattctgcc

SEQ ID NO: 16195 - DNA, 19 bp, Artificial Sequence
  Synthetic
gtgatgctcacccaccaaa

SEQ ID NO: 16196 - DNA, 20 bp, Artificial Sequence
  Synthetic
gagcttcagatgtgtagggc

SEQ ID NO: 16197 - DNA, 17 bp, Artificial Sequence
  Synthetic
cgacccgcgcaaattcc

SEQ ID NO: 16198 - DNA, 16 bp, Artificial Sequence
  Synthetic
catgcggcggtcagga

SEQ ID NO: 16199 - DNA, 16 bp, Artificial Sequence
  Synthetic
cagttcggcggacgca

SEQ ID NO: 16200 - DNA, 16 bp, Artificial Sequence
  Synthetic
cgtccgcggaaggctt

SEQ ID NO: 16201 - DNA, 16 bp, Artificial Sequence
  Synthetic
ccggacacgcccagtt

SEQ ID NO: 16202 - DNA, 19 bp, Artificial Sequence
  Synthetic
cgacgacggagttgagatg

SEQ ID NO: 16203 - DNA, 20 bp, Artificial Sequence
  Synthetic
catcatgaccgtcttgcacg

SEQ ID NO: 16204 - DNA, 18 bp, Artificial Sequence
  Synthetic
gatggtgtacgccatggc

SEQ ID NO: 16205 - DNA, 20 bp, Artificial Sequence
  Synthetic
ctacaaaaccaacgcctcca

SEQ ID NO: 16206 - DNA, 16 bp, Artificial Sequence
  Synthetic
cggcgggttggtgcaa

SEQ ID NO: 16207 - DNA, 18 bp, Artificial Sequence
  Synthetic
ttttcaatccggccggtg

SEQ ID NO: 16208 - DNA, 16 bp, Artificial Sequence
  Synthetic
gacggcgatgtcctgc

SEQ ID NO: 16209 - DNA, 17 bp, Artificial Sequence
  Synthetic
cgacagccgttttgccg

SEQ ID NO: 16210 - DNA, 19 bp, Artificial Sequence
  Synthetic
cgcaatccaagtcccatcc

SEQ ID NO: 16211 - DNA, 16 bp, Artificial Sequence
  Synthetic
cgacatccgcgcccaa

SEQ ID NO: 16212 - DNA, 20 bp, Artificial Sequence
  Synthetic
cggaaggcttattgaccacc

SEQ ID NO: 16213 - DNA, 18 bp, Artificial Sequence
  Synthetic
gggcaaactctcccgttt

SEQ ID NO: 16214 - DNA, 20 bp, Artificial Sequence
  Synthetic
aagcgatgaaggacaacacc

SEQ ID NO: 16215 - DNA, 16 bp, Artificial Sequence
  Synthetic
caccgcccgaaaccga

SEQ ID NO: 16216 - DNA, 16 bp, Artificial Sequence
  Synthetic
ccgcgcacgttttcgg

SEQ ID NO: 16217 - DNA, 18 bp, Artificial Sequence
  Synthetic
gcacaggaaatgccgtct

SEQ ID NO: 16218 - DNA, 19 bp, Artificial Sequence
  Synthetic
cacggcagttatcaggctg

SEQ ID NO: 16219 - DNA, 19 bp, Artificial Sequence
  Synthetic
cgcggagtttaaagcacgc

SEQ ID NO: 16220 - DNA, 19 bp, Artificial Sequence
  Synthetic
gaacaaatccgcgtgttcg

SEQ ID NO: 16221 - DNA, 17 bp, Artificial Sequence
  Synthetic
ttcctgcaccagctcga

SEQ ID NO: 16222 - DNA, 16 bp, Artificial Sequence
  Synthetic
tgccctgcggatccaa

SEQ ID NO: 16223 - DNA, 17 bp, Artificial Sequence
  Synthetic
acaacggcagcgaatgg

SEQ ID NO: 16224 - DNA, 18 bp, Artificial Sequence
  Synthetic
atgacgcgcgaacgtttg

SEQ ID NO: 16225 - DNA, 16 bp, Artificial Sequence
  Synthetic
tgctcctgaccaccgc

SEQ ID NO: 16226 - DNA, 16 bp, Artificial Sequence
  Synthetic
tggaagccctcgccga

SEQ ID NO: 16227 - DNA, 18 bp, Artificial Sequence
  Synthetic
caccatcggcgtgaaacc

SEQ ID NO: 16228 - DNA, 16 bp, Artificial Sequence
  Synthetic
cgctgctcgccgtgat

SEQ ID NO: 16229 - DNA, 18 bp, Artificial Sequence
  Synthetic
cgtgtcgaaggcttgcag

SEQ ID NO: 16230 - DNA, 19 bp, Artificial Sequence
  Synthetic
agcgtaaccataggcagct

SEQ ID NO: 16231 - DNA, 17 bp, Artificial Sequence
  Synthetic
tgatgaccgcgctgtcc

SEQ ID NO: 16232 - DNA, 19 bp, Artificial Sequence
  Synthetic
gattacccagcaaatgcgc

SEQ ID NO: 16233 - DNA, 16 bp, Artificial Sequence
  Synthetic
cgcccccatgtgcgat

SEQ ID NO: 16234 - DNA, 24 bp, Artificial Sequence
  Synthetic
ccaaatcttttgctttagtatcag

SEQ ID NO: 16235 - DNA, 20 bp, Artificial Sequence
  Synthetic
tcaattgtaccaatcaggct

SEQ ID NO: 16236 - DNA, 22 bp, Artificial Sequence
  Synthetic
ttagttttgcctttagtggtaa

SEQ ID NO: 16237 - DNA, 19 bp, Artificial Sequence
  Synthetic
ggcacaaaataagccgatt

SEQ ID NO: 16238 - DNA, 17 bp, Artificial Sequence
  Synthetic
gacggcattgcatcgcg

SEQ ID NO: 16239 - DNA, 20 bp, Artificial Sequence
  Synthetic
atcgtcttcaacaacgacca

SEQ ID NO: 16240 - DNA, 19 bp, Artificial Sequence
  Synthetic
gcccaaacctccatctcac

SEQ ID NO: 16241 - DNA, 16 bp, Artificial Sequence
  Synthetic
cccgcgcctgtaaacg

SEQ ID NO: 16242 - DNA, 18 bp, Artificial Sequence
  Synthetic
ttgctgtgggggttgtct

SEQ ID NO: 16243 - DNA, 18 bp, Artificial Sequence
  Synthetic
cgaaataacgccgctcca

SEQ ID NO: 16244 - DNA, 18 bp, Artificial Sequence
  Synthetic
gcggattgcggatttcgt

SEQ ID NO: 16245 - DNA, 18 bp, Artificial Sequence
  Synthetic
tactacacccgcacccat

SEQ ID NO: 16246 - DNA, 19 bp, Artificial Sequence
  Synthetic
ccccgtattgaccacgtcc

SEQ ID NO: 16247 - DNA, 17 bp, Artificial Sequence
  Synthetic
gcgatgtggcaaacgcg

SEQ ID NO: 16248 - DNA, 18 bp, Artificial Sequence
  Synthetic
cgtatggcgatgtaccgg

SEQ ID NO: 16249 - DNA, 16 bp, Artificial Sequence
  Synthetic
cagcgattggggcgtc

SEQ ID NO: 16250 - DNA, 18 bp, Artificial Sequence
  Synthetic
aattgatgacgggggaag

SEQ ID NO: 16251 - DNA, 16 bp, Artificial Sequence
  Synthetic
gcgtgcggcatcgact

SEQ ID NO: 16252 - DNA, 17 bp, Artificial Sequence
  Synthetic
agcgatttggcgagccg

SEQ ID NO: 16253 - DNA, 18 bp, Artificial Sequence
  Synthetic
aataaatcgacgcgccgg

SEQ ID NO: 16254 - DNA, 16 bp, Artificial Sequence
  Synthetic
tccaactcgcgcaggt

SEQ ID NO: 16255 - DNA, 18 bp, Artificial Sequence
  Synthetic
accgccgcgatacctatg

SEQ ID NO: 16256 - DNA, 18 bp, Artificial Sequence
  Synthetic
catcctcctgccggtttg

SEQ ID NO: 16257 - DNA, 18 bp, Artificial Sequence
  Synthetic
gaggtatttggggcgaaa

SEQ ID NO: 16258 - DNA, 19 bp, Artificial Sequence
  Synthetic
tttccgggtgtattcggca

SEQ ID NO: 16259 - DNA, 19 bp, Artificial Sequence
  Synthetic
ccggacacttggttttcgg

SEQ ID NO: 16260 - DNA, 17 bp, Artificial Sequence
  Synthetic
cgctatgcgccaatccc

SEQ ID NO: 16261 - DNA, 18 bp, Artificial Sequence
  Synthetic
cttcccgttttcgccagt

SEQ ID NO: 16262 - DNA, 18 bp, Artificial Sequence
  Synthetic
ctggctgaccaacccctt

SEQ ID NO: 16263 - DNA, 16 bp, Artificial Sequence
  Synthetic
gctgccgccaatcgct

SEQ ID NO: 16264 - DNA, 20 bp, Artificial Sequence
  Synthetic
accggcagcttcaaaaacac

SEQ ID NO: 16265 - DNA, 18 bp, Artificial Sequence
  Synthetic
gccaacccaactacaccg

SEQ ID NO: 16266 - DNA, 16 bp, Artificial Sequence
  Synthetic
cgacagcctgcaaccc

SEQ ID NO: 16267 - DNA, 17 bp, Artificial Sequence
  Synthetic
acatgggacccgacgac

SEQ ID NO: 16268 - DNA, 19 bp, Artificial Sequence
  Synthetic
ctaccctatagcccgcctt

SEQ ID NO: 16269 - DNA, 18 bp, Artificial Sequence
  Synthetic
cgctgacgctgatttccg

SEQ ID NO: 16270 - DNA, 16 bp, Artificial Sequence
  Synthetic
gcgcccaagcttcgac

SEQ ID NO: 16271 - DNA, 19 bp, Artificial Sequence
  Synthetic
gtcgttgccaaagcctttg

SEQ ID NO: 16272 - DNA, 18 bp, Artificial Sequence
  Synthetic
acataaacagcggcaggg

SEQ ID NO: 16273 - DNA, 18 bp, Artificial Sequence
  Synthetic
ctttggacggcgttacca

SEQ ID NO: 16274 - DNA, 18 bp, Artificial Sequence
  Synthetic
ggaaggttcgggcatcac

SEQ ID NO: 16275 - DNA, 17 bp, Artificial Sequence
  Synthetic
tagcgtgccgggcgtta

SEQ ID NO: 16276 - DNA, 18 bp, Artificial Sequence
  Synthetic
aactcgtccgtactttgg

SEQ ID NO: 16277 - DNA, 20 bp, Artificial Sequence
  Synthetic
aatgcaatgtttatctgcct

SEQ ID NO: 16278 - DNA, 20 bp, Artificial Sequence
  Synthetic
caaatgccttggaaaaacct

SEQ ID NO: 16279 - DNA, 18 bp, Artificial Sequence
  Synthetic
ttgttatggcttggggtg

SEQ ID NO: 16280 - DNA, 18 bp, Artificial Sequence
  Synthetic
aggttgacaagcccggtt

SEQ ID NO: 16281 - DNA, 17 bp, Artificial Sequence
  Synthetic
gttgccggaaaccgtca

SEQ ID NO: 16282 - DNA, 19 bp, Artificial Sequence
  Synthetic
ctgccggtaatgttttgcg

SEQ ID NO: 16283 - DNA, 20 bp, Artificial Sequence
  Synthetic
cgatgcggtcgttttgaaag

SEQ ID NO: 16284 - DNA, 16 bp, Artificial Sequence
  Synthetic
gtcaggccggcggtat

SEQ ID NO: 16285 - DNA, 16 bp, Artificial Sequence
  Synthetic
tcgatgcgcgaagggt

SEQ ID NO: 16286 - DNA, 18 bp, Artificial Sequence
  Synthetic
gtcgagcagtgtgccttt

SEQ ID NO: 16287 - DNA, 20 bp, Artificial Sequence
  Synthetic
ttgtccgcgtatgatgaacg

SEQ ID NO: 16288 - DNA, 18 bp, Artificial Sequence
  Synthetic
cgtttccaagaggcggtc

SEQ ID NO: 16289 - DNA, 16 bp, Artificial Sequence
  Synthetic
ccgtcaaaaccggccg

SEQ ID NO: 16290 - DNA, 18 bp, Artificial Sequence
  Synthetic
ttttacccctgcttcacg

SEQ ID NO: 16291 - DNA, 16 bp, Artificial Sequence
  Synthetic
cggcgtacggctcgaa

SEQ ID NO: 16292 - DNA, 16 bp, Artificial Sequence
  Synthetic
cgatgccgtgtccgca

SEQ ID NO: 16293 - DNA, 17 bp, Artificial Sequence
  Synthetic
tcttctgtgccgtccgg

SEQ ID NO: 16294 - DNA, 17 bp, Artificial Sequence
  Synthetic
caggtggcggttgtagc

SEQ ID NO: 16295 - DNA, 19 bp, Artificial Sequence
  Synthetic
cgatacagtcgcacatggc

SEQ ID NO: 16296 - DNA, 18 bp, Artificial Sequence
  Synthetic
cgacctcgacaccgacga

SEQ ID NO: 16297 - DNA, 19 bp, Artificial Sequence
  Synthetic
aactcaaagtcctcgccga

SEQ ID NO: 16298 - DNA, 19 bp, Artificial Sequence
  Synthetic
tccccggtctgattgaagg

SEQ ID NO: 16299 - DNA, 18 bp, Artificial Sequence
  Synthetic
gggctggacggacatgtg

SEQ ID NO: 16300 - DNA, 16 bp, Artificial Sequence
  Synthetic
gttcggctgcacccca

SEQ ID NO: 16301 - DNA, 18 bp, Artificial Sequence
  Synthetic
ccacttgggcgtgaatcg

SEQ ID NO: 16302 - DNA, 19 bp, Artificial Sequence
  Synthetic
cgcctttgacaaagttcgg

SEQ ID NO: 16303 - DNA, 18 bp, Artificial Sequence
  Synthetic
ttgccgcaacacgtatcg

SEQ ID NO: 16304 - DNA, 19 bp, Artificial Sequence
  Synthetic
cgagtgcctgatgttcagt

SEQ ID NO: 16305 - DNA, 16 bp, Artificial Sequence
  Synthetic
agggcgaacagacggt

SEQ ID NO: 16306 - DNA, 17 bp, Artificial Sequence
  Synthetic
gggaaaacgcccaagcc

SEQ ID NO: 16307 - DNA, 16 bp, Artificial Sequence
  Synthetic
aatcggggtcggcagg

SEQ ID NO: 16308 - DNA, 17 bp, Artificial Sequence
  Synthetic
attcgacggccagtgcg

SEQ ID NO: 16309 - DNA, 19 bp, Artificial Sequence
  Synthetic
ggcggtgggcatttgtttg

SEQ ID NO: 16310 - DNA, 17 bp, Artificial Sequence
  Synthetic
gtgtaaacccgcgccac

SEQ ID NO: 16311 - DNA, 20 bp, Artificial Sequence
  Synthetic
actcgctggataatggcttg

SEQ ID NO: 16312 - DNA, 16 bp, Artificial Sequence
  Synthetic
agcgttgccgtcaggg

SEQ ID NO: 16313 - DNA, 15 bp, Artificial Sequence
  Synthetic
aaagcagggccgcca

SEQ ID NO: 16314 - DNA, 16 bp, Artificial Sequence
  Synthetic
ccgatccgcgcatcgt

SEQ ID NO: 16315 - DNA, 16 bp, Artificial Sequence
  Synthetic
cgcaagccggcaaact

SEQ ID NO: 16316 - DNA, 20 bp, Artificial Sequence
  Synthetic
ggcaaaaaccaaggctttga

SEQ ID NO: 16317 - DNA, 18 bp, Artificial Sequence
  Synthetic
cgaccgggcatattcagc

SEQ ID NO: 16318 - DNA, 16 bp, Artificial Sequence
  Synthetic
gcttttcgccgcttgc

SEQ ID NO: 16319 - DNA, 16 bp, Artificial Sequence
  Synthetic
gcgcggcaggtcgaaa

SEQ ID NO: 16320 - DNA, 20 bp, Artificial Sequence
  Synthetic
aaactttaccgcgaactgcc

SEQ ID NO: 16321 - DNA, 19 bp, Artificial Sequence
  Synthetic
gcaaggcgaagtcatcacc

SEQ ID NO: 16322 - DNA, 16 bp, Artificial Sequence
  Synthetic
tgctcaaacgcctgcg

SEQ ID NO: 16323 - DNA, 19 bp, Artificial Sequence
  Synthetic
cgtgaaaacaaacgcggac

SEQ ID NO: 16324 - DNA, 18 bp, Artificial Sequence
  Synthetic
actggccgaaatcacccg

SEQ ID NO: 16325 - DNA, 16 bp, Artificial Sequence
  Synthetic
cgcagcagcctttcgc

SEQ ID NO: 16326 - DNA, 17 bp, Artificial Sequence
  Synthetic
ccatttgggctgctcgc

SEQ ID NO: 16327 - DNA, 20 bp, Artificial Sequence
  Synthetic
ttgttctttgcccctgaagg

SEQ ID NO: 16328 - DNA, 18 bp, Artificial Sequence
  Synthetic
tgaaaagcctgaatccgt

SEQ ID NO: 16329 - DNA, 18 bp, Artificial Sequence
  Synthetic
gccgcctttaccgaatgc

SEQ ID NO: 16330 - DNA, 17 bp, Artificial Sequence
  Synthetic
ttggacgaagccgcagc

SEQ ID NO: 16331 - DNA, 17 bp, Artificial Sequence
  Synthetic
gccatccgtgaagcagc

SEQ ID NO: 16332 - DNA, 20 bp, Artificial Sequence
  Synthetic
tcatcacctacaaactcgcc

SEQ ID NO: 16333 - DNA, 17 bp, Artificial Sequence
  Synthetic
caggttgacggcaggtg

SEQ ID NO: 16334 - DNA, 20 bp, Artificial Sequence
  Synthetic
taatcgcgtccagattgagg

SEQ ID NO: 16335 - DNA, 17 bp, Artificial Sequence
  Synthetic
cctttttcgcgtgccgc

SEQ ID NO: 16336 - DNA, 18 bp, Artificial Sequence
  Synthetic
tgcccttgattgccgttg

SEQ ID NO: 16337 - DNA, 16 bp, Artificial Sequence
  Synthetic
aaggcttgggcgcaca

SEQ ID NO: 16338 - DNA, 19 bp, Artificial Sequence
  Synthetic
atggccttggtcggtatgg

SEQ ID NO: 16339 - DNA, 17 bp, Artificial Sequence
  Synthetic
cgaacatcggcggtctg

SEQ ID NO: 16340 - DNA, 19 bp, Artificial Sequence
  Synthetic
gaaccggtatcgaaatcgt

SEQ ID NO: 16341 - DNA, 20 bp, Artificial Sequence
  Synthetic
ttcctttctttgcgatgcct

SEQ ID NO: 16342 - DNA, 16 bp, Artificial Sequence
  Synthetic
cgccggcagaagcgtt

SEQ ID NO: 16343 - DNA, 20 bp, Artificial Sequence
  Synthetic
gacaaaaccaaattcccgcc

SEQ ID NO: 16344 - DNA, 16 bp, Artificial Sequence
  Synthetic
cgtgcctgttccggca

SEQ ID NO: 16345 - DNA, 17 bp, Artificial Sequence
  Synthetic
ggtaactgtgcgcctgc

SEQ ID NO: 16346 - DNA, 16 bp, Artificial Sequence
  Synthetic
gcgagcgtttcccagc

SEQ ID NO: 16347 - DNA, 18 bp, Artificial Sequence
  Synthetic
gcactaccgctggacgta

SEQ ID NO: 16348 - DNA, 16 bp, Artificial Sequence
  Synthetic
cggcgttcgtgtcggt

SEQ ID NO: 16349 - DNA, 20 bp, Artificial Sequence
  Synthetic
gatttcctcgaccttgcctt

SEQ ID NO: 16350 - DNA, 19 bp, Artificial Sequence
  Synthetic
agggttcgtacagggatgc

SEQ ID NO: 16351 - DNA, 18 bp, Artificial Sequence
  Synthetic
cgccgcatcatatgggaa

SEQ ID NO: 16352 - DNA, 16 bp, Artificial Sequence
  Synthetic
ccaagcgtgcggatgc

SEQ ID NO: 16353 - DNA, 15 bp, Artificial Sequence
  Synthetic
ccggttgcgcgcaaa

SEQ ID NO: 16354 - DNA, 20 bp, Artificial Sequence
  Synthetic
ttggaaatggaaaacccgcg

SEQ ID NO: 16355 - DNA, 18 bp, Artificial Sequence
  Synthetic
aggttgatgtcttgcggc

SEQ ID NO: 16356 - DNA, 19 bp, Artificial Sequence
  Synthetic
cttcatcggtcagcggaat

SEQ ID NO: 16357 - DNA, 17 bp, Artificial Sequence
  Synthetic
atgctgtcggcgagtgc

SEQ ID NO: 16358 - DNA, 16 bp, Artificial Sequence
  Synthetic
ggtcgctgtctcgcgt

SEQ ID NO: 16359 - DNA, 16 bp, Artificial Sequence
  Synthetic
aatcgggcccggatgg

SEQ ID NO: 16360 - DNA, 16 bp, Artificial Sequence
  Synthetic
gcactgccgccggatt

SEQ ID NO: 16361 - DNA, 16 bp, Artificial Sequence
  Synthetic
gcaccaaaatgccgcg

SEQ ID NO: 16362 - DNA, 23 bp, Artificial Sequence
  Synthetic
ggctttaattgacgattatcttg

SEQ ID NO: 16363 - DNA, 17 bp, Artificial Sequence
  Synthetic
ccgtccggttcaaaccc

SEQ ID NO: 16364 - DNA, 17 bp, Artificial Sequence
  Synthetic
attgtgcggcggaaacc

SEQ ID NO: 16365 - DNA, 17 bp, Artificial Sequence
  Synthetic
cgttcggctttggtgcc

SEQ ID NO: 16366 - DNA, 17 bp, Artificial Sequence
  Synthetic
aggctccggcgaatacg

SEQ ID NO: 16367 - DNA, 19 bp, Artificial Sequence
  Synthetic
cctgccctatctggtagcg

SEQ ID NO: 16368 - DNA, 20 bp, Artificial Sequence
  Synthetic
cgccggctttgtttatgttg

SEQ ID NO: 16369 - DNA, 16 bp, Artificial Sequence
  Synthetic
cgtttgaggcgcgggt

SEQ ID NO: 16370 - DNA, 18 bp, Artificial Sequence
  Synthetic
ttccgccgactattccca

SEQ ID NO: 16371 - DNA, 18 bp, Artificial Sequence
  Synthetic
gcggcggattttgcctct

SEQ ID NO: 16372 - DNA, 17 bp, Artificial Sequence
  Synthetic
aaacaggatgccgacgc

SEQ ID NO: 16373 - DNA, 20 bp, Artificial Sequence
  Synthetic
aacaagtgcagatgcttggt

SEQ ID NO: 16374 - DNA, 19 bp, Artificial Sequence
  Synthetic
ttcgttgaggaatcgggct

SEQ ID NO: 16375 - DNA, 18 bp, Artificial Sequence
  Synthetic
tgcctgaaacaatgccgt

SEQ ID NO: 16376 - DNA, 16 bp, Artificial Sequence
  Synthetic
cgaggtcgttgcgcag

SEQ ID NO: 16377 - DNA, 17 bp, Artificial Sequence
  Synthetic
tttggcggatgcggtcg

SEQ ID NO: 16378 - DNA, 18 bp, Artificial Sequence
  Synthetic
cgccgcaaaccaatttcg

SEQ ID NO: 16379 - DNA, 19 bp, Artificial Sequence
  Synthetic
catccgatacagccgtccc

SEQ ID NO: 16380 - DNA, 16 bp, Artificial Sequence
  Synthetic
cccgcctgccaaaacc

SEQ ID NO: 16381 - DNA, 20 bp, Artificial Sequence
  Synthetic
tacccggaaaaacatacgcg

SEQ ID NO: 16382 - DNA, 15 bp, Artificial Sequence
  Synthetic
ttgcggtcggtgcgt

SEQ ID NO: 16383 - DNA, 18 bp, Artificial Sequence
  Synthetic
aacagggcatattcgcgc

SEQ ID NO: 16384 - DNA, 17 bp, Artificial Sequence
  Synthetic
cggcaggcatgataggc

SEQ ID NO: 16385 - DNA, 19 bp, Artificial Sequence
  Synthetic
ccatttccgttacccgctt

SEQ ID NO: 16386 - DNA, 18 bp, Artificial Sequence
  Synthetic
gtcgtcgcttcgtttgcc

SEQ ID NO: 16387 - DNA, 17 bp, Artificial Sequence
  Synthetic
gcaaaattgccgccgcc

SEQ ID NO: 16388 - DNA, 19 bp, Artificial Sequence
  Synthetic
gccgtcgccgtattcaaac

SEQ ID NO: 16389 - DNA, 17 bp, Artificial Sequence
  Synthetic
atggcgaacgggtttgc

SEQ ID NO: 16390 - DNA, 18 bp, Artificial Sequence
  Synthetic
cgcaaggaagacggttcg

SEQ ID NO: 16391 - DNA, 18 bp, Artificial Sequence
  Synthetic
gaatgtttgttgcgccgg

SEQ ID NO: 16392 - DNA, 16 bp, Artificial Sequence
  Synthetic
gcgtcgccgaatctgc

SEQ ID NO: 16393 - DNA, 18 bp, Artificial Sequence
  Synthetic
ttgtccaatgcgctggtg

SEQ ID NO: 16394 - DNA, 15 bp, Artificial Sequence
  Synthetic
cgcgagcgtgccttt

SEQ ID NO: 16395 - DNA, 18 bp, Artificial Sequence
  Synthetic
ggtggaaaggatgtcggc

SEQ ID NO: 16396 - DNA, 19 bp, Artificial Sequence
  Synthetic
ctgcaatgggaaggaacgg

SEQ ID NO: 16397 - DNA, 18 bp, Artificial Sequence
  Synthetic
cttgcgtgcagagtaccg

SEQ ID NO: 16398 - DNA, 22 bp, Artificial Sequence
  Synthetic
ttgtagctactttgatattccg

SEQ ID NO: 16399 - DNA, 19 bp, Artificial Sequence
  Synthetic
ttatgcaacgaaagcttgt

SEQ ID NO: 16400 - DNA, 18 bp, Artificial Sequence
  Synthetic
aaaaggaccgtctgttgc

SEQ ID NO: 16401 - DNA, 18 bp, Artificial Sequence
  Synthetic
agaagtgttcctgcagct

SEQ ID NO: 16402 - DNA, 21 bp, Artificial Sequence
  Synthetic
atcatataccagcaacaaggg

SEQ ID NO: 16403 - DNA, 21 bp, Artificial Sequence
  Synthetic
tgggaaagttgattatgatgg

SEQ ID NO: 16404 - DNA, 18 bp, Artificial Sequence
  Synthetic
ctagggatccggccatag

SEQ ID NO: 16405 - DNA, 22 bp, Artificial Sequence
  Synthetic
tattccactagaacctataggc

SEQ ID NO: 16406 - DNA, 20 bp, Artificial Sequence
  Synthetic
gccacctgtacaaagtactc

SEQ ID NO: 16407 - DNA, 23 bp, Artificial Sequence
  Synthetic
ttttctgacgaatctttattgga

SEQ ID NO: 16408 - DNA, 21 bp, Artificial Sequence
  Synthetic
gttttgcgtttacagttacct

SEQ ID NO: 16409 - DNA, 18 bp, Artificial Sequence
  Synthetic
tggccagattttgtgcag

SEQ ID NO: 16410 - DNA, 23 bp, Artificial Sequence
  Synthetic
ttggaagtagaaatagtaatgca

SEQ ID NO: 16411 - DNA, 22 bp, Artificial Sequence
  Synthetic
caatgttaagctgtgaaacttg

SEQ ID NO: 16412 - DNA, 18 bp, Artificial Sequence
  Synthetic
cgacaatgcttcaatccg

SEQ ID NO: 16413 - DNA, 20 bp, Artificial Sequence
  Synthetic
gcctggacagtagtaaacag

SEQ ID NO: 16414 - DNA, 23 bp, Artificial Sequence
  Synthetic
attgaaccttttctgaaaacaac

SEQ ID NO: 16415 - DNA, 18 bp, Artificial Sequence
  Synthetic
aagcaagtactggcggaa

SEQ ID NO: 16416 - DNA, 19 bp, Artificial Sequence
  Synthetic
ctggatagagctcgatgag

SEQ ID NO: 16417 - DNA, 23 bp, Artificial Sequence
  Synthetic
atggtttcatcataaaaggaaga

SEQ ID NO: 16418 - DNA, 20 bp, Artificial Sequence
  Synthetic
ctccttcagtcactacaaca

SEQ ID NO: 16419 - DNA, 17 bp, Artificial Sequence
  Synthetic
ggaggaagccacacgga

SEQ ID NO: 16420 - DNA, 19 bp, Artificial Sequence
  Synthetic
cggaccccctttcaaagtg

SEQ ID NO: 16421 - DNA, 20 bp, Artificial Sequence
  Synthetic
tagcttcccagagagaagcg

SEQ ID NO: 16422 - DNA, 20 bp, Artificial Sequence
  Synthetic
ttccccttatgtccagtccc

SEQ ID NO: 16423 - DNA, 19 bp, Artificial Sequence
  Synthetic
gttctcgagggccttcctt

SEQ ID NO: 16424 - DNA, 22 bp, Artificial Sequence
  Synthetic
cgaaaccggtacatataaaagt

SEQ ID NO: 16425 - DNA, 20 bp, Artificial Sequence
  Synthetic
tatggtgcaacattagaagc

SEQ ID NO: 16426 - DNA, 25 bp, Artificial Sequence
  Synthetic
attgaagatgtaatactagatctgg

SEQ ID NO: 16427 - DNA, 18 bp, Artificial Sequence
  Synthetic
cttggtgtgccatcagtg

SEQ ID NO: 16428 - DNA, 19 bp, Artificial Sequence
  Synthetic
taacccaggcattgtttca

SEQ ID NO: 16429 - DNA, 21 bp, Artificial Sequence
  Synthetic
caatgggaatcctgtatatgc

SEQ ID NO: 16430 - DNA, 18 bp, Artificial Sequence
  Synthetic
gtggtgccctctactgtt

SEQ ID NO: 16431 - DNA, 21 bp, Artificial Sequence
  Synthetic
taaaggtactggagatgttga

SEQ ID NO: 16432 - DNA, 18 bp, Artificial Sequence
  Synthetic
ggcaccaaggaaaccgag

SEQ ID NO: 16433 - DNA, 18 bp, Artificial Sequence
  Synthetic
ctgtgggtcctacagaac

SEQ ID NO: 16434 - DNA, 20 bp, Artificial Sequence
  Synthetic
cagtagtactgtagcacctg

SEQ ID NO: 16435 - DNA, 21 bp, Artificial Sequence
  Synthetic
atatgcagaccctgatacagt

SEQ ID NO: 16436 - DNA, 25 bp, Artificial Sequence
  Synthetic
catggggataattattatttatggc

SEQ ID NO: 16437 - DNA, 21 bp, Artificial Sequence
  Synthetic
cgaaattcctaaggtatctgc

SEQ ID NO: 16438 - DNA, 25 bp, Artificial Sequence
  Synthetic
cagttatgtattataggttgtacac

SEQ ID NO: 16439 - DNA, 22 bp, Artificial Sequence
  Synthetic
acagcatgtttttttttcttcg

SEQ ID NO: 16440 - DNA, 22 bp, Artificial Sequence
  Synthetic
aacgcaaaaaacgtaaacttac

SEQ ID NO: 16441 - DNA, 16 bp, Artificial Sequence
  Synthetic
tggagcacccccccta

SEQ ID NO: 16442 - DNA, 20 bp, Artificial Sequence
  Synthetic
gcaagcccacctatatgtgt

SEQ ID NO: 16443 - DNA, 18 bp, Artificial Sequence
  Synthetic
tctagtaggcccgctggt

SEQ ID NO: 16444 - DNA, 20 bp, Artificial Sequence
  Synthetic
ttgttctccttccacttgcc

SEQ ID NO: 16445 - DNA, 20 bp, Artificial Sequence
  Synthetic
tttgttacagtccaaagtgg

SEQ ID NO: 16446 - DNA, 21 bp, Artificial Sequence
  Synthetic
tcaggccatttgtattttgag

SEQ ID NO: 16447 - DNA, 18 bp, Artificial Sequence
  Synthetic
gtcaccgcatagctctgc

SEQ ID NO: 16448 - DNA, 18 bp, Artificial Sequence
  Synthetic
cgctggtgactttctgtg

SEQ ID NO: 16449 - DNA, 19 bp, Artificial Sequence
  Synthetic
cacggttgatggtttgccc

SEQ ID NO: 16450 - DNA, 20 bp, Artificial Sequence
  Synthetic
acacccaataaccgttgacg

SEQ ID NO: 16451 - DNA, 20 bp, Artificial Sequence
  Synthetic
gccactcttgatacaaaacc

SEQ ID NO: 16452 - DNA, 18 bp, Artificial Sequence
  Synthetic
gtcctaaccgaagctcca

SEQ ID NO: 16453 - DNA, 19 bp, Artificial Sequence
  Synthetic
acattgttgaagccttcga

SEQ ID NO: 16454 - DNA, 21 bp, Artificial Sequence
  Synthetic
gagtacaatcaccacaactag

SEQ ID NO: 16455 - DNA, 18 bp, Artificial Sequence
  Synthetic
ttgacatgctaggcggct

SEQ ID NO: 16456 - DNA, 22 bp, Artificial Sequence
  Synthetic
acttgttcaaattactggagag

SEQ ID NO: 16457 - DNA, 19 bp, Artificial Sequence
  Synthetic
tcatgtcctgaaagcctgc

SEQ ID NO: 16458 - DNA, 20 bp, Artificial Sequence
  Synthetic
tgggaaagagtgagttttcg

SEQ ID NO: 16459 - DNA, 20 bp, Artificial Sequence
  Synthetic
gctaagtcccacatcactgg

SEQ ID NO: 16460 - DNA, 19 bp, Artificial Sequence
  Synthetic
tgttgtcgatgtggtcacc

SEQ ID NO: 16461 - DNA, 18 bp, Artificial Sequence
  Synthetic
cgaacaggctggcatgaa

SEQ ID NO: 16462 - DNA, 20 bp, Artificial Sequence
  Synthetic
ttgaggacaaacttcccgag

SEQ ID NO: 16463 - DNA, 18 bp, Artificial Sequence
  Synthetic
cttctctggcatgctaca

SEQ ID NO: 16464 - DNA, 18 bp, Artificial Sequence
  Synthetic
gggagaccccgggcttaa

SEQ ID NO: 16465 - DNA, 21 bp, Artificial Sequence
  Synthetic
tctgtttctctcaccatttcc

SEQ ID NO: 16466 - DNA, 20 bp, Artificial Sequence
  Synthetic
tacagaaattggtcaaagcc

SEQ ID NO: 16467 - DNA, 18 bp, Artificial Sequence
  Synthetic
caagtgtgcatagcatgg

SEQ ID NO: 16468 - DNA, 23 bp, Artificial Sequence
  Synthetic
ggaaaatcattcatactagcaca

SEQ ID NO: 16469 - DNA, 22 bp, Artificial Sequence
  Synthetic
cattgcttggatcctaacaatg

SEQ ID NO: 16470 - DNA, 23 bp, Artificial Sequence
  Synthetic
ttgaattgtcttattgttcgttg

SEQ ID NO: 16471 - DNA, 22 bp, Artificial Sequence
  Synthetic
attatattgggttgacacctgt

SEQ ID NO: 16472 - DNA, 25 bp, Artificial Sequence
  Synthetic
atatatttgaagagagtacagatgg

SEQ ID NO: 16473 - DNA, 22 bp, Artificial Sequence
  Synthetic
aaaagacgattatttcaggaca

SEQ ID NO: 16474 - DNA, 25 bp, Artificial Sequence
  Synthetic
aggtaaagtcatttctttcatgaac

SEQ ID NO: 16475 - DNA, 18 bp, Artificial Sequence
  Synthetic
tcgcagactccagccaag

SEQ ID NO: 16476 - DNA, 18 bp, Artificial Sequence
  Synthetic
gaatctgctgtcccgtct

SEQ ID NO: 16477 - DNA, 18 bp, Artificial Sequence
  Synthetic
tggattgggaattggcac

SEQ ID NO: 16478 - DNA, 20 bp, Artificial Sequence
  Synthetic
cttttccgatgatgtcactt

SEQ ID NO: 16479 - DNA, 18 bp, Artificial Sequence
  Synthetic
accgttaggggttggaac

SEQ ID NO: 16480 - DNA, 23 bp, Artificial Sequence
  Synthetic
aatacaagatggtgatatgtgtg

SEQ ID NO: 16481 - DNA, 18 bp, Artificial Sequence
  Synthetic
cagagctgtcaaccgttt

SEQ ID NO: 16482 - DNA, 18 bp, Artificial Sequence
  Synthetic
caacccttcttgtgacct

SEQ ID NO: 16483 - DNA, 20 bp, Artificial Sequence
  Synthetic
caaaagagcggtttttaccc

SEQ ID NO: 16484 - DNA, 18 bp, Artificial Sequence
  Synthetic
ggccaaacattgcgagta

SEQ ID NO: 16485 - DNA, 19 bp, Artificial Sequence
  Synthetic
agaggactatttggagcca

SEQ ID NO: 16486 - DNA, 23 bp, Artificial Sequence
  Synthetic
agattgatgaccaaatacaagac

SEQ ID NO: 16487 - DNA, 20 bp, Artificial Sequence
  Synthetic
atgagtgtcgaacagcctcc

SEQ ID NO: 16488 - DNA, 17 bp, Artificial Sequence
  Synthetic
gcccacaggacgtcaag

SEQ ID NO: 16489 - DNA, 17 bp, Artificial Sequence
  Synthetic
tgccctgtgtcctggaa

SEQ ID NO: 16490 - DNA, 20 bp, Artificial Sequence
  Synthetic
ctgggccaaggttatactgg

SEQ ID NO: 16491 - DNA, 20 bp, Artificial Sequence
  Synthetic
tcaactcttctgggtgtcca

SEQ ID NO: 16492 - DNA, 18 bp, Artificial Sequence
  Synthetic
taacattaggccccccgc

SEQ ID NO: 16493 - DNA, 20 bp, Artificial Sequence
  Synthetic
aattggacctatggtgagcg

SEQ ID NO: 16494 - DNA, 20 bp, Artificial Sequence
  Synthetic
gaagcaacctgcaagaacgt

SEQ ID NO: 16495 - DNA, 20 bp, Artificial Sequence
  Synthetic
tttcatagcccgagtggagg

SEQ ID NO: 16496 - DNA, 18 bp, Artificial Sequence
  Synthetic
tgaaggattgggcagcgt

SEQ ID NO: 16497 - DNA, 20 bp, Artificial Sequence
  Synthetic
aggtgcagttcttatccacg

SEQ ID NO: 16498 - DNA, 20 bp, Artificial Sequence
  Synthetic
ttacctcaagggttcctcgg

SEQ ID NO: 16499 - DNA, 16 bp, Artificial Sequence
  Synthetic
gttcgggttcggggca

SEQ ID NO: 16500 - DNA, 19 bp, Artificial Sequence
  Synthetic
taaagggcggtaggcatct

SEQ ID NO: 16501 - DNA, 20 bp, Artificial Sequence
  Synthetic
gagactactacagtgcccca

SEQ ID NO: 16502 - DNA, 20 bp, Artificial Sequence
  Synthetic
ccagctgggatacaatgtgg

SEQ ID NO: 16503 - DNA, 18 bp, Artificial Sequence
  Synthetic
accttgccgggtaatccc

SEQ ID NO: 16504 - DNA, 20 bp, Artificial Sequence
  Synthetic
tcaatactctgccctggagc

SEQ ID NO: 16505 - DNA, 19 bp, Artificial Sequence
  Synthetic
cggcactgacagacttcaa

SEQ ID NO: 16506 - DNA, 20 bp, Artificial Sequence
  Synthetic
acaatctgaagtgtccctgc

SEQ ID NO: 16507 - DNA, 18 bp, Artificial Sequence
  Synthetic
tctccaccctctctggca

SEQ ID NO: 16508 - DNA, 17 bp, Artificial Sequence
  Synthetic
gacttggaagcgaccgg

SEQ ID NO: 16509 - DNA, 18 bp, Artificial Sequence
  Synthetic
cagggtcatggtcaaccg

SEQ ID NO: 16510 - DNA, 19 bp, Artificial Sequence
  Synthetic
ccctagaggaagcctgtgg

SEQ ID NO: 16511 - DNA, 20 bp, Artificial Sequence
  Synthetic
gctttagcctcctgtagagc

SEQ ID NO: 16512 - DNA, 20 bp, Artificial Sequence
  Synthetic
cggttaattcctggctaggg

SEQ ID NO: 16513 - DNA, 18 bp, Artificial Sequence
  Synthetic
ttggagacatcgggctcg

SEQ ID NO: 16514 - DNA, 23 bp, Artificial Sequence
  Synthetic
cttgtagatctgttctctaaacg

SEQ ID NO: 16515 - DNA, 20 bp, Artificial Sequence
  Synthetic
ggttagagacgtgctagtgc

SEQ ID NO: 16516 - DNA, 20 bp, Artificial Sequence
  Synthetic
gagtgccaagaaatttgaca

SEQ ID NO: 16517 - DNA, 18 bp, Artificial Sequence
  Synthetic
gcaagggaggtaggacta

SEQ ID NO: 16518 - DNA, 18 bp, Artificial Sequence
  Synthetic
attgttgagtcctgcggt

SEQ ID NO: 16519 - DNA, 21 bp, Artificial Sequence
  Synthetic
gacgccatggtttatacttca

SEQ ID NO: 16520 - DNA, 19 bp, Artificial Sequence
  Synthetic
ttgttaacaaggcactcga

SEQ ID NO: 16521 - DNA, 19 bp, Artificial Sequence
  Synthetic
accagtctgtgtaaatggc

SEQ ID NO: 16522 - DNA, 25 bp, Artificial Sequence
  Synthetic
acttttcatcacgtatgtattgttc

SEQ ID NO: 16523 - DNA, 21 bp, Artificial Sequence
  Synthetic
tgtgttgacatcgttaaggag

SEQ ID NO: 16524 - DNA, 20 bp, Artificial Sequence
  Synthetic
tcacaggacatcttacttgc

SEQ ID NO: 16525 - DNA, 20 bp, Artificial Sequence
  Synthetic
gaacatgcttagaggtgaag

SEQ ID NO: 16526 - DNA, 22 bp, Artificial Sequence
  Synthetic
aactgtatcctggaatttgaga

SEQ ID NO: 16527 - DNA, 20 bp, Artificial Sequence
  Synthetic
ccgtagtgtcagtatcatca

SEQ ID NO: 16528 - DNA, 23 bp, Artificial Sequence
  Synthetic
atgtaaatcatgagggtaagact

SEQ ID NO: 16529 - DNA, 21 bp, Artificial Sequence
  Synthetic
catgctaatttggaatctgca

SEQ ID NO: 16530 - DNA, 21 bp, Artificial Sequence
  Synthetic
taaggagaccctctatcgtat

SEQ ID NO: 16531 - DNA, 18 bp, Artificial Sequence
  Synthetic
caaagccagcttcacgag

SEQ ID NO: 16532 - DNA, 22 bp, Artificial Sequence
  Synthetic
accatacagaaggaagtcatag

SEQ ID NO: 16533 - DNA, 21 bp, Artificial Sequence
  Synthetic
gctccttcttattgtaatggc

SEQ ID NO: 16534 - DNA, 18 bp, Artificial Sequence
  Synthetic
tcttggctcatgtggttt

SEQ ID NO: 16535 - DNA, 21 bp, Artificial Sequence
  Synthetic
tcattagtgatgaagttgctc

SEQ ID NO: 16536 - DNA, 22 bp, Artificial Sequence
  Synthetic
gtttccgttaagatgtttgatg

SEQ ID NO: 16537 - DNA, 20 bp, Artificial Sequence
  Synthetic
catatcaatgcccaagtagc

SEQ ID NO: 16538 - DNA, 21 bp, Artificial Sequence
  Synthetic
aaatcattggttacaaagcca

SEQ ID NO: 16539 - DNA, 18 bp, Artificial Sequence
  Synthetic
gctatgggcaaacctgtg

SEQ ID NO: 16540 - DNA, 19 bp, Artificial Sequence
  Synthetic
ttactcctcttgtgcaacc

SEQ ID NO: 16541 - DNA, 22 bp, Artificial Sequence
  Synthetic
gttacatttagtaccttcgagg

SEQ ID NO: 16542 - DNA, 20 bp, Artificial Sequence
  Synthetic
gctgatgttctctaccaacc

SEQ ID NO: 16543 - DNA, 21 bp, Artificial Sequence
  Synthetic
aaaattgtctgcttaggctta

SEQ ID NO: 16544 - DNA, 22 bp, Artificial Sequence
  Synthetic
agattcaccactactttgaatg

SEQ ID NO: 16545 - DNA, 24 bp, Artificial Sequence
  Synthetic
catcattggatgcttttaactttc

SEQ ID NO: 16546 - DNA, 25 bp, Artificial Sequence
  Synthetic
tctactatggtaatgctttagatca

SEQ ID NO: 16547 - DNA, 18 bp, Artificial Sequence
  Synthetic
atatgaactcccaggggc

SEQ ID NO: 16548 - DNA, 22 bp, Artificial Sequence
  Synthetic
agaagatggtttctcttttgtc

SEQ ID NO: 16549 - DNA, 19 bp, Artificial Sequence
  Synthetic
caggctatgacccaaatgt

SEQ ID NO: 16550 - DNA, 21 bp, Artificial Sequence
  Synthetic
ttggcctcttattgttacagc

SEQ ID NO: 16551 - DNA, 18 bp, Artificial Sequence
  Synthetic
tatggtgctgggcagttt

SEQ ID NO: 16552 - DNA, 23 bp, Artificial Sequence
  Synthetic
taaaggattctgtgacttgaaag

SEQ ID NO: 16553 - DNA, 23 bp, Artificial Sequence
  Synthetic
ataacttggttaaagattgtcca

SEQ ID NO: 16554 - DNA, 24 bp, Artificial Sequence
  Synthetic
tgtacgccaatcattattaaagac

SEQ ID NO: 16555 - DNA, 23 bp, Artificial Sequence
  Synthetic
tctcttcgaccgttattttaaat

SEQ ID NO: 16556 - DNA, 22 bp, Artificial Sequence
  Synthetic
tattgctagataaacgcactac

SEQ ID NO: 16557 - DNA, 25 bp, Artificial Sequence
  Synthetic
aactcaaatgaatcttaagtatgcc

SEQ ID NO: 16558 - DNA, 20 bp, Artificial Sequence
  Synthetic
gttcttgctcgcaaacataa

SEQ ID NO: 16559 - DNA, 21 bp, Artificial Sequence
  Synthetic
atcatgaattcgtggatgagt

SEQ ID NO: 16560 - DNA, 22 bp, Artificial Sequence
  Synthetic
acttatgattgaaaggttcgtg

SEQ ID NO: 16561 - DNA, 20 bp, Artificial Sequence
  Synthetic
gaccattcctatgttgcaag

SEQ ID NO: 16562 - DNA, 20 bp, Artificial Sequence
  Synthetic
ccaacacttgtactgagaga

SEQ ID NO: 16563 - DNA, 21 bp, Artificial Sequence
  Synthetic
cttagtgcacctactctagtg

SEQ ID NO: 16564 - DNA, 19 bp, Artificial Sequence
  Synthetic
atgcattgccagaaacaac

SEQ ID NO: 16565 - DNA, 22 bp, Artificial Sequence
  Synthetic
aaaagcacacaaggataagtca

SEQ ID NO: 16566 - DNA, 22 bp, Artificial Sequence
  Synthetic
cattttgtgcataatgtctgat

SEQ ID NO: 16567 - DNA, 24 bp, Artificial Sequence
  Synthetic
ggttaccctaatatgtttatcacc

SEQ ID NO: 16568 - DNA, 22 bp, Artificial Sequence
  Synthetic
agtgatacactgaaaggattgt

SEQ ID NO: 16569 - DNA, 22 bp, Artificial Sequence
  Synthetic
attataggagatgaactgaggg

SEQ ID NO: 16570 - DNA, 21 bp, Artificial Sequence
  Synthetic
aatgcaattgtgtgtaggttt

SEQ ID NO: 16571 - DNA, 20 bp, Artificial Sequence
  Synthetic
atttctgctggatttagcct

SEQ ID NO: 16572 - DNA, 18 bp, Artificial Sequence
  Synthetic
tctgcacaatgactgaca

SEQ ID NO: 16573 - DNA, 20 bp, Artificial Sequence
  Synthetic
taagcccagatcacaaatgg

SEQ ID NO: 16574 - DNA, 25 bp, Artificial Sequence
  Synthetic
aataaagtcacaagatttgtcagtg

SEQ ID NO: 16575 - DNA, 19 bp, Artificial Sequence
  Synthetic
ctcagacaatggttgccaa

SEQ ID NO: 16576 - DNA, 22 bp, Artificial Sequence
  Synthetic
ggacagcttttgttacaaatgt

SEQ ID NO: 16577 - DNA, 22 bp, Artificial Sequence
  Synthetic
gtaactttgaattgtgtgacaa

SEQ ID NO: 16578 - DNA, 19 bp, Artificial Sequence
  Synthetic
ttttcacctgctcaagaca

SEQ ID NO: 16579 - DNA, 25 bp, Artificial Sequence
  Synthetic
ctacaactcaacatttttttcaacc

SEQ ID NO: 16580 - DNA, 18 bp, Artificial Sequence
  Synthetic
taggccctttgagagaga

SEQ ID NO: 16581 - DNA, 25 bp, Artificial Sequence
  Synthetic
catctgaaatattagacatttcacc

SEQ ID NO: 16582 - DNA, 22 bp, Artificial Sequence
  Synthetic
actagccaaaaatctattgtgg

SEQ ID NO: 16583 - DNA, 22 bp, Artificial Sequence
  Synthetic
aggtcttttattgaggacttgc

SEQ ID NO: 16584 - DNA, 24 bp, Artificial Sequence
  Synthetic
tctatgagaaccaaaaacaaatcg

SEQ ID NO: 16585 - DNA, 19 bp, Artificial Sequence
  Synthetic
tgagtgtgttcttggacaa

SEQ ID NO: 16586 - DNA, 23 bp, Artificial Sequence
  Synthetic
tcgttattggcatcattaacaac

SEQ ID NO: 16587 - DNA, 22 bp, Artificial Sequence
  Synthetic
catcgtcatggttacaatcttg

SEQ ID NO: 16588 - DNA, 19 bp, Artificial Sequence
  Synthetic
gctgtttttcagagcgcta

SEQ ID NO: 16589 - DNA, 21 bp, Artificial Sequence
  Synthetic
aattggtggttattctgagga

SEQ ID NO: 16590 - DNA, 18 bp, Artificial Sequence
  Synthetic
tcggaagaaacaggtacg

SEQ ID NO: 16591 - DNA, 18 bp, Artificial Sequence
  Synthetic
tcctggaacaatggaacc

SEQ ID NO: 16592 - DNA, 20 bp, Artificial Sequence
  Synthetic
acttgtcattggtgctgtga

SEQ ID NO: 16593 - DNA, 24 bp, Artificial Sequence
  Synthetic
catgaaaattattctcttcctgac

SEQ ID NO: 16594 - DNA, 22 bp, Artificial Sequence
  Synthetic
ttgtatttctctatgcagttgc

SEQ ID NO: 16595 - DNA, 19 bp, Artificial Sequence
  Synthetic
ccccccgcattacatttgg

SEQ ID NO: 16596 - DNA, 18 bp, Artificial Sequence
  Synthetic
acttccctacggcgctaa

SEQ ID NO: 16597 - DNA, 20 bp, Artificial Sequence
  Synthetic
cttgagagcaaagtttctgg

SEQ ID NO: 16598 - DNA, 20 bp, Artificial Sequence
  Synthetic
tcatggagccattaaattgg

SEQ ID NO: 16599 - DNA, 24 bp, Artificial Sequence
  Synthetic
ttccgtttacgatacatagtctac

SEQ ID NO: 16600 - DNA, 18 bp, Artificial Sequence
  Synthetic
ccatgcggtgttgtactc

SEQ ID NO: 16601 - DNA, 20 bp, Artificial Sequence
  Synthetic
agtagacctggcagatgagg

SEQ ID NO: 16602 - DNA, 18 bp, Artificial Sequence
  Synthetic
gtgtccgtgtttcctgtt

SEQ ID NO: 16603 - DNA, 24 bp, Artificial Sequence
  Synthetic
ctgttaaagatgtgttagaaaagg

SEQ ID NO: 16604 - DNA, 18 bp, Artificial Sequence
  Synthetic
tggacagtcgttcttgga

SEQ ID NO: 16605 - DNA, 19 bp, Artificial Sequence
  Synthetic
aggtgagcaaggtagagaa

SEQ ID NO: 16606 - DNA, 22 bp, Artificial Sequence
  Synthetic
tcaattagccctatgttttcag

SEQ ID NO: 16607 - DNA, 25 bp, Artificial Sequence
  Synthetic
tgaatatgtacactgttgatttacg

SEQ ID NO: 16608 - DNA, 18 bp, Artificial Sequence
  Synthetic
tcctggtgttggaaaacc

SEQ ID NO: 16609 - DNA, 25 bp, Artificial Sequence
  Synthetic
caaagatttttgcttaagattagcc

SEQ ID NO: 16610 - DNA, 20 bp, Artificial Sequence
  Synthetic
ttatgtatgtacccccagga

SEQ ID NO: 16611 - DNA, 21 bp, Artificial Sequence
  Synthetic
cacgattcaaatattgtgtgc

SEQ ID NO: 16612 - DNA, 25 bp, Artificial Sequence
  Synthetic
tgattctattcttgtatcatactcc

SEQ ID NO: 16613 - DNA, 24 bp, Artificial Sequence
  Synthetic
tggtgttataggtatgattacagc

SEQ ID NO: 16614 - DNA, 20 bp, Artificial Sequence
  Synthetic
cacaaactgtaattgccact

SEQ ID NO: 16615 - DNA, 20 bp, Artificial Sequence
  Synthetic
actggaaaatctcttgccac

SEQ ID NO: 16616 - DNA, 21 bp, Artificial Sequence
  Synthetic
accatttacatccaagtttgt

SEQ ID NO: 16617 - DNA, 25 bp, Artificial Sequence
  Synthetic
ctataggtataatagctaatgtggt

SEQ ID NO: 16618 - DNA, 20 bp, Artificial Sequence
  Synthetic
tggtacttccaacacattct

SEQ ID NO: 16619 - DNA, 20 bp, Artificial Sequence
  Synthetic
tactgcacgaatgatcaagt

SEQ ID NO: 16620 - DNA, 24 bp, Artificial Sequence
  Synthetic
tgtgttattcagaagtgtatttgg

SEQ ID NO: 16621 - DNA, 18 bp, Artificial Sequence
  Synthetic
acccctgctgataagtct

SEQ ID NO: 16622 - DNA, 18 bp, Artificial Sequence
  Synthetic
aagaggtggagttgtcac

SEQ ID NO: 16623 - DNA, 24 bp, Artificial Sequence
  Synthetic
tctaaaaggagattgtttacagac

SEQ ID NO: 16624 - DNA, 22 bp, Artificial Sequence
  Synthetic
gggtaaagtaggctttctagat

SEQ ID NO: 16625 - DNA, 18 bp, Artificial Sequence
  Synthetic
ctgagcgtacgttttgct

SEQ ID NO: 16626 - DNA, 23 bp, Artificial Sequence
  Synthetic
caacctgatgtgttaaagtatgg

SEQ ID NO: 16627 - DNA, 24 bp, Artificial Sequence
  Synthetic
cagaaatatgggcatttatacctg

SEQ ID NO: 16628 - DNA, 18 bp, Artificial Sequence
  Synthetic
gcccattacaaggcctaa

SEQ ID NO: 16629 - DNA, 18 bp, Artificial Sequence
  Synthetic
cacacctgtcactgcatt

SEQ ID NO: 16630 - DNA, 25 bp, Artificial Sequence
  Synthetic
agaaggggaaacattaaatattcct

SEQ ID NO: 16631 - DNA, 23 bp, Artificial Sequence
  Synthetic
gtattcagatgtaagttaccaga

SEQ ID NO: 16632 - DNA, 18 bp, Artificial Sequence
  Synthetic
caattgctttgtggcctg

SEQ ID NO: 16633 - DNA, 23 bp, Artificial Sequence
  Synthetic
atgtaaaataactttggatgctg

SEQ ID NO: 16634 - DNA, 24 bp, Artificial Sequence
  Synthetic
gcttgaataaattgtttactgtgc

SEQ ID NO: 16635 - DNA, 23 bp, Artificial Sequence
  Synthetic
taaagtatgaaggggactattgc

SEQ ID NO: 16636 - DNA, 18 bp, Artificial Sequence
  Synthetic
ccaggacctgctttcaag

SEQ ID NO: 16637 - DNA, 18 bp, Artificial Sequence
  Synthetic
ccgagctttagtggacct

SEQ ID NO: 16638 - DNA, 20 bp, Artificial Sequence
  Synthetic
cagtgtgacgaagaagatga

SEQ ID NO: 16639 - DNA, 23 bp, Artificial Sequence
  Synthetic
tattcaaatactggacaatggac

SEQ ID NO: 16640 - DNA, 19 bp, Artificial Sequence
  Synthetic
cgacaagagaacgacgacg

SEQ ID NO: 16641 - DNA, 20 bp, Artificial Sequence
  Synthetic
tacaaaaccaagcataccac

SEQ ID NO: 16642 - DNA, 25 bp, Artificial Sequence
  Synthetic
cttttaatagggttatcaatcaagg

SEQ ID NO: 16643 - DNA, 18 bp, Artificial Sequence
  Synthetic
gcgcaggtgttaagacaa

SEQ ID NO: 16644 - DNA, 18 bp, Artificial Sequence
  Synthetic
atgtcgctgtttggagac

SEQ ID NO: 16645 - DNA, 18 bp, Artificial Sequence
  Synthetic
cctgtcaggaatgggaac

SEQ ID NO: 16646 - DNA, 18 bp, Artificial Sequence
  Synthetic
gtcttcggtacctggagt

SEQ ID NO: 16647 - DNA, 20 bp, Artificial Sequence
  Synthetic
actcactgagtgacatcaac

SEQ ID NO: 16648 - DNA, 19 bp, Artificial Sequence
  Synthetic
aggtccaatctaccgaaga

SEQ ID NO: 16649 - DNA, 20 bp, Artificial Sequence
  Synthetic
agcagaaatcctgggaatgc

SEQ ID NO: 16650 - DNA, 19 bp, Artificial Sequence
  Synthetic
caattggtgtggatggcat

SEQ ID NO: 16651 - DNA, 19 bp, Artificial Sequence
  Synthetic
tttttgttcatgatgcccg

SEQ ID NO: 16652 - DNA, 18 bp, Artificial Sequence
  Synthetic
ggctgttgctgcttcaat

SEQ ID NO: 16653 - DNA, 22 bp, Artificial Sequence
  Synthetic
aaattgacacgattactgttga

SEQ ID NO: 16654 - DNA, 21 bp, Artificial Sequence
  Synthetic
ccgttgaggtatttttctcac

SEQ ID NO: 16655 - DNA, 23 bp, Artificial Sequence
  Synthetic
gttgaaatgaaaaaacctcatgc

SEQ ID NO: 16656 - DNA, 25 bp, Artificial Sequence
  Synthetic
gttggtaaatcaaccttatttaacg

SEQ ID NO: 16657 - DNA, 18 bp, Artificial Sequence
  Synthetic
taaacgttatgcgcgtgt

SEQ ID NO: 16658 - DNA, 22 bp, Artificial Sequence
  Synthetic
cgtgcagaagaagaaatttcag

SEQ ID NO: 16659 - DNA, 23 bp, Artificial Sequence
  Synthetic
atggtaaaaatgattgttggtct

SEQ ID NO: 16660 - DNA, 20 bp, Artificial Sequence
  Synthetic
aggaggacataatggcatta

SEQ ID NO: 16661 - DNA, 18 bp, Artificial Sequence
  Synthetic
gtgggcttgtctggtcta

SEQ ID NO: 16662 - DNA, 20 bp, Artificial Sequence
  Synthetic
ggaggctcaaaatttgtgat

SEQ ID NO: 16663 - DNA, 18 bp, Artificial Sequence
  Synthetic
cagcaattagaagcgctg

SEQ ID NO: 16664 - DNA, 23 bp, Artificial Sequence
  Synthetic
aagttactaagttttgacgatgt

SEQ ID NO: 16665 - DNA, 23 bp, Artificial Sequence
  Synthetic
gaataccgattgaaatttctcct

SEQ ID NO: 16666 - DNA, 19 bp, Artificial Sequence
  Synthetic
gtggtgatcacatctgctt

SEQ ID NO: 16667 - DNA, 19 bp, Artificial Sequence
  Synthetic
tggtaccgaaaacatgagt

SEQ ID NO: 16668 - DNA, 25 bp, Artificial Sequence
  Synthetic
atcaagatgaataccctaaatttgg

SEQ ID NO: 16669 - DNA, 18 bp, Artificial Sequence
  Synthetic
cttttgctgctcaggctt

SEQ ID NO: 16670 - DNA, 18 bp, Artificial Sequence
  Synthetic
cacgattatggtcggtgg

SEQ ID NO: 16671 - DNA, 22 bp, Artificial Sequence
  Synthetic
tcttgccaaagaatatctgaac

SEQ ID NO: 16672 - DNA, 25 bp, Artificial Sequence
  Synthetic
tttgaaggataagattgatagaagg

SEQ ID NO: 16673 - DNA, 25 bp, Artificial Sequence
  Synthetic
ctttgatcagcatttaaaactactg

SEQ ID NO: 16674 - DNA, 24 bp, Artificial Sequence
  Synthetic
ctaaaaaatggttagttaagccag

SEQ ID NO: 16675 - DNA, 20 bp, Artificial Sequence
  Synthetic
gttgtcaagagcttactgac

SEQ ID NO: 16676 - DNA, 19 bp, Artificial Sequence
  Synthetic
aaagtaaatggttggcagc

SEQ ID NO: 16677 - DNA, 19 bp, Artificial Sequence
  Synthetic
tgtctcttggtatacggct

SEQ ID NO: 16678 - DNA, 19 bp, Artificial Sequence
  Synthetic
tggtgcttacttcttgagc

SEQ ID NO: 16679 - DNA, 25 bp, Artificial Sequence
  Synthetic
tctttcaaaaacactaagaaagacc

SEQ ID NO: 16680 - DNA, 20 bp, Artificial Sequence
  Synthetic
aaagctgagtttgcaaaagc

SEQ ID NO: 16681 - DNA, 24 bp, Artificial Sequence
  Synthetic
catcagtttttagaggagaattgg

SEQ ID NO: 16682 - DNA, 25 bp, Artificial Sequence
  Synthetic
ctaaaaagagcttatttgtgacaag

SEQ ID NO: 16683 - DNA, 19 bp, Artificial Sequence
  Synthetic
gcacctgcttctagtccag

SEQ ID NO: 16684 - DNA, 18 bp, Artificial Sequence
  Synthetic
caccacaagtgttgcaac

SEQ ID NO: 16685 - DNA, 20 bp, Artificial Sequence
  Synthetic
gccatttgcaagtatttacg

SEQ ID NO: 16686 - DNA, 25 bp, Artificial Sequence
  Synthetic
ggtcttgaaatgtattatactagtg

SEQ ID NO: 16687 - DNA, 19 bp, Artificial Sequence
  Synthetic
ttccctcactggaaattcc

SEQ ID NO: 16688 - DNA, 22 bp, Artificial Sequence
  Synthetic
aggtttatccaccatattgatg

SEQ ID NO: 16689 - DNA, 18 bp, Artificial Sequence
  Synthetic
ctaagccaaccaaagcgt

SEQ ID NO: 16690 - DNA, 21 bp, Artificial Sequence
  Synthetic
aaagaaaatgagaccactgtc

SEQ ID NO: 16691 - DNA, 18 bp, Artificial Sequence
  Synthetic
ccaaacagctccgttgag

SEQ ID NO: 16692 - DNA, 22 bp, Artificial Sequence
  Synthetic
tatcatttacgatgcccttacc

SEQ ID NO: 16693 - DNA, 20 bp, Artificial Sequence
  Synthetic
gcagagttgaatttgacctt

SEQ ID NO: 16694 - DNA, 25 bp, Artificial Sequence
  Synthetic
cacatgtctaagttattattggttg

SEQ ID NO: 16695 - DNA, 18 bp, Artificial Sequence
  Synthetic
tgtggctctagcttttcg

SEQ ID NO: 16696 - DNA, 22 bp, Artificial Sequence
  Synthetic
agatactacgacgattagagaa

SEQ ID NO: 16697 - DNA, 22 bp, Artificial Sequence
  Synthetic
gaagcagtcttagctaatcaac

SEQ ID NO: 16698 - DNA, 24 bp, Artificial Sequence
  Synthetic
tattgttggtcctaatttcaatcg

SEQ ID NO: 16699 - DNA, 23 bp, Artificial Sequence
  Synthetic
taaaaatagggatgatgctatcg

SEQ ID NO: 16700 - DNA, 18 bp, Artificial Sequence
  Synthetic
gccattaccgactaccga

SEQ ID NO: 16701 - DNA, 19 bp, Artificial Sequence
  Synthetic
taagccctgattatgctcc

SEQ ID NO: 16702 - DNA, 21 bp, Artificial Sequence
  Synthetic
taaacggtaagaaagtagccg

SEQ ID NO: 16703 - DNA, 19 bp, Artificial Sequence
  Synthetic
ctcttgacgatgctcttcg

SEQ ID NO: 16704 - DNA, 18 bp, Artificial Sequence
  Synthetic
gctgcagcttctttttcc

SEQ ID NO: 16705 - DNA, 21 bp, Artificial Sequence
  Synthetic
tacaaaaaagagtttcggtgg

SEQ ID NO: 16706 - DNA, 21 bp, Artificial Sequence
  Synthetic
caagtccccttcttagaaagt

SEQ ID NO: 16707 - DNA, 19 bp, Artificial Sequence
  Synthetic
aggaaggtcaattggttgc

SEQ ID NO: 16708 - DNA, 19 bp, Artificial Sequence
  Synthetic
gttccggctatgaaaatgc

SEQ ID NO: 16709 - DNA, 20 bp, Artificial Sequence
  Synthetic
aaaatggcaccattgattgc

SEQ ID NO: 16710 - DNA, 19 bp, Artificial Sequence
  Synthetic
ttatccaaacgtgccaaac

SEQ ID NO: 16711 - DNA, 20 bp, Artificial Sequence
  Synthetic
ggctttattcaagacttgcc

SEQ ID NO: 16712 - DNA, 25 bp, Artificial Sequence
  Synthetic
cagtttgttccttttagaatcaaag

SEQ ID NO: 16713 - DNA, 21 bp, Artificial Sequence
  Synthetic
cctactttgctgaaatctacc

SEQ ID NO: 16714 - DNA, 19 bp, Artificial Sequence
  Synthetic
tacacctgatgacacactc

SEQ ID NO: 16715 - DNA, 19 bp, Artificial Sequence
  Synthetic
gaaggaacgcaaagacaaa

SEQ ID NO: 16716 - DNA, 18 bp, Artificial Sequence
  Synthetic
gtctggcgcataccattt

SEQ ID NO: 16717 - DNA, 18 bp, Artificial Sequence
  Synthetic
cggattgcgagaaatcac

SEQ ID NO: 16718 - DNA, 20 bp, Artificial Sequence
  Synthetic
aacaaagaacgcctagaaca

SEQ ID NO: 16719 - DNA, 18 bp, Artificial Sequence
  Synthetic
caggcttgattgcgtcag

SEQ ID NO: 16720 - DNA, 21 bp, Artificial Sequence
  Synthetic
ccgctcagttgatttatgatc

SEQ ID NO: 16721 - DNA, 25 bp, Artificial Sequence
  Synthetic
ttatcagtttttagaggctattggt

SEQ ID NO: 16722 - DNA, 18 bp, Artificial Sequence
  Synthetic
aaacgacctcaactccaa

SEQ ID NO: 16723 - DNA, 19 bp, Artificial Sequence
  Synthetic
tctttttcagatggggggt

SEQ ID NO: 16724 - DNA, 18 bp, Artificial Sequence
  Synthetic
cttagcagccgagtacga

SEQ ID NO: 16725 - DNA, 18 bp, Artificial Sequence
  Synthetic
agcagccttgtctgctta

SEQ ID NO: 16726 - DNA, 18 bp, Artificial Sequence
  Synthetic
cgtcagttagtggaaggg

SEQ ID NO: 16727 - DNA, 23 bp, Artificial Sequence
  Synthetic
tatggcctgtcaattagatacac

SEQ ID NO: 16728 - DNA, 23 bp, Artificial Sequence
  Synthetic
atgaacccctaaaacattacact

SEQ ID NO: 16729 - DNA, 19 bp, Artificial Sequence
  Synthetic
gtttgaatttgcatgtggc

SEQ ID NO: 16730 - DNA, 20 bp, Artificial Sequence
  Synthetic
ttgtggatctgtgtttaagc

SEQ ID NO: 16731 - DNA, 18 bp, Artificial Sequence
  Synthetic
aaagcaagagcccctgaa

SEQ ID NO: 16732 - DNA, 20 bp, Artificial Sequence
  Synthetic
ccagttgctactttatcgac

SEQ ID NO: 16733 - DNA, 20 bp, Artificial Sequence
  Synthetic
gcggtaaaaattcctggacg

SEQ ID NO: 16734 - DNA, 21 bp, Artificial Sequence
  Synthetic
caggctgtaataatttagcgc

SEQ ID NO: 16735 - DNA, 19 bp, Artificial Sequence
  Synthetic
ccaaaggtttcaagccttg

SEQ ID NO: 16736 - DNA, 22 bp, Artificial Sequence
  Synthetic
tgccttaaacccatttaattgc

SEQ ID NO: 16737 - DNA, 18 bp, Artificial Sequence
  Synthetic
caagtcctgcaacagcta

SEQ ID NO: 16738 - DNA, 23 bp, Artificial Sequence
  Synthetic
tatttttgatggtcttgtcaacg

SEQ ID NO: 16739 - DNA, 22 bp, Artificial Sequence
  Synthetic
gtaatcaccaaaggtttgtagt

SEQ ID NO: 16740 - DNA, 23 bp, Artificial Sequence
  Synthetic
caggtggagtatatcaattctcc

SEQ ID NO: 16741 - DNA, 22 bp, Artificial Sequence
  Synthetic
agcttcaacgattttttcaatg

SEQ ID NO: 16742 - DNA, 19 bp, Artificial Sequence
  Synthetic
agccttatttcggtaagct

SEQ ID NO: 16743 - DNA, 23 bp, Artificial Sequence
  Synthetic
taaccattgctcaaaaaagaaga

SEQ ID NO: 16744 - DNA, 20 bp, Artificial Sequence
  Synthetic
ttgatttgggacataacagc

SEQ ID NO: 16745 - DNA, 18 bp, Artificial Sequence
  Synthetic
atgttttaaggcccgtcg

SEQ ID NO: 16746 - DNA, 23 bp, Artificial Sequence
  Synthetic
taagccaagaatgttaaaaaacc

SEQ ID NO: 16747 - DNA, 22 bp, Artificial Sequence
  Synthetic
ttatgctggtgattttttctca

SEQ ID NO: 16748 - DNA, 23 bp, Artificial Sequence
  Synthetic
tttgaaaaacgttggataagacg

SEQ ID NO: 16749 - DNA, 19 bp, Artificial Sequence
  Synthetic
caagaagtgcaatgatggg

SEQ ID NO: 16750 - DNA, 18 bp, Artificial Sequence
  Synthetic
tcccaccaaagtaatgcg

SEQ ID NO: 16751 - DNA, 20 bp, Artificial Sequence
  Synthetic
tttcacttcttcactagcgt

SEQ ID NO: 16752 - DNA, 18 bp, Artificial Sequence
  Synthetic
cgacgacgttctaagcta

SEQ ID NO: 16753 - DNA, 20 bp, Artificial Sequence
  Synthetic
ccatagaaacacggacatca

SEQ ID NO: 16754 - DNA, 21 bp, Artificial Sequence
  Synthetic
caagaagaaccagagtcaaac

SEQ ID NO: 16755 - DNA, 19 bp, Artificial Sequence
  Synthetic
cccatgatggatgaaaggt

SEQ ID NO: 16756 - DNA, 20 bp, Artificial Sequence
  Synthetic
tagtcatcctcaccaaaacc

SEQ ID NO: 16757 - DNA, 25 bp, Artificial Sequence
  Synthetic
cgatatacgtattagtatcaaggat

SEQ ID NO: 16758 - DNA, 21 bp, Artificial Sequence
  Synthetic
tatcaacctgacttaaagcgt

SEQ ID NO: 16759 - DNA, 18 bp, Artificial Sequence
  Synthetic
ttgttcccaagctgcttg

SEQ ID NO: 16760 - DNA, 25 bp, Artificial Sequence
  Synthetic
ctgtgattataagcaaatcatcttg

SEQ ID NO: 16761 - DNA, 23 bp, Artificial Sequence
  Synthetic
aaacgattaatgtctattctcgt

SEQ ID NO: 16762 - DNA, 25 bp, Artificial Sequence
  Synthetic
aaagttactaaatagctatagtccg

SEQ ID NO: 16763 - DNA, 19 bp, Artificial Sequence
  Synthetic
agctgagctaaactcccat

SEQ ID NO: 16764 - DNA, 20 bp, Artificial Sequence
  Synthetic
atgctttcagcgcttatccc

SEQ ID NO: 16765 - DNA, 20 bp, Artificial Sequence
  Synthetic
tgttatccccagggtagctt

SEQ ID NO: 16766 - DNA, 19 bp, Artificial Sequence
  Synthetic
ggcgtcaccccctatacat

SEQ ID NO: 16767 - DNA, 25 bp, Artificial Sequence
  Synthetic
cagctcaatgttataaagataagca

SEQ ID NO: 16768 - DNA, 20 bp, Artificial Sequence
  Synthetic
ctctcctaccatgacacttt

SEQ ID NO: 16769 - DNA, 19 bp, Artificial Sequence
  Synthetic
atcgtaactcgccggttca

SEQ ID NO: 16770 - DNA, 18 bp, Artificial Sequence
  Synthetic
gacctcctgcgtgcaaag

SEQ ID NO: 16771 - DNA, 23 bp, Artificial Sequence
  Synthetic
tctttgattgttttttcagtagc

SEQ ID NO: 16772 - DNA, 20 bp, Artificial Sequence
  Synthetic
cttgttatctgctgccattg

SEQ ID NO: 16773 - DNA, 19 bp, Artificial Sequence
  Synthetic
ctgggatacgagttgatcc

SEQ ID NO: 16774 - DNA, 21 bp, Artificial Sequence
  Synthetic
accaccaagtttgttatcacc

SEQ ID NO: 16775 - DNA, 18 bp, Artificial Sequence
  Synthetic
cactgcttgacgttttgc

SEQ ID NO: 16776 - DNA, 25 bp, Artificial Sequence
  Synthetic
gcttctaacttgctatctagtttac

SEQ ID NO: 16777 - DNA, 18 bp, Artificial Sequence
  Synthetic
ccaaggcacgttctagat

SEQ ID NO: 16778 - DNA, 25 bp, Artificial Sequence
  Synthetic
cgataataatcacctaatttagcag

SEQ ID NO: 16779 - DNA, 18 bp, Artificial Sequence
  Synthetic
agcgctcctctacgatag

SEQ ID NO: 16780 - DNA, 18 bp, Artificial Sequence
  Synthetic
cttggcatccgtccacta

SEQ ID NO: 16781 - DNA, 18 bp, Artificial Sequence
  Synthetic
gctggtggaacttctgtt

SEQ ID NO: 16782 - DNA, 22 bp, Artificial Sequence
  Synthetic
cacaaaaagatctctttgcctt

SEQ ID NO: 16783 - DNA, 23 bp, Artificial Sequence
  Synthetic
ctatgcgcaaaatgatatctttg

SEQ ID NO: 16784 - DNA, 19 bp, Artificial Sequence
  Synthetic
tggaaaataagcgtgctca

SEQ ID NO: 16785 - DNA, 24 bp, Artificial Sequence
  Synthetic
aagcctattatgatctgatgaaga

SEQ ID NO: 16786 - DNA, 18 bp, Artificial Sequence
  Synthetic
tcgtgattgtggttgacc

SEQ ID NO: 16787 - DNA, 18 bp, Artificial Sequence
  Synthetic
ctattgagagcgcacaga

SEQ ID NO: 16788 - DNA, 20 bp, Artificial Sequence
  Synthetic
cgatcaagaacaagaagctc

SEQ ID NO: 16789 - DNA, 25 bp, Artificial Sequence
  Synthetic
taccaagcctataaagaaaaacaag

SEQ ID NO: 16790 - DNA, 24 bp, Artificial Sequence
  Synthetic
tagctctagtgatatcaaatatgc

SEQ ID NO: 16791 - DNA, 19 bp, Artificial Sequence
  Synthetic
ggtcagaatcaccacttcc

SEQ ID NO: 16792 - DNA, 18 bp, Artificial Sequence
  Synthetic
caaaagggcacaggttga

SEQ ID NO: 16793 - DNA, 23 bp, Artificial Sequence
  Synthetic
gaaaggaattcacacttatgact

SEQ ID NO: 16794 - DNA, 20 bp, Artificial Sequence
  Synthetic
ctcagtttgactttgcctta

SEQ ID NO: 16795 - DNA, 24 bp, Artificial Sequence
  Synthetic
ctctttaatcagcttgagattgac

SEQ ID NO: 16796 - DNA, 23 bp, Artificial Sequence
  Synthetic
atcaaagatgtagataatcaccg

SEQ ID NO: 16797 - DNA, 19 bp, Artificial Sequence
  Synthetic
agattgggctttatcacgt

SEQ ID NO: 16798 - DNA, 23 bp, Artificial Sequence
  Synthetic
gtctgattaaatcctacccattg

SEQ ID NO: 16799 - DNA, 23 bp, Artificial Sequence
  Synthetic
gattactccattattggcaaagg

SEQ ID NO: 16800 - DNA, 19 bp, Artificial Sequence
  Synthetic
ccacgagtggtttgattgt

SEQ ID NO: 16801 - DNA, 18 bp, Artificial Sequence
  Synthetic
catcagtatgtcgccgcc

SEQ ID NO: 16802 - DNA, 17 bp, Artificial Sequence
  Synthetic
gatatgcagcgctggcg

SEQ ID NO: 16803 - DNA, 20 bp, Artificial Sequence
  Synthetic
caatgcgtgctcatggtatg

SEQ ID NO: 16804 - DNA, 19 bp, Artificial Sequence
  Synthetic
gcgcgttagggctattggg

SEQ ID NO: 16805 - DNA, 19 bp, Artificial Sequence
  Synthetic
aaagtcaccgttggcacag

SEQ ID NO: 16806 - DNA, 20 bp, Artificial Sequence
  Synthetic
aaagagacatttgtccccgg

SEQ ID NO: 16807 - DNA, 20 bp, Artificial Sequence
  Synthetic
ctgacagccgacttttaccc

SEQ ID NO: 16808 - DNA, 18 bp, Artificial Sequence
  Synthetic
gccaccgtctacaccgga

SEQ ID NO: 16809 - DNA, 16 bp, Artificial Sequence
  Synthetic
gagtccagccggtcca

SEQ ID NO: 16810 - DNA, 19 bp, Artificial Sequence
  Synthetic
tgtggcgcctgactatagg

SEQ ID NO: 16811 - DNA, 16 bp, Artificial Sequence
  Synthetic
ggggaagtccgtcggt

SEQ ID NO: 16812 - DNA, 20 bp, Artificial Sequence
  Synthetic
tgattttgagagcaagggcc

SEQ ID NO: 16813 - DNA, 20 bp, Artificial Sequence
  Synthetic
tgcaggacatagacgcagtg

SEQ ID NO: 16814 - DNA, 19 bp, Artificial Sequence
  Synthetic
caggtacggcaaggagaca

SEQ ID NO: 16815 - DNA, 20 bp, Artificial Sequence
  Synthetic
tattgatgaaggaggccggg

SEQ ID NO: 16816 - DNA, 16 bp, Artificial Sequence
  Synthetic
gccctcatcaccggct

SEQ ID NO: 16817 - DNA, 17 bp, Artificial Sequence
  Synthetic
ctgctctgtcgtgcctg

SEQ ID NO: 16818 - DNA, 16 bp, Artificial Sequence
  Synthetic
cgacgcggcacacgat

SEQ ID NO: 16819 - DNA, 18 bp, Artificial Sequence
  Synthetic
ggtgggtatgcggtgtca

SEQ ID NO: 16820 - DNA, 19 bp, Artificial Sequence
  Synthetic
accaattcagcctacaccg

SEQ ID NO: 16821 - DNA, 16 bp, Artificial Sequence
  Synthetic
gctcgccccatcacca

SEQ ID NO: 16822 - DNA, 19 bp, Artificial Sequence
  Synthetic
gggcaagatcagtttttgg

SEQ ID NO: 16823 - DNA, 23 bp, Artificial Sequence
  Synthetic
actaaacgaaatttttctagtgc

SEQ ID NO: 16824 - DNA, 18 bp, Artificial Sequence
  Synthetic
gttcgcacctatagcgaa

SEQ ID NO: 16825 - DNA, 23 bp, Artificial Sequence
  Synthetic
attacaaatggtatgtcattgct

SEQ ID NO: 16826 - DNA, 25 bp, Artificial Sequence
  Synthetic
tactttctaatcaattacgtctagc

SEQ ID NO: 16827 - DNA, 22 bp, Artificial Sequence
  Synthetic
tgaacttgccactgttaatttg

SEQ ID NO: 16828 - DNA, 19 bp, Artificial Sequence
  Synthetic
ggttgatggctgtagtgtc

SEQ ID NO: 16829 - DNA, 25 bp, Artificial Sequence
  Synthetic
cacttacttctaatggtcttttagg

SEQ ID NO: 16830 - DNA, 24 bp, Artificial Sequence
  Synthetic
gtccattatttatacaggtgattg

SEQ ID NO: 16831 - DNA, 22 bp, Artificial Sequence
  Synthetic
ggtaaaaagtttgatgatcagg

SEQ ID NO: 16832 - DNA, 20 bp, Artificial Sequence
  Synthetic
aagctggtgaagttaaacct

SEQ ID NO: 16833 - DNA, 21 bp, Artificial Sequence
  Synthetic
tttttgttgagagttgtacca

SEQ ID NO: 16834 - DNA, 19 bp, Artificial Sequence
  Synthetic
aacaattgggtgttgtgag

SEQ ID NO: 16835 - DNA, 23 bp, Artificial Sequence
  Synthetic
tgtaaaagtactgtagttgaagt

SEQ ID NO: 16836 - DNA, 21 bp, Artificial Sequence
  Synthetic
tgtttgaagcacctttacact

SEQ ID NO: 16837 - DNA, 21 bp, Artificial Sequence
  Synthetic
tattgtagagttggtgaatgc

SEQ ID NO: 16838 - DNA, 21 bp, Artificial Sequence
  Synthetic
atagtggtagtgctagtgagg

SEQ ID NO: 16839 - DNA, 25 bp, Artificial Sequence
  Synthetic
accactgttcttattgattatgatc

SEQ ID NO: 16840 - DNA, 23 bp, Artificial Sequence
  Synthetic
tacaccaaattgagttaggtagt

SEQ ID NO: 16841 - DNA, 25 bp, Artificial Sequence
  Synthetic
aggttttttaaatgtactatgggtg

SEQ ID NO: 16842 - DNA, 23 bp, Artificial Sequence
  Synthetic
ttgcttatgaaaatgctagacaa

SEQ ID NO: 16843 - DNA, 20 bp, Artificial Sequence
  Synthetic
tctgttcattatgctggagt

SEQ ID NO: 16844 - DNA, 21 bp, Artificial Sequence
  Synthetic
cgttcttggttttataggtgc

SEQ ID NO: 16845 - DNA, 20 bp, Artificial Sequence
  Synthetic
ggtaaatgtgttcaggttcc

SEQ ID NO: 16846 - DNA, 25 bp, Artificial Sequence
  Synthetic
tgttataaagaggtgtactaagtcg

SEQ ID NO: 16847 - DNA, 25 bp, Artificial Sequence
  Synthetic
cccagttgaaaatgaagatatacat

SEQ ID NO: 16848 - DNA, 20 bp, Artificial Sequence
  Synthetic
gtgttccacttgttacaact

SEQ ID NO: 16849 - DNA, 21 bp, Artificial Sequence
  Synthetic
ctttgacaaagcgtaatgtcc

SEQ ID NO: 16850 - DNA, 22 bp, Artificial Sequence
  Synthetic
gcctaacatgatacgtatgatt

SEQ ID NO: 16851 - DNA, 23 bp, Artificial Sequence
  Synthetic
gttgggttgaagaagatttaact

SEQ ID NO: 16852 - DNA, 25 bp, Artificial Sequence
  Synthetic
aatcaagaagataagttttggtgtg

SEQ ID NO: 16853 - DNA, 23 bp, Artificial Sequence
  Synthetic
ttttgtcttaacatctcacaatg

SEQ ID NO: 16854 - DNA, 20 bp, Artificial Sequence
  Synthetic
tttgctattcgtaatgtgcg

SEQ ID NO: 16855 - DNA, 23 bp, Artificial Sequence
  Synthetic
gttgtgattatgtttacaatccg

SEQ ID NO: 16856 - DNA, 19 bp, Artificial Sequence
  Synthetic
gctgttactgatgccaaat

SEQ ID NO: 16857 - DNA, 21 bp, Artificial Sequence
  Synthetic
caaagtttttgttcgctatgg

SEQ ID NO: 16858 - DNA, 24 bp, Artificial Sequence
  Synthetic
actaaagagtttagatcttggtgt

SEQ ID NO: 16859 - DNA, 18 bp, Artificial Sequence
  Synthetic
acaatgtgcgtacctcat

SEQ ID NO: 16860 - DNA, 19 bp, Artificial Sequence
  Synthetic
tggcctcttgctttttcac

SEQ ID NO: 16861 - DNA, 22 bp, Artificial Sequence
  Synthetic
ggcataactatatctggtgaaa

SEQ ID NO: 16862 - DNA, 18 bp, Artificial Sequence
  Synthetic
gccgcattcctaatggtt

SEQ ID NO: 16863 - DNA, 21 bp, Artificial Sequence
  Synthetic
ttcttgacaccacaatacctt

SEQ ID NO: 16864 - DNA, 18 bp, Artificial Sequence
  Synthetic
gtgtgagcacttgcagtt

SEQ ID NO: 16865 - DNA, 23 bp, Artificial Sequence
  Synthetic
cttggttttaaaaatgtttccac

SEQ ID NO: 16866 - DNA, 21 bp, Artificial Sequence
  Synthetic
ttacctcagagaaacattcgt

SEQ ID NO: 16867 - DNA, 21 bp, Artificial Sequence
  Synthetic
tgttaatcaacagggtagtgc

SEQ ID NO: 16868 - DNA, 18 bp, Artificial Sequence
  Synthetic
atgtaaaggcgtggtctg

SEQ ID NO: 16869 - DNA, 24 bp, Artificial Sequence
  Synthetic
gaaaattatatcaaatggccttgg

SEQ ID NO: 16870 - DNA, 22 bp, Artificial Sequence
  Synthetic
tgcttaccaagattatatgcaa

SEQ ID NO: 16871 - DNA, 23 bp, Artificial Sequence
  Synthetic
gcttttaatcctgaaactaatgc

SEQ ID NO: 16872 - DNA, 25 bp, Artificial Sequence
  Synthetic
tctaaactaaacaaaatggctagtg

SEQ ID NO: 16873 - DNA, 19 bp, Artificial Sequence
  Synthetic
caacgttctgatggtgttg

SEQ ID NO: 16874 - DNA, 22 bp, Artificial Sequence
  Synthetic
gattctaaccagtcttcttcag

SEQ ID NO: 16875 - DNA, 18 bp, Artificial Sequence
  Synthetic
aggttttccacagcttgc

SEQ ID NO: 16876 - DNA, 19 bp, Artificial Sequence
  Synthetic
tcaagggtgtgctagaact

SEQ ID NO: 16877 - DNA, 19 bp, Artificial Sequence
  Synthetic
aacgattggtttttggtgg

SEQ ID NO: 16878 - DNA, 18 bp, Artificial Sequence
  Synthetic
taaagatacggctggcgt

SEQ ID NO: 16879 - DNA, 20 bp, Artificial Sequence
  Synthetic
ctgagcctccaaaatcaaga

SEQ ID NO: 16880 - DNA, 25 bp, Artificial Sequence
  Synthetic
aacaggacagtaaattgatagaaga

SEQ ID NO: 16881 - DNA, 18 bp, Artificial Sequence
  Synthetic
gagagctgtttttggcac

SEQ ID NO: 16882 - DNA, 16 bp, Artificial Sequence
  Synthetic
ctggggctcctgcagt

SEQ ID NO: 16883 - DNA, 21 bp, Artificial Sequence
  Synthetic
aggataggtagtgctagaatg

SEQ ID NO: 16884 - DNA, 22 bp, Artificial Sequence
  Synthetic
ctcatgcaaaatatcaaacacc

SEQ ID NO: 16885 - DNA, 22 bp, Artificial Sequence
  Synthetic
gaaattttccccatagatgttg

SEQ ID NO: 16886 - DNA, 20 bp, Artificial Sequence
  Synthetic
ggagaagcatcaacatcaga

SEQ ID NO: 16887 - DNA, 20 bp, Artificial Sequence
  Synthetic
aatccagcatttgagccaga

SEQ ID NO: 16888 - DNA, 20 bp, Artificial Sequence
  Synthetic
tattgctccagaagactcaa

SEQ ID NO: 16889 - DNA, 20 bp, Artificial Sequence
  Synthetic
ccatcactagaatcctgtcc

SEQ ID NO: 16890 - DNA, 19 bp, Artificial Sequence
  Synthetic
gggccaccctcttttaaat

SEQ ID NO: 16891 - DNA, 19 bp, Artificial Sequence
  Synthetic
ttggggctatggattttgc

SEQ ID NO: 16892 - DNA, 21 bp, Artificial Sequence
  Synthetic
caacaaattatgtaggcacac

SEQ ID NO: 16893 - DNA, 24 bp, Artificial Sequence
  Synthetic
ctgattgattgtgtgttattttcc

SEQ ID NO: 16894 - DNA, 23 bp, Artificial Sequence
  Synthetic
tcttcattgtttatggtttaccg

SEQ ID NO: 16895 - DNA, 18 bp, Artificial Sequence
  Synthetic
gcgcagtgtttgaatgtg

SEQ ID NO: 16896 - DNA, 25 bp, Artificial Sequence
  Synthetic
ttggaaactaacagtgatatatcag

SEQ ID NO: 16897 - DNA, 21 bp, Artificial Sequence
  Synthetic
cgaaggcgattatttaatgtg

SEQ ID NO: 16898 - DNA, 18 bp, Artificial Sequence
  Synthetic
cctgctgcaatgttttgg

SEQ ID NO: 16899 - DNA, 19 bp, Artificial Sequence
  Synthetic
tttgtatgagcctgttgca

SEQ ID NO: 16900 - DNA, 22 bp, Artificial Sequence
  Synthetic
ctgttgagtctttatgaacagg

SEQ ID NO: 16901 - DNA, 25 bp, Artificial Sequence
  Synthetic
aagattcttcaatatggaagtttgg

SEQ ID NO: 16902 - DNA, 22 bp, Artificial Sequence
  Synthetic
tctatctaacattcccactaca

SEQ ID NO: 16903 - DNA, 21 bp, Artificial Sequence
  Synthetic
gtcaatctgtaggtgaagaca

SEQ ID NO: 16904 - DNA, 18 bp, Artificial Sequence
  Synthetic
tgttaccgggcatcctag

SEQ ID NO: 16905 - DNA, 22 bp, Artificial Sequence
  Synthetic
tagaagatggtgatatgatgga

SEQ ID NO: 16906 - DNA, 22 bp, Artificial Sequence
  Synthetic
aatacatttgtagccaatggag

SEQ ID NO: 16907 - DNA, 23 bp, Artificial Sequence
  Synthetic
gacaccaaatcctaataaaatgc

SEQ ID NO: 16908 - DNA, 19 bp, Artificial Sequence
  Synthetic
tttagtcactggcaaacgg

SEQ ID NO: 16909 - DNA, 22 bp, Artificial Sequence
  Synthetic
ggggtaaaaatgatgaaagtgc

SEQ ID NO: 16910 - DNA, 23 bp, Artificial Sequence
  Synthetic
aaaaagggatatacgtaatgtgt

SEQ ID NO: 16911 - DNA, 19 bp, Artificial Sequence
  Synthetic
tcttcgagcgttttgatga

SEQ ID NO: 16912 - DNA, 18 bp, Artificial Sequence
  Synthetic
tggaagtccatggtgagg

SEQ ID NO: 16913 - DNA, 18 bp, Artificial Sequence
  Synthetic
gcatggagctgtaggagt

SEQ ID NO: 16914 - DNA, 18 bp, Artificial Sequence
  Synthetic
tggtcttgaccacatcct

SEQ ID NO: 16915 - DNA, 25 bp, Artificial Sequence
  Synthetic
gtggtgaaattattatacaatgagc

SEQ ID NO: 16916 - DNA, 25 bp, Artificial Sequence
  Synthetic
aaggttccatttatttacacaagag

SEQ ID NO: 16917 - DNA, 20 bp, Artificial Sequence
  Synthetic
agcaaagatgtcttttgctt

SEQ ID NO: 16918 - DNA, 24 bp, Artificial Sequence
  Synthetic
gagatcttgtctttgattttcaag

SEQ ID NO: 16919 - DNA, 20 bp, Artificial Sequence
  Synthetic
aagtcagcacatcagaaagg

SEQ ID NO: 16920 - DNA, 21 bp, Artificial Sequence
  Synthetic
aagctaacagagggaaaatgg

SEQ ID NO: 16921 - DNA, 21 bp, Artificial Sequence
  Synthetic
gtcttcaacctctaatcctcc

SEQ ID NO: 16922 - DNA, 18 bp, Artificial Sequence
  Synthetic
cagctggagacttggagt

SEQ ID NO: 16923 - DNA, 23 bp, Artificial Sequence
  Synthetic
tgaaataatgaagttttcctgga

SEQ ID NO: 16924 - DNA, 25 bp, Artificial Sequence
  Synthetic
atggatatagtggacaattagtttg

SEQ ID NO: 16925 - DNA, 22 bp, Artificial Sequence
  Synthetic
gtttttccagtcttttccatct

SEQ ID NO: 16926 - DNA, 21 bp, Artificial Sequence
  Synthetic
agaatctcagtcaactttgga

SEQ ID NO: 16927 - DNA, 19 bp, Artificial Sequence
  Synthetic
cgaaggtcttcctggaatg

SEQ ID NO: 16928 - DNA, 23 bp, Artificial Sequence
  Synthetic
atcatcacattgataaaaccatg

SEQ ID NO: 16929 - DNA, 21 bp, Artificial Sequence
  Synthetic
ctcctggatttccttatgtcc

SEQ ID NO: 16930 - DNA, 20 bp, Artificial Sequence
  Synthetic
tactcaattttgtgccgaat

SEQ ID NO: 16931 - DNA, 21 bp, Artificial Sequence
  Synthetic
agctacattctatgtctggtt

SEQ ID NO: 16932 - DNA, 18 bp, Artificial Sequence
  Synthetic
ggagaccctcagtgtgat

SEQ ID NO: 16933 - DNA, 24 bp, Artificial Sequence
  Synthetic
gacccacttaaaattcaaataccc

SEQ ID NO: 16934 - DNA, 24 bp, Artificial Sequence
  Synthetic
ggagacatacttttgattaacagc

SEQ ID NO: 16935 - DNA, 18 bp, Artificial Sequence
  Synthetic
gcaacagggatgcgaaat

SEQ ID NO: 16936 - DNA, 22 bp, Artificial Sequence
  Synthetic
gaagtagaagggagaattcagg

SEQ ID NO: 16937 - DNA, 25 bp, Artificial Sequence
  Synthetic
atacagagatgaagcattaaacaac

SEQ ID NO: 16938 - DNA, 19 bp, Artificial Sequence
  Synthetic
cctgccactcataaacaag

SEQ ID NO: 16939 - DNA, 21 bp, Artificial Sequence
  Synthetic
tgttgtttcaattgtgctaga

SEQ ID NO: 16940 - DNA, 21 bp, Artificial Sequence
  Synthetic
agaagcaactataccagacat

SEQ ID NO: 16941 - DNA, 18 bp, Artificial Sequence
  Synthetic
accttctttgctgtgtcc

SEQ ID NO: 16942 - DNA, 19 bp, Artificial Sequence
  Synthetic
gagcagcaaatacaggact

SEQ ID NO: 16943 - DNA, 23 bp, Artificial Sequence
  Synthetic
atgctcagcaaatttaaaaacag

SEQ ID NO: 16944 - DNA, 21 bp, Artificial Sequence
  Synthetic
gaaagacaaacttagaggctc

SEQ ID NO: 16945 - DNA, 18 bp, Artificial Sequence
  Synthetic
gcgcacgtagagtaaagc

SEQ ID NO: 16946 - DNA, 24 bp, Artificial Sequence
  Synthetic
gtcctactgatataatacctttgg

SEQ ID NO: 16947 - DNA, 23 bp, Artificial Sequence
  Synthetic
aggttacattagagtcagtagac

SEQ ID NO: 16948 - DNA, 21 bp, Artificial Sequence
  Synthetic
tttacatccaagtttgagacg

SEQ ID NO: 16949 - DNA, 21 bp, Artificial Sequence
  Synthetic
catgaagtgttagttcccaag

SEQ ID NO: 16950 - DNA, 21 bp, Artificial Sequence
  Synthetic
ggtgaatacatcctttgatcc

SEQ ID NO: 16951 - DNA, 21 bp, Artificial Sequence
  Synthetic
taatgatgtgtatggcaatgc

SEQ ID NO: 16952 - DNA, 18 bp, Artificial Sequence
  Synthetic
tctctcaccattgcaaca

SEQ ID NO: 16953 - DNA, 22 bp, Artificial Sequence
  Synthetic
gcaatgtcaaattacaggattt

SEQ ID NO: 16954 - DNA, 18 bp, Artificial Sequence
  Synthetic
gtgtgtgtagcatggtcc

SEQ ID NO: 16955 - DNA, 22 bp, Artificial Sequence
  Synthetic
ggaaaattgtccatattagccc

SEQ ID NO: 16956 - DNA, 18 bp, Artificial Sequence
  Synthetic
gagagggaatccaggagt

SEQ ID NO: 16957 - DNA, 19 bp, Artificial Sequence
  Synthetic
gcctaattacgctgtccgc

SEQ ID NO: 16958 - DNA, 19 bp, Artificial Sequence
  Synthetic
ccctgtggagactgcatct

SEQ ID NO: 16959 - DNA, 17 bp, Artificial Sequence
  Synthetic
gctggacgaactgtgcg

SEQ ID NO: 16960 - DNA, 16 bp, Artificial Sequence
  Synthetic
gggcggtctcccttgt

SEQ ID NO: 16961 - DNA, 20 bp, Artificial Sequence
  Synthetic
gtgtacgtccaccacatgag

SEQ ID NO: 16962 - DNA, 18 bp, Artificial Sequence
  Synthetic
gccggcgagagaaagaga

SEQ ID NO: 16963 - DNA, 16 bp, Artificial Sequence
  Synthetic
cgggtatgagccgcca

SEQ ID NO: 16964 - DNA, 18 bp, Artificial Sequence
  Synthetic
cgtagacgggctcgaagc

SEQ ID NO: 16965 - DNA, 19 bp, Artificial Sequence
  Synthetic
aacatcaagttccctggaa

SEQ ID NO: 16966 - DNA, 19 bp, Artificial Sequence
  Synthetic
gcaaaaagtctggcaaacc

SEQ ID NO: 16967 - DNA, 19 bp, Artificial Sequence
  Synthetic
tgcaaaaaaacagagtggt

SEQ ID NO: 16968 - DNA, 22 bp, Artificial Sequence
  Synthetic
gacacgaaacactgatacttac

SEQ ID NO: 16969 - DNA, 18 bp, Artificial Sequence
  Synthetic
ctcccgaagaactgacag

SEQ ID NO: 16970 - DNA, 21 bp, Artificial Sequence
  Synthetic
cctttgccatagtaaacatga

SEQ ID NO: 16971 - DNA, 21 bp, Artificial Sequence
  Synthetic
gtttgttgttgtacttcaagc

SEQ ID NO: 16972 - DNA, 20 bp, Artificial Sequence
  Synthetic
attgtttgatttcggttgga

SEQ ID NO: 16973 - DNA, 21 bp, Artificial Sequence
  Synthetic
agggacttgatatatccgagt

SEQ ID NO: 16974 - DNA, 22 bp, Artificial Sequence
  Synthetic
ttgtgtttttttaccgaaagac

SEQ ID NO: 16975 - DNA, 22 bp, Artificial Sequence
  Synthetic
tctgcgcagattttaaaatacg

SEQ ID NO: 16976 - DNA, 19 bp, Artificial Sequence
  Synthetic
ttacgtcgtttcctgtagc

SEQ ID NO: 16977 - DNA, 18 bp, Artificial Sequence
  Synthetic
tctgacggctaaggtgaa

SEQ ID NO: 16978 - DNA, 21 bp, Artificial Sequence
  Synthetic
tgtatcggaaaaactcgaatt

SEQ ID NO: 16979 - DNA, 24 bp, Artificial Sequence
  Synthetic
gaaagtttcggaaaatgtaaacac

SEQ ID NO: 16980 - DNA, 23 bp, Artificial Sequence
  Synthetic
tgtgttataacagacatatgcaa

SEQ ID NO: 16981 - DNA, 22 bp, Artificial Sequence
  Synthetic
aggacactttcaaaatttttcg

SEQ ID NO: 16982 - DNA, 18 bp, Artificial Sequence
  Synthetic
cggtgagcaagttctctt

SEQ ID NO: 16983 - DNA, 18 bp, Artificial Sequence
  Synthetic
aacgctgtttaaaagggc

SEQ ID NO: 16984 - DNA, 19 bp, Artificial Sequence
  Synthetic
gctgacaggatcgtcccct

SEQ ID NO: 16985 - DNA, 16 bp, Artificial Sequence
  Synthetic
tggagacgcgggcgaa

SEQ ID NO: 16986 - DNA, 20 bp, Artificial Sequence
  Synthetic
gccgtgacgtatgaagaaga

SEQ ID NO: 16987 - DNA, 19 bp, Artificial Sequence
  Synthetic
gcctccgatacgtacgact

SEQ ID NO: 16988 - DNA, 20 bp, Artificial Sequence
  Synthetic
aatcatgcattgtgtggggt

SEQ ID NO: 16989 - DNA, 18 bp, Artificial Sequence
  Synthetic
ccttagcccaagagcatg

SEQ ID NO: 16990 - DNA, 18 bp, Artificial Sequence
  Synthetic
ctcacagaacttcaggct

SEQ ID NO: 16991 - DNA, 18 bp, Artificial Sequence
  Synthetic
aaatgggaggacctgaga

SEQ ID NO: 16992 - DNA, 23 bp, Artificial Sequence
  Synthetic
aatacaataagcaatgaggaaac

SEQ ID NO: 16993 - DNA, 23 bp, Artificial Sequence
  Synthetic
gactttcgagtttagtagtacag

SEQ ID NO: 16994 - DNA, 23 bp, Artificial Sequence
  Synthetic
cgatacaagggtatgatatgacc

SEQ ID NO: 16995 - DNA, 22 bp, Artificial Sequence
  Synthetic
gttatcatgcgaacaattcaac

SEQ ID NO: 16996 - DNA, 20 bp, Artificial Sequence
  Synthetic
aagctcatggtcctacattg

SEQ ID NO: 16997 - DNA, 19 bp, Artificial Sequence
  Synthetic
aaagaagtcctcgtgctat

SEQ ID NO: 16998 - DNA, 19 bp, Artificial Sequence
  Synthetic
tggaaatctagtggtaccg

SEQ ID NO: 16999 - DNA, 23 bp, Artificial Sequence
  Synthetic
attcaatctagaggcctatttgg

SEQ ID NO: 17000 - DNA, 17 bp, Artificial Sequence
  Synthetic
cttccacgcggcagatc

SEQ ID NO: 17001 - DNA, 20 bp, Artificial Sequence
  Synthetic
ttggagtgggagagaacaga

SEQ ID NO: 17002 - DNA, 18 bp, Artificial Sequence
  Synthetic
ctccgcacgtctgtctga

SEQ ID NO: 17003 - DNA, 16 bp, Artificial Sequence
  Synthetic
agtctatgcgcgcgcc

SEQ ID NO: 17004 - DNA, 20 bp, Artificial Sequence
  Synthetic
ttcacacagatgcaaccgat

SEQ ID NO: 17005 - DNA, 16 bp, Artificial Sequence
  Synthetic
ccgtctggcgtcgaac

SEQ ID NO: 17006 - DNA, 18 bp, Artificial Sequence
  Synthetic
cgccgttctgtctcgaga

SEQ ID NO: 17007 - DNA, 20 bp, Artificial Sequence
  Synthetic
gaagaatctgccgatcacca

SEQ ID NO: 17008 - DNA, 16 bp, Artificial Sequence
  Synthetic
agaaagaggcgccggt

SEQ ID NO: 17009 - DNA, 20 bp, Artificial Sequence
  Synthetic
ctgcgaagatagtgaccccg

SEQ ID NO: 17010 - DNA, 24 bp, Artificial Sequence
  Synthetic
actccttaacacatcattattcct

SEQ ID NO: 17011 - DNA, 19 bp, Artificial Sequence
  Synthetic
tagcgattttgtgctcatg

SEQ ID NO: 17012 - DNA, 22 bp, Artificial Sequence
  Synthetic
gtttccaatgtccattttttcc

SEQ ID NO: 17013 - DNA, 24 bp, Artificial Sequence
  Synthetic
tagctctgttttctttgttttgtc

SEQ ID NO: 17014 - DNA, 23 bp, Artificial Sequence
  Synthetic
tttttgttaaaaagcgaatgtcc

SEQ ID NO: 17015 - DNA, 18 bp, Artificial Sequence
  Synthetic
cacacatcacgagtctcc

SEQ ID NO: 17016 - DNA, 23 bp, Artificial Sequence
  Synthetic
tatgatcatctgaaactgtttgg

SEQ ID NO: 17017 - DNA, 20 bp, Artificial Sequence
  Synthetic
gatgacgcatacgatctact

SEQ ID NO: 17018 - DNA, 18 bp, Artificial Sequence
  Synthetic
ccgtcattacatctcccg

SEQ ID NO: 17019 - DNA, 18 bp, Artificial Sequence
  Synthetic
tttcgacgcaaactttgg

SEQ ID NO: 17020 - DNA, 20 bp, Artificial Sequence
  Synthetic
gttcgttgagagaattaggc

SEQ ID NO: 17021 - DNA, 25 bp, Artificial Sequence
  Synthetic
agaaacatactgatttgtacagaag

SEQ ID NO: 17022 - DNA, 18 bp, Artificial Sequence
  Synthetic
gtgttggtaaacgcgtgt

SEQ ID NO: 17023 - DNA, 18 bp, Artificial Sequence
  Synthetic
tttttcaaacgtctgggc

SEQ ID NO: 17024 - DNA, 18 bp, Artificial Sequence
  Synthetic
gtttgtggagtcggtagc

SEQ ID NO: 17025 - DNA, 20 bp, Artificial Sequence
  Synthetic
gagcctagcgattagtttgt

SEQ ID NO: 17026 - DNA, 18 bp, Artificial Sequence
  Synthetic
tgatgccaatgaagcctt

SEQ ID NO: 17027 - DNA, 19 bp, Artificial Sequence
  Synthetic
tgaatgggagcctttgaac

SEQ ID NO: 17028 - DNA, 21 bp, Artificial Sequence
  Synthetic
atctgtgtttgtatctgctcc

SEQ ID NO: 17029 - DNA, 23 bp, Artificial Sequence
  Synthetic
tgaattttttctggaatcttgag

SEQ ID NO: 17030 - DNA, 16 bp, Artificial Sequence
  Synthetic
gccgacacactgcagc

SEQ ID NO: 17031 - DNA, 18 bp, Artificial Sequence
  Synthetic
gagctctctcaccccgtg

SEQ ID NO: 17032 - DNA, 17 bp, Artificial Sequence
  Synthetic
ggccgccgagattaacg

SEQ ID NO: 17033 - DNA, 17 bp, Artificial Sequence
  Synthetic
ccggtgattcccggaga

SEQ ID NO: 17034 - DNA, 16 bp, Artificial Sequence
  Synthetic
acatgagggcggccag

SEQ ID NO: 17035 - DNA, 18 bp, Artificial Sequence
  Synthetic
ccttaatgggaacgggga

SEQ ID NO: 17036 - DNA, 21 bp, Artificial Sequence
  Synthetic
ctattgccgcaaatatcattg

SEQ ID NO: 17037 - DNA, 20 bp, Artificial Sequence
  Synthetic
gtttcctttggcatatccgc

SEQ ID NO: 17038 - DNA, 18 bp, Artificial Sequence
  Synthetic
tttctgacatgaccctcg

SEQ ID NO: 17039 - DNA, 20 bp, Artificial Sequence
  Synthetic
ctcatcggaggacttgaatg

SEQ ID NO: 17040 - DNA, 18 bp, Artificial Sequence
  Synthetic
gtaaccgaaaacggtccg

SEQ ID NO: 17041 - DNA, 25 bp, Artificial Sequence
  Synthetic
ttatggaaaagtgaatcagtatagg

SEQ ID NO: 17042 - DNA, 20 bp, Artificial Sequence
  Synthetic
tcagaagatgaccatgaaca

SEQ ID NO: 17043 - DNA, 19 bp, Artificial Sequence
  Synthetic
tatagtgtgccccaactgt

SEQ ID NO: 17044 - DNA, 18 bp, Artificial Sequence
  Synthetic
gcgacagttgaaacggaa

SEQ ID NO: 17045 - DNA, 18 bp, Artificial Sequence
  Synthetic
tggacaacgtgtagatgg

SEQ ID NO: 17046 - DNA, 21 bp, Artificial Sequence
  Synthetic
gttggaacatagttttgctga

SEQ ID NO: 17047 - DNA, 19 bp, Artificial Sequence
  Synthetic
cagtttagagctgcagaca

SEQ ID NO: 17048 - DNA, 19 bp, Artificial Sequence
  Synthetic
catgcagcaattgaaatgc

SEQ ID NO: 17049 - DNA, 18 bp, Artificial Sequence
  Synthetic
cggagacttgtccatcag

SEQ ID NO: 17050 - DNA, 20 bp, Artificial Sequence
  Synthetic
catcaggtacagatgtccct

SEQ ID NO: 17051 - DNA, 20 bp, Artificial Sequence
  Synthetic
ttaacatctggtcctgacat

SEQ ID NO: 17052 - DNA, 23 bp, Artificial Sequence
  Synthetic
ccatattttgaattgaaaaagcc

SEQ ID NO: 17053 - DNA, 25 bp, Artificial Sequence
  Synthetic
gttgctatggattataaacaaactc

SEQ ID NO: 17054 - DNA, 18 bp, Artificial Sequence
  Synthetic
gcccctacctcttcttcc

SEQ ID NO: 17055 - DNA, 18 bp, Artificial Sequence
  Synthetic
gttccctgccaaaaatgc

SEQ ID NO: 17056 - DNA, 23 bp, Artificial Sequence
  Synthetic
acatataaaagcactgtgtacaa

SEQ ID NO: 17057 - DNA, 25 bp, Artificial Sequence
  Synthetic
ctgtttgctattttatagtaaggtc

SEQ ID NO: 17058 - DNA, 21 bp, Artificial Sequence
  Synthetic
atcagcagtataatcatgcac

SEQ ID NO: 17059 - DNA, 18 bp, Artificial Sequence
  Synthetic
gacagctcagcagttgtt

SEQ ID NO: 17060 - DNA, 19 bp, Artificial Sequence
  Synthetic
aggctcacaacatagtgtg

SEQ ID NO: 17061 - DNA, 22 bp, Artificial Sequence
  Synthetic
acaccagaatggatagaaagac

SEQ ID NO: 17062 - DNA, 23 bp, Artificial Sequence
  Synthetic
tatgaaacaatggataaagcatg

SEQ ID NO: 17063 - DNA, 23 bp, Artificial Sequence
  Synthetic
aatggaaatcctgtataccaatt

SEQ ID NO: 17064 - DNA, 19 bp, Artificial Sequence
  Synthetic
ggatgggtggtgtaaagtg

SEQ ID NO: 17065 - DNA, 18 bp, Artificial Sequence
  Synthetic
ggcacctacgaagcctca

SEQ ID NO: 17066 - DNA, 23 bp, Artificial Sequence
  Synthetic
aggtatcggtttcaaaaacataa

SEQ ID NO: 17067 - DNA, 19 bp, Artificial Sequence
  Synthetic
cgccatatatgctgctagg

SEQ ID NO: 17068 - DNA, 25 bp, Artificial Sequence
  Synthetic
agttctactacatatactaatccca

SEQ ID NO: 17069 - DNA, 25 bp, Artificial Sequence
  Synthetic
gataatcccatatttcaaaatgctg

SEQ ID NO: 17070 - DNA, 22 bp, Artificial Sequence
  Synthetic
tcaatctccttttgataccacc

SEQ ID NO: 17071 - DNA, 25 bp, Artificial Sequence
  Synthetic
catactatgaattctaccttactgg

SEQ ID NO: 17072 - DNA, 25 bp, Artificial Sequence
  Synthetic
tttgttttatacactatgccttacc

SEQ ID NO: 17073 - DNA, 18 bp, Artificial Sequence
  Synthetic
cccaatgggtgttgtact

SEQ ID NO: 17074 - DNA, 20 bp, Artificial Sequence
  Synthetic
tgcatacccagcagtagacc

SEQ ID NO: 17075 - DNA, 20 bp, Artificial Sequence
  Synthetic
tgacccagttaaagatgtct

SEQ ID NO: 17076 - DNA, 24 bp, Artificial Sequence
  Synthetic
acatcttctaatatagtgccaatc

SEQ ID NO: 17077 - DNA, 21 bp, Artificial Sequence
  Synthetic
tgtacactgtacaactaggga

SEQ ID NO: 17078 - DNA, 21 bp, Artificial Sequence
  Synthetic
ctggtattgatgaaccaacaa

SEQ ID NO: 17079 - DNA, 24 bp, Artificial Sequence
  Synthetic
tagaaagtttccttggtagatctg

SEQ ID NO: 17080 - DNA, 18 bp, Artificial Sequence
  Synthetic
caggagctccaattcctt

SEQ ID NO: 17081 - DNA, 18 bp, Artificial Sequence
  Synthetic
acatggtgtcattggcat

SEQ ID NO: 17082 - DNA, 18 bp, Artificial Sequence
  Synthetic
aaactcctctgaccctca

SEQ ID NO: 17083 - DNA, 21 bp, Artificial Sequence
  Synthetic
ttgctcaacatacaccttagc

SEQ ID NO: 17084 - DNA, 20 bp, Artificial Sequence
  Synthetic
ccaaaggctgttttagtacc

SEQ ID NO: 17085 - DNA, 23 bp, Artificial Sequence
  Synthetic
tgaaaattattgtgtgtgtgttg

SEQ ID NO: 17086 - DNA, 20 bp, Artificial Sequence
  Synthetic
aaagttggtttgttgtggat

SEQ ID NO: 17087 - DNA, 24 bp, Artificial Sequence
  Synthetic
agaagctacaaaagtaataagtcc

SEQ ID NO: 17088 - DNA, 21 bp, Artificial Sequence
  Synthetic
tatacgcagatgaagatagca

SEQ ID NO: 17089 - DNA, 22 bp, Artificial Sequence
  Synthetic
tatgaggaatgcattagatggt

SEQ ID NO: 17090 - DNA, 22 bp, Artificial Sequence
  Synthetic
ttcaagtttcagaagctaaagc

SEQ ID NO: 17091 - DNA, 18 bp, Artificial Sequence
  Synthetic
ggcctcctccaactccat

SEQ ID NO: 17092 - DNA, 21 bp, Artificial Sequence
  Synthetic
aactgtaaacctcccaaaagg

SEQ ID NO: 17093 - DNA, 23 bp, Artificial Sequence
  Synthetic
aggggaaatcgatattgtatcag

SEQ ID NO: 17094 - DNA, 25 bp, Artificial Sequence
  Synthetic
gatgtttcatttacatttgaaaggg

SEQ ID NO: 17095 - DNA, 22 bp, Artificial Sequence
  Synthetic
tggattggtagtgtttaatccc

SEQ ID NO: 17096 - DNA, 21 bp, Artificial Sequence
  Synthetic
gaagaggaaatccattaggtg

SEQ ID NO: 17097 - DNA, 18 bp, Artificial Sequence
  Synthetic
ggctggaaaggttggaga

SEQ ID NO: 17098 - DNA, 24 bp, Artificial Sequence
  Synthetic
tacaagtatattacttcatgggcc

SEQ ID NO: 17099 - DNA, 18 bp, Artificial Sequence
  Synthetic
gctcagccactaacccgt

SEQ ID NO: 17100 - DNA, 18 bp, Artificial Sequence
  Synthetic
ctgtgggatggaaccaac

SEQ ID NO: 17101 - DNA, 20 bp, Artificial Sequence
  Synthetic
aaattcacacaacctctagc

SEQ ID NO: 17102 - DNA, 19 bp, Artificial Sequence
  Synthetic
taaaggttggtggtggaag

SEQ ID NO: 17103 - DNA, 25 bp, Artificial Sequence
  Synthetic
ttcaaatgttaggagagataacaag

SEQ ID NO: 17104 - DNA, 21 bp, Artificial Sequence
  Synthetic
gataagtcagagttctcaggg

SEQ ID NO: 17105 - DNA, 20 bp, Artificial Sequence
  Synthetic
caagaaaacagcagacaagc

SEQ ID NO: 17106 - DNA, 20 bp, Artificial Sequence
  Synthetic
acaccaatgatgaaacagga

SEQ ID NO: 17107 - DNA, 18 bp, Artificial Sequence
  Synthetic
ctctttgggccaagatcc

SEQ ID NO: 17108 - DNA, 24 bp, Artificial Sequence
  Synthetic
ggttttcctaggtttactattcca

SEQ ID NO: 17109 - DNA, 20 bp, Artificial Sequence
  Synthetic
attcagcacaaactaccatg

SEQ ID NO: 17110 - DNA, 20 bp, Artificial Sequence
  Synthetic
ttggagggctgctactatag

SEQ ID NO: 17111 - DNA, 20 bp, Artificial Sequence
  Synthetic
gtttagacactcaccaaggt

SEQ ID NO: 17112 - DNA, 19 bp, Artificial Sequence
  Synthetic
ctgtcacaagtcaccatgg

SEQ ID NO: 17113 - DNA, 20 bp, Artificial Sequence
  Synthetic
gtttaaccaaaccaggtgac

SEQ ID NO: 17114 - DNA, 18 bp, Artificial Sequence
  Synthetic
acccacagtaacagtccc

SEQ ID NO: 17115 - DNA, 20 bp, Artificial Sequence
  Synthetic
atagaggagagcaaatccag

SEQ ID NO: 17116 - DNA, 20 bp, Artificial Sequence
  Synthetic
ttgatgtgtattgcccaagg

SEQ ID NO: 17117 - DNA, 21 bp, Artificial Sequence
  Synthetic
atatgactatccaacccaacc

SEQ ID NO: 17118 - DNA, 19 bp, Artificial Sequence
  Synthetic
tcctggtgttaaggaacca

SEQ ID NO: 17119 - DNA, 20 bp, Artificial Sequence
  Synthetic
ttcccttatgtgtctttggg

SEQ ID NO: 17120 - DNA, 20 bp, Artificial Sequence
  Synthetic
caggtatcttaacaggctca

SEQ ID NO: 17121 - DNA, 20 bp, Artificial Sequence
  Synthetic
aatgtgaccttccttaaacg

SEQ ID NO: 17122 - DNA, 21 bp, Artificial Sequence
  Synthetic
cgcgagatactaacaaaaacc

SEQ ID NO: 17123 - DNA, 18 bp, Artificial Sequence
  Synthetic
gtcggacagagtgatggt

SEQ ID NO: 17124 - DNA, 20 bp, Artificial Sequence
  Synthetic
gtcgttttcccaaatgaagt

SEQ ID NO: 17125 - DNA, 19 bp, Artificial Sequence
  Synthetic
catccgtcaagaaggaaga

SEQ ID NO: 17126 - DNA, 18 bp, Artificial Sequence
  Synthetic
ggcgatctgaatttcgtg

SEQ ID NO: 17127 - DNA, 19 bp, Artificial Sequence
  Synthetic
attgaccgtttcttgaggg

SEQ ID NO: 17128 - DNA, 20 bp, Artificial Sequence
  Synthetic
acaagcggtaatgcagttga

SEQ ID NO: 17129 - DNA, 18 bp, Artificial Sequence
  Synthetic
accgattacgtggggttt

SEQ ID NO: 17130 - DNA, 18 bp, Artificial Sequence
  Synthetic
cccacacttcaggaccta

SEQ ID NO: 17131 - DNA, 18 bp, Artificial Sequence
  Synthetic
ttggacaatcctgaggtg

SEQ ID NO: 17132 - DNA, 18 bp, Artificial Sequence
  Synthetic
ggttagaccgagtggcga

SEQ ID NO: 17133 - DNA, 20 bp, Artificial Sequence
  Synthetic
gggaatttaacaagacacgc

SEQ ID NO: 17134 - DNA, 19 bp, Artificial Sequence
  Synthetic
gcaggggctacattctgga

SEQ ID NO: 17135 - DNA, 18 bp, Artificial Sequence
  Synthetic
acgaggattgggaggagg

SEQ ID NO: 17136 - DNA, 18 bp, Artificial Sequence
  Synthetic
tggaagacccaagagcga

SEQ ID NO: 17137 - DNA, 20 bp, Artificial Sequence
  Synthetic
gtgcaactttagccagacca

SEQ ID NO: 17138 - DNA, 16 bp, Artificial Sequence
  Synthetic
gggatgggccggagtt

SEQ ID NO: 17139 - DNA, 18 bp, Artificial Sequence
  Synthetic
tggtccacctctcccgat

SEQ ID NO: 17140 - DNA, 20 bp, Artificial Sequence
  Synthetic
ggcctggatcttaaggttgg

SEQ ID NO: 17141 - DNA, 17 bp, Artificial Sequence
  Synthetic
ggggtgatgagctgcga

SEQ ID NO: 17142 - DNA, 16 bp, Artificial Sequence
  Synthetic
tccaggcggtcccaga

SEQ ID NO: 17143 - DNA, 17 bp, Artificial Sequence
  Synthetic
cggagcttgcccttgga

SEQ ID NO: 17144 - DNA, 16 bp, Artificial Sequence
  Synthetic
tgtcctgcaggggcgt

SEQ ID NO: 17145 - DNA, 18 bp, Artificial Sequence
  Synthetic
ccagctgttggggtaggt

SEQ ID NO: 17146 - DNA, 18 bp, Artificial Sequence
  Synthetic
cgcaacgcacttccattc

SEQ ID NO: 17147 - DNA, 20 bp, Artificial Sequence
  Synthetic
tacacatagatgggctccga

SEQ ID NO: 17148 - DNA, 20 bp, Artificial Sequence
  Synthetic
atggttaacggccttgtagg

SEQ ID NO: 17149 - DNA, 18 bp, Artificial Sequence
  Synthetic
ctgggcggctaggacaat

SEQ ID NO: 17150 - DNA, 16 bp, Artificial Sequence
  Synthetic
tcccagcgatcccagc

SEQ ID NO: 17151 - DNA, 16 bp, Artificial Sequence
  Synthetic
cgctgcacgggctgta

SEQ ID NO: 17152 - DNA, 16 bp, Artificial Sequence
  Synthetic
gacgcggcggttgaca

SEQ ID NO: 17153 - DNA, 16 bp, Artificial Sequence
  Synthetic
tccccgtcaacgtcgc

SEQ ID NO: 17154 - DNA, 18 bp, Artificial Sequence
  Synthetic
tcgcgctcaaaatccccg

SEQ ID NO: 17155 - DNA, 18 bp, Artificial Sequence
  Synthetic
ggcgctaacgatgcatct

SEQ ID NO: 17156 - DNA, 19 bp, Artificial Sequence
  Synthetic
atgtcatcatttgcggcgg

SEQ ID NO: 17157 - DNA, 17 bp, Artificial Sequence
  Synthetic
actaggaagtgcggcgg

SEQ ID NO: 17158 - DNA, 18 bp, Artificial Sequence
  Synthetic
cttcctccgtagcctggc

SEQ ID NO: 17159 - DNA, 18 bp, Artificial Sequence
  Synthetic
agcattgccagggttacg

SEQ ID NO: 17160 - DNA, 18 bp, Artificial Sequence
  Synthetic
ggcctacgagcagacggt

SEQ ID NO: 17161 - DNA, 20 bp, Artificial Sequence
  Synthetic
gcgatcaactactcagtgct

SEQ ID NO: 17162 - DNA, 16 bp, Artificial Sequence
  Synthetic
aggatgcacccgctgc

SEQ ID NO: 17163 - DNA, 16 bp, Artificial Sequence
  Synthetic
aggccatccgtcccga

SEQ ID NO: 17164 - DNA, 20 bp, Artificial Sequence
  Synthetic
tttttccagacaagccggca

SEQ ID NO: 17165 - DNA, 19 bp, Artificial Sequence
  Synthetic
acgacaccgacagtttgag

SEQ ID NO: 17166 - DNA, 16 bp, Artificial Sequence
  Synthetic
gcgcggcgtccatgaa

SEQ ID NO: 17167 - DNA, 20 bp, Artificial Sequence
  Synthetic
gaacgccatggccaataacg

SEQ ID NO: 17168 - DNA, 20 bp, Artificial Sequence
  Synthetic
ccttgttagagatgaggcgc

SEQ ID NO: 17169 - DNA, 19 bp, Artificial Sequence
  Synthetic
aagtggggcgtcaaaatgg

SEQ ID NO: 17170 - DNA, 20 bp, Artificial Sequence
  Synthetic
caagtacttggaaagcaaga

SEQ ID NO: 17171 - DNA, 20 bp, Artificial Sequence
  Synthetic
gcaagtttactggtcgctgc

SEQ ID NO: 17172 - DNA, 20 bp, Artificial Sequence
  Synthetic
cgagtgaccgttactgacgc

SEQ ID NO: 17173 - DNA, 16 bp, Artificial Sequence
  Synthetic
gcttacaagcgcgggc

SEQ ID NO: 17174 - DNA, 16 bp, Artificial Sequence
  Synthetic
cagacgagcggccgtt

SEQ ID NO: 17175 - DNA, 17 bp, Artificial Sequence
  Synthetic
tgtgcgcgagtttgctc

SEQ ID NO: 17176 - DNA, 19 bp, Artificial Sequence
  Synthetic
tacccgaccatgcagatca

SEQ ID NO: 17177 - DNA, 16 bp, Artificial Sequence
  Synthetic
gtgcagaccgacccct

SEQ ID NO: 17178 - DNA, 19 bp, Artificial Sequence
  Synthetic
actgttgcagagagatggc

SEQ ID NO: 17179 - DNA, 20 bp, Artificial Sequence
  Synthetic
catcaattttgcgtccctgg

SEQ ID NO: 17180 - DNA, 16 bp, Artificial Sequence
  Synthetic
ccgtgcagcgcgagat

SEQ ID NO: 17181 - DNA, 16 bp, Artificial Sequence
  Synthetic
cagctccggtcgtgca

SEQ ID NO: 17182 - DNA, 16 bp, Artificial Sequence
  Synthetic
ccgggtctggtgcagt

SEQ ID NO: 17183 - DNA, 22 bp, Artificial Sequence
  Synthetic
caaaacaaactaatgctggaaa

SEQ ID NO: 17184 - DNA, 20 bp, Artificial Sequence
  Synthetic
tgtggttgacttacaagaca

SEQ ID NO: 17185 - DNA, 18 bp, Artificial Sequence
  Synthetic
ttgtacctgcccgactcc

SEQ ID NO: 17186 - DNA, 20 bp, Artificial Sequence
  Synthetic
cacctacgagtggaacttcc

SEQ ID NO: 17187 - DNA, 19 bp, Artificial Sequence
  Synthetic
gttcgactcctcggttagc

SEQ ID NO: 17188 - DNA, 16 bp, Artificial Sequence
  Synthetic
ccctgcccttccagca

SEQ ID NO: 17189 - DNA, 20 bp, Artificial Sequence
  Synthetic
tgaagttttcgacgtggtca

SEQ ID NO: 17190 - DNA, 16 bp, Artificial Sequence
  Synthetic
gctcgcgcacctgcta

SEQ ID NO: 17191 - DNA, 18 bp, Artificial Sequence
  Synthetic
gggaaccccaccatgaac

SEQ ID NO: 17192 - DNA, 19 bp, Artificial Sequence
  Synthetic
tgcggtactggtacttggg

SEQ ID NO: 17193 - DNA, 19 bp, Artificial Sequence
  Synthetic
ctgtggggcttgtggttac

SEQ ID NO: 17194 - DNA, 16 bp, Artificial Sequence
  Synthetic
gcgctgaccgttctcg

SEQ ID NO: 17195 - DNA, 20 bp, Artificial Sequence
  Synthetic
tttggaagatctcggtctgc

SEQ ID NO: 17196 - DNA, 20 bp, Artificial Sequence
  Synthetic
tgtttggtctttctgggctg

SEQ ID NO: 17197 - DNA, 20 bp, Artificial Sequence
  Synthetic
gcaacccaaaatcaagcagg

SEQ ID NO: 17198 - DNA, 19 bp, Artificial Sequence
  Synthetic
gttacactagcgccctggt

SEQ ID NO: 17199 - DNA, 18 bp, Artificial Sequence
  Synthetic
ttggaatgtatgcgccgc

SEQ ID NO: 17200 - DNA, 19 bp, Artificial Sequence
  Synthetic
gacgagaacctgaaggagc

SEQ ID NO: 17201 - DNA, 19 bp, Artificial Sequence
  Synthetic
agctggccaactacattgc

SEQ ID NO: 17202 - DNA, 20 bp, Artificial Sequence
  Synthetic
tctttgaggaccaattgcgc

SEQ ID NO: 17203 - DNA, 17 bp, Artificial Sequence
  Synthetic
gcaggcaacagagcagc

SEQ ID NO: 17204 - DNA, 18 bp, Artificial Sequence
  Synthetic
cttgaccaccagggagct

SEQ ID NO: 17205 - DNA, 20 bp, Artificial Sequence
  Synthetic
actaccgtactacttccgcg

SEQ ID NO: 17206 - DNA, 20 bp, Artificial Sequence
  Synthetic
cagttcgtggaggagtttgt

SEQ ID NO: 17207 - DNA, 18 bp, Artificial Sequence
  Synthetic
cccgaagttgcatgagaa

SEQ ID NO: 17208 - DNA, 22 bp, Artificial Sequence
  Synthetic
tatctgctgggttagatattgc

SEQ ID NO: 17209 - DNA, 19 bp, Artificial Sequence
  Synthetic
ctaccaaggagaacatggt

SEQ ID NO: 17210 - DNA, 21 bp, Artificial Sequence
  Synthetic
ccagttacatggtatgatgga

SEQ ID NO: 17211 - DNA, 20 bp, Artificial Sequence
  Synthetic
gtgtcagtcaaaaccttgtt

SEQ ID NO: 17212 - DNA, 22 bp, Artificial Sequence
  Synthetic
gataaggcaaatcgttacagaa

SEQ ID NO: 17213 - DNA, 24 bp, Artificial Sequence
  Synthetic
ctcaggtttgcatattcaaattac

SEQ ID NO: 17214 - DNA, 18 bp, Artificial Sequence
  Synthetic
gccattccccacctacct

SEQ ID NO: 17215 - DNA, 23 bp, Artificial Sequence
  Synthetic
ttcctattacttggtaattgtgg

SEQ ID NO: 17216 - DNA, 19 bp, Artificial Sequence
  Synthetic
ccccagcagaagcaaaagt

SEQ ID NO: 17217 - DNA, 18 bp, Artificial Sequence
  Synthetic
cttccttactcccccctt

SEQ ID NO: 17218 - DNA, 24 bp, Artificial Sequence
  Synthetic
ggtggaaatatatgtgttagagtt

SEQ ID NO: 17219 - DNA, 21 bp, Artificial Sequence
  Synthetic
tttggtagcctatccaaaacc

SEQ ID NO: 17220 - DNA, 19 bp, Artificial Sequence
  Synthetic
cacattctcccaccaccag

SEQ ID NO: 17221 - DNA, 19 bp, Artificial Sequence
  Synthetic
gcaccgcattctaatttcg

SEQ ID NO: 17222 - DNA, 20 bp, Artificial Sequence
  Synthetic
aggcacactgacatacatct

SEQ ID NO: 17223 - DNA, 19 bp, Artificial Sequence
  Synthetic
tgcgaattcccctcaacac

SEQ ID NO: 17224 - DNA, 20 bp, Artificial Sequence
  Synthetic
catcatgttacattcctgca

SEQ ID NO: 17225 - DNA, 19 bp, Artificial Sequence
  Synthetic
ctgcatgctggaataagct

SEQ ID NO: 17226 - DNA, 19 bp, Artificial Sequence
  Synthetic
gtccgtgtgattaaagagc

SEQ ID NO: 17227 - DNA, 18 bp, Artificial Sequence
  Synthetic
cagtacaagcgccaacag

SEQ ID NO: 17228 - DNA, 18 bp, Artificial Sequence
  Synthetic
ttataatggccgggctac

SEQ ID NO: 17229 - DNA, 18 bp, Artificial Sequence
  Synthetic
ccattgttccaagggcaa

SEQ ID NO: 17230 - DNA, 20 bp, Artificial Sequence
  Synthetic
atactcagagacccagttca

SEQ ID NO: 17231 - DNA, 25 bp, Artificial Sequence
  Synthetic
ttgatcatacagacataacatttgg

SEQ ID NO: 17232 - DNA, 18 bp, Artificial Sequence
  Synthetic
ggccgacagaaaacagag

SEQ ID NO: 17233 - DNA, 19 bp, Artificial Sequence
  Synthetic
tctcagatgtcatcggact

SEQ ID NO: 17234 - DNA, 20 bp, Artificial Sequence
  Synthetic
ggagtggaatctctaggaga

SEQ ID NO: 17235 - DNA, 24 bp, Artificial Sequence
  Synthetic
gagggtagaacaaataataatgga

SEQ ID NO: 17236 - DNA, 18 bp, Artificial Sequence
  Synthetic
tcgaagaccacaacacca

SEQ ID NO: 17237 - DNA, 18 bp, Artificial Sequence
  Synthetic
cgggaaaacgggaaatcc

SEQ ID NO: 17238 - DNA, 20 bp, Artificial Sequence
  Synthetic
aaatggctgaaacatacagg

SEQ ID NO: 17239 - DNA, 22 bp, Artificial Sequence
  Synthetic
gcattgacctcaaaataactgt

SEQ ID NO: 17240 - DNA, 24 bp, Artificial Sequence
  Synthetic
tggaacatcactaggtacaattac

SEQ ID NO: 17241 - DNA, 21 bp, Artificial Sequence
  Synthetic
caggcacattatccaaaactc

SEQ ID NO: 17242 - DNA, 25 bp, Artificial Sequence
  Synthetic
tcagttcaaataagaaaaacgtagg

SEQ ID NO: 17243 - DNA, 25 bp, Artificial Sequence
  Synthetic
atccctgataacaataactaatgac

SEQ ID NO: 17244 - DNA, 25 bp, Artificial Sequence
  Synthetic
ctctactctgctaatataacagaaa

SEQ ID NO: 17245 - DNA, 18 bp, Artificial Sequence
  Synthetic
catccacatgtacatgcg

SEQ ID NO: 17246 - DNA, 24 bp, Artificial Sequence
  Synthetic
catacaacaatcaaatctatccac

SEQ ID NO: 17247 - DNA, 21 bp, Artificial Sequence
  Synthetic
gaaaacaccattgctattcac

SEQ ID NO: 17248 - DNA, 23 bp, Artificial Sequence
  Synthetic
ggtaatttctcatacctatgaca

SEQ ID NO: 17249 - DNA, 22 bp, Artificial Sequence
  Synthetic
acttttgaccatcctttttctg

SEQ ID NO: 17250 - DNA, 23 bp, Artificial Sequence
  Synthetic
gaaggtaggctacttaaactagg

SEQ ID NO: 17251 - DNA, 19 bp, Artificial Sequence
  Synthetic
ccactatctcctgatgcag

SEQ ID NO: 17252 - DNA, 19 bp, Artificial Sequence
  Synthetic
cccggcagatcaaaatcag

SEQ ID NO: 17253 - DNA, 25 bp, Artificial Sequence
  Synthetic
gtattaatgtattgtgatgttgtcg

SEQ ID NO: 17254 - DNA, 19 bp, Artificial Sequence
  Synthetic
aagatgagagcagtccagg

SEQ ID NO: 17255 - DNA, 20 bp, Artificial Sequence
  Synthetic
tcttgcagctgttaaagttg

SEQ ID NO: 17256 - DNA, 23 bp, Artificial Sequence
  Synthetic
aagggaaaaattggttaagatgt

SEQ ID NO: 17257 - DNA, 25 bp, Artificial Sequence
  Synthetic
gagtatatgtgttcagtagaattgg

SEQ ID NO: 17258 - DNA, 19 bp, Artificial Sequence
  Synthetic
gggcttatggaactgatga

SEQ ID NO: 17259 - DNA, 21 bp, Artificial Sequence
  Synthetic
ttcgggggtattctaatcaat

SEQ ID NO: 17260 - DNA, 21 bp, Artificial Sequence
  Synthetic
tgagagtaagaggtataggga

SEQ ID NO: 17261 - DNA, 22 bp, Artificial Sequence
  Synthetic
ttatcacaccaattgagacttt

SEQ ID NO: 17262 - DNA, 18 bp, Artificial Sequence
  Synthetic
ggatgtcaatccgacctt

SEQ ID NO: 17263 - DNA, 20 bp, Artificial Sequence
  Synthetic
atcacacccaggaatctttg

SEQ ID NO: 17264 - DNA, 22 bp, Artificial Sequence
  Synthetic
ggatgtgatagaatcaatggat

SEQ ID NO: 17265 - DNA, 22 bp, Artificial Sequence
  Synthetic
acactagcgagaaatatttgtg

SEQ ID NO: 17266 - DNA, 18 bp, Artificial Sequence
  Synthetic
ctgagcattgcacccata

SEQ ID NO: 17267 - DNA, 21 bp, Artificial Sequence
  Synthetic
tcttaggagtctcaatcctga

SEQ ID NO: 17268 - DNA, 22 bp, Artificial Sequence
  Synthetic
gatttgtagccaattttagcat

SEQ ID NO: 17269 - DNA, 19 bp, Artificial Sequence
  Synthetic
tctccacattccagaagtc

SEQ ID NO: 17270 - DNA, 21 bp, Artificial Sequence
  Synthetic
gggaattcttgaagatgaaca

SEQ ID NO: 17271 - DNA, 18 bp, Artificial Sequence
  Synthetic
gtagggtcagcaaagcac

SEQ ID NO: 17272 - DNA, 18 bp, Artificial Sequence
  Synthetic
aaaagtgagggagctgcg

SEQ ID NO: 17273 - DNA, 20 bp, Artificial Sequence
  Synthetic
ggtggttgacctacattgca

SEQ ID NO: 17274 - DNA, 24 bp, Artificial Sequence
  Synthetic
agacatattagaggtgtttaaggt

SEQ ID NO: 17275 - DNA, 19 bp, Artificial Sequence
  Synthetic
tgtgcgatacaaatgtggg

SEQ ID NO: 17276 - DNA, 19 bp, Artificial Sequence
  Synthetic
tgggcatatgacaatgaca

SEQ ID NO: 17277 - DNA, 20 bp, Artificial Sequence
  Synthetic
ggtaccaaaaaaaagctgca

SEQ ID NO: 17278 - DNA, 18 bp, Artificial Sequence
  Synthetic
aggaggaggaggatgagg

SEQ ID NO: 17279 - DNA, 19 bp, Artificial Sequence
  Synthetic
aagggttacaaacaagtgc

SEQ ID NO: 17280 - DNA, 21 bp, Artificial Sequence
  Synthetic
gctttcctatctttcctcact

SEQ ID NO: 17281 - DNA, 19 bp, Artificial Sequence
  Synthetic
gggggattgggtataggca

SEQ ID NO: 17282 - DNA, 18 bp, Artificial Sequence
  Synthetic
gggtctgtgcaggttagc

SEQ ID NO: 17283 - DNA, 19 bp, Artificial Sequence
  Synthetic
gcgctcgggtacactttta

SEQ ID NO: 17284 - DNA, 20 bp, Artificial Sequence
  Synthetic
gtaccagctgtaccatatgt

SEQ ID NO: 17285 - DNA, 18 bp, Artificial Sequence
  Synthetic
cagttcccgtctgcttac

SEQ ID NO: 17286 - DNA, 22 bp, Artificial Sequence
  Synthetic
aataaatctgaagtgccattgg

SEQ ID NO: 17287 - DNA, 25 bp, Artificial Sequence
  Synthetic
ctgattcccaattatttaataagcc

SEQ ID NO: 17288 - DNA, 19 bp, Artificial Sequence
  Synthetic
ttgttggatgactggaact

SEQ ID NO: 17289 - DNA, 20 bp, Artificial Sequence
  Synthetic
tgctacaaaacgcaaaaagc

SEQ ID NO: 17290 - DNA, 20 bp, Artificial Sequence
  Synthetic
tgcaccctgtgagtaagtgt

SEQ ID NO: 17291 - DNA, 18 bp, Artificial Sequence
  Synthetic
gggtgtgtttgacaggtt

SEQ ID NO: 17292 - DNA, 21 bp, Artificial Sequence
  Synthetic
ttggagaaacagtggaattac

SEQ ID NO: 17293 - DNA, 18 bp, Artificial Sequence
  Synthetic
gacgtttgcatccaacac

SEQ ID NO: 17294 - DNA, 19 bp, Artificial Sequence
  Synthetic
gggacggtccagtacttcc

SEQ ID NO: 17295 - DNA, 18 bp, Artificial Sequence
  Synthetic
ccggcccgtcaatcaaag

SEQ ID NO: 17296 - DNA, 21 bp, Artificial Sequence
  Synthetic
tttaccgagtaaaaggttcca

SEQ ID NO: 17297 - DNA, 19 bp, Artificial Sequence
  Synthetic
tgattctggtctcacctgt

SEQ ID NO: 17298 - DNA, 18 bp, Artificial Sequence
  Synthetic
cgcggttcgatgtagggt

SEQ ID NO: 17299 - DNA, 20 bp, Artificial Sequence
  Synthetic
catgtggctgagcaaaaagg

SEQ ID NO: 17300 - DNA, 17 bp, Artificial Sequence
  Synthetic
aggttcctgcggaggtg

SEQ ID NO: 17301 - DNA, 17 bp, Artificial Sequence
  Synthetic
tacttgaggagccggcg

SEQ ID NO: 17302 - DNA, 16 bp, Artificial Sequence
  Synthetic
ccccttccgcctccaa

SEQ ID NO: 17303 - DNA, 18 bp, Artificial Sequence
  Synthetic
gtcgtcacgctccacaac

SEQ ID NO: 17304 - DNA, 18 bp, Artificial Sequence
  Synthetic
gtcctcgaattcgtggcc

SEQ ID NO: 17305 - DNA, 20 bp, Artificial Sequence
  Synthetic
cggtgcgaaatgaagagtgt

SEQ ID NO: 17306 - DNA, 20 bp, Artificial Sequence
  Synthetic
tgagaagcagtttcaggacg

SEQ ID NO: 17307 - DNA, 19 bp, Artificial Sequence
  Synthetic
ttatcaggtacgtgctgtt

SEQ ID NO: 17308 - DNA, 16 bp, Artificial Sequence
  Synthetic
cgatggagcgcatgcc

SEQ ID NO: 17309 - DNA, 18 bp, Artificial Sequence
  Synthetic
cccgttgcagtgattcgg

SEQ ID NO: 17310 - DNA, 17 bp, Artificial Sequence
  Synthetic
gtcccgttgtgcgttgt

SEQ ID NO: 17311 - DNA, 19 bp, Artificial Sequence
  Synthetic
cagacggtgtcagtcaagg

SEQ ID NO: 17312 - DNA, 20 bp, Artificial Sequence
  Synthetic
ccaacagtagtccctctgcc

SEQ ID NO: 17313 - DNA, 19 bp, Artificial Sequence
  Synthetic
cgtcctccccctgaaaagc

SEQ ID NO: 17314 - DNA, 17 bp, Artificial Sequence
  Synthetic
cgtagctggcggttctg

SEQ ID NO: 17315 - DNA, 16 bp, Artificial Sequence
  Synthetic
agccacgcgctagcac

SEQ ID NO: 17316 - DNA, 20 bp, Artificial Sequence
  Synthetic
aaaggggatcaaattggccc

SEQ ID NO: 17317 - DNA, 18 bp, Artificial Sequence
  Synthetic
cgaggcctgcgtaacttg

SEQ ID NO: 17318 - DNA, 19 bp, Artificial Sequence
  Synthetic
ctgtccttagttggcgccg

SEQ ID NO: 17319 - DNA, 18 bp, Artificial Sequence
  Synthetic
cggcggtaacaaaggacg

SEQ ID NO: 17320 - DNA, 18 bp, Artificial Sequence
  Synthetic
gacgcaaagacgctcctg

SEQ ID NO: 17321 - DNA, 20 bp, Artificial Sequence
  Synthetic
cagagagcctagaatcacgc

SEQ ID NO: 17322 - DNA, 19 bp, Artificial Sequence
  Synthetic
ccccacacgccatagacat

SEQ ID NO: 17323 - DNA, 20 bp, Artificial Sequence
  Synthetic
ctttccacacgcaatgaagc

SEQ ID NO: 17324 - DNA, 20 bp, Artificial Sequence
  Synthetic
ttgtatgccagaagcctcct

SEQ ID NO: 17325 - DNA, 16 bp, Artificial Sequence
  Synthetic
cgctgtgcgccctcaa

SEQ ID NO: 17326 - DNA, 17 bp, Artificial Sequence
  Synthetic
tgctgctcctgctcctc

SEQ ID NO: 17327 - DNA, 18 bp, Artificial Sequence
  Synthetic
cggagacacaggatggga

SEQ ID NO: 17328 - DNA, 16 bp, Artificial Sequence
  Synthetic
acggtgcccagtgggt

SEQ ID NO: 17329 - DNA, 20 bp, Artificial Sequence
  Synthetic
gagacagctctgattcacgg

SEQ ID NO: 17330 - DNA, 17 bp, Artificial Sequence
  Synthetic
aagcgtcggagagctgg

SEQ ID NO: 17331 - DNA, 17 bp, Artificial Sequence
  Synthetic
ggacggagtgatggcct

SEQ ID NO: 17332 - DNA, 19 bp, Artificial Sequence
  Synthetic
agtccggagaagatagggc

SEQ ID NO: 17333 - DNA, 18 bp, Artificial Sequence
  Synthetic
gcagggatgtctgaggag

SEQ ID NO: 17334 - DNA, 19 bp, Artificial Sequence
  Synthetic
cggggtggtaactacctgc

SEQ ID NO: 17335 - DNA, 20 bp, Artificial Sequence
  Synthetic
cagacagtgggtatggcaat

SEQ ID NO: 17336 - DNA, 21 bp, Artificial Sequence
  Synthetic
catagaaccaccaaaactgag

SEQ ID NO: 17337 - DNA, 22 bp, Artificial Sequence
  Synthetic
tcaggtttctaagacatcaagg

SEQ ID NO: 17338 - DNA, 20 bp, Artificial Sequence
  Synthetic
agtgagcatagacagaaagc

SEQ ID NO: 17339 - DNA, 19 bp, Artificial Sequence
  Synthetic
tgctgtttaaggcccgaga

SEQ ID NO: 17340 - DNA, 20 bp, Artificial Sequence
  Synthetic
tggctgggactgttattcac

SEQ ID NO: 17341 - DNA, 18 bp, Artificial Sequence
  Synthetic
gcctttgtaacactgtgg

SEQ ID NO: 17342 - DNA, 19 bp, Artificial Sequence
  Synthetic
tggggtcatgatgatgttc

SEQ ID NO: 17343 - DNA, 18 bp, Artificial Sequence
  Synthetic
caggagcgtcacatccca

SEQ ID NO: 17344 - DNA, 19 bp, Artificial Sequence
  Synthetic
gttgcccccagcttctact

SEQ ID NO: 17345 - DNA, 18 bp, Artificial Sequence
  Synthetic
gtggcggcctaatgaaag

SEQ ID NO: 17346 - DNA, 18 bp, Artificial Sequence
  Synthetic
gaggacggggatatggtt

SEQ ID NO: 17347 - DNA, 22 bp, Artificial Sequence
  Synthetic
ggaatatctcaggcatatggag

SEQ ID NO: 17348 - DNA, 22 bp, Artificial Sequence
  Synthetic
acatgtatggtatgtatcccct

SEQ ID NO: 17349 - DNA, 23 bp, Artificial Sequence
  Synthetic
aaacttactagatgatagcgatg

SEQ ID NO: 17350 - DNA, 22 bp, Artificial Sequence
  Synthetic
acagtggaatagaaaatgaagc

SEQ ID NO: 17351 - DNA, 25 bp, Artificial Sequence
  Synthetic
ggtttctcatatgaattcaaaaagc

SEQ ID NO: 17352 - DNA, 24 bp, Artificial Sequence
  Synthetic
tcatgagaaaagaaggaatactgt

SEQ ID NO: 17353 - DNA, 20 bp, Artificial Sequence
  Synthetic
atcagctcttcctaccccac

SEQ ID NO: 17354 - DNA, 23 bp, Artificial Sequence
  Synthetic
aataaagtagaggaaacaacact

SEQ ID NO: 17355 - DNA, 19 bp, Artificial Sequence
  Synthetic
ggtcactcctgaagtagtg

SEQ ID NO: 17356 - DNA, 19 bp, Artificial Sequence
  Synthetic
gaaaatcccgcctttacca

SEQ ID NO: 17357 - DNA, 19 bp, Artificial Sequence
  Synthetic
tggtgtggctcttagagtg

SEQ ID NO: 17358 - DNA, 19 bp, Artificial Sequence
  Synthetic
atcttccaccttccagacc

SEQ ID NO: 17359 - DNA, 21 bp, Artificial Sequence
  Synthetic
gaaactgaaaggtattgaggt

SEQ ID NO: 17360 - DNA, 19 bp, Artificial Sequence
  Synthetic
ctgcccacctcttgaatta

SEQ ID NO: 17361 - DNA, 23 bp, Artificial Sequence
  Synthetic
gggttgtaggtgaaaatattcct

SEQ ID NO: 17362 - DNA, 18 bp, Artificial Sequence
  Synthetic
ccacacgttgtcctgatc

SEQ ID NO: 17363 - DNA, 23 bp, Artificial Sequence
  Synthetic
actgtgaatttaatgtgaaatgc

SEQ ID NO: 17364 - DNA, 23 bp, Artificial Sequence
  Synthetic
ttgcaagaaattgatattcgttg

SEQ ID NO: 17365 - DNA, 23 bp, Artificial Sequence
  Synthetic
gtgagaatgagcatgatactttg

SEQ ID NO: 17366 - DNA, 23 bp, Artificial Sequence
  Synthetic
attgaaaagacgattgttgtttc

SEQ ID NO: 17367 - DNA, 25 bp, Artificial Sequence
  Synthetic
taacaaatgcctcttatatgtatgg

SEQ ID NO: 17368 - DNA, 18 bp, Artificial Sequence
  Synthetic
gacgacgacgacgaagag

SEQ ID NO: 17369 - DNA, 25 bp, Artificial Sequence
  Synthetic
gaacataaagaatctagtagcaagc

SEQ ID NO: 17370 - DNA, 25 bp, Artificial Sequence
  Synthetic
aataaagtagaaggtaatacatggg

SEQ ID NO: 17371 - DNA, 20 bp, Artificial Sequence
  Synthetic
tgttatagacacaggcacat

SEQ ID NO: 17372 - DNA, 18 bp, Artificial Sequence
  Synthetic
actgctgtgcaaactcat

SEQ ID NO: 17373 - DNA, 23 bp, Artificial Sequence
  Synthetic
ttgcactttatacatctaggttt

SEQ ID NO: 17374 - DNA, 22 bp, Artificial Sequence
  Synthetic
attaatacattaccctgtgcag

SEQ ID NO: 17375 - DNA, 25 bp, Artificial Sequence
  Synthetic
attgttggaactgatttatacttcc

SEQ ID NO: 17376 - DNA, 23 bp, Artificial Sequence
  Synthetic
ggtattgaaattgatagaggtgg

SEQ ID NO: 17377 - DNA, 22 bp, Artificial Sequence
  Synthetic
tattttaatcctaatggccagg

SEQ ID NO: 17378 - DNA, 23 bp, Artificial Sequence
  Synthetic
tattttgcatgtgaaatggaaca

SEQ ID NO: 17379 - DNA, 20 bp, Artificial Sequence
  Synthetic
tgaacaggccaaaaatgaac

SEQ ID NO: 17380 - DNA, 18 bp, Artificial Sequence
  Synthetic
agggctcaacctttcaga

SEQ ID NO: 17381 - DNA, 20 bp, Artificial Sequence
  Synthetic
caactgtggaaaactccatt

SEQ ID NO: 17382 - DNA, 25 bp, Artificial Sequence
  Synthetic
tgcagatttcttaaaattagagagg

SEQ ID NO: 17383 - DNA, 18 bp, Artificial Sequence
  Synthetic
ccagaccggatgatggaa

SEQ ID NO: 17384 - DNA, 23 bp, Artificial Sequence
  Synthetic
taaaggacaagaaatgtgatgtc

SEQ ID NO: 17385 - DNA, 18 bp, Artificial Sequence
  Synthetic
cattttggcgccaactct

SEQ ID NO: 17386 - DNA, 18 bp, Artificial Sequence
  Synthetic
ggggtgtgtagacattgc

SEQ ID NO: 17387 - DNA, 20 bp, Artificial Sequence
  Synthetic
ctgacgctgctattagaagt

SEQ ID NO: 17388 - DNA, 25 bp, Artificial Sequence
  Synthetic
tcaaatttgttaaatgatgaggagg

SEQ ID NO: 17389 - DNA, 22 bp, Artificial Sequence
  Synthetic
tgattggattgtaaatcagacc

SEQ ID NO: 17390 - DNA, 21 bp, Artificial Sequence
  Synthetic
atggtacccctgtatttcaac

SEQ ID NO: 17391 - DNA, 23 bp, Artificial Sequence
  Synthetic
caagctttattattttttgcacg

SEQ ID NO: 17392 - DNA, 24 bp, Artificial Sequence
  Synthetic
tttgtagactcagatgatatgtgg

SEQ ID NO: 17393 - DNA, 17 bp, Artificial Sequence
  Synthetic
ccacggggctacgagaa

SEQ ID NO: 17394 - DNA, 17 bp, Artificial Sequence
  Synthetic
gggaagcgagcacctca

SEQ ID NO: 17395 - DNA, 21 bp, Artificial Sequence
  Synthetic
agagtacaaacagttagtgga

SEQ ID NO: 17396 - DNA, 23 bp, Artificial Sequence
  Synthetic
gaatctgcattaactgatcatgt

SEQ ID NO: 17397 - DNA, 18 bp, Artificial Sequence
  Synthetic
gccctcacgtttagttcg

SEQ ID NO: 17398 - DNA, 25 bp, Artificial Sequence
  Synthetic
agtgcatttttatacagatcttagc

SEQ ID NO: 17399 - DNA, 21 bp, Artificial Sequence
  Synthetic
gcgttctaccacatttactgt

SEQ ID NO: 17400 - DNA, 19 bp, Artificial Sequence
  Synthetic
cctgcaactggtaaggtat

SEQ ID NO: 17401 - DNA, 24 bp, Artificial Sequence
  Synthetic
ccagaaaaggaaagattagtatgg

SEQ ID NO: 17402 - DNA, 18 bp, Artificial Sequence
  Synthetic
aatgttatgccaggcact

SEQ ID NO: 17403 - DNA, 19 bp, Artificial Sequence
  Synthetic
tcttacatcacaggcaaca

SEQ ID NO: 17404 - DNA, 20 bp, Artificial Sequence
  Synthetic
acagaaaataacagggtccc

SEQ ID NO: 17405 - DNA, 18 bp, Artificial Sequence
  Synthetic
gaaggggtcttgcaagga

SEQ ID NO: 17406 - DNA, 23 bp, Artificial Sequence
  Synthetic
agacattaaacgaaaaacagatg

SEQ ID NO: 17407 - DNA, 23 bp, Artificial Sequence
  Synthetic
tacaagaaaatgtagaagacctt

SEQ ID NO: 17408 - DNA, 19 bp, Artificial Sequence
  Synthetic
gcaggtaaacgaggaatgt

SEQ ID NO: 17409 - DNA, 18 bp, Artificial Sequence
  Synthetic
aaaaccacgctaaaaccg

SEQ ID NO: 17410 - DNA, 19 bp, Artificial Sequence
  Synthetic
ttttaccgaactggatggg

SEQ ID NO: 17411 - DNA, 23 bp, Artificial Sequence
  Synthetic
agtgttattgatattcaaacgcc

SEQ ID NO: 17412 - DNA, 19 bp, Artificial Sequence
  Synthetic
gggcgcgagatttgtacaa

SEQ ID NO: 17413 - DNA, 18 bp, Artificial Sequence
  Synthetic
cagtgacggaagacctag

SEQ ID NO: 17414 - DNA, 18 bp, Artificial Sequence
  Synthetic
ccttagggcaacattggg

SEQ ID NO: 17415 - DNA, 21 bp, Artificial Sequence
  Synthetic
aaaacgtgaacaagtctatgc

SEQ ID NO: 17416 - DNA, 18 bp, Artificial Sequence
  Synthetic
tagcctttgtaccagcac

SEQ ID NO: 17417 - DNA, 18 bp, Artificial Sequence
  Synthetic
gatgagctggaggaggag

SEQ ID NO: 17418 - DNA, 25 bp, Artificial Sequence
  Synthetic
gggtcagttatttcaaatctaatag

SEQ ID NO: 17419 - DNA, 23 bp, Artificial Sequence
  Synthetic
tccaaaaaaacgtttatttgagg

SEQ ID NO: 17420 - DNA, 20 bp, Artificial Sequence
  Synthetic
atttgtgtttggtcaaatgc

SEQ ID NO: 17421 - DNA, 19 bp, Artificial Sequence
  Synthetic
cagcaagaaaacgaagagt

SEQ ID NO: 17422 - DNA, 19 bp, Artificial Sequence
  Synthetic
tattttgggggtttgggaa

SEQ ID NO: 17423 - DNA, 19 bp, Artificial Sequence
  Synthetic
cagaaggtgttccagagac

SEQ ID NO: 17424 - DNA, 23 bp, Artificial Sequence
  Synthetic
ttgttattcaatcaagaacttgc

SEQ ID NO: 17425 - DNA, 21 bp, Artificial Sequence
  Synthetic
agaattaggtagaggaggtcc

SEQ ID NO: 17426 - DNA, 21 bp, Artificial Sequence
  Synthetic
gcacacaagaattcaagatgg

SEQ ID NO: 17427 - DNA, 21 bp, Artificial Sequence
  Synthetic
aagcgattttaaccagtacac

SEQ ID NO: 17428 - DNA, 20 bp, Artificial Sequence
  Synthetic
ttttgccaaatgtactgtga

SEQ ID NO: 17429 - DNA, 20 bp, Artificial Sequence
  Synthetic
cagaggcgattgttataccg

SEQ ID NO: 17430 - DNA, 24 bp, Artificial Sequence
  Synthetic
ctttacctgaggtgattattaggt

SEQ ID NO: 17431 - DNA, 19 bp, Artificial Sequence
  Synthetic
acttcttgtgcaaactgtg

SEQ ID NO: 17432 - DNA, 18 bp, Artificial Sequence
  Synthetic
ggcaaaacggagactgtt

SEQ ID NO: 17433 - DNA, 24 bp, Artificial Sequence
  Synthetic
taatttcatgatgggagaatttcc

SEQ ID NO: 17434 - DNA, 20 bp, Artificial Sequence
  Synthetic
ctagctctacaaggccaacc

SEQ ID NO: 17435 - DNA, 18 bp, Artificial Sequence
  Synthetic
tagaacggttgcgagaac

SEQ ID NO: 17436 - DNA, 18 bp, Artificial Sequence
  Synthetic
gggcataggtactggcaa

SEQ ID NO: 17437 - DNA, 21 bp, Artificial Sequence
  Synthetic
ccatcagttgttagtacctct

SEQ ID NO: 17438 - DNA, 21 bp, Artificial Sequence
  Synthetic
tatagggggacaatatgagga

SEQ ID NO: 17439 - DNA, 23 bp, Artificial Sequence
  Synthetic
taacaaatacatgagcaaacagt

SEQ ID NO: 17440 - DNA, 23 bp, Artificial Sequence
  Synthetic
tgtcaattttgtaaagtttcagg

SEQ ID NO: 17441 - DNA, 25 bp, Artificial Sequence
  Synthetic
tccttatgccagatataatttttgg

SEQ ID NO: 17442 - DNA, 25 bp, Artificial Sequence
  Synthetic
caactatatctactgactcatttgg

SEQ ID NO: 17443 - DNA, 20 bp, Artificial Sequence
  Synthetic
cgccaaaaggaagtaaagac

SEQ ID NO: 17444 - DNA, 21 bp, Artificial Sequence
  Synthetic
cgagtgacatcaaaatcatgg

SEQ ID NO: 17445 - DNA, 18 bp, Artificial Sequence
  Synthetic
gagagaaagtcggaaccc

SEQ ID NO: 17446 - DNA, 18 bp, Artificial Sequence
  Synthetic
gagtcagctggtgtggat

SEQ ID NO: 17447 - DNA, 22 bp, Artificial Sequence
  Synthetic
cgttttctgtacaaagaaacct

SEQ ID NO: 17448 - DNA, 19 bp, Artificial Sequence
  Synthetic
tttcaaccgaaaacggtac

SEQ ID NO: 17449 - DNA, 23 bp, Artificial Sequence
  Synthetic
acggtaaagtaacaactattcca

SEQ ID NO: 17450 - DNA, 18 bp, Artificial Sequence
  Synthetic
gacagggagacagctcag

SEQ ID NO: 17451 - DNA, 18 bp, Artificial Sequence
  Synthetic
gatggaggctcacagact

SEQ ID NO: 17452 - DNA, 20 bp, Artificial Sequence
  Synthetic
aatacagcacagttttcagg

SEQ ID NO: 17453 - DNA, 25 bp, Artificial Sequence
  Synthetic
cacacatatgtagtaaagtagatga

SEQ ID NO: 17454 - DNA, 24 bp, Artificial Sequence
  Synthetic
attatacagactttaatgacgagg

SEQ ID NO: 17455 - DNA, 18 bp, Artificial Sequence
  Synthetic
tattttgctgctacgcct

SEQ ID NO: 17456 - DNA, 22 bp, Artificial Sequence
  Synthetic
atgctgtgtggttaataaacac

SEQ ID NO: 17457 - DNA, 18 bp, Artificial Sequence
  Synthetic
ggctctgtccatgttagt

SEQ ID NO: 17458 - DNA, 22 bp, Artificial Sequence
  Synthetic
tggataatccagtctttgagga

SEQ ID NO: 17459 - DNA, 22 bp, Artificial Sequence
  Synthetic
cacatgatgtggttatacatgg

SEQ ID NO: 17460 - DNA, 18 bp, Artificial Sequence
  Synthetic
ctcacgtttgcttgctgt

SEQ ID NO: 17461 - DNA, 19 bp, Artificial Sequence
  Synthetic
acagggacacaataatggc

SEQ ID NO: 17462 - DNA, 25 bp, Artificial Sequence
  Synthetic
catactatgaactccactttacttg

SEQ ID NO: 17463 - DNA, 21 bp, Artificial Sequence
  Synthetic
actactactaaaaaacgctcg

SEQ ID NO: 17464 - DNA, 18 bp, Artificial Sequence
  Synthetic
ggttgtgtccctaggcat

SEQ ID NO: 17465 - DNA, 18 bp, Artificial Sequence
  Synthetic
gtaagacgcctcgcctta

SEQ ID NO: 17466 - DNA, 22 bp, Artificial Sequence
  Synthetic
atatcggtgcatatataagtgc

SEQ ID NO: 17467 - DNA, 18 bp, Artificial Sequence
  Synthetic
aagtgtgcaggacattgt

SEQ ID NO: 17468 - DNA, 18 bp, Artificial Sequence
  Synthetic
aaaattgtgtgccccaac

SEQ ID NO: 17469 - DNA, 22 bp, Artificial Sequence
  Synthetic
gtacccgaatggattaaaagac

SEQ ID NO: 17470 - DNA, 20 bp, Artificial Sequence
  Synthetic
agtcatttttggttatcgcc

SEQ ID NO: 17471 - DNA, 23 bp, Artificial Sequence
  Synthetic
aaagtgtttacgttttcaaatcc

SEQ ID NO: 17472 - DNA, 20 bp, Artificial Sequence
  Synthetic
acataaggcacgtgaaatgg

SEQ ID NO: 17473 - DNA, 22 bp, Artificial Sequence
  Synthetic
tacaaaacatgtaagcaaagtg

SEQ ID NO: 17474 - DNA, 25 bp, Artificial Sequence
  Synthetic
gattcttctatagtttcattagtgg

SEQ ID NO: 17475 - DNA, 20 bp, Artificial Sequence
  Synthetic
agaatttcagcacagtgact

SEQ ID NO: 17476 - DNA, 22 bp, Artificial Sequence
  Synthetic
tatgggtccgattttatattgc

SEQ ID NO: 17477 - DNA, 25 bp, Artificial Sequence
  Synthetic
gtcagtagattataaacaaacacag

SEQ ID NO: 17478 - DNA, 18 bp, Artificial Sequence
  Synthetic
gcagatccctatggcgat

SEQ ID NO: 17479 - DNA, 19 bp, Artificial Sequence
  Synthetic
taatagccactgtgtctcc

SEQ ID NO: 17480 - DNA, 22 bp, Artificial Sequence
  Synthetic
aaaagtgatcagatttgcattg

SEQ ID NO: 17481 - DNA, 19 bp, Artificial Sequence
  Synthetic
acgaattcatcaatgtgcc

SEQ ID NO: 17482 - DNA, 20 bp, Artificial Sequence
  Synthetic
acccaacaataaagaggagc

SEQ ID NO: 17483 - DNA, 21 bp, Artificial Sequence
  Synthetic
gaatgatgccatcaatttcga

SEQ ID NO: 17484 - DNA, 25 bp, Artificial Sequence
  Synthetic
gagagagagaagaagaaaaaagaga

SEQ ID NO: 17485 - DNA, 25 bp, Artificial Sequence
  Synthetic
aaggaggatagagaatttaaacaag

SEQ ID NO: 17486 - DNA, 18 bp, Artificial Sequence
  Synthetic
aacgtatgactacccgca

SEQ ID NO: 17487 - DNA, 22 bp, Artificial Sequence
  Synthetic
ctgagtgacatcaaaatcatgg

SEQ ID NO: 17488 - DNA, 23 bp, Artificial Sequence
  Synthetic
aataaatacctggaagaacatcc

SEQ ID NO: 17489 - DNA, 18 bp, Artificial Sequence
  Synthetic
ctccctaggaggtctgga

SEQ ID NO: 17490 - DNA, 18 bp, Artificial Sequence
  Synthetic
gagtcaactggtgtggat

SEQ ID NO: 17491 - DNA, 25 bp, Artificial Sequence
  Synthetic
ctattggagatgtaaagttagaact

SEQ ID NO: 17492 - DNA, 21 bp, Artificial Sequence
  Synthetic
aaagtactttagtcctagccc

SEQ ID NO: 17493 - DNA, 20 bp, Artificial Sequence
  Synthetic
aacattactgcaaccacatt

SEQ ID NO: 17494 - DNA, 25 bp, Artificial Sequence
  Synthetic
aataaaatatacccaaggtaaggtg

SEQ ID NO: 17495 - DNA, 24 bp, Artificial Sequence
  Synthetic
ctttttttagtaaactgtggaagc

SEQ ID NO: 17496 - DNA, 23 bp, Artificial Sequence
  Synthetic
tcgcatacatttaaaaaacaagg

SEQ ID NO: 17497 - DNA, 18 bp, Artificial Sequence
  Synthetic
ggggatccgagtctccta

SEQ ID NO: 17498 - DNA, 22 bp, Artificial Sequence
  Synthetic
acctcctacatctactcctaag

SEQ ID NO: 17499 - DNA, 18 bp, Artificial Sequence
  Synthetic
tggctcagttgaattgca

SEQ ID NO: 17500 - DNA, 19 bp, Artificial Sequence
  Synthetic
acatcctgttattcctggc

SEQ ID NO: 17501 - DNA, 18 bp, Artificial Sequence
  Synthetic
ggtgctaaggacgctaga

SEQ ID NO: 17502 - DNA, 23 bp, Artificial Sequence
  Synthetic
gtttgagggtaatggtaaaaagt

SEQ ID NO: 17503 - DNA, 25 bp, Artificial Sequence
  Synthetic
cttacagatatattgattctcttgc

SEQ ID NO: 17504 - DNA, 19 bp, Artificial Sequence
  Synthetic
tattgcttttggaggcacc

SEQ ID NO: 17505 - DNA, 24 bp, Artificial Sequence
  Synthetic
acctgttccacaagtactacaaca

SEQ ID NO: 17506 - DNA, 22 bp, Artificial Sequence
  Synthetic
tgctgcagctgtttcatgattt

SEQ ID NO: 17507 - DNA, 25 bp, Artificial Sequence
  Synthetic
gcagagtagcatcatctagaaaacc

SEQ ID NO: 17508 - DNA, 25 bp, Artificial Sequence
  Synthetic
tggcgagcataataatatagcacat

SEQ ID NO: 17509 - DNA, 19 bp, Artificial Sequence
  Synthetic
ggtggggaaacggagtcgc

SEQ ID NO: 17510 - DNA, 20 bp, Artificial Sequence
  Synthetic
ataccccagcaccgaccacc

SEQ ID NO: 17511 - DNA, 25 bp, Artificial Sequence
  Synthetic
tgagcctgattttgaaatgctacaa

SEQ ID NO: 17512 - DNA, 25 bp, Artificial Sequence
  Synthetic
ggacctcccaaagtctctaattcta

SEQ ID NO: 17513 - DNA, 20 bp, Artificial Sequence
  Synthetic
aatgcctcatctggagcagc

SEQ ID NO: 17514 - DNA, 23 bp, Artificial Sequence
  Synthetic
gggttaacaatagtgtgtggcac

SEQ ID NO: 17515 - DNA, 25 bp, Artificial Sequence
  Synthetic
ggatttcctgttaatccaatgccta

SEQ ID NO: 17516 - DNA, 25 bp, Artificial Sequence
  Synthetic
ggccatttaccttatttactggtga

SEQ ID NO: 17517 - DNA, 22 bp, Artificial Sequence
  Synthetic
ccagaatgcatattgtccccag

SEQ ID NO: 17518 - DNA, 25 bp, Artificial Sequence
  Synthetic
gtctgtaactaagtcctaaggatgc

SEQ ID NO: 17519 - DNA, 20 bp, Artificial Sequence
  Synthetic
aatgcctgcaataagcacgc

SEQ ID NO: 17520 - DNA, 24 bp, Artificial Sequence
  Synthetic
ggacaacaaagagaaagtccttcg

SEQ ID NO: 17521 - DNA, 24 bp, Artificial Sequence
  Synthetic
actttcgttttagggcagctattg

SEQ ID NO: 17522 - DNA, 25 bp, Artificial Sequence
  Synthetic
gcgccaagctttctaaagaaagatt

SEQ ID NO: 17523 - DNA, 20 bp, Artificial Sequence
  Synthetic
gcgtgtcttggaggtcgagg

SEQ ID NO: 17524 - DNA, 25 bp, Artificial Sequence
  Synthetic
ccaagtctagacagacctgttgttt

SEQ ID NO: 17525 - DNA, 25 bp, Artificial Sequence
  Synthetic
ctccaggatttactctactaggagt

SEQ ID NO: 17526 - DNA, 20 bp, Artificial Sequence
  Synthetic
acggttggatgtccactagc

SEQ ID NO: 17527 - DNA, 24 bp, Artificial Sequence
  Synthetic
ctctggtgtgtaatgtctccaaag

SEQ ID NO: 17528 - DNA, 20 bp, Artificial Sequence
  Synthetic
agcaaaatccagatcgggcg

SEQ ID NO: 17529 - DNA, 24 bp, Artificial Sequence
  Synthetic
tcgcctatgacttggatgaagtat

SEQ ID NO: 17530 - DNA, 24 bp, Artificial Sequence
  Synthetic
ccgaataggaaagtatgggtgacc

SEQ ID NO: 17531 - DNA, 22 bp, Artificial Sequence
  Synthetic
ggtctaaagatacgtcctggcg

SEQ ID NO: 17532 - DNA, 23 bp, Artificial Sequence
  Synthetic
ggtgttccaaagtacacatgtga

SEQ ID NO: 17533 - DNA, 22 bp, Artificial Sequence
  Synthetic
ggtcctggaggctgtacgacac

SEQ ID NO: 17534 - DNA, 20 bp, Artificial Sequence
  Synthetic
gactccgccaacgatctgcc

SEQ ID NO: 17535 - DNA, 22 bp, Artificial Sequence
  Synthetic
gcgcctaggacagggatgtacc

SEQ ID NO: 17536 - DNA, 22 bp, Artificial Sequence
  Synthetic
cactggttcccaacacctgcta

SEQ ID NO: 17537 - DNA, 19 bp, Artificial Sequence
  Synthetic
ccattgacaaggccggcgc

SEQ ID NO: 17538 - DNA, 22 bp, Artificial Sequence
  Synthetic
cctctcgggacagccactagaa

SEQ ID NO: 17539 - DNA, 22 bp, Artificial Sequence
  Synthetic
gacgtatcttgcacggaggacc

SEQ ID NO: 17540 - DNA, 21 bp, Artificial Sequence
  Synthetic
ggggacatgtccaccctgtct

SEQ ID NO: 17541 - DNA, 20 bp, Artificial Sequence
  Synthetic
gccgcgttgaggtggatcaa

SEQ ID NO: 17542 - DNA, 22 bp, Artificial Sequence
  Synthetic
cacgtttggagtgctgcttcac

SEQ ID NO: 17543 - DNA, 19 bp, Artificial Sequence
  Synthetic
aaatcccgtaggccgccgg

SEQ ID NO: 17544 - DNA, 19 bp, Artificial Sequence
  Synthetic
aacacctgcacctcgccgg

SEQ ID NO: 17545 - DNA, 20 bp, Artificial Sequence
  Synthetic
acaagacaggccctcccgag

SEQ ID NO: 17546 - DNA, 22 bp, Artificial Sequence
  Synthetic
cggtgcgcacacttggatcaat

SEQ ID NO: 17547 - DNA, 21 bp, Artificial Sequence
  Synthetic
cccccttgatgtgttgcaggg

SEQ ID NO: 17548 - DNA, 22 bp, Artificial Sequence
  Synthetic
gcgagacagaatcttgcgggac

SEQ ID NO: 17549 - DNA, 20 bp, Artificial Sequence
  Synthetic
aaacctctctgtcgggggcc

SEQ ID NO: 17550 - DNA, 21 bp, Artificial Sequence
  Synthetic
gggggctagtaactgaggcgg

SEQ ID NO: 17551 - DNA, 22 bp, Artificial Sequence
  Synthetic
cggcacaaacaactcccacaac

SEQ ID NO: 17552 - DNA, 22 bp, Artificial Sequence
  Synthetic
tccctggaaggctgggaagtac

SEQ ID NO: 17553 - DNA, 20 bp, Artificial Sequence
  Synthetic
acacgggcacttgaggtcct

SEQ ID NO: 17554 - DNA, 19 bp, Artificial Sequence
  Synthetic
acaggaggggtctgcgcag

SEQ ID NO: 17555 - DNA, 22 bp, Artificial Sequence
  Synthetic
tgggcgcaagagatctgacttc

SEQ ID NO: 17556 - DNA, 22 bp, Artificial Sequence
  Synthetic
gctctcagtgcggatgtcttgt

SEQ ID NO: 17557 - DNA, 19 bp, Artificial Sequence
  Synthetic
gtcatcgccgcagaccagg

SEQ ID NO: 17558 - DNA, 22 bp, Artificial Sequence
  Synthetic
cgcctgcaagtggagtgagttt

SEQ ID NO: 17559 - DNA, 25 bp, Artificial Sequence
  Synthetic
gctgattttcctcctgttattgctg

SEQ ID NO: 17560 - DNA, 22 bp, Artificial Sequence
  Synthetic
agtctccagctgctttcatttg

SEQ ID NO: 17561 - DNA, 24 bp, Artificial Sequence
  Synthetic
gtgtctattgtgtagcctgttccc

SEQ ID NO: 17562 - DNA, 20 bp, Artificial Sequence
  Synthetic
catggcattctgtgaccctg

SEQ ID NO: 17563 - DNA, 21 bp, Artificial Sequence
  Synthetic
cgtttccacctacgggtaaac

SEQ ID NO: 17564 - DNA, 25 bp, Artificial Sequence
  Synthetic
cccatcccattgttgatcatattgt

SEQ ID NO: 17565 - DNA, 25 bp, Artificial Sequence
  Synthetic
ttctggaatatgcaggtttctcaaa

SEQ ID NO: 17566 - DNA, 22 bp, Artificial Sequence
  Synthetic
aaggttgcaacacttagcgtag

SEQ ID NO: 17567 - DNA, 20 bp, Artificial Sequence
  Synthetic
gcatatctggtcccccctca

SEQ ID NO: 17568 - DNA, 25 bp, Artificial Sequence
  Synthetic
actgtatctcgggttttctttctcc

SEQ ID NO: 17569 - DNA, 23 bp, Artificial Sequence
  Synthetic
cgcttgtattgttgtacgatcct

SEQ ID NO: 17570 - DNA, 24 bp, Artificial Sequence
  Synthetic
atccctgaactacctcttttcgat

SEQ ID NO: 17571 - DNA, 24 bp, Artificial Sequence
  Synthetic
tgccatcctccttctataaaacca

SEQ ID NO: 17572 - DNA, 22 bp, Artificial Sequence
  Synthetic
tttgtggtgtggtgtcattgtg

SEQ ID NO: 17573 - DNA, 23 bp, Artificial Sequence
  Synthetic
aacttgactttgctaagagccat

SEQ ID NO: 17574 - DNA, 25 bp, Artificial Sequence
  Synthetic
tgggtagtaagcctttataacgttt

SEQ ID NO: 17575 - DNA, 20 bp, Artificial Sequence
  Synthetic
cccattatgcctaggccagc

SEQ ID NO: 17576 - DNA, 24 bp, Artificial Sequence
  Synthetic
aaccatggcatctcttataccatc

SEQ ID NO: 17577 - DNA, 25 bp, Artificial Sequence
  Synthetic
gtttgtttgttggtcttctgttggt

SEQ ID NO: 17578 - DNA, 25 bp, Artificial Sequence
  Synthetic
tgggtgtggatatttgtttcactag

SEQ ID NO: 17579 - DNA, 25 bp, Artificial Sequence
  Synthetic
cctgagtaagggatgatttttgcat

SEQ ID NO: 17580 - DNA, 25 bp, Artificial Sequence
  Synthetic
ctgatgaacaatgacttgggatgat

SEQ ID NO: 17581 - DNA, 21 bp, Artificial Sequence
  Synthetic
tgattgagagtgtcccaggtc

SEQ ID NO: 17582 - DNA, 25 bp, Artificial Sequence
  Synthetic
gcaaggtacaaagttgaacacttca

SEQ ID NO: 17583 - DNA, 23 bp, Artificial Sequence
  Synthetic
ttcccttttgacttgtgtgttct

SEQ ID NO: 17584 - DNA, 24 bp, Artificial Sequence
  Synthetic
gcatttgttttgaggattggcaac

SEQ ID NO: 17585 - DNA, 25 bp, Artificial Sequence
  Synthetic
actccatttgataagctgactacag

SEQ ID NO: 17586 - DNA, 23 bp, Artificial Sequence
  Synthetic
actgatcctgcattgtcacagta

SEQ ID NO: 17587 - DNA, 23 bp, Artificial Sequence
  Synthetic
accactcagttgatccttgctta

SEQ ID NO: 17588 - DNA, 20 bp, Artificial Sequence
  Synthetic
cactccaactacaccgaggg

SEQ ID NO: 17589 - DNA, 23 bp, Artificial Sequence
  Synthetic
ctgagttctctttctttgcctgt

SEQ ID NO: 17590 - DNA, 24 bp, Artificial Sequence
  Synthetic
tctgtagtggtatagtgttgtgca

SEQ ID NO: 17591 - DNA, 25 bp, Artificial Sequence
  Synthetic
ggcgatgcaaatagttaacacttaa

SEQ ID NO: 17592 - DNA, 22 bp, Artificial Sequence
  Synthetic
ggaggctgcacgacactcatac

SEQ ID NO: 17593 - DNA, 19 bp, Artificial Sequence
  Synthetic
acgatctgaccgccacccg

SEQ ID NO: 17594 - DNA, 19 bp, Artificial Sequence
  Synthetic
tggcagcgcctccaagagg

SEQ ID NO: 17595 - DNA, 19 bp, Artificial Sequence
  Synthetic
tcgaggcgttaccctcgcg

SEQ ID NO: 17596 - DNA, 20 bp, Artificial Sequence
  Synthetic
ttgtgggatccggagcagct

SEQ ID NO: 17597 - DNA, 21 bp, Artificial Sequence
  Synthetic
tgggcaaaatcggtaaggcgt

SEQ ID NO: 17598 - DNA, 22 bp, Artificial Sequence
  Synthetic
tccgcacactttggtgaatcca

SEQ ID NO: 17599 - DNA, 22 bp, Artificial Sequence
  Synthetic
cggacctgtccctgtcttccag

SEQ ID NO: 17600 - DNA, 19 bp, Artificial Sequence
  Synthetic
acaagaccgtgcgtcccgg

SEQ ID NO: 17601 - DNA, 21 bp, Artificial Sequence
  Synthetic
ggtccgaagatggccaggagt

SEQ ID NO: 17602 - DNA, 22 bp, Artificial Sequence
  Synthetic
cgggagaagacgactggttcca

SEQ ID NO: 17603 - DNA, 22 bp, Artificial Sequence
  Synthetic
cccgtggtagacagtccagcat

SEQ ID NO: 17604 - DNA, 22 bp, Artificial Sequence
  Synthetic
aaagtccaccgctttagccact

SEQ ID NO: 17605 - DNA, 22 bp, Artificial Sequence
  Synthetic
aggaacttgccgtaggtggagt

SEQ ID NO: 17606 - DNA, 21 bp, Artificial Sequence
  Synthetic
cgagctcgtcgcacttcttct

SEQ ID NO: 17607 - DNA, 22 bp, Artificial Sequence
  Synthetic
ggacgagtcgaacatgccggag

SEQ ID NO: 17608 - DNA, 19 bp, Artificial Sequence
  Synthetic
gggtgttggcccatggagg

SEQ ID NO: 17609 - DNA, 21 bp, Artificial Sequence
  Synthetic
tgcttgaactgctcagcgagc

SEQ ID NO: 17610 - DNA, 19 bp, Artificial Sequence
  Synthetic
aaggcagtagcggcaccgg

SEQ ID NO: 17611 - DNA, 18 bp, Artificial Sequence
  Synthetic
tgcatcgctctccggcac

SEQ ID NO: 17612 - DNA, 22 bp, Artificial Sequence
  Synthetic
gtcctaggaccgacgatcctca

SEQ ID NO: 17613 - DNA, 22 bp, Artificial Sequence
  Synthetic
cgggtactcgtggagtcctact

SEQ ID NO: 17614 - DNA, 22 bp, Artificial Sequence
  Synthetic
agcggatcgaaggagtccagaa

SEQ ID NO: 17615 - DNA, 20 bp, Artificial Sequence
  Synthetic
gccggaagttgaggagctgc

SEQ ID NO: 17616 - DNA, 22 bp, Artificial Sequence
  Synthetic
ctttggcaagcactgcgtgaag

SEQ ID NO: 17617 - DNA, 21 bp, Artificial Sequence
  Synthetic
acacgatgagacgagctggct

SEQ ID NO: 17618 - DNA, 22 bp, Artificial Sequence
  Synthetic
gcccccaacataaagcctctca

SEQ ID NO: 17619 - DNA, 22 bp, Artificial Sequence
  Synthetic
ggggttgtagggtcacgggtaa

SEQ ID NO: 17620 - DNA, 22 bp, Artificial Sequence
  Synthetic
tgcggccaccctattgatttca

SEQ ID NO: 17621 - DNA, 25 bp, Artificial Sequence
  Synthetic
cccatattctttcattgccttttcc

SEQ ID NO: 17622 - DNA, 25 bp, Artificial Sequence
  Synthetic
ggagaaatttaggcttctcaactcc

SEQ ID NO: 17623 - DNA, 25 bp, Artificial Sequence
  Synthetic
tgtctttggaattttctcctcgttt

SEQ ID NO: 17624 - DNA, 22 bp, Artificial Sequence
  Synthetic
cttgcaatgtgctcaattggag

SEQ ID NO: 17625 - DNA, 25 bp, Artificial Sequence
  Synthetic
tcggatcagtaagagagaattccat

SEQ ID NO: 17626 - DNA, 25 bp, Artificial Sequence
  Synthetic
gtctttttctttgacagaagactcg

SEQ ID NO: 17627 - DNA, 20 bp, Artificial Sequence
  Synthetic
gagggccttccactttctgc

SEQ ID NO: 17628 - DNA, 25 bp, Artificial Sequence
  Synthetic
ccaagcgaatctctgtagagtttta

SEQ ID NO: 17629 - DNA, 21 bp, Artificial Sequence
  Synthetic
ggggttcagtagcagacattg

SEQ ID NO: 17630 - DNA, 23 bp, Artificial Sequence
  Synthetic
caggtcaaacggttctggtttta

SEQ ID NO: 17631 - DNA, 25 bp, Artificial Sequence
  Synthetic
gcttccacaaaaaaccatccattac

SEQ ID NO: 17632 - DNA, 22 bp, Artificial Sequence
  Synthetic
ccgggggcttaggtccttttct

SEQ ID NO: 17633 - DNA, 23 bp, Artificial Sequence
  Synthetic
aggattgccatctaatgcattgc

SEQ ID NO: 17634 - DNA, 22 bp, Artificial Sequence
  Synthetic
gtgttgctagggtctccattct

SEQ ID NO: 17635 - DNA, 23 bp, Artificial Sequence
  Synthetic
gttcggtgctgtatactgtcttt

SEQ ID NO: 17636 - DNA, 25 bp, Artificial Sequence
  Synthetic
ccacataatacactttgtgttctgc

SEQ ID NO: 17637 - DNA, 25 bp, Artificial Sequence
  Synthetic
gggttaccctcatatacaggattgt

SEQ ID NO: 17638 - DNA, 20 bp, Artificial Sequence
  Synthetic
aggacgtgcgggaacaaatg

SEQ ID NO: 17639 - DNA, 22 bp, Artificial Sequence
  Synthetic
gaggtagctacatcaaggggta

SEQ ID NO: 17640 - DNA, 24 bp, Artificial Sequence
  Synthetic
cccgttgtaaccagtatggcttat

SEQ ID NO: 17641 - DNA, 25 bp, Artificial Sequence
  Synthetic
gggttataccaaagttccagtcctc

SEQ ID NO: 17642 - DNA, 19 bp, Artificial Sequence
  Synthetic
tcaggaggcaccacaggcg

SEQ ID NO: 17643 - DNA, 22 bp, Artificial Sequence
  Synthetic
acgagcccccaactgtgtacta

SEQ ID NO: 17644 - DNA, 22 bp, Artificial Sequence
  Synthetic
ctgggcttgggtttggatgagt

SEQ ID NO: 17645 - DNA, 20 bp, Artificial Sequence
  Synthetic
tggcagtggggtcaaactgc

SEQ ID NO: 17646 - DNA, 20 bp, Artificial Sequence
  Synthetic
gtctttggcactccctggca

SEQ ID NO: 17647 - DNA, 20 bp, Artificial Sequence
  Synthetic
ggctgatttggggggggttt

SEQ ID NO: 17648 - DNA, 22 bp, Artificial Sequence
  Synthetic
ggcaagattacaggcggccttt

SEQ ID NO: 17649 - DNA, 21 bp, Artificial Sequence
  Synthetic
tcgccaggttccattggcttt

SEQ ID NO: 17650 - DNA, 22 bp, Artificial Sequence
  Synthetic
gcatttcgaacagggtgggact

SEQ ID NO: 17651 - DNA, 22 bp, Artificial Sequence
  Synthetic
gctggcgtaaggtaggagttcc

SEQ ID NO: 17652 - DNA, 20 bp, Artificial Sequence
  Synthetic
tggggtaggggggcatgtag

SEQ ID NO: 17653 - DNA, 22 bp, Artificial Sequence
  Synthetic
gcgaacgtggtgcaaatagacg

SEQ ID NO: 17654 - DNA, 25 bp, Artificial Sequence
  Synthetic
acacatattgaggaagtcttgggaa

SEQ ID NO: 17655 - DNA, 21 bp, Artificial Sequence
  Synthetic
gcgcttaccgggatgagagca

SEQ ID NO: 17656 - DNA, 22 bp, Artificial Sequence
  Synthetic
gggcaggattgcagggtttaga

SEQ ID NO: 17657 - DNA, 20 bp, Artificial Sequence
  Synthetic
taggggcaggtccatgattg

SEQ ID NO: 17658 - DNA, 19 bp, Artificial Sequence
  Synthetic
gcgggatcctagcgtggga

SEQ ID NO: 17659 - DNA, 20 bp, Artificial Sequence
  Synthetic
ggctggaggcgatgtggttg

SEQ ID NO: 17660 - DNA, 22 bp, Artificial Sequence
  Synthetic
agagcgggagaaagaggaggaa

SEQ ID NO: 17661 - DNA, 20 bp, Artificial Sequence
  Synthetic
tttgcctgttccatgcccgg

SEQ ID NO: 17662 - DNA, 22 bp, Artificial Sequence
  Synthetic
ggaggggagtcgagggataagg

SEQ ID NO: 17663 - DNA, 23 bp, Artificial Sequence
  Synthetic
tgtagtactaaagatggctggcc

SEQ ID NO: 17664 - DNA, 20 bp, Artificial Sequence
  Synthetic
acgtcagggcctagcctgag

SEQ ID NO: 17665 - DNA, 21 bp, Artificial Sequence
  Synthetic
ggatggcggcctcaggtaagg

SEQ ID NO: 17666 - DNA, 21 bp, Artificial Sequence
  Synthetic
gccatatggtccactgtggtt

SEQ ID NO: 17667 - DNA, 25 bp, Artificial Sequence
  Synthetic
ttgtcattggtccatttctattcca

SEQ ID NO: 17668 - DNA, 25 bp, Artificial Sequence
  Synthetic
aggagaaattttgcaatcttggagt

SEQ ID NO: 17669 - DNA, 23 bp, Artificial Sequence
  Synthetic
ctagtggatctgctgatactgct

SEQ ID NO: 17670 - DNA, 25 bp, Artificial Sequence
  Synthetic
gcacccttattttcaatgtttggag

SEQ ID NO: 17671 - DNA, 25 bp, Artificial Sequence
  Synthetic
gcacttttgcatctttctgaaaatg

SEQ ID NO: 17672 - DNA, 22 bp, Artificial Sequence
  Synthetic
gtttcactgacctcctcaggag

SEQ ID NO: 17673 - DNA, 25 bp, Artificial Sequence
  Synthetic
ccctcatttgttggaatagagtcct

SEQ ID NO: 17674 - DNA, 20 bp, Artificial Sequence
  Synthetic
tccggatgtgccttcatctg

SEQ ID NO: 17675 - DNA, 20 bp, Artificial Sequence
  Synthetic
caaagagggcctgccacttt

SEQ ID NO: 17676 - DNA, 22 bp, Artificial Sequence
  Synthetic
tccattcaagtcctccgatgag

SEQ ID NO: 17677 - DNA, 22 bp, Artificial Sequence
  Synthetic
tccatggctgtatggaggatct

SEQ ID NO: 17678 - DNA, 25 bp, Artificial Sequence
  Synthetic
acttccattgtttcaaggcatgaat

SEQ ID NO: 17679 - DNA, 25 bp, Artificial Sequence
  Synthetic
agcctctcttattcagtctttgttt

SEQ ID NO: 17680 - DNA, 23 bp, Artificial Sequence
  Synthetic
tctcacaacatttgccagtttgg

SEQ ID NO: 17681 - DNA, 25 bp, Artificial Sequence
  Synthetic
gctggtatttgtgttcgaatcttca

SEQ ID NO: 17682 - DNA, 22 bp, Artificial Sequence
  Synthetic
agcaaaatcgtcggatgattgg

SEQ ID NO: 17683 - DNA, 25 bp, Artificial Sequence
  Synthetic
ccaaggtcattgtttatcatgttgt

SEQ ID NO: 17684 - DNA, 22 bp, Artificial Sequence
  Synthetic
cgccaacagtaaggtgacgaca

SEQ ID NO: 17685 - DNA, 21 bp, Artificial Sequence
  Synthetic
gcctcgagcttgggcttctcc

SEQ ID NO: 17686 - DNA, 22 bp, Artificial Sequence
  Synthetic
agtttcggggattgtgaaccgt

SEQ ID NO: 17687 - DNA, 18 bp, Artificial Sequence
  Synthetic
agcagcgtggcggcgaaa

SEQ ID NO: 17688 - DNA, 21 bp, Artificial Sequence
  Synthetic
gcagtaccactaccgccaccc

SEQ ID NO: 17689 - DNA, 23 bp, Artificial Sequence
  Synthetic
aatgttgcgttgttggagagtat

SEQ ID NO: 17690 - DNA, 20 bp, Artificial Sequence
  Synthetic
caagaagcgaccgcagtggg

SEQ ID NO: 17691 - DNA, 20 bp, Artificial Sequence
  Synthetic
gcgtgctgcatagcttggcg

SEQ ID NO: 17692 - DNA, 22 bp, Artificial Sequence
  Synthetic
cggtgctttctgcagtgtgtgg

SEQ ID NO: 17693 - DNA, 21 bp, Artificial Sequence
  Synthetic
cgaaacgagaggctcagccgc

SEQ ID NO: 17694 - DNA, 20 bp, Artificial Sequence
  Synthetic
tccacaggtaccgcgtctgt

SEQ ID NO: 17695 - DNA, 18 bp, Artificial Sequence
  Synthetic
ccggcggctgcagttgtt

SEQ ID NO: 17696 - DNA, 22 bp, Artificial Sequence
  Synthetic
cgcctcgttttcctcttcggtg

SEQ ID NO: 17697 - DNA, 22 bp, Artificial Sequence
  Synthetic
gcgcctctctcatggatccact

SEQ ID NO: 17698 - DNA, 19 bp, Artificial Sequence
  Synthetic
tgacgtacccgccgggaac

SEQ ID NO: 17699 - DNA, 18 bp, Artificial Sequence
  Synthetic
tggagtttgcgcgcgtcg

SEQ ID NO: 17700 - DNA, 19 bp, Artificial Sequence
  Synthetic
accccgtgcaacgtcgaga

SEQ ID NO: 17701 - DNA, 21 bp, Artificial Sequence
  Synthetic
gcagctatgctcgatgaccga

SEQ ID NO: 17702 - DNA, 20 bp, Artificial Sequence
  Synthetic
gccgtcaacagcgtgccttt

SEQ ID NO: 17703 - DNA, 21 bp, Artificial Sequence
  Synthetic
gccgacttggaggactttgcc

SEQ ID NO: 17704 - DNA, 19 bp, Artificial Sequence
  Synthetic
gccgtagttgtcgcggtcc

SEQ ID NO: 17705 - DNA, 21 bp, Artificial Sequence
  Synthetic
cgactgccgcatggtttcctc

SEQ ID NO: 17706 - DNA, 21 bp, Artificial Sequence
  Synthetic
cgctcgtcagcaggtagaagg

SEQ ID NO: 17707 - DNA, 20 bp, Artificial Sequence
  Synthetic
cccttgaacatcccgcagca

SEQ ID NO: 17708 - DNA, 19 bp, Artificial Sequence
  Synthetic
gcgcggtcattctggccaa

SEQ ID NO: 17709 - DNA, 18 bp, Artificial Sequence
  Synthetic
gctcgcagtagtggcgca

SEQ ID NO: 17710 - DNA, 20 bp, Artificial Sequence
  Synthetic
agtgcgtatacggggctggg

SEQ ID NO: 17711 - DNA, 20 bp, Artificial Sequence
  Synthetic
aagcagccgcgtcttaagcg

SEQ ID NO: 17712 - DNA, 20 bp, Artificial Sequence
  Synthetic
ctacgcacctgtggccgcag

SEQ ID NO: 17713 - DNA, 19 bp, Artificial Sequence
  Synthetic
taccagcggcccatggtgc

SEQ ID NO: 17714 - DNA, 20 bp, Artificial Sequence
  Synthetic
ccgcgcacttttgccaagtc

SEQ ID NO: 17715 - DNA, 19 bp, Artificial Sequence
  Synthetic
tggcgcagttctggcacgg

SEQ ID NO: 17716 - DNA, 20 bp, Artificial Sequence
  Synthetic
agacgcgcgtactcggaaac

SEQ ID NO: 17717 - DNA, 22 bp, Artificial Sequence
  Synthetic
ccagacctccagcaacaccgtc

SEQ ID NO: 17718 - DNA, 19 bp, Artificial Sequence
  Synthetic
acggtttccacgccaccgc

SEQ ID NO: 17719 - DNA, 19 bp, Artificial Sequence
  Synthetic
ctgcgcgaagaactgggct

SEQ ID NO: 17720 - DNA, 20 bp, Artificial Sequence
  Synthetic
cgtggttggagcagcaccag

SEQ ID NO: 17721 - DNA, 19 bp, Artificial Sequence
  Synthetic
ttctggcggtgggtcccga

SEQ ID NO: 17722 - DNA, 20 bp, Artificial Sequence
  Synthetic
ggcgtccgaatggtgggtag

SEQ ID NO: 17723 - DNA, 21 bp, Artificial Sequence
  Synthetic
acgcggccattttgtgtttgg

SEQ ID NO: 17724 - DNA, 20 bp, Artificial Sequence
  Synthetic
tgtcaaccgtcgcatcacgc

SEQ ID NO: 17725 - DNA, 22 bp, Artificial Sequence
  Synthetic
cgttgtggtagaacggcaaccg

SEQ ID NO: 17726 - DNA, 21 bp, Artificial Sequence
  Synthetic
cgcagattctcggccaacagc

SEQ ID NO: 17727 - DNA, 20 bp, Artificial Sequence
  Synthetic
gcacccaggacctccggtac

SEQ ID NO: 17728 - DNA, 22 bp, Artificial Sequence
  Synthetic
ccgcagaaagtcgaagatgccc

SEQ ID NO: 17729 - DNA, 22 bp, Artificial Sequence
  Synthetic
gtgagcaccatcagcacctgat

SEQ ID NO: 17730 - DNA, 21 bp, Artificial Sequence
  Synthetic
ggctgcagcgctttcagaatt

SEQ ID NO: 17731 - DNA, 19 bp, Artificial Sequence
  Synthetic
ttcgggtagctgcaggccg

SEQ ID NO: 17732 - DNA, 21 bp, Artificial Sequence
  Synthetic
cggttgggcgcgttgatctag

SEQ ID NO: 17733 - DNA, 21 bp, Artificial Sequence
  Synthetic
cagtccgccgctcattttgtg

SEQ ID NO: 17734 - DNA, 19 bp, Artificial Sequence
  Synthetic
tgatgcgggtgcgtagggt

SEQ ID NO: 17735 - DNA, 19 bp, Artificial Sequence
  Synthetic
gaaagcgaagacggcgccc

SEQ ID NO: 17736 - DNA, 22 bp, Artificial Sequence
  Synthetic
gtcatggccaatcgtcgtctcc

SEQ ID NO: 17737 - DNA, 19 bp, Artificial Sequence
  Synthetic
ggacccgaaaacgagggcg

SEQ ID NO: 17738 - DNA, 22 bp, Artificial Sequence
  Synthetic
cgtgcaggatgacgtggattct

SEQ ID NO: 17739 - DNA, 21 bp, Artificial Sequence
  Synthetic
ggtgagagtagtggtggggct

SEQ ID NO: 17740 - DNA, 19 bp, Artificial Sequence
  Synthetic
gagaggaggagagccggca

SEQ ID NO: 17741 - DNA, 19 bp, Artificial Sequence
  Synthetic
cggcgtcggcgtttccaac

SEQ ID NO: 17742 - DNA, 20 bp, Artificial Sequence
  Synthetic
catctctaccgccgccgtgc

SEQ ID NO: 17743 - DNA, 21 bp, Artificial Sequence
  Synthetic
tgcgacgaacacgaagctctc

SEQ ID NO: 17744 - DNA, 20 bp, Artificial Sequence
  Synthetic
caccgacacagcagcaccag

SEQ ID NO: 17745 - DNA, 22 bp, Artificial Sequence
  Synthetic
gcgtccgacgatgtgctcttct

SEQ ID NO: 17746 - DNA, 22 bp, Artificial Sequence
  Synthetic
cgtcttttcggcgctcaacaag

SEQ ID NO: 17747 - DNA, 19 bp, Artificial Sequence
  Synthetic
acgcccgccagaagtacgc

SEQ ID NO: 17748 - DNA, 19 bp, Artificial Sequence
  Synthetic
tctgttggcggggctcacg

SEQ ID NO: 17749 - DNA, 20 bp, Artificial Sequence
  Synthetic
agaggctacccgaccgtagc

SEQ ID NO: 17750 - DNA, 20 bp, Artificial Sequence
  Synthetic
gacggtcgtggtctcctcgg

SEQ ID NO: 17751 - DNA, 21 bp, Artificial Sequence
  Synthetic
acagtacgacggcaacccaac

SEQ ID NO: 17752 - DNA, 21 bp, Artificial Sequence
  Synthetic
catcctgctgtcacacgacga

SEQ ID NO: 17753 - DNA, 18 bp, Artificial Sequence
  Synthetic
aagcgcgtgcccacccaa

SEQ ID NO: 17754 - DNA, 22 bp, Artificial Sequence
  Synthetic
acctggcatcgcagcctctttc

SEQ ID NO: 17755 - DNA, 19 bp, Artificial Sequence
  Synthetic
tggcttacgacgctgacgc

SEQ ID NO: 17756 - DNA, 22 bp, Artificial Sequence
  Synthetic
ggtcgaacctcataacggtggg

SEQ ID NO: 17757 - DNA, 22 bp, Artificial Sequence
  Synthetic
cttgcgcttaccgatccgctta

SEQ ID NO: 17758 - DNA, 19 bp, Artificial Sequence
  Synthetic
gctcactcaacaccgccgt

SEQ ID NO: 17759 - DNA, 22 bp, Artificial Sequence
  Synthetic
acgtgacgatcaaaagtgcccg

SEQ ID NO: 17760 - DNA, 19 bp, Artificial Sequence
  Synthetic
acgatgatggcccgcgacg

SEQ ID NO: 17761 - DNA, 22 bp, Artificial Sequence
  Synthetic
gcaaccagtgctccactacgtc

SEQ ID NO: 17762 - DNA, 19 bp, Artificial Sequence
  Synthetic
acatggacgccgcctctgc

SEQ ID NO: 17763 - DNA, 18 bp, Artificial Sequence
  Synthetic
atgcaaagacggcgcggg

SEQ ID NO: 17764 - DNA, 18 bp, Artificial Sequence
  Synthetic
tgttgtgtccgccgctgc

SEQ ID NO: 17765 - DNA, 20 bp, Artificial Sequence
  Synthetic
cccgggcactgatcctgacc

SEQ ID NO: 17766 - DNA, 20 bp, Artificial Sequence
  Synthetic
cacgctgaccggcgatcagg

SEQ ID NO: 17767 - DNA, 19 bp, Artificial Sequence
  Synthetic
ttggcccacgacgcctgac

SEQ ID NO: 17768 - DNA, 20 bp, Artificial Sequence
  Synthetic
gcgactcctggacctgcgta

SEQ ID NO: 17769 - DNA, 19 bp, Artificial Sequence
  Synthetic
agatgtggcaggcgcgtct

SEQ ID NO: 17770 - DNA, 19 bp, Artificial Sequence
  Synthetic
acaaccccacgggccgaag

SEQ ID NO: 17771 - DNA, 18 bp, Artificial Sequence
  Synthetic
tctcggtgctgggcgctt

SEQ ID NO: 17772 - DNA, 19 bp, Artificial Sequence
  Synthetic
agggactggaggtgcgcgt

SEQ ID NO: 17773 - DNA, 19 bp, Artificial Sequence
  Synthetic
cgctgtgctggcatcgagt

SEQ ID NO: 17774 - DNA, 22 bp, Artificial Sequence
  Synthetic
ccatgacctacgtgcgcaagtt

SEQ ID NO: 17775 - DNA, 20 bp, Artificial Sequence
  Synthetic
tcgctcgaccgttcgtacga

SEQ ID NO: 17776 - DNA, 22 bp, Artificial Sequence
  Synthetic
gcggtctccacgtcaggtacga

SEQ ID NO: 17777 - DNA, 18 bp, Artificial Sequence
  Synthetic
aacgcgctgcacgaccac

SEQ ID NO: 17778 - DNA, 20 bp, Artificial Sequence
  Synthetic
cggaacccgccatgcaacga

SEQ ID NO: 17779 - DNA, 22 bp, Artificial Sequence
  Synthetic
cgctcgagctcctgcctaaagt

SEQ ID NO: 17780 - DNA, 22 bp, Artificial Sequence
  Synthetic
tcccagtaacagacgacccagt

SEQ ID NO: 17781 - DNA, 22 bp, Artificial Sequence
  Synthetic
gccacgtggttttcgagaacgt

SEQ ID NO: 17782 - DNA, 19 bp, Artificial Sequence
  Synthetic
gggagcgcggtggaagaca

SEQ ID NO: 17783 - DNA, 19 bp, Artificial Sequence
  Synthetic
tctcccccgattccagcgt

SEQ ID NO: 17784 - DNA, 18 bp, Artificial Sequence
  Synthetic
cgctcatccgcgtgctct

SEQ ID NO: 17785 - DNA, 20 bp, Artificial Sequence
  Synthetic
cacggcgtgtccttgctacc

SEQ ID NO: 17786 - DNA, 19 bp, Artificial Sequence
  Synthetic
ttcacgtccgggtggctgc

SEQ ID NO: 17787 - DNA, 22 bp, Artificial Sequence
  Synthetic
ggcgctgatgatgttgacgtcg

SEQ ID NO: 17788 - DNA, 21 bp, Artificial Sequence
  Synthetic
agatgatgcaccccgaactcg

SEQ ID NO: 17789 - DNA, 19 bp, Artificial Sequence
  Synthetic
gcctaacctccgctcgcac

SEQ ID NO: 17790 - DNA, 22 bp, Artificial Sequence
  Synthetic
gcggaggaagattcgtctgagc

SEQ ID NO: 17791 - DNA, 19 bp, Artificial Sequence
  Synthetic
ggccgacgctggttctcct

SEQ ID NO: 17792 - DNA, 21 bp, Artificial Sequence
  Synthetic
ggtcgcagatgagcagcttct

SEQ ID NO: 17793 - DNA, 19 bp, Artificial Sequence
  Synthetic
ttctccaacgcgcggcagg

SEQ ID NO: 17794 - DNA, 22 bp, Artificial Sequence
  Synthetic
cgtccaggttactcggggaaca

SEQ ID NO: 17795 - DNA, 19 bp, Artificial Sequence
  Synthetic
tcgtcctccccttcgtccg

SEQ ID NO: 17796 - DNA, 22 bp, Artificial Sequence
  Synthetic
accactagcttggctacgtgga

SEQ ID NO: 17797 - DNA, 20 bp, Artificial Sequence
  Synthetic
tcgtcgcgctccagcacata

SEQ ID NO: 17798 - DNA, 21 bp, Artificial Sequence
  Synthetic
cgcgctctcttgaacacgaca

SEQ ID NO: 17799 - DNA, 21 bp, Artificial Sequence
  Synthetic
cggatctgcggctcaaacacc

SEQ ID NO: 17800 - DNA, 20 bp, Artificial Sequence
  Synthetic
gactttacggtgcgcggcga

SEQ ID NO: 17801 - DNA, 22 bp, Artificial Sequence
  Synthetic
tctgccgccaccaaaagatctg

SEQ ID NO: 17802 - DNA, 18 bp, Artificial Sequence
  Synthetic
tttccctaccgcgcgctg

SEQ ID NO: 17803 - DNA, 20 bp, Artificial Sequence
  Synthetic
tccacgatgtcggcgatgac

SEQ ID NO: 17804 - DNA, 21 bp, Artificial Sequence
  Synthetic
cccccagggcgttgtaaaagt

SEQ ID NO: 17805 - DNA, 20 bp, Artificial Sequence
  Synthetic
ggggatgtcgtgggtctcct

SEQ ID NO: 17806 - DNA, 22 bp, Artificial Sequence
  Synthetic
gcgcttgagaaaaatgtcgcgg

SEQ ID NO: 17807 - DNA, 20 bp, Artificial Sequence
  Synthetic
agccctcgagcgtgtacgtc

SEQ ID NO: 17808 - DNA, 19 bp, Artificial Sequence
  Synthetic
tgcagactcttgccctgcg

SEQ ID NO: 17809 - DNA, 21 bp, Artificial Sequence
  Synthetic
acagcctggatctcaccgtca

SEQ ID NO: 17810 - DNA, 20 bp, Artificial Sequence
  Synthetic
cgctggatgacggtgatgcg

SEQ ID NO: 17811 - DNA, 22 bp, Artificial Sequence
  Synthetic
actgctgtggtgttgccttctg

SEQ ID NO: 17812 - DNA, 22 bp, Artificial Sequence
  Synthetic
gccacgacaaacactaccgtcg

SEQ ID NO: 17813 - DNA, 19 bp, Artificial Sequence
  Synthetic
tgcatccgtccggtggtgc

SEQ ID NO: 17814 - DNA, 19 bp, Artificial Sequence
  Synthetic
ttccgtgctggcgatcgcg

SEQ ID NO: 17815 - DNA, 22 bp, Artificial Sequence
  Synthetic
tctacccaccctgcgagacatc

SEQ ID NO: 17816 - DNA, 19 bp, Artificial Sequence
  Synthetic
agtgtgccgcacaaggccg

SEQ ID NO: 17817 - DNA, 22 bp, Artificial Sequence
  Synthetic
cccctggtcttcaagcacactt

SEQ ID NO: 17818 - DNA, 20 bp, Artificial Sequence
  Synthetic
gagatgccaacagtgttgct

SEQ ID NO: 17819 - DNA, 21 bp, Artificial Sequence
  Synthetic
cgtacttttccactccaggcg

SEQ ID NO: 17820 - DNA, 22 bp, Artificial Sequence
  Synthetic
gttaggtcgctactcgctggga

SEQ ID NO: 17821 - DNA, 22 bp, Artificial Sequence
  Synthetic
gagcaagttaccatcccctgca

SEQ ID NO: 17822 - DNA, 19 bp, Artificial Sequence
  Synthetic
agggttgagggggccgttc

SEQ ID NO: 17823 - DNA, 18 bp, Artificial Sequence
  Synthetic
aacgacgacgcggttgcc

SEQ ID NO: 17824 - DNA, 19 bp, Artificial Sequence
  Synthetic
gccacaaaagccaccgcgg

SEQ ID NO: 17825 - DNA, 20 bp, Artificial Sequence
  Synthetic
tgcgcgctgctggtgtttta

SEQ ID NO: 17826 - DNA, 19 bp, Artificial Sequence
  Synthetic
acgaaggtccaagcggcgg

SEQ ID NO: 17827 - DNA, 22 bp, Artificial Sequence
  Synthetic
cgcgtgactctctgttcgatgg

SEQ ID NO: 17828 - DNA, 19 bp, Artificial Sequence
  Synthetic
cccaacggtcacacgtccg

SEQ ID NO: 17829 - DNA, 20 bp, Artificial Sequence
  Synthetic
caacgcggcacttccaacag

SEQ ID NO: 17830 - DNA, 19 bp, Artificial Sequence
  Synthetic
ttcgcacacccagcccctg

SEQ ID NO: 17831 - DNA, 19 bp, Artificial Sequence
  Synthetic
ccgacgtcccgcatccaac

SEQ ID NO: 17832 - DNA, 19 bp, Artificial Sequence
  Synthetic
gaacacgcgcaacagggcc

SEQ ID NO: 17833 - DNA, 20 bp, Artificial Sequence
  Synthetic
tatcgtcgggtcggctgtcc

SEQ ID NO: 17834 - DNA, 21 bp, Artificial Sequence
  Synthetic
cctcgtcatcctccgtgtcgg

SEQ ID NO: 17835 - DNA, 20 bp, Artificial Sequence
  Synthetic
ggcccactttcgggtggagg

SEQ ID NO: 17836 - DNA, 22 bp, Artificial Sequence
  Synthetic
ggtgccgaaatcaccgtgtgaa

SEQ ID NO: 17837 - DNA, 19 bp, Artificial Sequence
  Synthetic
atgtcgcgacacccgggtc

SEQ ID NO: 17838 - DNA, 25 bp, Artificial Sequence
  Synthetic
agaacatatataatcgccgtttcgt

SEQ ID NO: 17839 - DNA, 19 bp, Artificial Sequence
  Synthetic
agcacggggtactcgtggc

SEQ ID NO: 17840 - DNA, 22 bp, Artificial Sequence
  Synthetic
gaaggaaaccgaccccgaaact

SEQ ID NO: 17841 - DNA, 20 bp, Artificial Sequence
  Synthetic
ctcaacctgtgcgccacagc

SEQ ID NO: 17842 - DNA, 21 bp, Artificial Sequence
  Synthetic
ccctcactgggctacgagtgc

SEQ ID NO: 17843 - DNA, 20 bp, Artificial Sequence
  Synthetic
tcatctacgtgccccccggg

SEQ ID NO: 17844 - DNA, 19 bp, Artificial Sequence
  Synthetic
tcagcgaaaccggcacccg

SEQ ID NO: 17845 - DNA, 19 bp, Artificial Sequence
  Synthetic
ggctgtcatgggtctgcgc

SEQ ID NO: 17846 - DNA, 19 bp, Artificial Sequence
  Synthetic
atcgttcacgtcgccgccg

SEQ ID NO: 17847 - DNA, 18 bp, Artificial Sequence
  Synthetic
acagcagccgcgcttgtc

SEQ ID NO: 17848 - DNA, 21 bp, Artificial Sequence
  Synthetic
gcgtctacgtggtgatgctgc

SEQ ID NO: 17849 - DNA, 19 bp, Artificial Sequence
  Synthetic
aggcctggttacagcgcgg

SEQ ID NO: 17850 - DNA, 20 bp, Artificial Sequence
  Synthetic
gcaaccccgccaactggttc

SEQ ID NO: 17851 - DNA, 20 bp, Artificial Sequence
  Synthetic
tgttcgacagcggcgtagac

SEQ ID NO: 17852 - DNA, 21 bp, Artificial Sequence
  Synthetic
ggtcatgacaccgacgcgttg

SEQ ID NO: 17853 - DNA, 19 bp, Artificial Sequence
  Synthetic
gtcgctcggcattccgcac

SEQ ID NO: 17854 - DNA, 18 bp, Artificial Sequence
  Synthetic
agttgtgccgccggagct

SEQ ID NO: 17855 - DNA, 20 bp, Artificial Sequence
  Synthetic
aaccagatggcgacggacgt

SEQ ID NO: 17856 - DNA, 20 bp, Artificial Sequence
  Synthetic
tgctaaccacgcaaccggat

SEQ ID NO: 17857 - DNA, 18 bp, Artificial Sequence
  Synthetic
atcccggcaagttgcgcg

SEQ ID NO: 17858 - DNA, 20 bp, Artificial Sequence
  Synthetic
cgcctgctctctccaggtcc

SEQ ID NO: 17859 - DNA, 20 bp, Artificial Sequence
  Synthetic
gccttccagactgcacggcc

SEQ ID NO: 17860 - DNA, 20 bp, Artificial Sequence
  Synthetic
cagaaaacacccccccgccc

SEQ ID NO: 17861 - DNA, 25 bp, Artificial Sequence
  Synthetic
tcttccccatattccttcattgtct

SEQ ID NO: 17862 - DNA, 25 bp, Artificial Sequence
  Synthetic
tgtagtcgtatagatccggaagaaa

SEQ ID NO: 17863 - DNA, 20 bp, Artificial Sequence
  Synthetic
ttcgcctctctcggactgac

SEQ ID NO: 17864 - DNA, 23 bp, Artificial Sequence
  Synthetic
tcctcaaagtccaatttttccgg

SEQ ID NO: 17865 - DNA, 20 bp, Artificial Sequence
  Synthetic
caatgtgctcaattggggca

SEQ ID NO: 17866 - DNA, 24 bp, Artificial Sequence
  Synthetic
ccatactcacaaagttcaccacgt

SEQ ID NO: 17867 - DNA, 24 bp, Artificial Sequence
  Synthetic
tctctttgatagaagactcagcct

SEQ ID NO: 17868 - DNA, 22 bp, Artificial Sequence
  Synthetic
cagatgccctgatctcagtagc

SEQ ID NO: 17869 - DNA, 24 bp, Artificial Sequence
  Synthetic
cctctttgtcatacaggatcagct

SEQ ID NO: 17870 - DNA, 24 bp, Artificial Sequence
  Synthetic
ccattttcgcctctccagaaattc

SEQ ID NO: 17871 - DNA, 22 bp, Artificial Sequence
  Synthetic
ttgaagcaatttgaacccctct

SEQ ID NO: 17872 - DNA, 23 bp, Artificial Sequence
  Synthetic
gcatttcagttttcgcgcctaaa

SEQ ID NO: 17873 - DNA, 23 bp, Artificial Sequence
  Synthetic
tccaatatgtcgtcagcttcctg

SEQ ID NO: 17874 - DNA, 22 bp, Artificial Sequence
  Synthetic
ccgaatcgctacagggaaagcc

SEQ ID NO: 17875 - DNA, 20 bp, Artificial Sequence
  Synthetic
acatctacgcctcccagtca

SEQ ID NO: 17876 - DNA, 20 bp, Artificial Sequence
  Synthetic
tactgcaagagctggcgaac

SEQ ID NO: 17877 - DNA, 22 bp, Artificial Sequence
  Synthetic
gcgccagcgagtaaatgcaaac

SEQ ID NO: 17878 - DNA, 25 bp, Artificial Sequence
  Synthetic
gcgcatgaagtaatggttactgttt

SEQ ID NO: 17879 - DNA, 23 bp, Artificial Sequence
  Synthetic
aggcattttctgaagctgcatta

SEQ ID NO: 17880 - DNA, 25 bp, Artificial Sequence
  Synthetic
accccatttaaacacactctagaaa

SEQ ID NO: 17881 - DNA, 22 bp, Artificial Sequence
  Synthetic
ggcgagggtccaatagttgcat

SEQ ID NO: 17882 - DNA, 25 bp, Artificial Sequence
  Synthetic
aggctcatctttacaaaatactgga

SEQ ID NO: 17883 - DNA, 25 bp, Artificial Sequence
  Synthetic
tggttctccacaatatgaatccaag

SEQ ID NO: 17884 - DNA, 22 bp, Artificial Sequence
  Synthetic
tgggaagtctcagttgttgcgt

SEQ ID NO: 17885 - DNA, 22 bp, Artificial Sequence
  Synthetic
cgcaacgaggaagtttgctgga

SEQ ID NO: 17886 - DNA, 23 bp, Artificial Sequence
  Synthetic
ttaaatgccttcagtgtcctcac

SEQ ID NO: 17887 - DNA, 23 bp, Artificial Sequence
  Synthetic
tggtcagaattcctgtacgagga

SEQ ID NO: 17888 - DNA, 21 bp, Artificial Sequence
  Synthetic
gtgtactcacccaaccagttg

SEQ ID NO: 17889 - DNA, 22 bp, Artificial Sequence
  Synthetic
ccaccattttccccacctggaa

SEQ ID NO: 17890 - DNA, 20 bp, Artificial Sequence
  Synthetic
atgcatcggccctcacacac

SEQ ID NO: 17891 - DNA, 21 bp, Artificial Sequence
  Synthetic
ggttcttaccgtgcagatgca

SEQ ID NO: 17892 - DNA, 20 bp, Artificial Sequence
  Synthetic
ggacgtccctggacccttta

SEQ ID NO: 17893 - DNA, 25 bp, Artificial Sequence
  Synthetic
actttctactgcttaaccccagaaa

SEQ ID NO: 17894 - DNA, 22 bp, Artificial Sequence
  Synthetic
acactgcgcacgcttttacaaa

SEQ ID NO: 17895 - DNA, 20 bp, Artificial Sequence
  Synthetic
ctggacatgcaggtcgaggg

SEQ ID NO: 17896 - DNA, 20 bp, Artificial Sequence
  Synthetic
ttcctccgggagctcgtccg

SEQ ID NO: 17897 - DNA, 22 bp, Artificial Sequence
  Synthetic
cactattgaacgtgcgggacat

SEQ ID NO: 17898 - DNA, 22 bp, Artificial Sequence
  Synthetic
cgtcgcggcgaaatgattgaaa

SEQ ID NO: 17899 - DNA, 20 bp, Artificial Sequence
  Synthetic
ttgctcagcttcctggtact

SEQ ID NO: 17900 - DNA, 22 bp, Artificial Sequence
  Synthetic
accgctttgtagatgtggatga

SEQ ID NO: 17901 - DNA, 20 bp, Artificial Sequence
  Synthetic
gctgccggcatcacatggat

SEQ ID NO: 17902 - DNA, 21 bp, Artificial Sequence
  Synthetic
ggatcctgccggtttcgaacc

SEQ ID NO: 17903 - DNA, 22 bp, Artificial Sequence
  Synthetic
gcgaaacatgttctgacgaggc

SEQ ID NO: 17904 - DNA, 24 bp, Artificial Sequence
  Synthetic
agcttctacaaagtcccaaagatg

SEQ ID NO: 17905 - DNA, 19 bp, Artificial Sequence
  Synthetic
cgcttggctgccaccgtag

SEQ ID NO: 17906 - DNA, 24 bp, Artificial Sequence
  Synthetic
gctttgctatccaacaaagcattt

SEQ ID NO: 17907 - DNA, 25 bp, Artificial Sequence
  Synthetic
aaaagtaatcgggtccagactgata

SEQ ID NO: 17908 - DNA, 25 bp, Artificial Sequence
  Synthetic
gcatttgtaaagtattccccgttca

SEQ ID NO: 17909 - DNA, 20 bp, Artificial Sequence
  Synthetic
ttttgcgtcgctgccaacgt

SEQ ID NO: 17910 - DNA, 25 bp, Artificial Sequence
  Synthetic
ggcatgttggtatgtaagatggttt

SEQ ID NO: 17911 - DNA, 21 bp, Artificial Sequence
  Synthetic
ctaattgggtttcggggtccc

SEQ ID NO: 17912 - DNA, 22 bp, Artificial Sequence
  Synthetic
agttgtaactgcgtcctttggg

SEQ ID NO: 17913 - DNA, 22 bp, Artificial Sequence
  Synthetic
cgcactggatgttggctagacc

SEQ ID NO: 17914 - DNA, 20 bp, Artificial Sequence
  Synthetic
gctgcccgcatcatagctcg

SEQ ID NO: 17915 - DNA, 20 bp, Artificial Sequence
  Synthetic
aactcgacgccgtctgctga

SEQ ID NO: 17916 - DNA, 22 bp, Artificial Sequence
  Synthetic
cctctaacttttgccgcttagg

SEQ ID NO: 17917 - DNA, 22 bp, Artificial Sequence
  Synthetic
tgatggacctcgtctacggcta

SEQ ID NO: 17918 - DNA, 20 bp, Artificial Sequence
  Synthetic
aacggatccgggcacagttt

SEQ ID NO: 17919 - DNA, 21 bp, Artificial Sequence
  Synthetic
gccatcttgaaagcgctggtg

SEQ ID NO: 17920 - DNA, 22 bp, Artificial Sequence
  Synthetic
ccacgatccagtacccctcgaa

SEQ ID NO: 17921 - DNA, 22 bp, Artificial Sequence
  Synthetic
tgtttgctgcattgttagctga

SEQ ID NO: 17922 - DNA, 20 bp, Artificial Sequence
  Synthetic
actgcggaattccacaagga

SEQ ID NO: 17923 - DNA, 25 bp, Artificial Sequence
  Synthetic
ggtagttttatgtttcctggagtgt

SEQ ID NO: 17924 - DNA, 24 bp, Artificial Sequence
  Synthetic
agtgtgctctgaagaatcatgttt

SEQ ID NO: 17925 - DNA, 23 bp, Artificial Sequence
  Synthetic
aggtgccgtctaaatagggaatg

SEQ ID NO: 17926 - DNA, 25 bp, Artificial Sequence
  Synthetic
agttgttatgttgaaactctacggt

SEQ ID NO: 17927 - DNA, 22 bp, Artificial Sequence
  Synthetic
gggtccacagcctagatctcga

SEQ ID NO: 17928 - DNA, 22 bp, Artificial Sequence
  Synthetic
gaacatacaacaaaacaggccg

SEQ ID NO: 17929 - DNA, 22 bp, Artificial Sequence
  Synthetic
gctccccccctaggcttgttat

SEQ ID NO: 17930 - DNA, 21 bp, Artificial Sequence
  Synthetic
cttttatgctggccgactacc

SEQ ID NO: 17931 - DNA, 22 bp, Artificial Sequence
  Synthetic
ctgcgtgtgggagcataagtgt

SEQ ID NO: 17932 - DNA, 20 bp, Artificial Sequence
  Synthetic
gttgttgttcgcaatccggc

SEQ ID NO: 17933 - DNA, 20 bp, Artificial Sequence
  Synthetic
tcctcggggggagtctcgta

SEQ ID NO: 17934 - DNA, 25 bp, Artificial Sequence
  Synthetic
gacaggataggggtattttgtgatt

SEQ ID NO: 17935 - DNA, 21 bp, Artificial Sequence
  Synthetic
gcctccgggtcttgcaagttt

SEQ ID NO: 17936 - DNA, 20 bp, Artificial Sequence
  Synthetic
aagcattgctgccaaacacc

SEQ ID NO: 17937 - DNA, 20 bp, Artificial Sequence
  Synthetic
attgctgtcagactgcggtc

SEQ ID NO: 17938 - DNA, 20 bp, Artificial Sequence
  Synthetic
ttgcggctttcggggacatg

SEQ ID NO: 17939 - DNA, 20 bp, Artificial Sequence
  Synthetic
catgagcagtagccccgacg

SEQ ID NO: 17940 - DNA, 20 bp, Artificial Sequence
  Synthetic
tcgtgttcttgacctcgact

SEQ ID NO: 17941 - DNA, 22 bp, Artificial Sequence
  Synthetic
gagagcggcttgttctagcagt

SEQ ID NO: 17942 - DNA, 22 bp, Artificial Sequence
  Synthetic
cgggaacaggacaaatgcaata

SEQ ID NO: 17943 - DNA, 20 bp, Artificial Sequence
  Synthetic
aaatgcttgcgtacagggtg

SEQ ID NO: 17944 - DNA, 25 bp, Artificial Sequence
  Synthetic
agccagaaggtaaagaaaagagaaa

SEQ ID NO: 17945 - DNA, 24 bp, Artificial Sequence
  Synthetic
ccgtagtaccatcgactgacatta

SEQ ID NO: 17946 - DNA, 24 bp, Artificial Sequence
  Synthetic
gaaccgtcaccatactgtaagaaa

SEQ ID NO: 17947 - DNA, 25 bp, Artificial Sequence
  Synthetic
ttggatattcgggaagatcatcagt

SEQ ID NO: 17948 - DNA, 25 bp, Artificial Sequence
  Synthetic
tgttctttgcctggtaaagattcat

SEQ ID NO: 17949 - DNA, 24 bp, Artificial Sequence
  Synthetic
gtttgcaagtctgtcaggtttgac

SEQ ID NO: 17950 - DNA, 23 bp, Artificial Sequence
  Synthetic
aaggggctccaaaacattgatat

SEQ ID NO: 17951 - DNA, 22 bp, Artificial Sequence
  Synthetic
gggtaagagcgttgttgcgaac

SEQ ID NO: 17952 - DNA, 25 bp, Artificial Sequence
  Synthetic
gctcgcatcaaagggataattaaca

SEQ ID NO: 17953 - DNA, 25 bp, Artificial Sequence
  Synthetic
ggttgatgtgattaatcttccctgt

SEQ ID NO: 17954 - DNA, 24 bp, Artificial Sequence
  Synthetic
gcaatttgtgttttgtgtgtgttt

SEQ ID NO: 17955 - DNA, 25 bp, Artificial Sequence
  Synthetic
gatggacactgactgttgttacttt

SEQ ID NO: 17956 - DNA, 20 bp, Artificial Sequence
  Synthetic
gatgcttttgggacgctggt

SEQ ID NO: 17957 - DNA, 22 bp, Artificial Sequence
  Synthetic
aaagctacgttgagtacttcgg

SEQ ID NO: 17958 - DNA, 20 bp, Artificial Sequence
  Synthetic
tgccacctgcgagatttacg

SEQ ID NO: 17959 - DNA, 25 bp, Artificial Sequence
  Synthetic
tgctggcttctgatttgtatgattt

SEQ ID NO: 17960 - DNA, 20 bp, Artificial Sequence
  Synthetic
aagcatgtttcagaggtcgc

SEQ ID NO: 17961 - DNA, 21 bp, Artificial Sequence
  Synthetic
gcctaaacaagagggcgactc

SEQ ID NO: 17962 - DNA, 22 bp, Artificial Sequence
  Synthetic
cttctcgtaggcactttgcgga

SEQ ID NO: 17963 - DNA, 22 bp, Artificial Sequence
  Synthetic
agggagacatcaaggctgggtt

SEQ ID NO: 17964 - DNA, 22 bp, Artificial Sequence
  Synthetic
ccactgccaccaacaaacatcc

SEQ ID NO: 17965 - DNA, 20 bp, Artificial Sequence
  Synthetic
gtgcggtagctttaatggcc

SEQ ID NO: 17966 - DNA, 25 bp, Artificial Sequence
  Synthetic
tctttgttcttctgaagaaatggga

SEQ ID NO: 17967 - DNA, 21 bp, Artificial Sequence
  Synthetic
gtgtgaaattcgcccataggg

SEQ ID NO: 17968 - DNA, 20 bp, Artificial Sequence
  Synthetic
gcaggtattgggtggctctg

SEQ ID NO: 17969 - DNA, 24 bp, Artificial Sequence
  Synthetic
cctatggttccatgtacacacaac

SEQ ID NO: 17970 - DNA, 23 bp, Artificial Sequence
  Synthetic
acttgtcaccaatccattccaag

SEQ ID NO: 17971 - DNA, 24 bp, Artificial Sequence
  Synthetic
ggtctcttccatctggattttgac

SEQ ID NO: 17972 - DNA, 21 bp, Artificial Sequence
  Synthetic
ccccggagttgaatcatctcc

SEQ ID NO: 17973 - DNA, 25 bp, Artificial Sequence
  Synthetic
tccacatcattttcatctgtgacaa

SEQ ID NO: 17974 - DNA, 22 bp, Artificial Sequence
  Synthetic
ggttctttttcaccggggaata

SEQ ID NO: 17975 - DNA, 23 bp, Artificial Sequence
  Synthetic
aaacacccttctgaagttagctg

SEQ ID NO: 17976 - DNA, 20 bp, Artificial Sequence
  Synthetic
gaggccagaaacggctatct

SEQ ID NO: 17977 - DNA, 20 bp, Artificial Sequence
  Synthetic
gtcgtccaaggttgcaggtc

SEQ ID NO: 17978 - DNA, 25 bp, Artificial Sequence
  Synthetic
ctcctcctctgtaatctcatactca

SEQ ID NO: 17979 - DNA, 25 bp, Artificial Sequence
  Synthetic
ttctgcttcatggacaatataccaa

SEQ ID NO: 17980 - DNA, 24 bp, Artificial Sequence
  Synthetic
ggagttattttcacagcctgcaac

SEQ ID NO: 17981 - DNA, 25 bp, Artificial Sequence
  Synthetic
aactctctgttaacatagcatgctt

SEQ ID NO: 17982 - DNA, 24 bp, Artificial Sequence
  Synthetic
tcagaattgcttcttgaagtgcat

SEQ ID NO: 17983 - DNA, 25 bp, Artificial Sequence
  Synthetic
acagtccagttctgctaaatctttg

SEQ ID NO: 17984 - DNA, 22 bp, Artificial Sequence
  Synthetic
gggccctgattttccttctcgt

SEQ ID NO: 17985 - DNA, 25 bp, Artificial Sequence
  Synthetic
actcatgaataagaagttgcagcaa

SEQ ID NO: 17986 - DNA, 22 bp, Artificial Sequence
  Synthetic
tcagcaaacgatcagcaagagt

SEQ ID NO: 17987 - DNA, 25 bp, Artificial Sequence
  Synthetic
gatgttgttgggtctattgcatcta

SEQ ID NO: 17988 - DNA, 22 bp, Artificial Sequence
  Synthetic
gccaatgctatccgttttgtgg

SEQ ID NO: 17989 - DNA, 25 bp, Artificial Sequence
  Synthetic
agtaggtatttgctgaacccttcta

SEQ ID NO: 17990 - DNA, 25 bp, Artificial Sequence
  Synthetic
acttctagtttttattgtgcctcgg

SEQ ID NO: 17991 - DNA, 25 bp, Artificial Sequence
  Synthetic
gtctggcaaattgaatctaaacact

SEQ ID NO: 17992 - DNA, 25 bp, Artificial Sequence
  Synthetic
tccaaagaaaaacaagctatctcca

SEQ ID NO: 17993 - DNA, 21 bp, Artificial Sequence
  Synthetic
cctcaattccagagggaggtg

SEQ ID NO: 17994 - DNA, 23 bp, Artificial Sequence
  Synthetic
ccaaatgactcagagagactgga

SEQ ID NO: 17995 - DNA, 19 bp, Artificial Sequence
  Synthetic
gttggcagctgacgccggt

SEQ ID NO: 17996 - DNA, 20 bp, Artificial Sequence
  Synthetic
ttgcacagccagttgacgtt

SEQ ID NO: 17997 - DNA, 23 bp, Artificial Sequence
  Synthetic
tccatccgttataaaaaagcccg

SEQ ID NO: 17998 - DNA, 22 bp, Artificial Sequence
  Synthetic
gcacatacattgctccgtccct

SEQ ID NO: 17999 - DNA, 20 bp, Artificial Sequence
  Synthetic
tggaggtggccctgtatagg

SEQ ID NO: 18000 - DNA, 25 bp, Artificial Sequence
  Synthetic
gcttaaaaaatccttcccccattct

SEQ ID NO: 18001 - DNA, 25 bp, Artificial Sequence
  Synthetic
gcattgagagaagtaacagtagtct

SEQ ID NO: 18002 - DNA, 25 bp, Artificial Sequence
  Synthetic
gcagctgtaaaatcaactccttcat

SEQ ID NO: 18003 - DNA, 25 bp, Artificial Sequence
  Synthetic
ttaaacatgtcgcaaaccatttgat

SEQ ID NO: 18004 - DNA, 20 bp, Artificial Sequence
  Synthetic
tatggtcgttgcagacgtgg

SEQ ID NO: 18005 - DNA, 25 bp, Artificial Sequence
  Synthetic
gttgttgcatatccagcataatcaa

SEQ ID NO: 18006 - DNA, 24 bp, Artificial Sequence
  Synthetic
agctgtctactaattgctcatagc

SEQ ID NO: 18007 - DNA, 25 bp, Artificial Sequence
  Synthetic
gcactatagcttctaccataaacca

SEQ ID NO: 18008 - DNA, 20 bp, Artificial Sequence
  Synthetic
ctttccactgcctcggctat

SEQ ID NO: 18009 - DNA, 21 bp, Artificial Sequence
  Synthetic
tgctcccgtacactgtttgtg

SEQ ID NO: 18010 - DNA, 25 bp, Artificial Sequence
  Synthetic
actctcctcgcatatgtcattatca

SEQ ID NO: 18011 - DNA, 22 bp, Artificial Sequence
  Synthetic
cttcctcgtcctcagaatcctg

SEQ ID NO: 18012 - DNA, 25 bp, Artificial Sequence
  Synthetic
cggttccatactatactcagtcctt

SEQ ID NO: 18013 - DNA, 20 bp, Artificial Sequence
  Synthetic
gtttccactgtccacgggtc

SEQ ID NO: 18014 - DNA, 25 bp, Artificial Sequence
  Synthetic
tggtagggggtatttttacaacatc

SEQ ID NO: 18015 - DNA, 25 bp, Artificial Sequence
  Synthetic
ggttgttaatagcagccacaatagt

SEQ ID NO: 18016 - DNA, 21 bp, Artificial Sequence
  Synthetic
ctatataggcccacacgaggc

SEQ ID NO: 18017 - DNA, 25 bp, Artificial Sequence
  Synthetic
ggaaaagttatatcagggccagatt

SEQ ID NO: 18018 - DNA, 25 bp, Artificial Sequence
  Synthetic
gcatgataaaatatgttggtgcgag

SEQ ID NO: 18019 - DNA, 25 bp, Artificial Sequence
  Synthetic
ggaacatctgatttattggtctgca

SEQ ID NO: 18020 - DNA, 20 bp, Artificial Sequence
  Synthetic
gtccctgggctttttgtagc

SEQ ID NO: 18021 - DNA, 20 bp, Artificial Sequence
  Synthetic
taaggcaataccgcaccctg

SEQ ID NO: 18022 - DNA, 22 bp, Artificial Sequence
  Synthetic
tcaccggttccgaagaccacta

SEQ ID NO: 18023 - DNA, 22 bp, Artificial Sequence
  Synthetic
ctgcgcggcaacaagtaaactc

SEQ ID NO: 18024 - DNA, 20 bp, Artificial Sequence
  Synthetic
ctgacaccatgtgccagggc

SEQ ID NO: 18025 - DNA, 21 bp, Artificial Sequence
  Synthetic
cggtaggagtaagggccaccc

SEQ ID NO: 18026 - DNA, 22 bp, Artificial Sequence
  Synthetic
cccagtggcctccagagagtaa

SEQ ID NO: 18027 - DNA, 21 bp, Artificial Sequence
  Synthetic
gccttggccgtagctgtcaag

SEQ ID NO: 18028 - DNA, 22 bp, Artificial Sequence
  Synthetic
cggtactgttcatccacacgca

SEQ ID NO: 18029 - DNA, 22 bp, Artificial Sequence
  Synthetic
caggggtgatagctctacccga

SEQ ID NO: 18030 - DNA, 22 bp, Artificial Sequence
  Synthetic
caggagaaaacagggccacagc

SEQ ID NO: 18031 - DNA, 20 bp, Artificial Sequence
  Synthetic
aatcactgagtcgcgaggcc

SEQ ID NO: 18032 - DNA, 22 bp, Artificial Sequence
  Synthetic
cccttatgatgtctccgcacgc

SEQ ID NO: 18033 - DNA, 20 bp, Artificial Sequence
  Synthetic
accgcagtacccaggaagga

SEQ ID NO: 18034 - DNA, 20 bp, Artificial Sequence
  Synthetic
acgaagtctaccgccttggc

SEQ ID NO: 18035 - DNA, 21 bp, Artificial Sequence
  Synthetic
cgtggtgatggtcctgactcc

SEQ ID NO: 18036 - DNA, 22 bp, Artificial Sequence
  Synthetic
ccccccttgatcagctccagag

SEQ ID NO: 18037 - DNA, 20 bp, Artificial Sequence
  Synthetic
cctaccagtgcggcctctcc

SEQ ID NO: 18038 - DNA, 20 bp, Artificial Sequence
  Synthetic
tggagcgagccagaccttgg

SEQ ID NO: 18039 - DNA, 22 bp, Artificial Sequence
  Synthetic
ggtagagcacttcgcgatcagg

SEQ ID NO: 18040 - DNA, 22 bp, Artificial Sequence
  Synthetic
agggtttgttgggtggtcagag

SEQ ID NO: 18041 - DNA, 17 bp, Artificial Sequence
  Synthetic
tggcggcgcaaaatcgc

SEQ ID NO: 18042 - DNA, 21 bp, Artificial Sequence
  Synthetic
ggggatgcctggcattaaggg

SEQ ID NO: 18043 - DNA, 21 bp, Artificial Sequence
  Synthetic
gatgccgtccacttccgtgaa

SEQ ID NO: 18044 - DNA, 20 bp, Artificial Sequence
  Synthetic
acgtggcctgaagaagacgg

SEQ ID NO: 18045 - DNA, 19 bp, Artificial Sequence
  Synthetic
acagggggctgctttgccg

SEQ ID NO: 18046 - DNA, 22 bp, Artificial Sequence
  Synthetic
gccccagtccacgagtatgaca

SEQ ID NO: 18047 - DNA, 20 bp, Artificial Sequence
  Synthetic
ttgcgggaatggctccgaac

SEQ ID NO: 18048 - DNA, 22 bp, Artificial Sequence
  Synthetic
ggagtcaaagcagcgggtatca

SEQ ID NO: 18049 - DNA, 19 bp, Artificial Sequence
  Synthetic
ctacgccgtcgctctcagc

SEQ ID NO: 18050 - DNA, 20 bp, Artificial Sequence
  Synthetic
atcgagtttggcagcggcag

SEQ ID NO: 18051 - DNA, 25 bp, Artificial Sequence
  Synthetic
tgctgtgaccataagacaatatgaa

SEQ ID NO: 18052 - DNA, 22 bp, Artificial Sequence
  Synthetic
gcctcaacattgggtgaattca

SEQ ID NO: 18053 - DNA, 24 bp, Artificial Sequence
  Synthetic
cttgagtgcatctggtaatttcca

SEQ ID NO: 18054 - DNA, 24 bp, Artificial Sequence
  Synthetic
accaataaacaggtttgtcccaaa

SEQ ID NO: 18055 - DNA, 24 bp, Artificial Sequence
  Synthetic
cctgatgtccatggtattgtcatt

SEQ ID NO: 18056 - DNA, 21 bp, Artificial Sequence
  Synthetic
acctaagccttcagtgagtgc

SEQ ID NO: 18057 - DNA, 20 bp, Artificial Sequence
  Synthetic
tgccatgtgtaatcgcccac

SEQ ID NO: 18058 - DNA, 20 bp, Artificial Sequence
  Synthetic
gtagggtagtgctctgggtg

SEQ ID NO: 18059 - DNA, 25 bp, Artificial Sequence
  Synthetic
tggaatagtaaacacctgatgtacg

SEQ ID NO: 18060 - DNA, 25 bp, Artificial Sequence
  Synthetic
tgtcgtatgtcagcaaaacaaacat

SEQ ID NO: 18061 - DNA, 24 bp, Artificial Sequence
  Synthetic
ggagatccatcacatccaagtagt

SEQ ID NO: 18062 - DNA, 23 bp, Artificial Sequence
  Synthetic
cgtcccacaatggatgttgttaa

SEQ ID NO: 18063 - DNA, 25 bp, Artificial Sequence
  Synthetic
tgtgttagaatttgtggaggctaga

SEQ ID NO: 18064 - DNA, 25 bp, Artificial Sequence
  Synthetic
gggggtgctactcaaattaataagt

SEQ ID NO: 18065 - DNA, 25 bp, Artificial Sequence
  Synthetic
ccttgtcacctggaaaaacatcata

SEQ ID NO: 18066 - DNA, 25 bp, Artificial Sequence
  Synthetic
ggttgcctagtttcattctcatgtt

SEQ ID NO: 18067 - DNA, 20 bp, Artificial Sequence
  Synthetic
tctgggggtgtgatggttag

SEQ ID NO: 18068 - DNA, 20 bp, Artificial Sequence
  Synthetic
aacagcccatgggtccagct

SEQ ID NO: 18069 - DNA, 20 bp, Artificial Sequence
  Synthetic
actgagccctcctgcgacaa

SEQ ID NO: 18070 - DNA, 20 bp, Artificial Sequence
  Synthetic
gcaggcagcagtggatgtgt

SEQ ID NO: 18071 - DNA, 21 bp, Artificial Sequence
  Synthetic
cgatgagagcggaatgtcccg

SEQ ID NO: 18072 - DNA, 22 bp, Artificial Sequence
  Synthetic
accaggataccccgtggattgt

SEQ ID NO: 18073 - DNA, 24 bp, Artificial Sequence
  Synthetic
ggcgtaagataattcctgcagaaa

SEQ ID NO: 18074 - DNA, 24 bp, Artificial Sequence
  Synthetic
actctggctgtacaagaattacac

SEQ ID NO: 18075 - DNA, 23 bp, Artificial Sequence
  Synthetic
gctattccactgtcctcaaacag

SEQ ID NO: 18076 - DNA, 25 bp, Artificial Sequence
  Synthetic
tgtttgttttacaacccaatctggt

SEQ ID NO: 18077 - DNA, 25 bp, Artificial Sequence
  Synthetic
acaatctagtaatggctgaatccaa

SEQ ID NO: 18078 - DNA, 20 bp, Artificial Sequence
  Synthetic
ggtggggctgcttgatctcc

SEQ ID NO: 18079 - DNA, 21 bp, Artificial Sequence
  Synthetic
cctgatcgtggaacagatcga

SEQ ID NO: 18080 - DNA, 23 bp, Artificial Sequence
  Synthetic
catggaggtacccttaggaagtg

SEQ ID NO: 18081 - DNA, 22 bp, Artificial Sequence
  Synthetic
tccctccctaggtgtttgagca

SEQ ID NO: 18082 - DNA, 25 bp, Artificial Sequence
  Synthetic
tcatctatttcaaactgcgccatag

SEQ ID NO: 18083 - DNA, 22 bp, Artificial Sequence
  Synthetic
ctgtctagaggagttgtcagct

SEQ ID NO: 18084 - DNA, 25 bp, Artificial Sequence
  Synthetic
gggtcgaaagatacattttgcctat

SEQ ID NO: 18085 - DNA, 24 bp, Artificial Sequence
  Synthetic
tctgtataaaatccggccatttgc

SEQ ID NO: 18086 - DNA, 25 bp, Artificial Sequence
  Synthetic
cctcactagtaactagagaaccact

SEQ ID NO: 18087 - DNA, 25 bp, Artificial Sequence
  Synthetic
acctaaaggtgtctgatccaaatca

SEQ ID NO: 18088 - DNA, 25 bp, Artificial Sequence
  Synthetic
cgaagttaaagtgatagaacaccga

SEQ ID NO: 18089 - DNA, 22 bp, Artificial Sequence
  Synthetic
tgctggtgagagagaaaaggcc

SEQ ID NO: 18090 - DNA, 22 bp, Artificial Sequence
  Synthetic
gcgggtaggggcagtataccaa

SEQ ID NO: 18091 - DNA, 20 bp, Artificial Sequence
  Synthetic
acaggacctcaggcgggagg

SEQ ID NO: 18092 - DNA, 20 bp, Artificial Sequence
  Synthetic
agggcgtaggtgatggctcc

SEQ ID NO: 18093 - DNA, 20 bp, Artificial Sequence
  Synthetic
agcgacctcagaggcgttcc

SEQ ID NO: 18094 - DNA, 21 bp, Artificial Sequence
  Synthetic
aaaaccaacacccgtgggtca

SEQ ID NO: 18095 - DNA, 19 bp, Artificial Sequence
  Synthetic
tgccagggacgacgtagga

SEQ ID NO: 18096 - DNA, 21 bp, Artificial Sequence
  Synthetic
cagaggcggcataggtgagac

SEQ ID NO: 18097 - DNA, 22 bp, Artificial Sequence
  Synthetic
ccttagagccatccgggtaggt

SEQ ID NO: 18098 - DNA, 22 bp, Artificial Sequence
  Synthetic
gcagcctcaagcatctttgggt

SEQ ID NO: 18099 - DNA, 22 bp, Artificial Sequence
  Synthetic
gccagatttgctgtccgtgcaa

SEQ ID NO: 18100 - DNA, 18 bp, Artificial Sequence
  Synthetic
aatgacaacccggcgccc

SEQ ID NO: 18101 - DNA, 22 bp, Artificial Sequence
  Synthetic
ggaggacccgactagtggtctg

SEQ ID NO: 18102 - DNA, 20 bp, Artificial Sequence
  Synthetic
gagatgcccacctcgcgaag

SEQ ID NO: 18103 - DNA, 20 bp, Artificial Sequence
  Synthetic
aggtcgagctcaaggacggc

SEQ ID NO: 18104 - DNA, 22 bp, Artificial Sequence
  Synthetic
ccagggccccaattcttctcag

SEQ ID NO: 18105 - DNA, 19 bp, Artificial Sequence
  Synthetic
tgggcctggtcacgccaag

SEQ ID NO: 18106 - DNA, 21 bp, Artificial Sequence
  Synthetic
gggagacccgcgtgttggtat

SEQ ID NO: 18107 - DNA, 20 bp, Artificial Sequence
  Synthetic
agactgggccggtcgaagag

SEQ ID NO: 18108 - DNA, 22 bp, Artificial Sequence
  Synthetic
gcacccaggctagtggtgtaag

SEQ ID NO: 18109 - DNA, 20 bp, Artificial Sequence
  Synthetic
attggctgcatatcgacgac

SEQ ID NO: 18110 - DNA, 21 bp, Artificial Sequence
  Synthetic
ccaccaacgattcaggaacat

SEQ ID NO: 18111 - DNA, 23 bp, Artificial Sequence
  Synthetic
gcatgccagatttaccggttatg

SEQ ID NO: 18112 - DNA, 25 bp, Artificial Sequence
  Synthetic
aaactctttcatatgccgttcctat

SEQ ID NO: 18113 - DNA, 21 bp, Artificial Sequence
  Synthetic
acaacatccaacgccgtttta

SEQ ID NO: 18114 - DNA, 24 bp, Artificial Sequence
  Synthetic
aatcgagtcttttcgttcccataa

SEQ ID NO: 18115 - DNA, 22 bp, Artificial Sequence
  Synthetic
tgattaaacaatgggccgttga

SEQ ID NO: 18116 - DNA, 25 bp, Artificial Sequence
  Synthetic
ggaaagaccgtttgttttatagtgg

SEQ ID NO: 18117 - DNA, 22 bp, Artificial Sequence
  Synthetic
tgagtggattattcgacgggac

SEQ ID NO: 18118 - DNA, 24 bp, Artificial Sequence
  Synthetic
cctctatggttgacagcacatttc

SEQ ID NO: 18119 - DNA, 22 bp, Artificial Sequence
  Synthetic
acctcatcgaaatgcgtatagc

SEQ ID NO: 18120 - DNA, 20 bp, Artificial Sequence
  Synthetic
ttttcggtttaggcagccgg

SEQ ID NO: 18121 - DNA, 19 bp, Artificial Sequence
  Synthetic
tgtggccgcccggttttgg

SEQ ID NO: 18122 - DNA, 20 bp, Artificial Sequence
  Synthetic
cagtacgtgctgccgggttt

SEQ ID NO: 18123 - DNA, 20 bp, Artificial Sequence
  Synthetic
ccatccaacagggtgcggtt

SEQ ID NO: 18124 - DNA, 22 bp, Artificial Sequence
  Synthetic
aggaaacatgatgcccggggta

SEQ ID NO: 18125 - DNA, 25 bp, Artificial Sequence
  Synthetic
ccctgcttgcccatactatatgttt

SEQ ID NO: 18126 - DNA, 20 bp, Artificial Sequence
  Synthetic
gtgtcctgtgtcagctgctg

SEQ ID NO: 18127 - DNA, 20 bp, Artificial Sequence
  Synthetic
atctggcctggtgcaatagg

SEQ ID NO: 18128 - DNA, 22 bp, Artificial Sequence
  Synthetic
gttcgcattttggaccaacaag

SEQ ID NO: 18129 - DNA, 25 bp, Artificial Sequence
  Synthetic
tggaatattgctggtgatcctttcc

SEQ ID NO: 18130 - DNA, 24 bp, Artificial Sequence
  Synthetic
tctgtatgtcattgacagtccagc

SEQ ID NO: 18131 - DNA, 24 bp, Artificial Sequence
  Synthetic
tggttattttttgcactgcctctg

SEQ ID NO: 18132 - DNA, 25 bp, Artificial Sequence
  Synthetic
ccattgctctccaattactgtgata

SEQ ID NO: 18133 - DNA, 23 bp, Artificial Sequence
  Synthetic
actggccatcttcctgctaattt

SEQ ID NO: 18134 - DNA, 25 bp, Artificial Sequence
  Synthetic
gtgggatgtgtacttctgaacttat

SEQ ID NO: 18135 - DNA, 25 bp, Artificial Sequence
  Synthetic
gccaagtattgtagagatcctacct

SEQ ID NO: 18136 - DNA, 25 bp, Artificial Sequence
  Synthetic
gcagaattcttattatggcttccac

SEQ ID NO: 18137 - DNA, 21 bp, Artificial Sequence
  Synthetic
tgcttccttccacacaggtac

SEQ ID NO: 18138 - DNA, 25 bp, Artificial Sequence
  Synthetic
agttgatactactggcctaattcca

SEQ ID NO: 18139 - DNA, 25 bp, Artificial Sequence
  Synthetic
tctcttgttaatagcagccctgtaa

SEQ ID NO: 18140 - DNA, 22 bp, Artificial Sequence
  Synthetic
cgcctcaatagccctcagcaaa

SEQ ID NO: 18141 - DNA, 21 bp, Artificial Sequence
  Synthetic
gctcccaccctatctgctgct

SEQ ID NO: 18142 - DNA, 22 bp, Artificial Sequence
  Synthetic
agcaagctcgatgtcagcagtt

SEQ ID NO: 18143 - DNA, 22 bp, Artificial Sequence
  Synthetic
cgtcagagattcccacctcggt

SEQ ID NO: 18144 - DNA, 20 bp, Artificial Sequence
  Synthetic
ccaggggctcagtctggaca

SEQ ID NO: 18145 - DNA, 20 bp, Artificial Sequence
  Synthetic
cccccttcagcacctacgtg

SEQ ID NO: 18146 - DNA, 19 bp, Artificial Sequence
  Synthetic
tcttcgccgggctggacga

SEQ ID NO: 18147 - DNA, 19 bp, Artificial Sequence
  Synthetic
ttcgaggctgtgctgcgcg

SEQ ID NO: 18148 - DNA, 21 bp, Artificial Sequence
  Synthetic
cgcgtacatggccaagctcca

SEQ ID NO: 18149 - DNA, 19 bp, Artificial Sequence
  Synthetic
aggtcctggactgcgtggt

SEQ ID NO: 18150 - DNA, 19 bp, Artificial Sequence
  Synthetic
agctcgtgctcccagaggc

SEQ ID NO: 18151 - DNA, 20 bp, Artificial Sequence
  Synthetic
gctccggggacagttctcca

SEQ ID NO: 18152 - DNA, 21 bp, Artificial Sequence
  Synthetic
gggcaggactagctcgtcgtc

SEQ ID NO: 18153 - DNA, 20 bp, Artificial Sequence
  Synthetic
cgatacacggcaacccccgg

SEQ ID NO: 18154 - DNA, 21 bp, Artificial Sequence
  Synthetic
ctggtgttcgaactgggccac

SEQ ID NO: 18155 - DNA, 21 bp, Artificial Sequence
  Synthetic
tggagcttgtggccctacacc

SEQ ID NO: 18156 - DNA, 22 bp, Artificial Sequence
  Synthetic
gcaagggggagctgctgatcta

SEQ ID NO: 18157 - DNA, 20 bp, Artificial Sequence
  Synthetic
tgaccacatggggccggtac

SEQ ID NO: 18158 - DNA, 20 bp, Artificial Sequence
  Synthetic
gctgctgccgacacaacgtc

SEQ ID NO: 18159 - DNA, 19 bp, Artificial Sequence
  Synthetic
tcgggctggcggtcgatct

SEQ ID NO: 18160 - DNA, 20 bp, Artificial Sequence
  Synthetic
ccacgacatccgcggcttta

SEQ ID NO: 18161 - DNA, 20 bp, Artificial Sequence
  Synthetic
caaggcggcccacttggaat

SEQ ID NO: 18162 - DNA, 22 bp, Artificial Sequence
  Synthetic
acgaagtgaaccaactgccgaa

SEQ ID NO: 18163 - DNA, 18 bp, Artificial Sequence
  Synthetic
acgatcgtgctgcgcgag

SEQ ID NO: 18164 - DNA, 21 bp, Artificial Sequence
  Synthetic
gctgacgcgtgcttttgttcc

SEQ ID NO: 18165 - DNA, 21 bp, Artificial Sequence
  Synthetic
agagctacgcgtacctctgcc

SEQ ID NO: 18166 - DNA, 19 bp, Artificial Sequence
  Synthetic
ccaccaacgtgccctaccc

SEQ ID NO: 18167 - DNA, 19 bp, Artificial Sequence
  Synthetic
ttgtgcgggaggggcttgg

SEQ ID NO: 18168 - DNA, 21 bp, Artificial Sequence
  Synthetic
ccccgcgggatcggatacaag

SEQ ID NO: 18169 - DNA, 19 bp, Artificial Sequence
  Synthetic
tggcacaacagacccgcgg

SEQ ID NO: 18170 - DNA, 19 bp, Artificial Sequence
  Synthetic
ggtccatgttcgagggcgg

SEQ ID NO: 18171 - DNA, 21 bp, Artificial Sequence
  Synthetic
tcgaaggcggaatagtggcgc

SEQ ID NO: 18172 - DNA, 19 bp, Artificial Sequence
  Synthetic
tgcaggcggttgtcgaggc

SEQ ID NO: 18173 - DNA, 22 bp, Artificial Sequence
  Synthetic
cgtcagcaccttcatcgacctg

SEQ ID NO: 18174 - DNA, 21 bp, Artificial Sequence
  Synthetic
gccgcacctcaaggaggaact

SEQ ID NO: 18175 - DNA, 19 bp, Artificial Sequence
  Synthetic
tccagcgcaaccagctccc

SEQ ID NO: 18176 - DNA, 18 bp, Artificial Sequence
  Synthetic
agaagttctgccggcggc

SEQ ID NO: 18177 - DNA, 19 bp, Artificial Sequence
  Synthetic
aggttccgaacgccgtcgg

SEQ ID NO: 18178 - DNA, 19 bp, Artificial Sequence
  Synthetic
tctgcgccaagtgcctggg

SEQ ID NO: 18179 - DNA, 18 bp, Artificial Sequence
  Synthetic
acgccggtgttctgcacg

SEQ ID NO: 18180 - DNA, 21 bp, Artificial Sequence
  Synthetic
gctgatccacatgctggccat

SEQ ID NO: 18181 - DNA, 18 bp, Artificial Sequence
  Synthetic
acgtgagggctcgcagga

SEQ ID NO: 18182 - DNA, 22 bp, Artificial Sequence
  Synthetic
tccctcagatgatagggcgtgt

SEQ ID NO: 18183 - DNA, 21 bp, Artificial Sequence
  Synthetic
ggagtcgaggaccttcagggc

SEQ ID NO: 18184 - DNA, 22 bp, Artificial Sequence
  Synthetic
cctgcatgccaatgcccatgga

SEQ ID NO: 18185 - DNA, 21 bp, Artificial Sequence
  Synthetic
cggcgggatccatggcgatat

SEQ ID NO: 18186 - DNA, 21 bp, Artificial Sequence
  Synthetic
ccacgaacacgagctcggtct

SEQ ID NO: 18187 - DNA, 19 bp, Artificial Sequence
  Synthetic
tcatccacgacgccccgga

SEQ ID NO: 18188 - DNA, 19 bp, Artificial Sequence
  Synthetic
accgaggaggcgtgggtga

SEQ ID NO: 18189 - DNA, 20 bp, Artificial Sequence
  Synthetic
acggatcggcgggcaaaaac

SEQ ID NO: 18190 - DNA, 21 bp, Artificial Sequence
  Synthetic
gcgaatagctacggccgcttg

SEQ ID NO: 18191 - DNA, 19 bp, Artificial Sequence
  Synthetic
cccgtcggtcgcatacagc

SEQ ID NO: 18192 - DNA, 19 bp, Artificial Sequence
  Synthetic
tgcacaacgtacggggcgg

SEQ ID NO: 18193 - DNA, 21 bp, Artificial Sequence
  Synthetic
tgacatagtccccgcccaggc

SEQ ID NO: 18194 - DNA, 19 bp, Artificial Sequence
  Synthetic
gttggtcccgacgctcagc

SEQ ID NO: 18195 - DNA, 19 bp, Artificial Sequence
  Synthetic
tggtgaagggcgacgaacg

SEQ ID NO: 18196 - DNA, 19 bp, Artificial Sequence
  Synthetic
agctgcaccagggtctggc

SEQ ID NO: 18197 - DNA, 22 bp, Artificial Sequence
  Synthetic
cgtggcattcagacagtacggg

SEQ ID NO: 18198 - DNA, 21 bp, Artificial Sequence
  Synthetic
accacacgacatgcaggcttc

SEQ ID NO: 18199 - DNA, 18 bp, Artificial Sequence
  Synthetic
aagtcgacacaccgcgcg

SEQ ID NO: 18200 - DNA, 21 bp, Artificial Sequence
  Synthetic
cccgtgcatgaagacctggat

SEQ ID NO: 18201 - DNA, 20 bp, Artificial Sequence
  Synthetic
gcatcatcccgcccgcatcc

SEQ ID NO: 18202 - DNA, 19 bp, Artificial Sequence
  Synthetic
acgcgtggtaggtcgctgg

SEQ ID NO: 18203 - DNA, 22 bp, Artificial Sequence
  Synthetic
tgggatcggccatcttaagcga

SEQ ID NO: 18204 - DNA, 20 bp, Artificial Sequence
  Synthetic
ggcatgtaggagcacgctgc

SEQ ID NO: 18205 - DNA, 21 bp, Artificial Sequence
  Synthetic
ccaaaacaaaccggctggcgt

SEQ ID NO: 18206 - DNA, 22 bp, Artificial Sequence
  Synthetic
cgtgctggccccttgatacgat

SEQ ID NO: 18207 - DNA, 22 bp, Artificial Sequence
  Synthetic
ccagccttgcaagcactctagt

SEQ ID NO: 18208 - DNA, 25 bp, Artificial Sequence
  Synthetic
acagcaatacaatacagcaaacagt

SEQ ID NO: 18209 - DNA, 22 bp, Artificial Sequence
  Synthetic
ccgtatcccagtgttgcttgct

SEQ ID NO: 18210 - DNA, 25 bp, Artificial Sequence
  Synthetic
acctccatagcacttatctcactat

SEQ ID NO: 18211 - DNA, 25 bp, Artificial Sequence
  Synthetic
gcactggtttacaattatttctggc

SEQ ID NO: 18212 - DNA, 23 bp, Artificial Sequence
  Synthetic
gacaccgcttattcacatactgt

SEQ ID NO: 18213 - DNA, 25 bp, Artificial Sequence
  Synthetic
ggtgataaccaaaaatgtgacccat

SEQ ID NO: 18214 - DNA, 25 bp, Artificial Sequence
  Synthetic
cccatttccacaatacaacttctgt

SEQ ID NO: 18215 - DNA, 20 bp, Artificial Sequence
  Synthetic
ggggttctctccctcgtgga

SEQ ID NO: 18216 - DNA, 25 bp, Artificial Sequence
  Synthetic
tgcctagcaagcattgtttaatgat

SEQ ID NO: 18217 - DNA, 21 bp, Artificial Sequence
  Synthetic
cactggatatggacgggcgtc

SEQ ID NO: 18218 - DNA, 20 bp, Artificial Sequence
  Synthetic
gtcaattgtgtccccccggg

SEQ ID NO: 18219 - DNA, 21 bp, Artificial Sequence
  Synthetic
gccagtagtgcgcctctggta

SEQ ID NO: 18220 - DNA, 20 bp, Artificial Sequence
  Synthetic
gcgtagggtctcctctcaca

SEQ ID NO: 18221 - DNA, 21 bp, Artificial Sequence
  Synthetic
gcagcatggaggaaagtactg

SEQ ID NO: 18222 - DNA, 25 bp, Artificial Sequence
  Synthetic
agggattttcagcatcatcaaactt

SEQ ID NO: 18223 - DNA, 24 bp, Artificial Sequence
  Synthetic
actcatgtctgcatcctcaatgta

SEQ ID NO: 18224 - DNA, 25 bp, Artificial Sequence
  Synthetic
ggtgtgccttaaaaactcaaaaaac

SEQ ID NO: 18225 - DNA, 25 bp, Artificial Sequence
  Synthetic
acctcccaaaacttaagatctttgt

SEQ ID NO: 18226 - DNA, 22 bp, Artificial Sequence
  Synthetic
ggggctattggcaagacagacc

SEQ ID NO: 18227 - DNA, 22 bp, Artificial Sequence
  Synthetic
tctccttcacaatcggatgaca

SEQ ID NO: 18228 - DNA, 23 bp, Artificial Sequence
  Synthetic
ggtgatatgtgaacagcatgcag

SEQ ID NO: 18229 - DNA, 25 bp, Artificial Sequence
  Synthetic
aggagctctctcatacagattcatt

SEQ ID NO: 18230 - DNA, 24 bp, Artificial Sequence
  Synthetic
gatcagcaagtgtttcaccttcta

SEQ ID NO: 18231 - DNA, 20 bp, Artificial Sequence
  Synthetic
ttgaactgcgcgggaaactt

SEQ ID NO: 18232 - DNA, 25 bp, Artificial Sequence
  Synthetic
gctcaggaattgctgataaatccat

SEQ ID NO: 18233 - DNA, 25 bp, Artificial Sequence
  Synthetic
ggtttccttcacatattcatccgta

SEQ ID NO: 18234 - DNA, 21 bp, Artificial Sequence
  Synthetic
aggaccacccctatccatttg

SEQ ID NO: 18235 - DNA, 25 bp, Artificial Sequence
  Synthetic
tttctgtaaaaatcagcaagctgtt

SEQ ID NO: 18236 - DNA, 23 bp, Artificial Sequence
  Synthetic
ccgttgcgcactaaatagaagtg

SEQ ID NO: 18237 - DNA, 22 bp, Artificial Sequence
  Synthetic
gaagagtacgaacagcagtagc

SEQ ID NO: 18238 - DNA, 24 bp, Artificial Sequence
  Synthetic
gagagatacatgaaccgtctgtac

SEQ ID NO: 18239 - DNA, 24 bp, Artificial Sequence
  Synthetic
atagcgactacctgagaagtactt

SEQ ID NO: 18240 - DNA, 23 bp, Artificial Sequence
  Synthetic
tgctgaagctgttcgatgatcta

SEQ ID NO: 18241 - DNA, 25 bp, Artificial Sequence
  Synthetic
tgcccaagtatcattggttatttca

SEQ ID NO: 18242 - DNA, 20 bp, Artificial Sequence
  Synthetic
atgtggacggggtgttgctg

SEQ ID NO: 18243 - DNA, 21 bp, Artificial Sequence
  Synthetic
cccgttcgctgagttgatcga

SEQ ID NO: 18244 - DNA, 23 bp, Artificial Sequence
  Synthetic
agcgcgctttgatctatacattt

SEQ ID NO: 18245 - DNA, 25 bp, Artificial Sequence
  Synthetic
tggtacagtctccggtaaaggtata

SEQ ID NO: 18246 - DNA, 25 bp, Artificial Sequence
  Synthetic
tccgctgcatctgtatatatttcat

SEQ ID NO: 18247 - DNA, 25 bp, Artificial Sequence
  Synthetic
tgatcctattcaagggttgtaactc

SEQ ID NO: 18248 - DNA, 24 bp, Artificial Sequence
  Synthetic
ctctctaagatcccgctcaaactc

SEQ ID NO: 18249 - DNA, 25 bp, Artificial Sequence
  Synthetic
cctccccctaatccatctactatag

SEQ ID NO: 18250 - DNA, 21 bp, Artificial Sequence
  Synthetic
gatgacccgatgttcccaatc

SEQ ID NO: 18251 - DNA, 24 bp, Artificial Sequence
  Synthetic
agccaatatcacacatatccccat

SEQ ID NO: 18252 - DNA, 25 bp, Artificial Sequence
  Synthetic
tcacagttgaacattcacagtacat

SEQ ID NO: 18253 - DNA, 25 bp, Artificial Sequence
  Synthetic
tctgaacttgcacttacctttacaa

SEQ ID NO: 18254 - DNA, 25 bp, Artificial Sequence
  Synthetic
cgtagtgtagtttgatacagttcct

SEQ ID NO: 18255 - DNA, 24 bp, Artificial Sequence
  Synthetic
gtactgctctgacaccttggatat

SEQ ID NO: 18256 - DNA, 25 bp, Artificial Sequence
  Synthetic
acctttttgtcactaggaaggtcta

SEQ ID NO: 18257 - DNA, 23 bp, Artificial Sequence
  Synthetic
gctaacgaagtgtccatgtgttc

SEQ ID NO: 18258 - DNA, 25 bp, Artificial Sequence
  Synthetic
aggaaatcctcaaaatgaattccct

SEQ ID NO: 18259 - DNA, 25 bp, Artificial Sequence
  Synthetic
gacaaaacctcgttgcttaaaaggt

SEQ ID NO: 18260 - DNA, 22 bp, Artificial Sequence
  Synthetic
gactcaactcagcaacagtctg

SEQ ID NO: 18261 - DNA, 25 bp, Artificial Sequence
  Synthetic
gcagaaatatgatttcccagtgtca

SEQ ID NO: 18262 - DNA, 25 bp, Artificial Sequence
  Synthetic
ggatcttaaatcagtttctcccctt

SEQ ID NO: 18263 - DNA, 21 bp, Artificial Sequence
  Synthetic
tgctccggaggttcgttctcc

SEQ ID NO: 18264 - DNA, 25 bp, Artificial Sequence
  Synthetic
cgatctgctaatgtattgccttcta

SEQ ID NO: 18265 - DNA, 20 bp, Artificial Sequence
  Synthetic
tgcttctgcatgcacacttg

SEQ ID NO: 18266 - DNA, 25 bp, Artificial Sequence
  Synthetic
ggcgggattttcaaattcaaattga

SEQ ID NO: 18267 - DNA, 25 bp, Artificial Sequence
  Synthetic
aggctctataggttcaattgcacta

SEQ ID NO: 18268 - DNA, 20 bp, Artificial Sequence
  Synthetic
tttgccacaggtttagccgg

SEQ ID NO: 18269 - DNA, 25 bp, Artificial Sequence
  Synthetic
cgttcaggattgaaaattgactgat

SEQ ID NO: 18270 - DNA, 20 bp, Artificial Sequence
  Synthetic
taggtggacagtctcctgca

SEQ ID NO: 18271 - DNA, 20 bp, Artificial Sequence
  Synthetic
aatggcgagcatacgactgc

SEQ ID NO: 18272 - DNA, 25 bp, Artificial Sequence
  Synthetic
gacatcttgttgccaaagatgttat

SEQ ID NO: 18273 - DNA, 25 bp, Artificial Sequence
  Synthetic
ggctatgttccaaacaacttacctt

SEQ ID NO: 18274 - DNA, 23 bp, Artificial Sequence
  Synthetic
cccttatcaacaaaactgcttgc

SEQ ID NO: 18275 - DNA, 25 bp, Artificial Sequence
  Synthetic
gcaacaaaaaaaagccttacacctc

SEQ ID NO: 18276 - DNA, 24 bp, Artificial Sequence
  Synthetic
tccacaggttcatcgtctagtaaa

SEQ ID NO: 18277 - DNA, 22 bp, Artificial Sequence
  Synthetic
attcattatggcggttcccatg

SEQ ID NO: 18278 - DNA, 22 bp, Artificial Sequence
  Synthetic
gatggtgtttcggaactgatcg

SEQ ID NO: 18279 - DNA, 23 bp, Artificial Sequence
  Synthetic
ttgctgttccaccaattggttta

SEQ ID NO: 18280 - DNA, 20 bp, Artificial Sequence
  Synthetic
gtgcttgtactaggacccgc

SEQ ID NO: 18281 - DNA, 25 bp, Artificial Sequence
  Synthetic
cctgtgacttttggtacttctactt

SEQ ID NO: 18282 - DNA, 25 bp, Artificial Sequence
  Synthetic
ggccatatctaatctgttgtcttct

SEQ ID NO: 18283 - DNA, 25 bp, Artificial Sequence
  Synthetic
accgtcttcctaaataagactgact

SEQ ID NO: 18284 - DNA, 21 bp, Artificial Sequence
  Synthetic
aattgttgggtgcggtaagga

SEQ ID NO: 18285 - DNA, 25 bp, Artificial Sequence
  Synthetic
tgcatgtgtctaaatcttcttgtct

SEQ ID NO: 18286 - DNA, 21 bp, Artificial Sequence
  Synthetic
tggtgctatgtttcttggagc

SEQ ID NO: 18287 - DNA, 25 bp, Artificial Sequence
  Synthetic
ccgcttttaatgcatctgaaacatt

SEQ ID NO: 18288 - DNA, 20 bp, Artificial Sequence
  Synthetic
gcaggctaggacacggtcac

SEQ ID NO: 18289 - DNA, 20 bp, Artificial Sequence
  Synthetic
gtgaattcagtgctggtgcc

SEQ ID NO: 18290 - DNA, 25 bp, Artificial Sequence
  Synthetic
gccaaatactcccatgtccttaaga

SEQ ID NO: 18291 - DNA, 20 bp, Artificial Sequence
  Synthetic
tgttgtagatggcgtcgctg

SEQ ID NO: 18292 - DNA, 25 bp, Artificial Sequence
  Synthetic
ccagtaaattctgtgcacattggtg

SEQ ID NO: 18293 - DNA, 25 bp, Artificial Sequence
  Synthetic
accaatgtagagttttgtgccaaat

SEQ ID NO: 18294 - DNA, 25 bp, Artificial Sequence
  Synthetic
ggattgtaagccaatatcccataca

SEQ ID NO: 18295 - DNA, 25 bp, Artificial Sequence
  Synthetic
tgcgttcttgtttttgatttctgtc

SEQ ID NO: 18296 - DNA, 23 bp, Artificial Sequence
  Synthetic
ctttgccatgtgtaatcatccca

SEQ ID NO: 18297 - DNA, 20 bp, Artificial Sequence
  Synthetic
tgcttccacatgtttggctc

SEQ ID NO: 18298 - DNA, 23 bp, Artificial Sequence
  Synthetic
ggagtagtaaacaccggatgtgc

SEQ ID NO: 18299 - DNA, 22 bp, Artificial Sequence
  Synthetic
gcaaaacagacataaccgcctc

SEQ ID NO: 18300 - DNA, 25 bp, Artificial Sequence
  Synthetic
cgagtcatgtatggatgctatttgt

SEQ ID NO: 18301 - DNA, 25 bp, Artificial Sequence
  Synthetic
tggatgtagttagtgatttgccaga

SEQ ID NO: 18302 - DNA, 20 bp, Artificial Sequence
  Synthetic
agtggggggacttagagtgt

SEQ ID NO: 18303 - DNA, 24 bp, Artificial Sequence
  Synthetic
gtgttggtaagacacagatacgat

SEQ ID NO: 18304 - DNA, 25 bp, Artificial Sequence
  Synthetic
gccatggttattggtcctacatcta

SEQ ID NO: 18305 - DNA, 23 bp, Artificial Sequence
  Synthetic
cttggttttggtgggtgtgttta

SEQ ID NO: 18306 - DNA, 24 bp, Artificial Sequence
  Synthetic
cctccccatactctttcattgttt

SEQ ID NO: 18307 - DNA, 22 bp, Artificial Sequence
  Synthetic
attcggaagtctaagtggtcgt

SEQ ID NO: 18308 - DNA, 23 bp, Artificial Sequence
  Synthetic
ctcatgcttgcaatgtgttcaat

SEQ ID NO: 18309 - DNA, 23 bp, Artificial Sequence
  Synthetic
gtcagtgagagaaaactccatgc

SEQ ID NO: 18310 - DNA, 22 bp, Artificial Sequence
  Synthetic
tttgacagaggactcagcttca

SEQ ID NO: 18311 - DNA, 25 bp, Artificial Sequence
  Synthetic
ggattcttctcctgtcttcctgatg

SEQ ID NO: 18312 - DNA, 25 bp, Artificial Sequence
  Synthetic
catgttttagcctttcgaccttttc

SEQ ID NO: 18313 - DNA, 23 bp, Artificial Sequence
  Synthetic
ccaccattaaaggggcaattttg

SEQ ID NO: 18314 - DNA, 21 bp, Artificial Sequence
  Synthetic
ggcacatctccaaaagcgaag

SEQ ID NO: 18315 - DNA, 23 bp, Artificial Sequence
  Synthetic
cccgaccattgtgaattcctcat

SEQ ID NO: 18316 - DNA, 21 bp, Artificial Sequence
  Synthetic
aggacctttgcatccttttgg

SEQ ID NO: 18317 - DNA, 22 bp, Artificial Sequence
  Synthetic
cagcttttctgttccctgtgtt

SEQ ID NO: 18318 - DNA, 20 bp, Artificial Sequence
  Synthetic
catcctactctgcttcggcg

SEQ ID NO: 18319 - DNA, 25 bp, Artificial Sequence
  Synthetic
gctaccaaatcaaatttctcttgca

SEQ ID NO: 18320 - DNA, 25 bp, Artificial Sequence
  Synthetic
cgagactgtagaatcacaatcactt

SEQ ID NO: 18321 - DNA, 22 bp, Artificial Sequence
  Synthetic
gttcagcttcatcttcgcctaa

SEQ ID NO: 18322 - DNA, 22 bp, Artificial Sequence
  Synthetic
gctcagcgacagagttggtggt

SEQ ID NO: 18323 - DNA, 25 bp, Artificial Sequence
  Synthetic
gaagtcgttcaagtctcgatagacc

SEQ ID NO: 18324 - DNA, 20 bp, Artificial Sequence
  Synthetic
tgacctccaccacccttacc

SEQ ID NO: 18325 - DNA, 25 bp, Artificial Sequence
  Synthetic
acaccagttacttcagaaacaagat

SEQ ID NO: 18326 - DNA, 24 bp, Artificial Sequence
  Synthetic
gcgccttatattagcaggatgtat

SEQ ID NO: 18327 - DNA, 25 bp, Artificial Sequence
  Synthetic
cgtcattcaaaacgtcaaagtaagg

SEQ ID NO: 18328 - DNA, 25 bp, Artificial Sequence
  Synthetic
gggcataaacattaggattttccgt

SEQ ID NO: 18329 - DNA, 22 bp, Artificial Sequence
  Synthetic
ggaggctgcacgacactcatac

SEQ ID NO: 18330 - DNA, 19 bp, Artificial Sequence
  Synthetic
accaacgatctggccgccg

SEQ ID NO: 18331 - DNA, 20 bp, Artificial Sequence
  Synthetic
gctctcacgcaaggcacaca

SEQ ID NO: 18332 - DNA, 22 bp, Artificial Sequence
  Synthetic
ttcgggcactctcagaatgctc

SEQ ID NO: 18333 - DNA, 20 bp, Artificial Sequence
  Synthetic
gttccaagggcttgcatgcg

SEQ ID NO: 18334 - DNA, 21 bp, Artificial Sequence
  Synthetic
agagttcatccacgtgcaccc

SEQ ID NO: 18335 - DNA, 21 bp, Artificial Sequence
  Synthetic
gggcatggtggtaaagctgca

SEQ ID NO: 18336 - DNA, 19 bp, Artificial Sequence
  Synthetic
acaccaaccggcggtaccc

SEQ ID NO: 18337 - DNA, 19 bp, Artificial Sequence
  Synthetic
acgcagcggtgtctgcacc

SEQ ID NO: 18338 - DNA, 22 bp, Artificial Sequence
  Synthetic
agccagcaccgtgataaacagt

SEQ ID NO: 18339 - DNA, 18 bp, Artificial Sequence
  Synthetic
ttggccacgcccctcgta

SEQ ID NO: 18340 - DNA, 22 bp, Artificial Sequence
  Synthetic
ggagtggcactcgtcacagatg

SEQ ID NO: 18341 - DNA, 20 bp, Artificial Sequence
  Synthetic
cgcctgaggtggggatcaca

SEQ ID NO: 18342 - DNA, 20 bp, Artificial Sequence
  Synthetic
agcttcacagagcacgacgc

SEQ ID NO: 18343 - DNA, 22 bp, Artificial Sequence
  Synthetic
taggaggggggtaggacctgtg

SEQ ID NO: 18344 - DNA, 22 bp, Artificial Sequence
  Synthetic
cagcccaaggaccttttgcttg

SEQ ID NO: 18345 - DNA, 19 bp, Artificial Sequence
  Synthetic
aagctgtggacgcggaggg

SEQ ID NO: 18346 - DNA, 21 bp, Artificial Sequence
  Synthetic
gtttgatgcgtccgtctcggg

SEQ ID NO: 18347 - DNA, 22 bp, Artificial Sequence
  Synthetic
tccggggtcctgtgatcttcat

SEQ ID NO: 18348 - DNA, 22 bp, Artificial Sequence
  Synthetic
gcccacagagaagctcacctca

SEQ ID NO: 18349 - DNA, 22 bp, Artificial Sequence
  Synthetic
ggtggtctatggcactctgctg

SEQ ID NO: 18350 - DNA, 20 bp, Artificial Sequence
  Synthetic
gccggctattgaccctccga

SEQ ID NO: 18351 - DNA, 22 bp, Artificial Sequence
  Synthetic
acccgcacggataagtctggat

SEQ ID NO: 18352 - DNA, 20 bp, Artificial Sequence
  Synthetic
tggcacggcatctgcgatag

SEQ ID NO: 18353 - DNA, 22 bp, Artificial Sequence
  Synthetic
tggtacagtcacgggtgaggta

SEQ ID NO: 18354 - DNA, 20 bp, Artificial Sequence
  Synthetic
cgctcccaccctgttgagtt

SEQ ID NO: 18355 - DNA, 25 bp, Artificial Sequence
  Synthetic
gcaatgtaggcttcaatgttctcat

SEQ ID NO: 18356 - DNA, 25 bp, Artificial Sequence
  Synthetic
gtcaattcaacaactgcatggtagg

SEQ ID NO: 18357 - DNA, 25 bp, Artificial Sequence
  Synthetic
cgatgtgcttttccattatccattt

SEQ ID NO: 18358 - DNA, 20 bp, Artificial Sequence
  Synthetic
ggagtgatgcttctgcgatg

SEQ ID NO: 18359 - DNA, 24 bp, Artificial Sequence
  Synthetic
ctaaccatagcagagaccaaactg

SEQ ID NO: 18360 - DNA, 25 bp, Artificial Sequence
  Synthetic
tggttttttgggtcttttcactctt

SEQ ID NO: 18361 - DNA, 24 bp, Artificial Sequence
  Synthetic
gccaaatcttgtaagcatacagga

SEQ ID NO: 18362 - DNA, 21 bp, Artificial Sequence
  Synthetic
acacctgttccacaagtgtga

SEQ ID NO: 18363 - DNA, 25 bp, Artificial Sequence
  Synthetic
tcttctaggattccactgtcatcaa

SEQ ID NO: 18364 - DNA, 25 bp, Artificial Sequence
  Synthetic
ccaaacacatatgaagcatttccaa

SEQ ID NO: 18365 - DNA, 25 bp, Artificial Sequence
  Synthetic
gaaggttctgttggcacatctatat

SEQ ID NO: 18366 - DNA, 25 bp, Artificial Sequence
  Synthetic
cattgtattcagaaactaccagtgc

SEQ ID NO: 18367 - DNA, 25 bp, Artificial Sequence
  Synthetic
gcacagtccattctccagttttact

SEQ ID NO: 18368 - DNA, 24 bp, Artificial Sequence
  Synthetic
gcatttgcccctcctctaattata

SEQ ID NO: 18369 - DNA, 23 bp, Artificial Sequence
  Synthetic
tgccatctggaattactctgcta

SEQ ID NO: 18370 - DNA, 25 bp, Artificial Sequence
  Synthetic
cgtatcctattcaaaccttgactga

SEQ ID NO: 18371 - DNA, 25 bp, Artificial Sequence
  Synthetic
agcctcagtaaatgctgtattctgt

SEQ ID NO: 18372 - DNA, 25 bp, Artificial Sequence
  Synthetic
gaccaacaccttagattgatctaca

SEQ ID NO: 18373 - DNA, 25 bp, Artificial Sequence
  Synthetic
ccttgttctcgctttccataaaaga

SEQ ID NO: 18374 - DNA, 25 bp, Artificial Sequence
  Synthetic
cctgtagtggaattttacaaagctg

SEQ ID NO: 18375 - DNA, 23 bp, Artificial Sequence
  Synthetic
actcaagctgaagtgtgcaaatt

SEQ ID NO: 18376 - DNA, 25 bp, Artificial Sequence
  Synthetic
acgttatctccctcttaagtttcct

SEQ ID NO: 18377 - DNA, 25 bp, Artificial Sequence
  Synthetic
cgcatttgaaaaaaagacgatcaag

SEQ ID NO: 18378 - DNA, 25 bp, Artificial Sequence
  Synthetic
tcatctgatatagcatcccctgttt

SEQ ID NO: 18379 - DNA, 23 bp, Artificial Sequence
  Synthetic
ctgctgagtttccacttcagtat

SEQ ID NO: 18380 - DNA, 25 bp, Artificial Sequence
  Synthetic
tgtgttagtattttgtcctgacaca

SEQ ID NO: 18381 - DNA, 25 bp, Artificial Sequence
  Synthetic
gcacttccactgtatatccatgttt

SEQ ID NO: 18382 - DNA, 25 bp, Artificial Sequence
  Synthetic
aggtgtggtatcagttgaagtagta

SEQ ID NO: 18383 - DNA, 25 bp, Artificial Sequence
  Synthetic
gcttacaaccttagatactgggaca

SEQ ID NO: 18384 - DNA, 20 bp, Artificial Sequence
  Synthetic
ctacacaggcccaaaccagc

SEQ ID NO: 18385 - DNA, 24 bp, Artificial Sequence
  Synthetic
tcaccatcctgaataactgtgttt

SEQ ID NO: 18386 - DNA, 25 bp, Artificial Sequence
  Synthetic
cagtagacccagagcctttaatgta

SEQ ID NO: 18387 - DNA, 25 bp, Artificial Sequence
  Synthetic
ctgatctaggtctgcagaaaacttt

SEQ ID NO: 18388 - DNA, 25 bp, Artificial Sequence
  Synthetic
gcaggaaacgtacaagtttaaacca

SEQ ID NO: 18389 - DNA, 25 bp, Artificial Sequence
  Synthetic
tgtgcataactgtggtaactttctg

SEQ ID NO: 18390 - DNA, 25 bp, Artificial Sequence
  Synthetic
tctttgctttttgtccagatgtctt

SEQ ID NO: 18391 - DNA, 20 bp, Artificial Sequence
  Synthetic
gttctgcttgtccagctgga

SEQ ID NO: 18392 - DNA, 24 bp, Artificial Sequence
  Synthetic
tcgattttcggatcttccccatat

SEQ ID NO: 18393 - DNA, 24 bp, Artificial Sequence
  Synthetic
agtcatacagatccgggagaaatt

SEQ ID NO: 18394 - DNA, 24 bp, Artificial Sequence
  Synthetic
tcttcatgttctttgtccttggaa

SEQ ID NO: 18395 - DNA, 20 bp, Artificial Sequence
  Synthetic
ccgtctcatgcttgcaatgt

SEQ ID NO: 18396 - DNA, 23 bp, Artificial Sequence
  Synthetic
cttgggtcggtaagggaaaattc

SEQ ID NO: 18397 - DNA, 25 bp, Artificial Sequence
  Synthetic
tcaaagaattctttggtcaggtctt

SEQ ID NO: 18398 - DNA, 24 bp, Artificial Sequence
  Synthetic
ttctctgtgtgaccattttcttgg

SEQ ID NO: 18399 - DNA, 23 bp, Artificial Sequence
  Synthetic
gctttcttctcattccctccgac

SEQ ID NO: 18400 - DNA, 25 bp, Artificial Sequence
  Synthetic
tgtgtccgtaacttcatactcttac

SEQ ID NO: 18401 - DNA, 20 bp, Artificial Sequence
  Synthetic
tctgaggattggagtccgtc

SEQ ID NO: 18402 - DNA, 25 bp, Artificial Sequence
  Synthetic
ctggtccaagatcgttgtttatcat

SEQ ID NO: 18403 - DNA, 25 bp, Artificial Sequence
  Synthetic
atcaattcccatttcaagcagacct

SEQ ID NO: 18404 - DNA, 24 bp, Artificial Sequence
  Synthetic
caagagaaattcccaccagagttt

SEQ ID NO: 18405 - DNA, 25 bp, Artificial Sequence
  Synthetic
tcagatacctcgaaagactcctgat

SEQ ID NO: 18406 - DNA, 25 bp, Artificial Sequence
  Synthetic
cctcagcaggtatatcctcataaca

SEQ ID NO: 18407 - DNA, 25 bp, Artificial Sequence
  Synthetic
tgcctcatccacaatataccaatca

SEQ ID NO: 18408 - DNA, 20 bp, Artificial Sequence
  Synthetic
ggcagtctctgtggcacttg

SEQ ID NO: 18409 - DNA, 25 bp, Artificial Sequence
  Synthetic
ggcaagtagagcagatcttgtatta

SEQ ID NO: 18410 - DNA, 24 bp, Artificial Sequence
  Synthetic
aagtctaactggctccaaaacctt

SEQ ID NO: 18411 - DNA, 25 bp, Artificial Sequence
  Synthetic
tgaggccactaagataaagagtcat

SEQ ID NO: 18412 - DNA, 22 bp, Artificial Sequence
  Synthetic
cgatttcgggtggtgtctcgac

SEQ ID NO: 18413 - DNA, 25 bp, Artificial Sequence
  Synthetic
cgtcgtttacgtactcttaacatga

SEQ ID NO: 18414 - DNA, 22 bp, Artificial Sequence
  Synthetic
tgggaacgtgtgattgtacgtg

SEQ ID NO: 18415 - DNA, 21 bp, Artificial Sequence
  Synthetic
agaaacgtgtaggcctttcct

SEQ ID NO: 18416 - DNA, 25 bp, Artificial Sequence
  Synthetic
gccatcatttgaggagatagagcta

SEQ ID NO: 18417 - DNA, 24 bp, Artificial Sequence
  Synthetic
atgaactaatttgcgacgtttacg

SEQ ID NO: 18418 - DNA, 25 bp, Artificial Sequence
  Synthetic
ctggaaatctaacacgaaagactct

SEQ ID NO: 18419 - DNA, 20 bp, Artificial Sequence
  Synthetic
ttgaccagtgttccccagtg

SEQ ID NO: 18420 - DNA, 22 bp, Artificial Sequence
  Synthetic
cagtttttggaacagaacgctg

SEQ ID NO: 18421 - DNA, 25 bp, Artificial Sequence
  Synthetic
gtcatgaggctatatgactaggcaa

SEQ ID NO: 18422 - DNA, 22 bp, Artificial Sequence
  Synthetic
cagatgctctgatttctgtggc

SEQ ID NO: 18423 - DNA, 24 bp, Artificial Sequence
  Synthetic
cctccagaaatttcggtcattgat

SEQ ID NO: 18424 - DNA, 22 bp, Artificial Sequence
  Synthetic
gtcatgcccacttgctactgca

SEQ ID NO: 18425 - DNA, 20 bp, Artificial Sequence
  Synthetic
tggacccctcttgtggaaag

SEQ ID NO: 18426 - DNA, 25 bp, Artificial Sequence
  Synthetic
gagaacatgaaataaagggctctct

SEQ ID NO: 18427 - DNA, 25 bp, Artificial Sequence
  Synthetic
cgttgtattttaatacagccactgc

SEQ ID NO: 18428 - DNA, 22 bp, Artificial Sequence
  Synthetic
tctgcacacacacatcactttg

SEQ ID NO: 18429 - DNA, 24 bp, Artificial Sequence
  Synthetic
gatcccaaatcatctcaaacccat

SEQ ID NO: 18430 - DNA, 23 bp, Artificial Sequence
  Synthetic
gagttttcaaagatccctgggtg

SEQ ID NO: 18431 - DNA, 22 bp, Artificial Sequence
  Synthetic
gccttcttttcattccctccga

SEQ ID NO: 18432 - DNA, 24 bp, Artificial Sequence
  Synthetic
ctttccctaatcttgccatcttgt

SEQ ID NO: 18433 - DNA, 20 bp, Artificial Sequence
  Synthetic
gtccgtcccaccagtatgtg

SEQ ID NO: 18434 - DNA, 22 bp, Artificial Sequence
  Synthetic
accaatgctcatgtcagccgat

SEQ ID NO: 18435 - DNA, 20 bp, Artificial Sequence
  Synthetic
atcctcaaagcgcgccatag

SEQ ID NO: 18436 - DNA, 25 bp, Artificial Sequence
  Synthetic
tgtctccatacacagagtctgaata

SEQ ID NO: 18437 - DNA, 23 bp, Artificial Sequence
  Synthetic
ttggggctctaaatgcaatacaa

SEQ ID NO: 18438 - DNA, 20 bp, Artificial Sequence
  Synthetic
gcatcattgtggacctcctg

SEQ ID NO: 18439 - DNA, 20 bp, Artificial Sequence
  Synthetic
atacattgccgccatgttcg

SEQ ID NO: 18440 - DNA, 25 bp, Artificial Sequence
  Synthetic
acatctaaatcgtatccactgtgac

SEQ ID NO: 18441 - DNA, 22 bp, Artificial Sequence
  Synthetic
atgttcccttgctgcaaagaat

SEQ ID NO: 18442 - DNA, 23 bp, Artificial Sequence
  Synthetic
ccatgttcctgcatcagtcatat

SEQ ID NO: 18443 - DNA, 21 bp, Artificial Sequence
  Synthetic
ggtgctggaatacggtgaggg

SEQ ID NO: 18444 - DNA, 25 bp, Artificial Sequence
  Synthetic
tgccaggtggatgatatatctctat

SEQ ID NO: 18445 - DNA, 22 bp, Artificial Sequence
  Synthetic
ataccaatacccatgcatacgc

SEQ ID NO: 18446 - DNA, 25 bp, Artificial Sequence
  Synthetic
aacatcactacgaggatcaaatgtt

SEQ ID NO: 18447 - DNA, 22 bp, Artificial Sequence
  Synthetic
agggtccatgtcatctgcatat

SEQ ID NO: 18448 - DNA, 24 bp, Artificial Sequence
  Synthetic
cacagcccaaaatacataactgtg

SEQ ID NO: 18449 - DNA, 24 bp, Artificial Sequence
  Synthetic
tgctctattccaaaaatgcctagc

SEQ ID NO: 18450 - DNA, 25 bp, Artificial Sequence
  Synthetic
gagactgtgtagaagcacatattgt

SEQ ID NO: 18451 - DNA, 22 bp, Artificial Sequence
  Synthetic
tgctgtaaggtgtgcagtttta

SEQ ID NO: 18452 - DNA, 25 bp, Artificial Sequence
  Synthetic
cggtataagggaaagttgtgcttat

SEQ ID NO: 18453 - DNA, 25 bp, Artificial Sequence
  Synthetic
cgagttttcaaaaataccaggatgg

SEQ ID NO: 18454 - DNA, 20 bp, Artificial Sequence
  Synthetic
tctcattgcctccaactggc

SEQ ID NO: 18455 - DNA, 24 bp, Artificial Sequence
  Synthetic
ccatcccaccagtaagtagtcttg

SEQ ID NO: 18456 - DNA, 20 bp, Artificial Sequence
  Synthetic
ctgactcgttgctcccagac

SEQ ID NO: 18457 - DNA, 25 bp, Artificial Sequence
  Synthetic
actgctggggaagaatttttcaaat

SEQ ID NO: 18458 - DNA, 20 bp, Artificial Sequence
  Synthetic
acaggatccaccgcctttcg

SEQ ID NO: 18459 - DNA, 22 bp, Artificial Sequence
  Synthetic
ggagcccacaacaatagtgggc

SEQ ID NO: 18460 - DNA, 20 bp, Artificial Sequence
  Synthetic
ggctccgccaaacttcccaa

SEQ ID NO: 18461 - DNA, 20 bp, Artificial Sequence
  Synthetic
gtgcctcgcccaccactaaa

SEQ ID NO: 18462 - DNA, 22 bp, Artificial Sequence
  Synthetic
gccgacactgtgccaagaacct

SEQ ID NO: 18463 - DNA, 22 bp, Artificial Sequence
  Synthetic
gctcacagtcatgttgacccca

SEQ ID NO: 18464 - DNA, 22 bp, Artificial Sequence
  Synthetic
ggcggccctttttgacatggat

SEQ ID NO: 18465 - DNA, 22 bp, Artificial Sequence
  Synthetic
ggcggcgttactgactgaatca

SEQ ID NO: 18466 - DNA, 22 bp, Artificial Sequence
  Synthetic
agcatctggcagtgccgagaac

SEQ ID NO: 18467 - DNA, 20 bp, Artificial Sequence
  Synthetic
gcggttgcctatgggagtgt

SEQ ID NO: 18468 - DNA, 19 bp, Artificial Sequence
  Synthetic
ctggcttcacagcgacggg

SEQ ID NO: 18469 - DNA, 20 bp, Artificial Sequence
  Synthetic
ctggttgaccaccacctggc

SEQ ID NO: 18470 - DNA, 21 bp, Artificial Sequence
  Synthetic
gacccgattgccacgatgcaa

SEQ ID NO: 18471 - DNA, 22 bp, Artificial Sequence
  Synthetic
catgcccagaacactaacgccg

SEQ ID NO: 18472 - DNA, 22 bp, Artificial Sequence
  Synthetic
cgtcctctcgcactcaaccttt

SEQ ID NO: 18473 - DNA, 22 bp, Artificial Sequence
  Synthetic
ccagcgcggagtagtagtgtcc

SEQ ID NO: 18474 - DNA, 22 bp, Artificial Sequence
  Synthetic
ggcccccccacctgagtaataa

SEQ ID NO: 18475 - DNA, 19 bp, Artificial Sequence
  Synthetic
tcacaggggtagcgctccc

SEQ ID NO: 18476 - DNA, 22 bp, Artificial Sequence
  Synthetic
ccaccccgagaggtggattcct

SEQ ID NO: 18477 - DNA, 20 bp, Artificial Sequence
  Synthetic
gccaggcaggagatgatgca

SEQ ID NO: 18478 - DNA, 20 bp, Artificial Sequence
  Synthetic
agagggattttgaggcgcgg

SEQ ID NO: 18479 - DNA, 20 bp, Artificial Sequence
  Synthetic
cgtcaccgtaaccgtgccag

SEQ ID NO: 18480 - DNA, 21 bp, Artificial Sequence
  Synthetic
catcctccagagcctgcaagg

SEQ ID NO: 18481 - DNA, 22 bp, Artificial Sequence
  Synthetic
caatgtcccccactgtgtctgt

SEQ ID NO: 18482 - DNA, 22 bp, Artificial Sequence
  Synthetic
acagttatcgcagccggatgtt

SEQ ID NO: 18483 - DNA, 22 bp, Artificial Sequence
  Synthetic
gccgagcaacactcagctgtat

SEQ ID NO: 18484 - DNA, 22 bp, Artificial Sequence
  Synthetic
atccggtgatgaaccacttcgg

SEQ ID NO: 18485 - DNA, 24 bp, Artificial Sequence
  Synthetic
tgccacagaaattgcaaggtatta

SEQ ID NO: 18486 - DNA, 20 bp, Artificial Sequence
  Synthetic
attcccttccaggcgttcct

SEQ ID NO: 18487 - DNA, 25 bp, Artificial Sequence
  Synthetic
tgctccagttcagtatcatctaaca

SEQ ID NO: 18488 - DNA, 25 bp, Artificial Sequence
  Synthetic
gcagtgtaatgtatatctacgtccc

SEQ ID NO: 18489 - DNA, 23 bp, Artificial Sequence
  Synthetic
ggacccagatatagtcacaatgc

SEQ ID NO: 18490 - DNA, 25 bp, Artificial Sequence
  Synthetic
tggtatgctatatctgcttcgtcta

SEQ ID NO: 18491 - DNA, 24 bp, Artificial Sequence
  Synthetic
acactctacccttcaacactctta

SEQ ID NO: 18492 - DNA, 25 bp, Artificial Sequence
  Synthetic
gccttgtaaaaaaagatttccagct

SEQ ID NO: 18493 - DNA, 19 bp, Artificial Sequence
  Synthetic
gtcgcgggggtggtgtttg

SEQ ID NO: 18494 - DNA, 21 bp, Artificial Sequence
  Synthetic
ctccccttctgcaggtggttg

SEQ ID NO: 18495 - DNA, 24 bp, Artificial Sequence
  Synthetic
agcttcttccagtaatcttccaag

SEQ ID NO: 18496 - DNA, 22 bp, Artificial Sequence
  Synthetic
caggttgccataggccttatca

SEQ ID NO: 18497 - DNA, 22 bp, Artificial Sequence
  Synthetic
gcccctcaggtacaggatggat

SEQ ID NO: 18498 - DNA, 25 bp, Artificial Sequence
  Synthetic
ggttcttcaaagacatccagatcat

SEQ ID NO: 18499 - DNA, 25 bp, Artificial Sequence
  Synthetic
tttctgcattattacgtgactctgg

SEQ ID NO: 18500 - DNA, 25 bp, Artificial Sequence
  Synthetic
ggatcaaaagatgtatcctgtctgt

SEQ ID NO: 18501 - DNA, 25 bp, Artificial Sequence
  Synthetic
ccactaacagttgggaaatacatgg

SEQ ID NO: 18502 - DNA, 25 bp, Artificial Sequence
  Synthetic
cgttttgttcctctattagaccctt

SEQ ID NO: 18503 - DNA, 25 bp, Artificial Sequence
  Synthetic
tgggttggtacattcattgaaatgt

SEQ ID NO: 18504 - DNA, 25 bp, Artificial Sequence
  Synthetic
acataaggttctcttgtcacccaaa

SEQ ID NO: 18505 - DNA, 23 bp, Artificial Sequence
  Synthetic
ccccagtgacacaaacatgtaac

SEQ ID NO: 18506 - DNA, 20 bp, Artificial Sequence
  Synthetic
ataccgggggtaacaggagc

SEQ ID NO: 18507 - DNA, 22 bp, Artificial Sequence
  Synthetic
agcgcgaatctttcttgattgt

SEQ ID NO: 18508 - DNA, 25 bp, Artificial Sequence
  Synthetic
ggtgttttatcgattgttccggtat

SEQ ID NO: 18509 - DNA, 22 bp, Artificial Sequence
  Synthetic
gtccagctttgaccatcatctg

SEQ ID NO: 18510 - DNA, 25 bp, Artificial Sequence
  Synthetic
tgggattgactttgtttttgtctga

SEQ ID NO: 18511 - DNA, 23 bp, Artificial Sequence
  Synthetic
ccgaaagtggtgcatagtttctt

SEQ ID NO: 18512 - DNA, 25 bp, Artificial Sequence
  Synthetic
ctacagcaatttctccaatgacaac

SEQ ID NO: 18513 - DNA, 25 bp, Artificial Sequence
  Synthetic
gctctccaatcaataattgctcaaa

SEQ ID NO: 18514 - DNA, 25 bp, Artificial Sequence
  Synthetic
gttcattaaacaatgccagggaatt

SEQ ID NO: 18515 - DNA, 25 bp, Artificial Sequence
  Synthetic
tggctcatcatggagattgttatca

SEQ ID NO: 18516 - DNA, 25 bp, Artificial Sequence
  Synthetic
cacccaggataggttacatcatcta

SEQ ID NO: 18517 - DNA, 25 bp, Artificial Sequence
  Synthetic
tggatcttctttaggctctagatca

SEQ ID NO: 18518 - DNA, 21 bp, Artificial Sequence
  Synthetic
tcgtcttggggtttgcggtac

SEQ ID NO: 18519 - DNA, 25 bp, Artificial Sequence
  Synthetic
tgatgtggtgtctgttacaatgttt

SEQ ID NO: 18520 - DNA, 25 bp, Artificial Sequence
  Synthetic
tgctagtagttggtaagtcctcaat

SEQ ID NO: 18521 - DNA, 25 bp, Artificial Sequence
  Synthetic
tgcgtttcagtacactaggatgtat

SEQ ID NO: 18522 - DNA, 25 bp, Artificial Sequence
  Synthetic
tgtttggatctggaaattgtagtct

SEQ ID NO: 18523 - DNA, 20 bp, Artificial Sequence
  Synthetic
ccccatcctctgcttgcttt

SEQ ID NO: 18524 - DNA, 25 bp, Artificial Sequence
  Synthetic
aggccaaatactgatttcattcgta

SEQ ID NO: 18525 - DNA, 23 bp, Artificial Sequence
  Synthetic
tggctcctaatgccctatgtaaa

SEQ ID NO: 18526 - DNA, 25 bp, Artificial Sequence
  Synthetic
gctgtcctctttgatacaaaaatcg

SEQ ID NO: 18527 - DNA, 21 bp, Artificial Sequence
  Synthetic
gggaatgtggtgcttatggca

SEQ ID NO: 18528 - DNA, 22 bp, Artificial Sequence
  Synthetic
tcaaagatacctgggtgggatt

SEQ ID NO: 18529 - DNA, 25 bp, Artificial Sequence
  Synthetic
ggtcatgttgtctcttactctcctt

SEQ ID NO: 18530 - DNA, 20 bp, Artificial Sequence
  Synthetic
attacccccaaccggaagtc

SEQ ID NO: 18531 - DNA, 25 bp, Artificial Sequence
  Synthetic
tctcttactctcgaacatgtatcct

SEQ ID NO: 18532 - DNA, 21 bp, Artificial Sequence
  Synthetic
gcccatcccaccagtatgttg

SEQ ID NO: 18533 - DNA, 25 bp, Artificial Sequence
  Synthetic
ccaaggtcattgtttatcatgttgt

SEQ ID NO: 18534 - DNA, 25 bp, Artificial Sequence
  Synthetic
ggatgtgaaggttccggatattgta

SEQ ID NO: 18535 - DNA, 20 bp, Artificial Sequence
  Synthetic
ctcgaacaagttgcagcact

SEQ ID NO: 18536 - DNA, 23 bp, Artificial Sequence
  Synthetic
tcagtctccttcaaatctgtgct

SEQ ID NO: 18537 - DNA, 25 bp, Artificial Sequence
  Synthetic
tcagattctgctatgtcatcagttt

SEQ ID NO: 18538 - DNA, 20 bp, Artificial Sequence
  Synthetic
atgcaccgctgaaagtctcg

SEQ ID NO: 18539 - DNA, 25 bp, Artificial Sequence
  Synthetic
gctagtgacagaggaatgaatagtt

SEQ ID NO: 18540 - DNA, 24 bp, Artificial Sequence
  Synthetic
gcaatttagcatcacccctgtatc

SEQ ID NO: 18541 - DNA, 25 bp, Artificial Sequence
  Synthetic
tccaattcccaaattgccaaagtat

SEQ ID NO: 18542 - DNA, 20 bp, Artificial Sequence
  Synthetic
atcagttccacctgctgcag

SEQ ID NO: 18543 - DNA, 25 bp, Artificial Sequence
  Synthetic
aaacgttccaaaggtatctcttcat

SEQ ID NO: 18544 - DNA, 21 bp, Artificial Sequence
  Synthetic
cccgctcaaagtataggctca

SEQ ID NO: 18545 - DNA, 25 bp, Artificial Sequence
  Synthetic
gcgtgcatgaaagtaaacatcagtt

SEQ ID NO: 18546 - DNA, 24 bp, Artificial Sequence
  Synthetic
gatgaccagtagatccaacaccta

SEQ ID NO: 18547 - DNA, 25 bp, Artificial Sequence
  Synthetic
aggaaagtttgcattaccaaatcct

SEQ ID NO: 18548 - DNA, 25 bp, Artificial Sequence
  Synthetic
cgttacaaagcagattaacaggcaa

SEQ ID NO: 18549 - DNA, 25 bp, Artificial Sequence
  Synthetic
actgtccacaaatagacgtctttta

SEQ ID NO: 18550 - DNA, 20 bp, Artificial Sequence
  Synthetic
ctggtgtccccgtcgctttg

SEQ ID NO: 18551 - DNA, 25 bp, Artificial Sequence
  Synthetic
agcgatatctccagcattttaatgt

SEQ ID NO: 18552 - DNA, 24 bp, Artificial Sequence
  Synthetic
acaggttcaaccactatgtttggt

SEQ ID NO: 18553 - DNA, 20 bp, Artificial Sequence
  Synthetic
tataggggctgctggttgca

SEQ ID NO: 18554 - DNA, 23 bp, Artificial Sequence
  Synthetic
gctctactaaaagctcttggtgt

SEQ ID NO: 18555 - DNA, 25 bp, Artificial Sequence
  Synthetic
catgtgagttactgaaatcctctgt

SEQ ID NO: 18556 - DNA, 24 bp, Artificial Sequence
  Synthetic
ggcagccaatatgacatctgtaaa

SEQ ID NO: 18557 - DNA, 22 bp, Artificial Sequence
  Synthetic
accctattgcaacacgtttacg

SEQ ID NO: 18558 - DNA, 24 bp, Artificial Sequence
  Synthetic
caggatatacctatgaagggtggg

SEQ ID NO: 18559 - DNA, 25 bp, Artificial Sequence
  Synthetic
gcgacaaaaggtacaaggtagtcta

SEQ ID NO: 18560 - DNA, 25 bp, Artificial Sequence
  Synthetic
caaactctgcacactgaatctattc

SEQ ID NO: 18561 - DNA, 25 bp, Artificial Sequence
  Synthetic
ccactgttctcaaacaatcgtcttt

SEQ ID NO: 18562 - DNA, 25 bp, Artificial Sequence
  Synthetic
tgtagcatttccagttgtacactta

SEQ ID NO: 18563 - DNA, 25 bp, Artificial Sequence
  Synthetic
gttgaatccaaaaatgactgtgact

SEQ ID NO: 18564 - DNA, 20 bp, Artificial Sequence
  Synthetic
gcttcttgcacagcatcgaa

SEQ ID NO: 18565 - DNA, 25 bp, Artificial Sequence
  Synthetic
agaggtaacagagggagaaatagtt

SEQ ID NO: 18566 - DNA, 25 bp, Artificial Sequence
  Synthetic
caattgtctttgtgcagtgtcttta

SEQ ID NO: 18567 - DNA, 23 bp, Artificial Sequence
  Synthetic
ccttcatttagaggcaccaaagc

SEQ ID NO: 18568 - DNA, 23 bp, Artificial Sequence
  Synthetic
tgtacttgttgtacccgcctatt

SEQ ID NO: 18569 - DNA, 25 bp, Artificial Sequence
  Synthetic
agtggttgtgctatatctgttacaa

SEQ ID NO: 18570 - DNA, 24 bp, Artificial Sequence
  Synthetic
ggatctggcagcataacccttaat

SEQ ID NO: 18571 - DNA, 25 bp, Artificial Sequence
  Synthetic
tccccataggattcctttgtcattt

SEQ ID NO: 18572 - DNA, 25 bp, Artificial Sequence
  Synthetic
ggaacaaatgctaaattccagtctt

SEQ ID NO: 18573 - DNA, 25 bp, Artificial Sequence
  Synthetic
caatgaaacattaaggtgcaagcat

SEQ ID NO: 18574 - DNA, 20 bp, Artificial Sequence
  Synthetic
gcagttaccactcccggtac

SEQ ID NO: 18575 - DNA, 22 bp, Artificial Sequence
  Synthetic
aggcagtcccccgtgatagtct

SEQ ID NO: 18576 - DNA, 19 bp, Artificial Sequence
  Synthetic
gacgcaatggacccgaggg

SEQ ID NO: 18577 - DNA, 21 bp, Artificial Sequence
  Synthetic
gcgggagtcgtatctggcgat

SEQ ID NO: 18578 - DNA, 21 bp, Artificial Sequence
  Synthetic
ctggacaaggtcgccatctgc

SEQ ID NO: 18579 - DNA, 21 bp, Artificial Sequence
  Synthetic
ccccctgccttacgtggtctt

SEQ ID NO: 18580 - DNA, 19 bp, Artificial Sequence
  Synthetic
agagccaggaccaggacgc

SEQ ID NO: 18581 - DNA, 22 bp, Artificial Sequence
  Synthetic
cacgcctacctgaaggtgaccc

SEQ ID NO: 18582 - DNA, 19 bp, Artificial Sequence
  Synthetic
agacggcgtccctggagtc

SEQ ID NO: 18583 - DNA, 22 bp, Artificial Sequence
  Synthetic
ccaggtacatcagcagacaggc

SEQ ID NO: 18584 - DNA, 22 bp, Artificial Sequence
  Synthetic
tcgtcgtcgaacggttttacgt

SEQ ID NO: 18585 - DNA, 20 bp, Artificial Sequence
  Synthetic
gcggtggcgctgttcaagat

SEQ ID NO: 18586 - DNA, 21 bp, Artificial Sequence
  Synthetic
cccgatgacgtgctggaccta

SEQ ID NO: 18587 - DNA, 21 bp, Artificial Sequence
  Synthetic
cgtcagtttacggaccgcgtg

SEQ ID NO: 18588 - DNA, 22 bp, Artificial Sequence
  Synthetic
cgggaaaaactaccgcgctgat

SEQ ID NO: 18589 - DNA, 21 bp, Artificial Sequence
  Synthetic
ggacgtaaaccaggtgggcca

SEQ ID NO: 18590 - DNA, 19 bp, Artificial Sequence
  Synthetic
ctcgccgagctatgggcct

SEQ ID NO: 18591 - DNA, 19 bp, Artificial Sequence
  Synthetic
ggagggcgtaacgttccgc

SEQ ID NO: 18592 - DNA, 19 bp, Artificial Sequence
  Synthetic
gcccgttaaccccccacgt

SEQ ID NO: 18593 - DNA, 19 bp, Artificial Sequence
  Synthetic
actgtcgtcggtggcgctg

SEQ ID NO: 18594 - DNA, 22 bp, Artificial Sequence
  Synthetic
tcaaccccgccctacactacac

SEQ ID NO: 18595 - DNA, 19 bp, Artificial Sequence
  Synthetic
ttggtgagcgcctggacgc

SEQ ID NO: 18596 - DNA, 22 bp, Artificial Sequence
  Synthetic
cggtttgttggcgcctttatgg

SEQ ID NO: 18597 - DNA, 21 bp, Artificial Sequence
  Synthetic
ctcctgtgcaccctcacgttc

SEQ ID NO: 18598 - DNA, 21 bp, Artificial Sequence
  Synthetic
cttcctaacccagaccccggg

SEQ ID NO: 18599 - DNA, 20 bp, Artificial Sequence
  Synthetic
cccacccccgaaccatgaac

SEQ ID NO: 18600 - DNA, 19 bp, Artificial Sequence
  Synthetic
tcagaacgggccggtcgtc

SEQ ID NO: 18601 - DNA, 19 bp, Artificial Sequence
  Synthetic
aaggtcatccgaggcgccg

SEQ ID NO: 18602 - DNA, 20 bp, Artificial Sequence
  Synthetic
aaggctgccgctttacgagg

SEQ ID NO: 18603 - DNA, 19 bp, Artificial Sequence
  Synthetic
aatcgtggcgcggctcgtg

SEQ ID NO: 18604 - DNA, 20 bp, Artificial Sequence
  Synthetic
gcgcctgatcgtggagacgg

SEQ ID NO: 18605 - DNA, 22 bp, Artificial Sequence
  Synthetic
cgctttgtgactgagaacgtgc

SEQ ID NO: 18606 - DNA, 21 bp, Artificial Sequence
  Synthetic
ggctcgtggtccagtgcatca

SEQ ID NO: 18607 - DNA, 21 bp, Artificial Sequence
  Synthetic
gaccagatgctgcacgtgctg

SEQ ID NO: 18608 - DNA, 20 bp, Artificial Sequence
  Synthetic
ctcgtgcgctttctggagct

SEQ ID NO: 18609 - DNA, 19 bp, Artificial Sequence
  Synthetic
accttcagtccggacgggc

SEQ ID NO: 18610 - DNA, 19 bp, Artificial Sequence
  Synthetic
taagctccatcgcgggcgg

SEQ ID NO: 18611 - DNA, 19 bp, Artificial Sequence
  Synthetic
tcctggcccagcagaccca

SEQ ID NO: 18612 - DNA, 18 bp, Artificial Sequence
  Synthetic
tgctcgcgacgtcgggtt

SEQ ID NO: 18613 - DNA, 19 bp, Artificial Sequence
  Synthetic
tcgaccgcctggccaaacg

SEQ ID NO: 18614 - DNA, 19 bp, Artificial Sequence
  Synthetic
gtggcgtgaaactcccgca

SEQ ID NO: 18615 - DNA, 22 bp, Artificial Sequence
  Synthetic
ggagggggaaggaacgaaacac

SEQ ID NO: 18616 - DNA, 22 bp, Artificial Sequence
  Synthetic
gggaactcgggggtgatgaagt

SEQ ID NO: 18617 - DNA, 21 bp, Artificial Sequence
  Synthetic
tcttggacatacggccgtccc

SEQ ID NO: 18618 - DNA, 20 bp, Artificial Sequence
  Synthetic
gaggccaagctagccgaggc

SEQ ID NO: 18619 - DNA, 22 bp, Artificial Sequence
  Synthetic
acatcaccaccgtcagcacctt

SEQ ID NO: 18620 - DNA, 19 bp, Artificial Sequence
  Synthetic
accccaacgccatcgcctc

SEQ ID NO: 18621 - DNA, 20 bp, Artificial Sequence
  Synthetic
gcgacgcacatcaaggtggg

SEQ ID NO: 18622 - DNA, 18 bp, Artificial Sequence
  Synthetic
cgagatgctgcgctccga

SEQ ID NO: 18623 - DNA, 18 bp, Artificial Sequence
  Synthetic
ttccccaacggcaagccc

SEQ ID NO: 18624 - DNA, 22 bp, Artificial Sequence
  Synthetic
atcaattccaaccggtgctgcg

SEQ ID NO: 18625 - DNA, 19 bp, Artificial Sequence
  Synthetic
agtacgtggaccaggcggt

SEQ ID NO: 18626 - DNA, 22 bp, Artificial Sequence
  Synthetic
acaaggtaaccataggcggggc

SEQ ID NO: 18627 - DNA, 20 bp, Artificial Sequence
  Synthetic
caccatcaaggtcccccccg

SEQ ID NO: 18628 - DNA, 20 bp, Artificial Sequence
  Synthetic
cggtaaaacagagcggggcg

SEQ ID NO: 18629 - DNA, 20 bp, Artificial Sequence
  Synthetic
cgcgagcggatctgctttcg

SEQ ID NO: 18630 - DNA, 19 bp, Artificial Sequence
  Synthetic
atcttgtcgcccacggccg

SEQ ID NO: 18631 - DNA, 20 bp, Artificial Sequence
  Synthetic
ccacttacgggggccacatg

SEQ ID NO: 18632 - DNA, 22 bp, Artificial Sequence
  Synthetic
gctcttaacgaggctctctgcg

SEQ ID NO: 18633 - DNA, 20 bp, Artificial Sequence
  Synthetic
acatgctggccatcatcggc

SEQ ID NO: 18634 - DNA, 22 bp, Artificial Sequence
  Synthetic
ccgccaaccaagggctgataga

SEQ ID NO: 18635 - DNA, 19 bp, Artificial Sequence
  Synthetic
acacgttcttcgccggccc

SEQ ID NO: 18636 - DNA, 19 bp, Artificial Sequence
  Synthetic
tcgtggtcaccggtgctcg

SEQ ID NO: 18637 - DNA, 19 bp, Artificial Sequence
  Synthetic
ttccccgcccggtcgagtt

SEQ ID NO: 18638 - DNA, 21 bp, Artificial Sequence
  Synthetic
cggttcttggccctggtgagt

SEQ ID NO: 18639 - DNA, 19 bp, Artificial Sequence
  Synthetic
accccacagccaaacgcgg

SEQ ID NO: 18640 - DNA, 18 bp, Artificial Sequence
  Synthetic
tccacatcgcgcaggggt

SEQ ID NO: 18641 - DNA, 19 bp, Artificial Sequence
  Synthetic
tagcccgatgcccccgttg

SEQ ID NO: 18642 - DNA, 19 bp, Artificial Sequence
  Synthetic
aggttggagccggcgatgg

SEQ ID NO: 18643 - DNA, 21 bp, Artificial Sequence
  Synthetic
atcgccgacaggtttctggag

SEQ ID NO: 18644 - DNA, 19 bp, Artificial Sequence
  Synthetic
gccagtgacgtggacgcct

SEQ ID NO: 18645 - DNA, 21 bp, Artificial Sequence
  Synthetic
agtgttccaggggcaggaaca

SEQ ID NO: 18646 - DNA, 19 bp, Artificial Sequence
  Synthetic
tgggcgtggcactatcggc

SEQ ID NO: 18647 - DNA, 22 bp, Artificial Sequence
  Synthetic
ttccggaatttatacccgggcc

SEQ ID NO: 18648 - DNA, 20 bp, Artificial Sequence
  Synthetic
cacggggttacgcgggtagt

SEQ ID NO: 18649 - DNA, 19 bp, Artificial Sequence
  Synthetic
tgggcacgtacacccccct

SEQ ID NO: 18650 - DNA, 19 bp, Artificial Sequence
  Synthetic
acgcgcagactgtcgacgg

SEQ ID NO: 18651 - DNA, 21 bp, Artificial Sequence
  Synthetic
gggctgtcattcctcgggaac

SEQ ID NO: 18652 - DNA, 21 bp, Artificial Sequence
  Synthetic
tggtgaatccagacgtggtgc

SEQ ID NO: 18653 - DNA, 21 bp, Artificial Sequence
  Synthetic
gctcgacctctccacacctgc

SEQ ID NO: 18654 - DNA, 19 bp, Artificial Sequence
  Synthetic
agaacgactggcgcgccac

SEQ ID NO: 18655 - DNA, 21 bp, Artificial Sequence
  Synthetic
gagaaccgtggacgacgtacg

SEQ ID NO: 18656 - DNA, 19 bp, Artificial Sequence
  Synthetic
tgttggccccgacgctcag

SEQ ID NO: 18657 - DNA, 19 bp, Artificial Sequence
  Synthetic
accacacgagcacgaggcc

SEQ ID NO: 18658 - DNA, 19 bp, Artificial Sequence
  Synthetic
atcggcgttggtggagggc

SEQ ID NO: 18659 - DNA, 19 bp, Artificial Sequence
  Synthetic
attccaggtcgtcgcggcg

SEQ ID NO: 18660 - DNA, 18 bp, Artificial Sequence
  Synthetic
tttcggcctgccaggtgg

SEQ ID NO: 18661 - DNA, 19 bp, Artificial Sequence
  Synthetic
tcgaccgaacagccgtccg

SEQ ID NO: 18662 - DNA, 20 bp, Artificial Sequence
  Synthetic
tctggacacccccacggacc

SEQ ID NO: 18663 - DNA, 22 bp, Artificial Sequence
  Synthetic
tggggagtagggccttttccat

SEQ ID NO: 18664 - DNA, 19 bp, Artificial Sequence
  Synthetic
cgccctcgacgagtgggat

SEQ ID NO: 18665 - DNA, 18 bp, Artificial Sequence
  Synthetic
aaaccgccccccaagcct

SEQ ID NO: 18666 - DNA, 21 bp, Artificial Sequence
  Synthetic
actgaccctctgatcgccgtt

SEQ ID NO: 18667 - DNA, 19 bp, Artificial Sequence
  Synthetic
cagccccttggagagcacc

SEQ ID NO: 18668 - DNA, 19 bp, Artificial Sequence
  Synthetic
ggcagtgccgcattttggc

SEQ ID NO: 18669 - DNA, 20 bp, Artificial Sequence
  Synthetic
gggccccggggttttaagga

SEQ ID NO: 18670 - DNA, 19 bp, Artificial Sequence
  Synthetic
agtccaggcacgcgtcctc

SEQ ID NO: 18671 - DNA, 22 bp, Artificial Sequence
  Synthetic
ctcttccgcggtaaatcccgtg

SEQ ID NO: 18672 - DNA, 22 bp, Artificial Sequence
  Synthetic
cgccttcacgattacccgttgg

SEQ ID NO: 18673 - DNA, 20 bp, Artificial Sequence
  Synthetic
tgggttcaggcgcctactca

SEQ ID NO: 18674 - DNA, 19 bp, Artificial Sequence
  Synthetic
tcgcacgggccccttttgg

SEQ ID NO: 18675 - DNA, 19 bp, Artificial Sequence
  Synthetic
tggcggtgggagagtcggt

SEQ ID NO: 18676 - DNA, 20 bp, Artificial Sequence
  Synthetic
cgcgcatgcttcatgggtcc

SEQ ID NO: 18677 - DNA, 19 bp, Artificial Sequence
  Synthetic
gggtggcggcaagaacagc

SEQ ID NO: 18678 - DNA, 20 bp, Artificial Sequence
  Synthetic
gtgttgttgggtgccctccg

SEQ ID NO: 18679 - DNA, 21 bp, Artificial Sequence
  Synthetic
cccggcgtccacaaatgagtt

SEQ ID NO: 18680 - DNA, 18 bp, Artificial Sequence
  Synthetic
tttggcgcgtcaccgacc

SEQ ID NO: 18681 - DNA, 18 bp, Artificial Sequence
  Synthetic
aggccgctgtccgtctct

SEQ ID NO: 18682 - DNA, 21 bp, Artificial Sequence
  Synthetic
gcttcgaccgaaactggcgag

SEQ ID NO: 18683 - DNA, 19 bp, Artificial Sequence
  Synthetic
agccacatcaggagcgccc

SEQ ID NO: 18684 - DNA, 25 bp, Artificial Sequence
  Synthetic
tgttcccaatttgtaacatcaagct

SEQ ID NO: 18685 - DNA, 21 bp, Artificial Sequence
  Synthetic
attgtcaaccaactggtgcca

SEQ ID NO: 18686 - DNA, 22 bp, Artificial Sequence
  Synthetic
atcaggataacaggagcactcc

SEQ ID NO: 18687 - DNA, 25 bp, Artificial Sequence
  Synthetic
cctggaattagtgcttttggttctc

SEQ ID NO: 18688 - DNA, 22 bp, Artificial Sequence
  Synthetic
ttccgaaagcccaggatgatgg

SEQ ID NO: 18689 - DNA, 25 bp, Artificial Sequence
  Synthetic
cccataacatccaatgacataaccc

SEQ ID NO: 18690 - DNA, 20 bp, Artificial Sequence
  Synthetic
gtggtctccatgcgacgtgc

SEQ ID NO: 18691 - DNA, 21 bp, Artificial Sequence
  Synthetic
gttccccccagcaaagaattg

SEQ ID NO: 18692 - DNA, 22 bp, Artificial Sequence
  Synthetic
tggaaagattctgccccatgct

SEQ ID NO: 18693 - DNA, 23 bp, Artificial Sequence
  Synthetic
tgtggtttttgtcagtatctcgc

SEQ ID NO: 18694 - DNA, 22 bp, Artificial Sequence
  Synthetic
ccacgggtccatttctattcca

SEQ ID NO: 18695 - DNA, 22 bp, Artificial Sequence
  Synthetic
agatgctagtggatctgctgat

SEQ ID NO: 18696 - DNA, 25 bp, Artificial Sequence
  Synthetic
acccctcatgtactcttatcttcaa

SEQ ID NO: 18697 - DNA, 23 bp, Artificial Sequence
  Synthetic
aatgccttaaaagctgatgcatg

SEQ ID NO: 18698 - DNA, 22 bp, Artificial Sequence
  Synthetic
gtttcactgacctcctcaggag

SEQ ID NO: 18699 - DNA, 25 bp, Artificial Sequence
  Synthetic
caagtacgtctctcatttgttggaa

SEQ ID NO: 18700 - DNA, 20 bp, Artificial Sequence
  Synthetic
gaaaccctctcaagacggcg

SEQ ID NO: 18701 - DNA, 23 bp, Artificial Sequence
  Synthetic
cacacaaatcacgacgacagaaa

SEQ ID NO: 18702 - DNA, 25 bp, Artificial Sequence
  Synthetic
cgcgataatatcaatcttctcctca

SEQ ID NO: 18703 - DNA, 24 bp, Artificial Sequence
  Synthetic
gcaacaacaacgacacgaattact

SEQ ID NO: 18704 - DNA, 25 bp, Artificial Sequence
  Synthetic
tgtcgtctaacagatttgagatgtt

SEQ ID NO: 18705 - DNA, 25 bp, Artificial Sequence
  Synthetic
gatctctacctgcgacgtaaaagta

SEQ ID NO: 18706 - DNA, 24 bp, Artificial Sequence
  Synthetic
tgaggccttcttttctcccataat

SEQ ID NO: 18707 - DNA, 21 bp, Artificial Sequence
  Synthetic
tttcggtgggactggaaacgg

SEQ ID NO: 18708 - DNA, 25 bp, Artificial Sequence
  Synthetic
gttcctatacccagtcctccaaaat

SEQ ID NO: 18709 - DNA, 24 bp, Artificial Sequence
  Synthetic
agttgtaagtacaggtggttctgc

SEQ ID NO: 18710 - DNA, 24 bp, Artificial Sequence
  Synthetic
gatctggagtagcagctacattct

SEQ ID NO: 18711 - DNA, 20 bp, Artificial Sequence
  Synthetic
tcgcctgaatgttggcctat

SEQ ID NO: 18712 - DNA, 25 bp, Artificial Sequence
  Synthetic
ctgtaccagcatagaaaaacagact

SEQ ID NO: 18713 - DNA, 25 bp, Artificial Sequence
  Synthetic
ttaaataatggattgcctgttgtgg

SEQ ID NO: 18714 - DNA, 24 bp, Artificial Sequence
  Synthetic
caccaaagccaatgtcacacatat

SEQ ID NO: 18715 - DNA, 25 bp, Artificial Sequence
  Synthetic
tcgttcagtcatatctatttgccaa

SEQ ID NO: 18716 - DNA, 25 bp, Artificial Sequence
  Synthetic
agtacattcagagaccattcacagt

SEQ ID NO: 18717 - DNA, 22 bp, Artificial Sequence
  Synthetic
cctttggcgccaaaaacttacc

SEQ ID NO: 18718 - DNA, 25 bp, Artificial Sequence
  Synthetic
cgtcagaaattaagttagcaggcaa

SEQ ID NO: 18719 - DNA, 21 bp, Artificial Sequence
  Synthetic
gcttagatgctctctcaggcg

SEQ ID NO: 18720 - DNA, 22 bp, Artificial Sequence
  Synthetic
gcagagtcggaccccaatttcc

SEQ ID NO: 18721 - DNA, 20 bp, Artificial Sequence
  Synthetic
atcccccagacccttttcca

SEQ ID NO: 18722 - DNA, 25 bp, Artificial Sequence
  Synthetic
gctggatctctaaaggtgaatagtt

SEQ ID NO: 18723 - DNA, 25 bp, Artificial Sequence
  Synthetic
tctcttcaaatatgttgtccccaat

SEQ ID NO: 18724 - DNA, 24 bp, Artificial Sequence
  Synthetic
gctatttacatcacgctggaactg

SEQ ID NO: 18725 - DNA, 25 bp, Artificial Sequence
  Synthetic
cgctctgtcatatctaaagtccaga

SEQ ID NO: 18726 - DNA, 24 bp, Artificial Sequence
  Synthetic
caggagtttataggtcagaaccca

SEQ ID NO: 18727 - DNA, 23 bp, Artificial Sequence
  Synthetic
gccaatctggtattatcccttcc

SEQ ID NO: 18728 - DNA, 20 bp, Artificial Sequence
  Synthetic
ccagctcctcccatgtccct

SEQ ID NO: 18729 - DNA, 20 bp, Artificial Sequence
  Synthetic
gcgccaacctgctagggatt

SEQ ID NO: 18730 - DNA, 23 bp, Artificial Sequence
  Synthetic
cgggccgtaacctaactttttct

SEQ ID NO: 18731 - DNA, 20 bp, Artificial Sequence
  Synthetic
ccgcttgttgcacggggtag

SEQ ID NO: 18732 - DNA, 25 bp, Artificial Sequence
  Synthetic
gcctatacatccactggatctgttc

SEQ ID NO: 18733 - DNA, 22 bp, Artificial Sequence
  Synthetic
cgagtgtccctcctttccacag

SEQ ID NO: 18734 - DNA, 23 bp, Artificial Sequence
  Synthetic
gacatgcctaaggctgtcagaat

SEQ ID NO: 18735 - DNA, 24 bp, Artificial Sequence
  Synthetic
ccttttctttttggctagtcctgc

SEQ ID NO: 18736 - DNA, 24 bp, Artificial Sequence
  Synthetic
ccctaggccatttagaagttcttt

SEQ ID NO: 18737 - DNA, 25 bp, Artificial Sequence
  Synthetic
gttcctggctcaagataattttgtt

SEQ ID NO: 18738 - DNA, 25 bp, Artificial Sequence
  Synthetic
gcctggtataggatctcctactagg

SEQ ID NO: 18739 - DNA, 25 bp, Artificial Sequence
  Synthetic
gccttgacttactaaatggtctact

SEQ ID NO: 18740 - DNA, 22 bp, Artificial Sequence
  Synthetic
tgcgttattggccacctactgg

SEQ ID NO: 18741 - DNA, 25 bp, Artificial Sequence
  Synthetic
tcttgttctgtggtaatcatgttga

SEQ ID NO: 18742 - DNA, 25 bp, Artificial Sequence
  Synthetic
ggtaacatctgtccagaacttttct

SEQ ID NO: 18743 - DNA, 22 bp, Artificial Sequence
  Synthetic
acacctggaaaatgagctctcg

SEQ ID NO: 18744 - DNA, 25 bp, Artificial Sequence
  Synthetic
gggtgtctccatgtctattatggat

SEQ ID NO: 18745 - DNA, 21 bp, Artificial Sequence
  Synthetic
actcacttgtctggtgcagaa

SEQ ID NO: 18746 - DNA, 25 bp, Artificial Sequence
  Synthetic
gcttgacacatggttttattgatgt

SEQ ID NO: 18747 - DNA, 24 bp, Artificial Sequence
  Synthetic
gcaatgtctcatgtaacatgtgcc

SEQ ID NO: 18748 - DNA, 25 bp, Artificial Sequence
  Synthetic
gagagtgaaacactaatcctgacat

SEQ ID NO: 18749 - DNA, 25 bp, Artificial Sequence
  Synthetic
ttttccctactttatgccaggtatt

SEQ ID NO: 18750 - DNA, 22 bp, Artificial Sequence
  Synthetic
cgcacatccccatgaatttagc

SEQ ID NO: 18751 - DNA, 22 bp, Artificial Sequence
  Synthetic
cagccagtccctgattgctgtt

SEQ ID NO: 18752 - DNA, 25 bp, Artificial Sequence
  Synthetic
tgctgcctatacaaatctttctgtc

SEQ ID NO: 18753 - DNA, 20 bp, Artificial Sequence
  Synthetic
cagcatggagtcaaactgcc

SEQ ID NO: 18754 - DNA, 21 bp, Artificial Sequence
  Synthetic
agggaacacccaggctctacc

SEQ ID NO: 18755 - DNA, 20 bp, Artificial Sequence
  Synthetic
tcccagtgcagattcgatct

SEQ ID NO: 18756 - DNA, 25 bp, Artificial Sequence
  Synthetic
gcaggtttgacttcatggagtattg

SEQ ID NO: 18757 - DNA, 25 bp, Artificial Sequence
  Synthetic
actggatttattgctgtcttgttgt

SEQ ID NO: 18758 - DNA, 25 bp, Artificial Sequence
  Synthetic
tccaggtttttgtaccatgtaatca

SEQ ID NO: 18759 - DNA, 24 bp, Artificial Sequence
  Synthetic
tcctttaatagttttgcaggcggt

SEQ ID NO: 18760 - DNA, 25 bp, Artificial Sequence
  Synthetic
gctcttagatcatccactttttcgt

SEQ ID NO: 18761 - DNA, 20 bp, Artificial Sequence
  Synthetic
gcattaaaggtgccagcagc

SEQ ID NO: 18762 - DNA, 25 bp, Artificial Sequence
  Synthetic
gccccatggaatgttatttctcttt

SEQ ID NO: 18763 - DNA, 21 bp, Artificial Sequence
  Synthetic
tcgatccagccatctgctcca

SEQ ID NO: 18764 - DNA, 25 bp, Artificial Sequence
  Synthetic
cacaatatcaagtgcagtatcccaa

SEQ ID NO: 18765 - DNA, 24 bp, Artificial Sequence
  Synthetic
tccgcgcaataattcttcaaaaag

SEQ ID NO: 18766 - DNA, 25 bp, Artificial Sequence
  Synthetic
gcttgttatacaatgccagggaatt

SEQ ID NO: 18767 - DNA, 24 bp, Artificial Sequence
  Synthetic
tcttgtaactctaattgcactgca

SEQ ID NO: 18768 - DNA, 24 bp, Artificial Sequence
  Synthetic
tccattgtaatctgcatcaccttt

SEQ ID NO: 18769 - DNA, 25 bp, Artificial Sequence
  Synthetic
ggacaatcaccagtaaagcattgtt

SEQ ID NO: 18770 - DNA, 22 bp, Artificial Sequence
  Synthetic
accaataggctccacaggtact

SEQ ID NO: 18771 - DNA, 25 bp, Artificial Sequence
  Synthetic
gcctgaacgtggttcattatttaca

SEQ ID NO: 18772 - DNA, 23 bp, Artificial Sequence
  Synthetic
cgttcaactatttgggtgggagt

SEQ ID NO: 18773 - DNA, 21 bp, Artificial Sequence
  Synthetic
caccttcacggctcactctta

SEQ ID NO: 18774 - DNA, 20 bp, Artificial Sequence
  Synthetic
acatctgagcgtttgcgttt

SEQ ID NO: 18775 - DNA, 25 bp, Artificial Sequence
  Synthetic
tgggatctggacacagtaatctaaa

SEQ ID NO: 18776 - DNA, 25 bp, Artificial Sequence
  Synthetic
gtgcaacctactataaacacctgat

SEQ ID NO: 18777 - DNA, 24 bp, Artificial Sequence
  Synthetic
ctccggagatatcctttgacattt

SEQ ID NO: 18778 - DNA, 25 bp, Artificial Sequence
  Synthetic
cccaatcatctaacactgttggatt

SEQ ID NO: 18779 - DNA, 25 bp, Artificial Sequence
  Synthetic
cagtttttctggatactttcggaga

SEQ ID NO: 18780 - DNA, 21 bp, Artificial Sequence
  Synthetic
gacaaacagctttcgcaacag

SEQ ID NO: 18781 - DNA, 20 bp, Artificial Sequence
  Synthetic
atgactcctcctctggggtg

SEQ ID NO: 18782 - DNA, 23 bp, Artificial Sequence
  Synthetic
cctagtccactgtcctgaaacag

SEQ ID NO: 18783 - DNA, 24 bp, Artificial Sequence
  Synthetic
gcttgagaagccatttgatgattt

SEQ ID NO: 18784 - DNA, 25 bp, Artificial Sequence
  Synthetic
agtcattaattgctcttgtagtgca

SEQ ID NO: 18785 - DNA, 20 bp, Artificial Sequence
  Synthetic
ttttcctcttcggcctcggc

SEQ ID NO: 18786 - DNA, 21 bp, Artificial Sequence
  Synthetic
tgacatcttctggacagtccc

SEQ ID NO: 18787 - DNA, 25 bp, Artificial Sequence
  Synthetic
gcatctggagtgattggtagtactt

SEQ ID NO: 18788 - DNA, 25 bp, Artificial Sequence
  Synthetic
aggaacctgttgaacaaatctatga

SEQ ID NO: 18789 - DNA, 25 bp, Artificial Sequence
  Synthetic
gtgtcaggaatgttaacaaatgtgt

SEQ ID NO: 18790 - DNA, 24 bp, Artificial Sequence
  Synthetic
gcaaactggttaggatctggtaat

SEQ ID NO: 18791 - DNA, 25 bp, Artificial Sequence
  Synthetic
cccgccgtccataaaaaaataattt

SEQ ID NO: 18792 - DNA, 25 bp, Artificial Sequence
  Synthetic
ccagctgccagttttctaatattga

SEQ ID NO: 18793 - DNA, 22 bp, Artificial Sequence
  Synthetic
ggtcgggtatcaaatacagcag

SEQ ID NO: 18794 - DNA, 25 bp, Artificial Sequence
  Synthetic
cctgtcttcctgatgtgtacttctt

SEQ ID NO: 18795 - DNA, 21 bp, Artificial Sequence
  Synthetic
ggtccatttctgttccaccac

SEQ ID NO: 18796 - DNA, 25 bp, Artificial Sequence
  Synthetic
cctttgttattgtcagctgtgattc

SEQ ID NO: 18797 - DNA, 21 bp, Artificial Sequence
  Synthetic
cctgacaatgttcctagcagc

SEQ ID NO: 18798 - DNA, 25 bp, Artificial Sequence
  Synthetic
gtccaaccattgtgaattcctcata

SEQ ID NO: 18799 - DNA, 21 bp, Artificial Sequence
  Synthetic
ggagttggtgcatgggattca

SEQ ID NO: 18800 - DNA, 25 bp, Artificial Sequence
  Synthetic
tgtttcactaacttcttcaggggat

SEQ ID NO: 18801 - DNA, 21 bp, Artificial Sequence
  Synthetic
cccaaaacatcacgcatctgc

SEQ ID NO: 18802 - DNA, 21 bp, Artificial Sequence
  Synthetic
tcctgctgttccttcatctgg

SEQ ID NO: 18803 - DNA, 21 bp, Artificial Sequence
  Synthetic
actttggttccgtttgacacg

SEQ ID NO: 18804 - DNA, 25 bp, Artificial Sequence
  Synthetic
tcttcattcacgaatttcccaggat

SEQ ID NO: 18805 - DNA, 23 bp, Artificial Sequence
  Synthetic
ccagtttgtttccactcccatat

SEQ ID NO: 18806 - DNA, 22 bp, Artificial Sequence
  Synthetic
ttgtccctccactatgatagca

SEQ ID NO: 18807 - DNA, 25 bp, Artificial Sequence
  Synthetic
tctgaaaccataccaaccatcaatt

SEQ ID NO: 18808 - DNA, 22 bp, Artificial Sequence
  Synthetic
tgtccatttctgaatcagccag

SEQ ID NO: 18809 - DNA, 23 bp, Artificial Sequence
  Synthetic
acttgccattctgccttaacaag

SEQ ID NO: 18810 - DNA, 25 bp, Artificial Sequence
  Synthetic
gcttttgacatatagcacagcgaat

SEQ ID NO: 18811 - DNA, 25 bp, Artificial Sequence
  Synthetic
ttctgtaacgttgtatgtcctgttt

SEQ ID NO: 18812 - DNA, 21 bp, Artificial Sequence
  Synthetic
tttcctgattttcctgcaccc

SEQ ID NO: 18813 - DNA, 24 bp, Artificial Sequence
  Synthetic
gcgattcttgccacatttaaatct

SEQ ID NO: 18814 - DNA, 20 bp, Artificial Sequence
  Synthetic
cagcacgttgggcatattca

SEQ ID NO: 18815 - DNA, 20 bp, Artificial Sequence
  Synthetic
acgcatctaaacgtttggcc

SEQ ID NO: 18816 - DNA, 25 bp, Artificial Sequence
  Synthetic
gcgtccctgtttttttaaacacttt

SEQ ID NO: 18817 - DNA, 22 bp, Artificial Sequence
  Synthetic
ggtcggggtggggtctttgtat

SEQ ID NO: 18818 - DNA, 25 bp, Artificial Sequence
  Synthetic
cacgcagcaacaactataaacaata

SEQ ID NO: 18819 - DNA, 21 bp, Artificial Sequence
  Synthetic
ctaaaaaccacagcagcagcc

SEQ ID NO: 18820 - DNA, 25 bp, Artificial Sequence
  Synthetic
tgcagaggacgtaatattaaaccca

SEQ ID NO: 18821 - DNA, 21 bp, Artificial Sequence
  Synthetic
tgatggcctagtgattgggct

SEQ ID NO: 18822 - DNA, 23 bp, Artificial Sequence
  Synthetic
gaggaggcagataaaccttgttg

SEQ ID NO: 18823 - DNA, 25 bp, Artificial Sequence
  Synthetic
accatcctgaataacactgttttgt

SEQ ID NO: 18824 - DNA, 25 bp, Artificial Sequence
  Synthetic
cgtctagtatgtcaggattcatggt

SEQ ID NO: 18825 - DNA, 25 bp, Artificial Sequence
  Synthetic
gcatgtgcttgctaaatttaatgga

SEQ ID NO: 18826 - DNA, 25 bp, Artificial Sequence
  Synthetic
cttaattgaaatgtgtctgcctgtg

SEQ ID NO: 18827 - DNA, 25 bp, Artificial Sequence
  Synthetic
cactgtgccattgtcatatttttca

SEQ ID NO: 18828 - DNA, 22 bp, Artificial Sequence
  Synthetic
cctccgaccgtctcttcagtct

SEQ ID NO: 18829 - DNA, 20 bp, Artificial Sequence
  Synthetic
agacctgctgctggtactga

SEQ ID NO: 18830 - DNA, 25 bp, Artificial Sequence
  Synthetic
ccaactacttctgaaactggatcaa

SEQ ID NO: 18831 - DNA, 24 bp, Artificial Sequence
  Synthetic
caggccatttacaagtggagttaa

SEQ ID NO: 18832 - DNA, 20 bp, Artificial Sequence
  Synthetic
accactgggcgtcggataat

SEQ ID NO: 18833 - DNA, 20 bp, Artificial Sequence
  Synthetic
gggctagcacatcagcttcc

SEQ ID NO: 18834 - DNA, 25 bp, Artificial Sequence
  Synthetic
acgggaattaagtaatcccatctga

SEQ ID NO: 18835 - DNA, 22 bp, Artificial Sequence
  Synthetic
atgagtcagcaatgccttgttt

SEQ ID NO: 18836 - DNA, 23 bp, Artificial Sequence
  Synthetic
acgatcgttaacggttggatttg

SEQ ID NO: 18837 - DNA, 22 bp, Artificial Sequence
  Synthetic
gccgtagtgctggctagtacca

SEQ ID NO: 18838 - DNA, 25 bp, Artificial Sequence
  Synthetic
ccacaatatcaagtgcaatatccca

SEQ ID NO: 18839 - DNA, 21 bp, Artificial Sequence
  Synthetic
gagctctggattggcataagc

SEQ ID NO: 18840 - DNA, 25 bp, Artificial Sequence
  Synthetic
tgaccagaactatccagatctgtat

SEQ ID NO: 18841 - DNA, 25 bp, Artificial Sequence
  Synthetic
tgttgcatggctctattttgtacaa

SEQ ID NO: 18842 - DNA, 25 bp, Artificial Sequence
  Synthetic
tcttcccaagaatccatgatttgat

SEQ ID NO: 18843 - DNA, 22 bp, Artificial Sequence
  Synthetic
gaccacagtctcagctctacta

SEQ ID NO: 18844 - DNA, 25 bp, Artificial Sequence
  Synthetic
gtgttcctgatgattctgtctgtat

SEQ ID NO: 18845 - DNA, 25 bp, Artificial Sequence
  Synthetic
cctgcatgtcgatatagatcaggta

SEQ ID NO: 18846 - DNA, 24 bp, Artificial Sequence
  Synthetic
ttgactttgagtggtaatggttct

SEQ ID NO: 18847 - DNA, 20 bp, Artificial Sequence
  Synthetic
tggcatcgaacagcattcct

SEQ ID NO: 18848 - DNA, 23 bp, Artificial Sequence
  Synthetic
ttcccaactccttttgcgataat

SEQ ID NO: 18849 - DNA, 25 bp, Artificial Sequence
  Synthetic
gggatgatcagtctatccaataacc

SEQ ID NO: 18850 - DNA, 21 bp, Artificial Sequence
  Synthetic
tctgagtgttcagcagcctag

SEQ ID NO: 18851 - DNA, 25 bp, Artificial Sequence
  Synthetic
ctccttgattaggtggttgattgat

SEQ ID NO: 18852 - DNA, 25 bp, Artificial Sequence
  Synthetic
ccagtattccatctcgaatttggat

SEQ ID NO: 18853 - DNA, 20 bp, Artificial Sequence
  Synthetic
gaagaccagacgtgcacctc

SEQ ID NO: 18854 - DNA, 22 bp, Artificial Sequence
  Synthetic
aagacctccatacccgagaaat

SEQ ID NO: 18855 - DNA, 21 bp, Artificial Sequence
  Synthetic
tgactgggttcactctcgatt

SEQ ID NO: 18856 - DNA, 24 bp, Artificial Sequence
  Synthetic
gcagagtttgaaccgtaagcattt

SEQ ID NO: 18857 - DNA, 25 bp, Artificial Sequence
  Synthetic
ctctgaccaaaagacacatctagat

SEQ ID NO: 18858 - DNA, 25 bp, Artificial Sequence
  Synthetic
gcaggtattaaagaggcatattgca

SEQ ID NO: 18859 - DNA, 25 bp, Artificial Sequence
  Synthetic
ccttcctcctgataaatgaatccac

SEQ ID NO: 18860 - DNA, 25 bp, Artificial Sequence
  Synthetic
agtgtaaaatttgcacgtgtttgtg

SEQ ID NO: 18861 - DNA, 23 bp, Artificial Sequence
  Synthetic
ctacgactccagcatcaaagatg

SEQ ID NO: 18862 - DNA, 20 bp, Artificial Sequence
  Synthetic
aaaccattgctagcggcctc

SEQ ID NO: 18863 - DNA, 25 bp, Artificial Sequence
  Synthetic
cttagtaagccaagcacaaacgtaa

SEQ ID NO: 18864 - DNA, 25 bp, Artificial Sequence
  Synthetic
ccacaagtacattgaactaatgcac

SEQ ID NO: 18865 - DNA, 25 bp, Artificial Sequence
  Synthetic
atgttcctcttctacaaaagtggaa

SEQ ID NO: 18866 - DNA, 24 bp, Artificial Sequence
  Synthetic
acagcacagtcaaagacagtttga

SEQ ID NO: 18867 - DNA, 20 bp, Artificial Sequence
  Synthetic
agcagtgctacgttcaacac

SEQ ID NO: 18868 - DNA, 23 bp, Artificial Sequence
  Synthetic
tcctcaaaccaagactcgttact

SEQ ID NO: 18869 - DNA, 25 bp, Artificial Sequence
  Synthetic
agtgtctaaaaacgcattataggcc

SEQ ID NO: 18870 - DNA, 25 bp, Artificial Sequence
  Synthetic
gtcaaaatgtgtagggtctgcaatt

SEQ ID NO: 18871 - DNA, 25 bp, Artificial Sequence
  Synthetic
tcccagtcaccttcatgtttaattt

SEQ ID NO: 18872 - DNA, 25 bp, Artificial Sequence
  Synthetic
gcatagtcaccatcaagtataccag

SEQ ID NO: 18873 - DNA, 22 bp, Artificial Sequence
  Synthetic
agtgggcgtacaaaacaaaaca

SEQ ID NO: 18874 - DNA, 25 bp, Artificial Sequence
  Synthetic
gcgttcaacttctctttaacaacaa

SEQ ID NO: 18875 - DNA, 25 bp, Artificial Sequence
  Synthetic
tggttctattttaggttgctcaact

SEQ ID NO: 18876 - DNA, 22 bp, Artificial Sequence
  Synthetic
acgtgtgcatcgttgaacatta

SEQ ID NO: 18877 - DNA, 25 bp, Artificial Sequence
  Synthetic
cgacccaatcaacatctattgcttt

SEQ ID NO: 18878 - DNA, 25 bp, Artificial Sequence
  Synthetic
cctctaacacttctaacacgtgaat

SEQ ID NO: 18879 - DNA, 23 bp, Artificial Sequence
  Synthetic
agctgctgacgcttttaagttat

SEQ ID NO: 18880 - DNA, 25 bp, Artificial Sequence
  Synthetic
tggctaaattgacttaactcttggt

SEQ ID NO: 18881 - DNA, 25 bp, Artificial Sequence
  Synthetic
gggaatctcttaagtctagcactct

SEQ ID NO: 18882 - DNA, 25 bp, Artificial Sequence
  Synthetic
aacgatgtgcattagaaatagcact

SEQ ID NO: 18883 - DNA, 23 bp, Artificial Sequence
  Synthetic
gcgtgacagcttggttttcatta

SEQ ID NO: 18884 - DNA, 25 bp, Artificial Sequence
  Synthetic
gccagcgacagtattaacaatttca

SEQ ID NO: 18885 - DNA, 20 bp, Artificial Sequence
  Synthetic
attcacctacgcggcagtat

SEQ ID NO: 18886 - DNA, 25 bp, Artificial Sequence
  Synthetic
gcaattaaatatgcagcacaccaaa

SEQ ID NO: 18887 - DNA, 25 bp, Artificial Sequence
  Synthetic
ccagcctgtaatgtagaaccataac

SEQ ID NO: 18888 - DNA, 25 bp, Artificial Sequence
  Synthetic
ctaaaagaatgtctaggtgtgtgca

SEQ ID NO: 18889 - DNA, 25 bp, Artificial Sequence
  Synthetic
gcaaccacattaactgttaacatct

SEQ ID NO: 18890 - DNA, 25 bp, Artificial Sequence
  Synthetic
acccaaatagtggtggtataaacaa

SEQ ID NO: 18891 - DNA, 23 bp, Artificial Sequence
  Synthetic
accaatgtgtacaacgctcttta

SEQ ID NO: 18892 - DNA, 25 bp, Artificial Sequence
  Synthetic
ggctggactaacacagaaatcataa

SEQ ID NO: 18893 - DNA, 24 bp, Artificial Sequence
  Synthetic
gcccactcctttgaattagaagct

SEQ ID NO: 18894 - DNA, 25 bp, Artificial Sequence
  Synthetic
gcttgttcagccattctgttaattt

SEQ ID NO: 18895 - DNA, 25 bp, Artificial Sequence
  Synthetic
tgcacattcttaccatcattatcct

SEQ ID NO: 18896 - DNA, 25 bp, Artificial Sequence
  Synthetic
ccagagtcatgttcccatttaacat

SEQ ID NO: 18897 - DNA, 25 bp, Artificial Sequence
  Synthetic
acatctttacacaattgccaacagg

SEQ ID NO: 18898 - DNA, 24 bp, Artificial Sequence
  Synthetic
cccggactcgtttaaataactgtt

SEQ ID NO: 18899 - DNA, 25 bp, Artificial Sequence
  Synthetic
cagtctttttcatcaaagttacgca

SEQ ID NO: 18900 - DNA, 21 bp, Artificial Sequence
  Synthetic
tgacgtgcagtagggtattcc

SEQ ID NO: 18901 - DNA, 25 bp, Artificial Sequence
  Synthetic
cgggtacaccatcaataaacacttt

SEQ ID NO: 18902 - DNA, 25 bp, Artificial Sequence
  Synthetic
cccctgagaacgtaagaagtcataa

SEQ ID NO: 18903 - DNA, 20 bp, Artificial Sequence
  Synthetic
aagagacgccacccactgta

SEQ ID NO: 18904 - DNA, 25 bp, Artificial Sequence
  Synthetic
caatgtaaccaagtccagcataagt

SEQ ID NO: 18905 - DNA, 24 bp, Artificial Sequence
  Synthetic
ggtaggcatctatagccagagaaa

SEQ ID NO: 18906 - DNA, 25 bp, Artificial Sequence
  Synthetic
gcagaacttttgtacaaaccaaaga

SEQ ID NO: 18907 - DNA, 25 bp, Artificial Sequence
  Synthetic
accgtaatctactttctcaaacaca

SEQ ID NO: 18908 - DNA, 21 bp, Artificial Sequence
  Synthetic
tcgctccagggtaatacacac

SEQ ID NO: 18909 - DNA, 25 bp, Artificial Sequence
  Synthetic
tgttgaggatcaccaacatatacaa

SEQ ID NO: 18910 - DNA, 25 bp, Artificial Sequence
  Synthetic
cctggcagctacataattttgacta

SEQ ID NO: 18911 - DNA, 25 bp, Artificial Sequence
  Synthetic
agacaatgacaaataagtagtggca

SEQ ID NO: 18912 - DNA, 21 bp, Artificial Sequence
  Synthetic
tgccaacattgtcacctgtga

SEQ ID NO: 18913 - DNA, 25 bp, Artificial Sequence
  Synthetic
gctccaatcttaacaaaataacgca

SEQ ID NO: 18914 - DNA, 25 bp, Artificial Sequence
  Synthetic
gcccttgtttatggcattttcatta

SEQ ID NO: 18915 - DNA, 22 bp, Artificial Sequence
  Synthetic
cccaccatttacaccttcaagg

SEQ ID NO: 18916 - DNA, 23 bp, Artificial Sequence
  Synthetic
tctgtgaatgtctgccacaaatt

SEQ ID NO: 18917 - DNA, 20 bp, Artificial Sequence
  Synthetic
aagcttgtcaagggacgctc

SEQ ID NO: 18918 - DNA, 25 bp, Artificial Sequence
  Synthetic
cgaccttgggtataaaaaccatcat

SEQ ID NO: 18919 - DNA, 25 bp, Artificial Sequence
  Synthetic
caacagtcaaatccaaagacttcaa

SEQ ID NO: 18920 - DNA, 25 bp, Artificial Sequence
  Synthetic
gcacccaagtgtaacactctcatat

SEQ ID NO: 18921 - DNA, 25 bp, Artificial Sequence
  Synthetic
cgccaaaatacataatttgcgtgta

SEQ ID NO: 18922 - DNA, 25 bp, Artificial Sequence
  Synthetic
cgttgcaaacagagtaactagtgtt

SEQ ID NO: 18923 - DNA, 25 bp, Artificial Sequence
  Synthetic
acgtagtttcattgccaatagtagt

SEQ ID NO: 18924 - DNA, 22 bp, Artificial Sequence
  Synthetic
agcgacacaatagacacaggta

SEQ ID NO: 18925 - DNA, 25 bp, Artificial Sequence
  Synthetic
tgaagttgatgtgtacgtaattcca

SEQ ID NO: 18926 - DNA, 25 bp, Artificial Sequence
  Synthetic
gaaacattacgtggttgaacagcaa

SEQ ID NO: 18927 - DNA, 25 bp, Artificial Sequence
  Synthetic
gctaaggttgtagtcaccaaaacta

SEQ ID NO: 18928 - DNA, 25 bp, Artificial Sequence
  Synthetic
tgcctgaattgctaatgaaaatggt

SEQ ID NO: 18929 - DNA, 25 bp, Artificial Sequence
  Synthetic
ccaatctaccagtaatcagcctatc

SEQ ID NO: 18930 - DNA, 25 bp, Artificial Sequence
  Synthetic
tgccttctttgtaaagagcaagatt

SEQ ID NO: 18931 - DNA, 25 bp, Artificial Sequence
  Synthetic
gtgctaatttcactggtcaaattca

SEQ ID NO: 18932 - DNA, 24 bp, Artificial Sequence
  Synthetic
tgtggatcttttcaacgtcgtaat

SEQ ID NO: 18933 - DNA, 25 bp, Artificial Sequence
  Synthetic
aaaattacagcaatcaaagttgcgt

SEQ ID NO: 18934 - DNA, 23 bp, Artificial Sequence
  Synthetic
atcactataagcaccacacacca

SEQ ID NO: 18935 - DNA, 21 bp, Artificial Sequence
  Synthetic
agcccaggtgtcaaagattga

SEQ ID NO: 18936 - DNA, 21 bp, Artificial Sequence
  Synthetic
acgtagaaaacccagcctgtg

SEQ ID NO: 18937 - DNA, 25 bp, Artificial Sequence
  Synthetic
ttctgaaacgtttttgaacattcca

SEQ ID NO: 18938 - DNA, 23 bp, Artificial Sequence
  Synthetic
acctaaagatttaagagccgcag

SEQ ID NO: 18939 - DNA, 25 bp, Artificial Sequence
  Synthetic
ggccaaaacattgtgtgacattaga

SEQ ID NO: 18940 - DNA, 23 bp, Artificial Sequence
  Synthetic
gagatgggttgaattctagtgca

SEQ ID NO: 18941 - DNA, 23 bp, Artificial Sequence
  Synthetic
accactggcttaccattgtgtat

SEQ ID NO: 18942 - DNA, 20 bp, Artificial Sequence
  Synthetic
ccaggtgtggcaaatggaca

SEQ ID NO: 18943 - DNA, 21 bp, Artificial Sequence
  Synthetic
agaaacatctgtcccatcgct

SEQ ID NO: 18944 - DNA, 22 bp, Artificial Sequence
  Synthetic
gcgatgctaccttttccaccct

SEQ ID NO: 18945 - DNA, 25 bp, Artificial Sequence
  Synthetic
ggcattacaccctctgtaaagctaa

SEQ ID NO: 18946 - DNA, 25 bp, Artificial Sequence
  Synthetic
ggcgcatttcgtatcttttatacat

SEQ ID NO: 18947 - DNA, 20 bp, Artificial Sequence
  Synthetic
tccacttgtgcaccaccttt

SEQ ID NO: 18948 - DNA, 24 bp, Artificial Sequence
  Synthetic
gcagaagtgtcagaagcagattct

SEQ ID NO: 18949 - DNA, 25 bp, Artificial Sequence
  Synthetic
tcagctaatgtggtttgttctactt

SEQ ID NO: 18950 - DNA, 22 bp, Artificial Sequence
  Synthetic
cgtgtcgggggttaccacatct

SEQ ID NO: 18951 - DNA, 25 bp, Artificial Sequence
  Synthetic
acagaaatatatgatggggtggcat

SEQ ID NO: 18952 - DNA, 22 bp, Artificial Sequence
  Synthetic
tgacgtgggcggtttaagaagt

SEQ ID NO: 18953 - DNA, 20 bp, Artificial Sequence
  Synthetic
agaaacaccctgaaggcctg

SEQ ID NO: 18954 - DNA, 23 bp, Artificial Sequence
  Synthetic
ggtaaccacagtgacatctgaaa

SEQ ID NO: 18955 - DNA, 21 bp, Artificial Sequence
  Synthetic
ccaacgcaagcttgttaggat

SEQ ID NO: 18956 - DNA, 23 bp, Artificial Sequence
  Synthetic
gccatcccgtgtaaaaaagtgac

SEQ ID NO: 18957 - DNA, 20 bp, Artificial Sequence
  Synthetic
ggggtacaaagcctaactgc

SEQ ID NO: 18958 - DNA, 19 bp, Artificial Sequence
  Synthetic
tgcccatctccacgcgaag

SEQ ID NO: 18959 - DNA, 22 bp, Artificial Sequence
  Synthetic
tgcttgtgaggcatgactccag

SEQ ID NO: 18960 - DNA, 19 bp, Artificial Sequence
  Synthetic
gcgttcagcagcgcctcag

SEQ ID NO: 18961 - DNA, 22 bp, Artificial Sequence
  Synthetic
ccaccggcatagtgatggtcac

SEQ ID NO: 18962 - DNA, 22 bp, Artificial Sequence
  Synthetic
gccgtgctgcacctcaaacatt

SEQ ID NO: 18963 - DNA, 19 bp, Artificial Sequence
  Synthetic
acaaggcaggacgcagccc

SEQ ID NO: 18964 - DNA, 23 bp, Artificial Sequence
  Synthetic
ctacctgaactaagactgggtgt

SEQ ID NO: 18965 - DNA, 22 bp, Artificial Sequence
  Synthetic
cgaggcaggcttacatgggagt

SEQ ID NO: 18966 - DNA, 19 bp, Artificial Sequence
  Synthetic
cgggttggtccagggcctt

SEQ ID NO: 18967 - DNA, 20 bp, Artificial Sequence
  Synthetic
ctcgtctgggttcttggccc

SEQ ID NO: 18968 - DNA, 20 bp, Artificial Sequence
  Synthetic
aagaggcccctctccgcgag

SEQ ID NO: 18969 - DNA, 22 bp, Artificial Sequence
  Synthetic
cctctggtaggactgggcgacc

SEQ ID NO: 18970 - DNA, 21 bp, Artificial Sequence
  Synthetic
cgtaaacgcgctggactgaga

SEQ ID NO: 18971 - DNA, 22 bp, Artificial Sequence
  Synthetic
gccttcttaggagctgtccgag

SEQ ID NO: 18972 - DNA, 22 bp, Artificial Sequence
  Synthetic
gagttgagctgcctaccatgct

SEQ ID NO: 18973 - DNA, 22 bp, Artificial Sequence
  Synthetic
cctcgtcttcggtctcagcttc

SEQ ID NO: 18974 - DNA, 20 bp, Artificial Sequence
  Synthetic
aggggctggtctgtgacctg

SEQ ID NO: 18975 - DNA, 18 bp, Artificial Sequence
  Synthetic
agtccaggcccgggacat

SEQ ID NO: 18976 - DNA, 19 bp, Artificial Sequence
  Synthetic
agagcccagaccggtctcc

SEQ ID NO: 18977 - DNA, 22 bp, Artificial Sequence
  Synthetic
gcaacgtccaggagctgttctc

SEQ ID NO: 18978 - DNA, 19 bp, Artificial Sequence
  Synthetic
tcgtggtggaggctgccag

SEQ ID NO: 18979 - DNA, 19 bp, Artificial Sequence
  Synthetic
cacgttggaccccaagcgg

SEQ ID NO: 18980 - DNA, 19 bp, Artificial Sequence
  Synthetic
ggcggagagaatggaggcc

SEQ ID NO: 18981 - DNA, 18 bp, Artificial Sequence
  Synthetic
aatgcggccctgcacgtg

SEQ ID NO: 18982 - DNA, 22 bp, Artificial Sequence
  Synthetic
aaagctggaagcgcctcctatc

SEQ ID NO: 18983 - DNA, 22 bp, Artificial Sequence
  Synthetic
gccctcctttggggatgatgca

SEQ ID NO: 18984 - DNA, 19 bp, Artificial Sequence
  Synthetic
acccgtgggacaaacgccc

SEQ ID NO: 18985 - DNA, 19 bp, Artificial Sequence
  Synthetic
tccccccgccactactcca

SEQ ID NO: 18986 - DNA, 20 bp, Artificial Sequence
  Synthetic
ccgctttctggtctcgggtg

SEQ ID NO: 18987 - DNA, 20 bp, Artificial Sequence
  Synthetic
cggccgccttcatcgagttc

SEQ ID NO: 18988 - DNA, 22 bp, Artificial Sequence
  Synthetic
gcttgaagaagagctcggggac

SEQ ID NO: 18989 - DNA, 22 bp, Artificial Sequence
  Synthetic
acggcgcagttgacgatagaga

SEQ ID NO: 18990 - DNA, 19 bp, Artificial Sequence
  Synthetic
cgggaggcagatgttggcc

SEQ ID NO: 18991 - DNA, 20 bp, Artificial Sequence
  Synthetic
agacaacgtgggcctcaacg

SEQ ID NO: 18992 - DNA, 21 bp, Artificial Sequence
  Synthetic
cgagggtgtctctggccttgc

SEQ ID NO: 18993 - DNA, 21 bp, Artificial Sequence
  Synthetic
ctcatgagcaccctggcaaca

SEQ ID NO: 18994 - DNA, 19 bp, Artificial Sequence
  Synthetic
aatccgcatggagcccccg

SEQ ID NO: 18995 - DNA, 18 bp, Artificial Sequence
  Synthetic
tccaccacgtggcgggtt

SEQ ID NO: 18996 - DNA, 22 bp, Artificial Sequence
  Synthetic
ccttcagatatgccacccccca

SEQ ID NO: 18997 - DNA, 20 bp, Artificial Sequence
  Synthetic
cccgagggtcatgggctcat

SEQ ID NO: 18998 - DNA, 19 bp, Artificial Sequence
  Synthetic
tcagtcagggaagccgccg

SEQ ID NO: 18999 - DNA, 20 bp, Artificial Sequence
  Synthetic
cagcagcgtgttcacaaact

SEQ ID NO: 19000 - DNA, 20 bp, Artificial Sequence
  Synthetic
gcctgtgctaccggacacgg

SEQ ID NO: 19001 - DNA, 19 bp, Artificial Sequence
  Synthetic
aacggggtggatttggcgt

SEQ ID NO: 19002 - DNA, 21 bp, Artificial Sequence
  Synthetic
caccctcctcttgaacaggcc

SEQ ID NO: 19003 - DNA, 21 bp, Artificial Sequence
  Synthetic
ggacattgtccccccctgact

SEQ ID NO: 19004 - DNA, 19 bp, Artificial Sequence
  Synthetic
acttggctgaaccaccggc

SEQ ID NO: 19005 - DNA, 19 bp, Artificial Sequence
  Synthetic
ctgaagcccggtgcccaaa

SEQ ID NO: 19006 - DNA, 22 bp, Artificial Sequence
  Synthetic
agccagatgttcaggaaccaaa

SEQ ID NO: 19007 - DNA, 20 bp, Artificial Sequence
  Synthetic
gggaacagcaggggaggtcc

SEQ ID NO: 19008 - DNA, 22 bp, Artificial Sequence
  Synthetic
gctctcgctgtagtcagactcg

SEQ ID NO: 19009 - DNA, 19 bp, Artificial Sequence
  Synthetic
ttggtgctgtgcccctgcc

SEQ ID NO: 19010 - DNA, 18 bp, Artificial Sequence
  Synthetic
catgcaccaggggcagct

SEQ ID NO: 19011 - DNA, 19 bp, Artificial Sequence
  Synthetic
gcagcgggtcagcagtcat

SEQ ID NO: 19012 - DNA, 21 bp, Artificial Sequence
  Synthetic
gggaagagcacatgcagcctg

SEQ ID NO: 19013 - DNA, 21 bp, Artificial Sequence
  Synthetic
gctgatggtgcttgccggatg

SEQ ID NO: 19014 - DNA, 19 bp, Artificial Sequence
  Synthetic
atccgggccttgacgtggg

SEQ ID NO: 19015 - DNA, 21 bp, Artificial Sequence
  Synthetic
gctctacgccttcctccgcag

SEQ ID NO: 19016 - DNA, 21 bp, Artificial Sequence
  Synthetic
ggaccaacaacccccacctgt

SEQ ID NO: 19017 - DNA, 25 bp, Artificial Sequence
  Synthetic
gtctcagttgagcattcacctttta

SEQ ID NO: 19018 - DNA, 22 bp, Artificial Sequence
  Synthetic
tgccggactctgtcatccgtaa

SEQ ID NO: 19019 - DNA, 22 bp, Artificial Sequence
  Synthetic
ccgatccgacccgctctacttt

SEQ ID NO: 19020 - DNA, 22 bp, Artificial Sequence
  Synthetic
gcaaaaggggccctattctgct

SEQ ID NO: 19021 - DNA, 19 bp, Artificial Sequence
  Synthetic
gcacagtgcggctcaggct

SEQ ID NO: 19022 - DNA, 20 bp, Artificial Sequence
  Synthetic
caccgacaacgttctgcgcc

SEQ ID NO: 19023 - DNA, 19 bp, Artificial Sequence
  Synthetic
tcccttcgcaggagggcca

SEQ ID NO: 19024 - DNA, 19 bp, Artificial Sequence
  Synthetic
tcccgatggcaggtgcacg

SEQ ID NO: 19025 - DNA, 20 bp, Artificial Sequence
  Synthetic
ggggctccggtgcctttttc

SEQ ID NO: 19026 - DNA, 21 bp, Artificial Sequence
  Synthetic
gcacacgttgttttggcaata

SEQ ID NO: 19027 - DNA, 22 bp, Artificial Sequence
  Synthetic
cggccgtttcaaatgctgtgga

SEQ ID NO: 19028 - DNA, 18 bp, Artificial Sequence
  Synthetic
tgctgtccaccgccctgt

SEQ ID NO: 19029 - DNA, 22 bp, Artificial Sequence
  Synthetic
cggggtttacagtggcctcatt

SEQ ID NO: 19030 - DNA, 20 bp, Artificial Sequence
  Synthetic
gctgaagcggctaagtggga

SEQ ID NO: 19031 - DNA, 19 bp, Artificial Sequence
  Synthetic
tcccgctctgccagctcga

SEQ ID NO: 19032 - DNA, 22 bp, Artificial Sequence
  Synthetic
tgctcttcaaccttggcagtgt

SEQ ID NO: 19033 - DNA, 19 bp, Artificial Sequence
  Synthetic
aggcaggcgtccttgggtg

SEQ ID NO: 19034 - DNA, 20 bp, Artificial Sequence
  Synthetic
tggcgccctaagaccacctg

SEQ ID NO: 19035 - DNA, 18 bp, Artificial Sequence
  Synthetic
gcagcacacgcccccatt

SEQ ID NO: 19036 - DNA, 21 bp, Artificial Sequence
  Synthetic
aaggctggcaaagatccccag

SEQ ID NO: 19037 - DNA, 22 bp, Artificial Sequence
  Synthetic
tcagcctacaagagcacccaga

SEQ ID NO: 19038 - DNA, 22 bp, Artificial Sequence
  Synthetic
gccgagaagaccttctcctgcc

SEQ ID NO: 19039 - DNA, 22 bp, Artificial Sequence
  Synthetic
gccatcaagtgcacgtgcaacg

SEQ ID NO: 19040 - DNA, 20 bp, Artificial Sequence
  Synthetic
gccgggacaagctcagcctc

SEQ ID NO: 19041 - DNA, 20 bp, Artificial Sequence
  Synthetic
aggaggccgggcgctatagg

SEQ ID NO: 19042 - DNA, 21 bp, Artificial Sequence
  Synthetic
gggacgtggtctactgggagc

SEQ ID NO: 19043 - DNA, 20 bp, Artificial Sequence
  Synthetic
cgctgtgtgggcgagctgat

SEQ ID NO: 19044 - DNA, 22 bp, Artificial Sequence
  Synthetic
agctagagaaggagccccatgg

SEQ ID NO: 19045 - DNA, 22 bp, Artificial Sequence
  Synthetic
tgtggctgcgttacaccgatat

SEQ ID NO: 19046 - DNA, 22 bp, Artificial Sequence
  Synthetic
ccctggccacctaccctcttag

SEQ ID NO: 19047 - DNA, 22 bp, Artificial Sequence
  Synthetic
tcaaggcctccctgaggaagga

SEQ ID NO: 19048 - DNA, 21 bp, Artificial Sequence
  Synthetic
cctcccctacggttaccccac

SEQ ID NO: 19049 - DNA, 23 bp, Artificial Sequence
  Synthetic
cgagtcagccatggaagaagaaa

SEQ ID NO: 19050 - DNA, 25 bp, Artificial Sequence
  Synthetic
aggtagtactaaagcatgcaaatct

SEQ ID NO: 19051 - DNA, 25 bp, Artificial Sequence
  Synthetic
cgtttgtactggagaaccaactaac

SEQ ID NO: 19052 - DNA, 25 bp, Artificial Sequence
  Synthetic
tgaaagaagaaaatggcaactggtg

SEQ ID NO: 19053 - DNA, 24 bp, Artificial Sequence
  Synthetic
ggtctatttgtgtggcgagttttc

SEQ ID NO: 19054 - DNA, 23 bp, Artificial Sequence
  Synthetic
accatatctttgggcatctgatg

SEQ ID NO: 19055 - DNA, 22 bp, Artificial Sequence
  Synthetic
cgaaaacggtcgtgtaggtctt

SEQ ID NO: 19056 - DNA, 25 bp, Artificial Sequence
  Synthetic
aggttggggttcttcaatttcaaat

SEQ ID NO: 19057 - DNA, 25 bp, Artificial Sequence
  Synthetic
tgcctccatgaaagtaatatccagt

SEQ ID NO: 19058 - DNA, 25 bp, Artificial Sequence
  Synthetic
gcatttccaaatccaaattcacaca

SEQ ID NO: 19059 - DNA, 25 bp, Artificial Sequence
  Synthetic
tgcaggacattttgtagctaatgat

SEQ ID NO: 19060 - DNA, 25 bp, Artificial Sequence
  Synthetic
ggtatgttggcttggctttatactc

SEQ ID NO: 19061 - DNA, 25 bp, Artificial Sequence
  Synthetic
cgcatggtagcctatacatattgtg

SEQ ID NO: 19062 - DNA, 25 bp, Artificial Sequence
  Synthetic
gtcgatgaaatctcctggataacat

SEQ ID NO: 19063 - DNA, 25 bp, Artificial Sequence
  Synthetic
acttctttccctttcttgttcacat

SEQ ID NO: 19064 - DNA, 25 bp, Artificial Sequence
  Synthetic
agcataccttggtgctattagattt

SEQ ID NO: 19065 - DNA, 20 bp, Artificial Sequence
  Synthetic
aaccggcaatggctccaaat

SEQ ID NO: 19066 - DNA, 25 bp, Artificial Sequence
  Synthetic
cccattgattccaatttcactccat

SEQ ID NO: 19067 - DNA, 21 bp, Artificial Sequence
  Synthetic
acgtgccaagacttaccgtta

SEQ ID NO: 19068 - DNA, 21 bp, Artificial Sequence
  Synthetic
acaccaaatcctcctctgtcc

SEQ ID NO: 19069 - DNA, 25 bp, Artificial Sequence
  Synthetic
cctttccagctgtttctgaccttat

SEQ ID NO: 19070 - DNA, 24 bp, Artificial Sequence
  Synthetic
accagttgtatatcacccagcaaa

SEQ ID NO: 19071 - DNA, 22 bp, Artificial Sequence
  Synthetic
ccctgtacagcatctccatcat

SEQ ID NO: 19072 - DNA, 20 bp, Artificial Sequence
  Synthetic
ctgttgttggtggattggcc

SEQ ID NO: 19073 - DNA, 24 bp, Artificial Sequence
  Synthetic
tggtggcatataatgtagccaaat

SEQ ID NO: 19074 - DNA, 24 bp, Artificial Sequence
  Synthetic
agtcaaattgtgtagcatttgcag

SEQ ID NO: 19075 - DNA, 25 bp, Artificial Sequence
  Synthetic
ggtcagtaagttcaaattgtggttt

SEQ ID NO: 19076 - DNA, 22 bp, Artificial Sequence
  Synthetic
ccccaatcgcataactccattt

SEQ ID NO: 19077 - DNA, 20 bp, Artificial Sequence
  Synthetic
accccgacctggaaagggtg

SEQ ID NO: 19078 - DNA, 21 bp, Artificial Sequence
  Synthetic
ggtgggggtagtggagtctgc

SEQ ID NO: 19079 - DNA, 21 bp, Artificial Sequence
  Synthetic
gcacttaagcacattggcgtc

SEQ ID NO: 19080 - DNA, 25 bp, Artificial Sequence
  Synthetic
cgaaccatgttagttagtatgggtt

SEQ ID NO: 19081 - DNA, 21 bp, Artificial Sequence
  Synthetic
cctggcccttcccctaatgga

SEQ ID NO: 19082 - DNA, 25 bp, Artificial Sequence
  Synthetic
accttctgttacaactggagtatct

SEQ ID NO: 19083 - DNA, 25 bp, Artificial Sequence
  Synthetic
ggcgttgtacatctaaaaattgcct

SEQ ID NO: 19084 - DNA, 22 bp, Artificial Sequence
  Synthetic
actttcaactgggccttgtact

SEQ ID NO: 19085 - DNA, 25 bp, Artificial Sequence
  Synthetic
gcaaacggtcactaattgcatgata

SEQ ID NO: 19086 - DNA, 22 bp, Artificial Sequence
  Synthetic
acctgatgttccaacccctaaa

SEQ ID NO: 19087 - DNA, 25 bp, Artificial Sequence
  Synthetic
tgctggcaaaaagaaattatgatcc

SEQ ID NO: 19088 - DNA, 23 bp, Artificial Sequence
  Synthetic
aggggccgttttttatcgaaatt

SEQ ID NO: 19089 - DNA, 20 bp, Artificial Sequence
  Synthetic
atgcacagctagcgccatat

SEQ ID NO: 19090 - DNA, 22 bp, Artificial Sequence
  Synthetic
tgttgggatcttctggcctatt

SEQ ID NO: 19091 - DNA, 25 bp, Artificial Sequence
  Synthetic
gcttaatgccactgtatcgtttcaa

SEQ ID NO: 19092 - DNA, 24 bp, Artificial Sequence
  Synthetic
acacgttaacagtactcgattcct

SEQ ID NO: 19093 - DNA, 24 bp, Artificial Sequence
  Synthetic
cgttttgatttagcctcagtcttc

SEQ ID NO: 19094 - DNA, 23 bp, Artificial Sequence
  Synthetic
gtgaaatggcgaactgtttgttc

SEQ ID NO: 19095 - DNA, 25 bp, Artificial Sequence
  Synthetic
agaacggttaggattcgtttttctt

SEQ ID NO: 19096 - DNA, 25 bp, Artificial Sequence
  Synthetic
actcggagacaagtgatataatgga

SEQ ID NO: 19097 - DNA, 25 bp, Artificial Sequence
  Synthetic
ccatctttacatgagaaggcattcc

SEQ ID NO: 19098 - DNA, 23 bp, Artificial Sequence
  Synthetic
aaccatgatccaccatgttcaat

SEQ ID NO: 19099 - DNA, 25 bp, Artificial Sequence
  Synthetic
cgcaccttgacaaatcctttagaaa

SEQ ID NO: 19100 - DNA, 24 bp, Artificial Sequence
  Synthetic
agcatcaactgatgagccagaatc

SEQ ID NO: 19101 - DNA, 21 bp, Artificial Sequence
  Synthetic
agacaaagagtatgcagcggt

SEQ ID NO: 19102 - DNA, 24 bp, Artificial Sequence
  Synthetic
tgttccatagtcccttgtcgatat

SEQ ID NO: 19103 - DNA, 24 bp, Artificial Sequence
  Synthetic
atcaccctctacaaaaagctccta

SEQ ID NO: 19104 - DNA, 23 bp, Artificial Sequence
  Synthetic
cacagtatcgcaagttgaaggtt

SEQ ID NO: 19105 - DNA, 20 bp, Artificial Sequence
  Synthetic
tttgcaggcctgtagtccct

SEQ ID NO: 19106 - DNA, 22 bp, Artificial Sequence
  Synthetic
cccccgaaaagctctatccatg

SEQ ID NO: 19107 - DNA, 23 bp, Artificial Sequence
  Synthetic
gccaaccattgcttatccgaaat

SEQ ID NO: 19108 - DNA, 22 bp, Artificial Sequence
  Synthetic
cctttgctacctcttccatgga

SEQ ID NO: 19109 - DNA, 25 bp, Artificial Sequence
  Synthetic
ttttgctatccaatttcctgagtct

SEQ ID NO: 19110 - DNA, 25 bp, Artificial Sequence
  Synthetic
aaagcgttctagttgtgtgtgataa

SEQ ID NO: 19111 - DNA, 22 bp, Artificial Sequence
  Synthetic
gttcgcatattggaagacggag

SEQ ID NO: 19112 - DNA, 23 bp, Artificial Sequence
  Synthetic
aggtttaacaaaagccaaggagg

SEQ ID NO: 19113 - DNA, 24 bp, Artificial Sequence
  Synthetic
cggagtagagaaatcagcagactg

SEQ ID NO: 19114 - DNA, 23 bp, Artificial Sequence
  Synthetic
catgcaccaatagttacggtgtt

SEQ ID NO: 19115 - DNA, 25 bp, Artificial Sequence
  Synthetic
gcttgtgtgtcttttgtctttttca

SEQ ID NO: 19116 - DNA, 23 bp, Artificial Sequence
  Synthetic
gtttcacctcctaagaagaaccg

SEQ ID NO: 19117 - DNA, 23 bp, Artificial Sequence
  Synthetic
catcctgttcagctttacgaagg

SEQ ID NO: 19118 - DNA, 25 bp, Artificial Sequence
  Synthetic
ccttcggttatcggagtagttacaa

SEQ ID NO: 19119 - DNA, 25 bp, Artificial Sequence
  Synthetic
ggaagcagataatttagaggaagct

SEQ ID NO: 19120 - DNA, 24 bp, Artificial Sequence
  Synthetic
cctaagatagcgatcaaaggttga

SEQ ID NO: 19121 - DNA, 23 bp, Artificial Sequence
  Synthetic
gcaggtttagatgttgtgggttt

SEQ ID NO: 19122 - DNA, 25 bp, Artificial Sequence
  Synthetic
aatgttctaaaggggatgtggattt

SEQ ID NO: 19123 - DNA, 21 bp, Artificial Sequence
  Synthetic
ggagtggattcctcggttgtt

SEQ ID NO: 19124 - DNA, 25 bp, Artificial Sequence
  Synthetic
catgggtgatttcttctgggaatta

SEQ ID NO: 19125 - DNA, 23 bp, Artificial Sequence
  Synthetic
agaactgctgcctctaaaagatc

SEQ ID NO: 19126 - DNA, 25 bp, Artificial Sequence
  Synthetic
ctggtaaaagaagggctgtttgata

SEQ ID NO: 19127 - DNA, 20 bp, Artificial Sequence
  Synthetic
ggctgcagaggctattgaag

SEQ ID NO: 19128 - DNA, 20 bp, Artificial Sequence
  Synthetic
agacgtcacaggtgtggtaa

SEQ ID NO: 19129 - DNA, 24 bp, Artificial Sequence
  Synthetic
gattgctcctcagaggtattggta

SEQ ID NO: 19130 - DNA, 22 bp, Artificial Sequence
  Synthetic
tggtttcttgcccaagatctca

SEQ ID NO: 19131 - DNA, 24 bp, Artificial Sequence
  Synthetic
ttcacagatcctccgtaaagaatg

SEQ ID NO: 19132 - DNA, 24 bp, Artificial Sequence
  Synthetic
aggttatggaatcgcggttatcag

SEQ ID NO: 19133 - DNA, 20 bp, Artificial Sequence
  Synthetic
tggaatttctcgaggcgctc

SEQ ID NO: 19134 - DNA, 25 bp, Artificial Sequence
  Synthetic
gaagtggatactgagacagaaagtt

SEQ ID NO: 19135 - DNA, 22 bp, Artificial Sequence
  Synthetic
ggtgcatattacgctgtccttc

SEQ ID NO: 19136 - DNA, 20 bp, Artificial Sequence
  Synthetic
tggtcaaagacgcaagctgt

SEQ ID NO: 19137 - DNA, 22 bp, Artificial Sequence
  Synthetic
atgattttgttcgttggcggag

SEQ ID NO: 19138 - DNA, 24 bp, Artificial Sequence
  Synthetic
agctagcttcatggagtatgtcta

SEQ ID NO: 19139 - DNA, 22 bp, Artificial Sequence
  Synthetic
gggaaaggggttttcaagaaga

SEQ ID NO: 19140 - DNA, 22 bp, Artificial Sequence
  Synthetic
tttcaggaatttctgtcggtgg

SEQ ID NO: 19141 - DNA, 21 bp, Artificial Sequence
  Synthetic
agaaggaagaccgcaaaggaa

SEQ ID NO: 19142 - DNA, 24 bp, Artificial Sequence
  Synthetic
catggtagtcgtaaaagaaaggga

SEQ ID NO: 19143 - DNA, 20 bp, Artificial Sequence
  Synthetic
tagaggcccaggaatggaga

SEQ ID NO: 19144 - DNA, 21 bp, Artificial Sequence
  Synthetic
gctcagtatttagcagggcag

SEQ ID NO: 19145 - DNA, 24 bp, Artificial Sequence
  Synthetic
gttagcatggcaggagaatttctt

SEQ ID NO: 19146 - DNA, 24 bp, Artificial Sequence
  Synthetic
aggctgctaatatgtcttcacgtt

SEQ ID NO: 19147 - DNA, 20 bp, Artificial Sequence
  Synthetic
tcagaaagggctgaaggcag

SEQ ID NO: 19148 - DNA, 23 bp, Artificial Sequence
  Synthetic
agttgcacagaaataacagctcc

SEQ ID NO: 19149 - DNA, 23 bp, Artificial Sequence
  Synthetic
tgctttcgagaggatacaaaggg

SEQ ID NO: 19150 - DNA, 20 bp, Artificial Sequence
  Synthetic
taaggggtccccagacatgg

SEQ ID NO: 19151 - DNA, 20 bp, Artificial Sequence
  Synthetic
tggctcagtcggttcttcag

SEQ ID NO: 19152 - DNA, 21 bp, Artificial Sequence
  Synthetic
tctacggcgagcttgtttact

SEQ ID NO: 19153 - DNA, 25 bp, Artificial Sequence
  Synthetic
cttgaatttcgaaagaggatgttgc

SEQ ID NO: 19154 - DNA, 22 bp, Artificial Sequence
  Synthetic
ggttgtcagtaagatcgtcgga

SEQ ID NO: 19155 - DNA, 22 bp, Artificial Sequence
  Synthetic
acaggattcttgctttggcaga

SEQ ID NO: 19156 - DNA, 25 bp, Artificial Sequence
  Synthetic
cattgatcgttttgctagggatttc

SEQ ID NO: 19157 - DNA, 23 bp, Artificial Sequence
  Synthetic
cacgagtgtttgagtgctaagtc

SEQ ID NO: 19158 - DNA, 20 bp, Artificial Sequence
  Synthetic
gtaggggctcaaggacgaac

SEQ ID NO: 19159 - DNA, 23 bp, Artificial Sequence
  Synthetic
gattgtagagtgggatcagcaag

SEQ ID NO: 19160 - DNA, 25 bp, Artificial Sequence
  Synthetic
cctacctggttgattatggagaaat

SEQ ID NO: 19161 - DNA, 20 bp, Artificial Sequence
  Synthetic
aaagctcctttttcgtgccc

SEQ ID NO: 19162 - DNA, 22 bp, Artificial Sequence
  Synthetic
tcccattctcttcacgaggttt

SEQ ID NO: 19163 - DNA, 23 bp, Artificial Sequence
  Synthetic
tgttcaatgttcctttggagcag

SEQ ID NO: 19164 - DNA, 20 bp, Artificial Sequence
  Synthetic
cgtgcgtgctagaacttctt

SEQ ID NO: 19165 - DNA, 25 bp, Artificial Sequence
  Synthetic
gcatttgtacgttgatatcgagcat

SEQ ID NO: 19166 - DNA, 21 bp, Artificial Sequence
  Synthetic
gcatgcagggttgctatcaac

SEQ ID NO: 19167 - DNA, 22 bp, Artificial Sequence
  Synthetic
tggtataagaacggtcgtgtgc

SEQ ID NO: 19168 - DNA, 21 bp, Artificial Sequence
  Synthetic
gatggcgctattgcaaatgca

SEQ ID NO: 19169 - DNA, 25 bp, Artificial Sequence
  Synthetic
agaagaaaactccaatcaaaacgtg

SEQ ID NO: 19170 - DNA, 20 bp, Artificial Sequence
  Synthetic
ggcagctcctcaattccgag

SEQ ID NO: 19171 - DNA, 20 bp, Artificial Sequence
  Synthetic
gggaagcagaccagagaaga

SEQ ID NO: 19172 - DNA, 21 bp, Artificial Sequence
  Synthetic
tccccagggaatttctttgca

SEQ ID NO: 19173 - DNA, 23 bp, Artificial Sequence
  Synthetic
gggaggtaaatcaagactccgat

SEQ ID NO: 19174 - DNA, 24 bp, Artificial Sequence
  Synthetic
atcgtagagtcttgtatcacctga

SEQ ID NO: 19175 - DNA, 22 bp, Artificial Sequence
  Synthetic
ttacgctaaaaacgggcctatt

SEQ ID NO: 19176 - DNA, 22 bp, Artificial Sequence
  Synthetic
tcatcaagctatcggcgatgta

SEQ ID NO: 19177 - DNA, 21 bp, Artificial Sequence
  Synthetic
gcaagagcagcttctttgtct

SEQ ID NO: 19178 - DNA, 20 bp, Artificial Sequence
  Synthetic
ctccaggagttgcggataca

SEQ ID NO: 19179 - DNA, 25 bp, Artificial Sequence
  Synthetic
caatcaatgcagaattcgtcacaaa

SEQ ID NO: 19180 - DNA, 22 bp, Artificial Sequence
  Synthetic
gctatcgaagtggattgccgaa

SEQ ID NO: 19181 - DNA, 23 bp, Artificial Sequence
  Synthetic
cttcgtcaagggttcttgtgatt

SEQ ID NO: 19182 - DNA, 21 bp, Artificial Sequence
  Synthetic
ttgcgcatggatgactgttag

SEQ ID NO: 19183 - DNA, 25 bp, Artificial Sequence
  Synthetic
cgagcagcaagaaggaattaattgt

SEQ ID NO: 19184 - DNA, 22 bp, Artificial Sequence
  Synthetic
gctgtttcatctgcggaacttt

SEQ ID NO: 19185 - DNA, 25 bp, Artificial Sequence
  Synthetic
gagaagtctttattcaagccaaagg

SEQ ID NO: 19186 - DNA, 20 bp, Artificial Sequence
  Synthetic
aacagaaagcctgagccagc

SEQ ID NO: 19187 - DNA, 24 bp, Artificial Sequence
  Synthetic
gtcctccgctgatgatattagaag

SEQ ID NO: 19188 - DNA, 20 bp, Artificial Sequence
  Synthetic
cagcaaatggtgaatgctgc

SEQ ID NO: 19189 - DNA, 21 bp, Artificial Sequence
  Synthetic
tgcgagtgttatatgagcacg

SEQ ID NO: 19190 - DNA, 25 bp, Artificial Sequence
  Synthetic
tgtccatttatttggtcttggagtc

SEQ ID NO: 19191 - DNA, 22 bp, Artificial Sequence
  Synthetic
cgcttcatcgataggcatagcc

SEQ ID NO: 19192 - DNA, 25 bp, Artificial Sequence
  Synthetic
tccaagaattagacaaaagatcgca

SEQ ID NO: 19193 - DNA, 25 bp, Artificial Sequence
  Synthetic
caaccaccttgatgaaaaacaaagt

SEQ ID NO: 19194 - DNA, 25 bp, Artificial Sequence
  Synthetic
cgatgtagtattttgctcttgcctt

SEQ ID NO: 19195 - DNA, 23 bp, Artificial Sequence
  Synthetic
agctaatcactcacagcaccatc

SEQ ID NO: 19196 - DNA, 20 bp, Artificial Sequence
  Synthetic
taccgtcgtatgtcggctga

SEQ ID NO: 19197 - DNA, 23 bp, Artificial Sequence
  Synthetic
ctttccgactgcagttgatcatt

SEQ ID NO: 19198 - DNA, 25 bp, Artificial Sequence
  Synthetic
gttgttcttttgggtacaacaatct

SEQ ID NO: 19199 - DNA, 20 bp, Artificial Sequence
  Synthetic
caaaggagttgccggacctc

SEQ ID NO: 19200 - DNA, 25 bp, Artificial Sequence
  Synthetic
cgttgaaaccgattttgttgctaac

SEQ ID NO: 19201 - DNA, 20 bp, Artificial Sequence
  Synthetic
acctgcggaagaagctgttg

SEQ ID NO: 19202 - DNA, 25 bp, Artificial Sequence
  Synthetic
ggatcctaaatagcgcttcactaaa

SEQ ID NO: 19203 - DNA, 24 bp, Artificial Sequence
  Synthetic
tcacctaacctaggattatgcgtt

SEQ ID NO: 19204 - DNA, 21 bp, Artificial Sequence
  Synthetic
gccctttcccaactccttgag

SEQ ID NO: 19205 - DNA, 20 bp, Artificial Sequence
  Synthetic
ttaggcccagaggtcgattg

SEQ ID NO: 19206 - DNA, 24 bp, Artificial Sequence
  Synthetic
gtcaccggagcatcattatttact

SEQ ID NO: 19207 - DNA, 20 bp, Artificial Sequence
  Synthetic
gtgggagcgttcgagacatg

SEQ ID NO: 19208 - DNA, 23 bp, Artificial Sequence
  Synthetic
ggacaattccgcataatttcgga

SEQ ID NO: 19209 - DNA, 22 bp, Artificial Sequence
  Synthetic
caatgcaccccttctttctgat

SEQ ID NO: 19210 - DNA, 21 bp, Artificial Sequence
  Synthetic
ccaccttcaatcacagcactt

SEQ ID NO: 19211 - DNA, 22 bp, Artificial Sequence
  Synthetic
cgggatgattgaagtacagtcc

SEQ ID NO: 19212 - DNA, 22 bp, Artificial Sequence
  Synthetic
ccagtcctcttgtctttcgact

SEQ ID NO: 19213 - DNA, 24 bp, Artificial Sequence
  Synthetic
ctgttttattcttgcgtattggct

SEQ ID NO: 19214 - DNA, 21 bp, Artificial Sequence
  Synthetic
cggctttgcgcataaaaaaca

SEQ ID NO: 19215 - DNA, 24 bp, Artificial Sequence
  Synthetic
gcgattttaaccacaagcttcaaa

SEQ ID NO: 19216 - DNA, 24 bp, Artificial Sequence
  Synthetic
caaagttctggcattacagatcct

SEQ ID NO: 19217 - DNA, 23 bp, Artificial Sequence
  Synthetic
gccctgaagtcagattttcttgc

SEQ ID NO: 19218 - DNA, 20 bp, Artificial Sequence
  Synthetic
atgcagggttcgggaaaaca

SEQ ID NO: 19219 - DNA, 22 bp, Artificial Sequence
  Synthetic
cctccgtagacaaaaacaacgg

SEQ ID NO: 19220 - DNA, 24 bp, Artificial Sequence
  Synthetic
gcactctttaaatgattgctgcct

SEQ ID NO: 19221 - DNA, 20 bp, Artificial Sequence
  Synthetic
gagtttgggcaagccgatga

SEQ ID NO: 19222 - DNA, 20 bp, Artificial Sequence
  Synthetic
ctgttcgaaacgcatggcag

SEQ ID NO: 19223 - DNA, 22 bp, Artificial Sequence
  Synthetic
tcccaaccaactgcttaaacat

SEQ ID NO: 19224 - DNA, 24 bp, Artificial Sequence
  Synthetic
agtgattgttacctctttgcaacc

SEQ ID NO: 19225 - DNA, 21 bp, Artificial Sequence
  Synthetic
ccataggatctggaaccggag

SEQ ID NO: 19226 - DNA, 25 bp, Artificial Sequence
  Synthetic
actctttttagactctgtgcgtgtc

SEQ ID NO: 19227 - DNA, 24 bp, Artificial Sequence
  Synthetic
gccccaatcgaaaatctctcctat

SEQ ID NO: 19228 - DNA, 23 bp, Artificial Sequence
  Synthetic
tgggatgcgatcttctgtgtatt

SEQ ID NO: 19229 - DNA, 23 bp, Artificial Sequence
  Synthetic
aggagaacacataccctcttctt

SEQ ID NO: 19230 - DNA, 22 bp, Artificial Sequence
  Synthetic
tgaagaaccaggatccagctaa

SEQ ID NO: 19231 - DNA, 20 bp, Artificial Sequence
  Synthetic
gctcgcaatagcagttctcc

SEQ ID NO: 19232 - DNA, 20 bp, Artificial Sequence
  Synthetic
agagtgcgcaataaccaccc

SEQ ID NO: 19233 - DNA, 25 bp, Artificial Sequence
  Synthetic
gtcacgaatattttcctgagaagga

SEQ ID NO: 19234 - DNA, 21 bp, Artificial Sequence
  Synthetic
aagaccctgctttccctgtaa

SEQ ID NO: 19235 - DNA, 23 bp, Artificial Sequence
  Synthetic
ccaaagctccgtacactttttcc

SEQ ID NO: 19236 - DNA, 20 bp, Artificial Sequence
  Synthetic
atctcccgcagccatatcac

SEQ ID NO: 19237 - DNA, 22 bp, Artificial Sequence
  Synthetic
gtgtctcgaaaagctgcttcta

SEQ ID NO: 19238 - DNA, 23 bp, Artificial Sequence
  Synthetic
cgatttccctaacgcttccttat

SEQ ID NO: 19239 - DNA, 21 bp, Artificial Sequence
  Synthetic
accacaactcttgctcgctta

SEQ ID NO: 19240 - DNA, 25 bp, Artificial Sequence
  Synthetic
catccgcaaaagttactttgttttg

SEQ ID NO: 19241 - DNA, 22 bp, Artificial Sequence
  Synthetic
acaagcttgctgttaaactcct

SEQ ID NO: 19242 - DNA, 25 bp, Artificial Sequence
  Synthetic
gcgcattgaaactatgcagatcaat

SEQ ID NO: 19243 - DNA, 20 bp, Artificial Sequence
  Synthetic
tccagcacacatgagacagg

SEQ ID NO: 19244 - DNA, 25 bp, Artificial Sequence
  Synthetic
ccagaaagtttaatctgcgctcttt

SEQ ID NO: 19245 - DNA, 23 bp, Artificial Sequence
  Synthetic
cctactcatgcggaatgttttgg

SEQ ID NO: 19246 - DNA, 22 bp, Artificial Sequence
  Synthetic
cctaatccacaacgaggtcctg

SEQ ID NO: 19247 - DNA, 24 bp, Artificial Sequence
  Synthetic
ttcctcattatctttggtcttgcc

SEQ ID NO: 19248 - DNA, 20 bp, Artificial Sequence
  Synthetic
acaaaccgatcgcgaattgg

SEQ ID NO: 19249 - DNA, 20 bp, Artificial Sequence
  Synthetic
cgcaaatgattacgcccctc

SEQ ID NO: 19250 - DNA, 22 bp, Artificial Sequence
  Synthetic
gccctgatagaaggagctatgg

SEQ ID NO: 19251 - DNA, 20 bp, Artificial Sequence
  Synthetic
ttggaggtggcatcctttcc

SEQ ID NO: 19252 - DNA, 20 bp, Artificial Sequence
  Synthetic
accggccaaactccatcaag

SEQ ID NO: 19253 - DNA, 24 bp, Artificial Sequence
  Synthetic
ccagcagctacattgctactaaag

SEQ ID NO: 19254 - DNA, 25 bp, Artificial Sequence
  Synthetic
tgaatgcgcagatcgtatatctaaa

SEQ ID NO: 19255 - DNA, 22 bp, Artificial Sequence
  Synthetic
aggttttcatatgctggttccc

SEQ ID NO: 19256 - DNA, 22 bp, Artificial Sequence
  Synthetic
acccgctgctgaattattttgt

SEQ ID NO: 19257 - DNA, 23 bp, Artificial Sequence
  Synthetic
gacaaaccatgattcacctcgat

SEQ ID NO: 19258 - DNA, 20 bp, Artificial Sequence
  Synthetic
ccgcatctgtaagctcacag

SEQ ID NO: 19259 - DNA, 20 bp, Artificial Sequence
  Synthetic
tcatcttcccgacggatgct

SEQ ID NO: 19260 - DNA, 25 bp, Artificial Sequence
  Synthetic
gccagattcgccttatttcttcttt

SEQ ID NO: 19261 - DNA, 23 bp, Artificial Sequence
  Synthetic
tctccagaagttccgatcattga

SEQ ID NO: 19262 - DNA, 21 bp, Artificial Sequence
  Synthetic
ggcccagtacctgcttcttag

SEQ ID NO: 19263 - DNA, 23 bp, Artificial Sequence
  Synthetic
ccttggaaccgattcttacactg

SEQ ID NO: 19264 - DNA, 23 bp, Artificial Sequence
  Synthetic
tgtactttaacacagccactgcc

SEQ ID NO: 19265 - DNA, 25 bp, Artificial Sequence
  Synthetic
cactagaatcaggataacaggagca

SEQ ID NO: 19266 - DNA, 25 bp, Artificial Sequence
  Synthetic
aaaccgtttcttgaactaatgcttt

SEQ ID NO: 19267 - DNA, 22 bp, Artificial Sequence
  Synthetic
tcagaccgtgtttaaagaagcg

SEQ ID NO: 19268 - DNA, 22 bp, Artificial Sequence
  Synthetic
ttgtgtaggctgaagctactgt

SEQ ID NO: 19269 - DNA, 25 bp, Artificial Sequence
  Synthetic
tccacatccttggtaaaggtagtct

SEQ ID NO: 19270 - DNA, 23 bp, Artificial Sequence
  Synthetic
aagctgttgttgcaattttttgc

SEQ ID NO: 19271 - DNA, 25 bp, Artificial Sequence
  Synthetic
cctgttatctagtcctccaacaact

SEQ ID NO: 19272 - DNA, 20 bp, Artificial Sequence
  Synthetic
cctgacagcaactccctcat

SEQ ID NO: 19273 - DNA, 24 bp, Artificial Sequence
  Synthetic
tggttacagtggtatcagttccac

SEQ ID NO: 19274 - DNA, 25 bp, Artificial Sequence
  Synthetic
agcttcagatcttgcattttcaatt

SEQ ID NO: 19275 - DNA, 25 bp, Artificial Sequence
  Synthetic
cagatcaatttttgtgtcaagaggg

SEQ ID NO: 19276 - DNA, 25 bp, Artificial Sequence
  Synthetic
gttgaatagcttagtgacacctcct

SEQ ID NO: 19277 - DNA, 21 bp, Artificial Sequence
  Synthetic
tagcaacctccatggcctccg

SEQ ID NO: 19278 - DNA, 23 bp, Artificial Sequence
  Synthetic
ggaacactttcactgcctgtatt

SEQ ID NO: 19279 - DNA, 20 bp, Artificial Sequence
  Synthetic
tcaatgggctggacaaggtc

SEQ ID NO: 19280 - DNA, 25 bp, Artificial Sequence
  Synthetic
ccatctacatcactacaatcagctt

SEQ ID NO: 19281 - DNA, 24 bp, Artificial Sequence
  Synthetic
tgcgttgaggcgaaatagtaatag

SEQ ID NO: 19282 - DNA, 20 bp, Artificial Sequence
  Synthetic
caaagctgctactacgctgc

SEQ ID NO: 19283 - DNA, 21 bp, Artificial Sequence
  Synthetic
cattgaaacggtcgctgagag

SEQ ID NO: 19284 - DNA, 24 bp, Artificial Sequence
  Synthetic
gtgcgtcttgagcaaatctgatat

SEQ ID NO: 19285 - DNA, 20 bp, Artificial Sequence
  Synthetic
tttggatccccctggaggcg

SEQ ID NO: 19286 - DNA, 18 bp, Artificial Sequence
  Synthetic
tcccccgttcccttccgt

SEQ ID NO: 19287 - DNA, 25 bp, Artificial Sequence
  Synthetic
gaccatgtagtactgaagcaatcat

SEQ ID NO: 19288 - DNA, 20 bp, Artificial Sequence
  Synthetic
ggcaccaaagcaggcctaat

SEQ ID NO: 19289 - DNA, 25 bp, Artificial Sequence
  Synthetic
ccaagtctgctaacccttatatagc

SEQ ID NO: 19290 - DNA, 25 bp, Artificial Sequence
  Synthetic
tcgtttcttccattttaagctagga

SEQ ID NO: 19291 - DNA, 22 bp, Artificial Sequence
  Synthetic
tccctgacaccttaggcactaa

SEQ ID NO: 19292 - DNA, 25 bp, Artificial Sequence
  Synthetic
agcatggtgtacatcctaaaacaaa

SEQ ID NO: 19293 - DNA, 25 bp, Artificial Sequence
  Synthetic
ccatagaaaaaacatgagttgccat

SEQ ID NO: 19294 - DNA, 25 bp, Artificial Sequence
  Synthetic
ggccgattaaataattgtgcatcag

SEQ ID NO: 19295 - DNA, 24 bp, Artificial Sequence
  Synthetic
caccactatgaaaaatctacgccc

SEQ ID NO: 19296 - DNA, 21 bp, Artificial Sequence
  Synthetic
gctagactgcacacaacactc

SEQ ID NO: 19297 - DNA, 20 bp, Artificial Sequence
  Synthetic
atttccgggattgcacaggc

SEQ ID NO: 19298 - DNA, 25 bp, Artificial Sequence
  Synthetic
tgcaatctcataacataacgtggat

SEQ ID NO: 19299 - DNA, 25 bp, Artificial Sequence
  Synthetic
aatccaacctttaaaatcacacgag

SEQ ID NO: 19300 - DNA, 25 bp, Artificial Sequence
  Synthetic
gccacacttgtgttgaacataatca

SEQ ID NO: 19301 - DNA, 25 bp, Artificial Sequence
  Synthetic
ccaatcttaaaacaagaaaggccat

SEQ ID NO: 19302 - DNA, 24 bp, Artificial Sequence
  Synthetic
ccagccttggccatataaacatta

SEQ ID NO: 19303 - DNA, 25 bp, Artificial Sequence
  Synthetic
agtttcctcaccttctacatcatct

SEQ ID NO: 19304 - DNA, 25 bp, Artificial Sequence
  Synthetic
ccaaggtatcaacaaacaactgact

SEQ ID NO: 19305 - DNA, 21 bp, Artificial Sequence
  Synthetic
gccccctgtagagacataaca

SEQ ID NO: 19306 - DNA, 25 bp, Artificial Sequence
  Synthetic
tctgtttcgtaaacaatggaacgtc

SEQ ID NO: 19307 - DNA, 25 bp, Artificial Sequence
  Synthetic
aacaggcacaaacctattagtgaaa

SEQ ID NO: 19308 - DNA, 25 bp, Artificial Sequence
  Synthetic
tctggagcattaagcaagaaacatt

SEQ ID NO: 19309 - DNA, 23 bp, Artificial Sequence
  Synthetic
tgtaccaaaatgcataacagcgt

SEQ ID NO: 19310 - DNA, 25 bp, Artificial Sequence
  Synthetic
acaccatctactttctcgaatgttt

SEQ ID NO: 19311 - DNA, 25 bp, Artificial Sequence
  Synthetic
ccatcgtcaacatcatccactttta

SEQ ID NO: 19312 - DNA, 25 bp, Artificial Sequence
  Synthetic
ccagcaacctaaaactccaatgtaa

SEQ ID NO: 19313 - DNA, 25 bp, Artificial Sequence
  Synthetic
gcggcctcaacagtaataaaagtat

SEQ ID NO: 19314 - DNA, 25 bp, Artificial Sequence
  Synthetic
actgattaaaagcatccacagacca

SEQ ID NO: 19315 - DNA, 25 bp, Artificial Sequence
  Synthetic
accatatcgtaacactttggtaggg

SEQ ID NO: 19316 - DNA, 20 bp, Artificial Sequence
  Synthetic
acgcacgatacgtacaagcc

SEQ ID NO: 19317 - DNA, 25 bp, Artificial Sequence
  Synthetic
acaacaattacagcgagtatagcac

SEQ ID NO: 19318 - DNA, 25 bp, Artificial Sequence
  Synthetic
gttggtaaagcacatcactaccatt

SEQ ID NO: 19319 - DNA, 25 bp, Artificial Sequence
  Synthetic
cgcataaaaaggaacccttaatggt

SEQ ID NO: 19320 - DNA, 25 bp, Artificial Sequence
  Synthetic
acaaggtcagatttaacttggctaa

SEQ ID NO: 19321 - DNA, 25 bp, Artificial Sequence
  Synthetic
acagtgtaaaaagcacaggagttat

SEQ ID NO: 19322 - DNA, 25 bp, Artificial Sequence
  Synthetic
ccatgtgtaagtaccaaaaagggaa

SEQ ID NO: 19323 - DNA, 20 bp, Artificial Sequence
  Synthetic
acctccaatacccaacagct

SEQ ID NO: 19324 - DNA, 25 bp, Artificial Sequence
  Synthetic
tcaacgaagctagccatattaacaa

SEQ ID NO: 19325 - DNA, 25 bp, Artificial Sequence
  Synthetic
acccgcataggtaacatagacatta

SEQ ID NO: 19326 - DNA, 25 bp, Artificial Sequence
  Synthetic
cagcttgcaatctaactgtagaaga

SEQ ID NO: 19327 - DNA, 24 bp, Artificial Sequence
  Synthetic
cgtaatttgcacaacccatcaaca

SEQ ID NO: 19328 - DNA, 25 bp, Artificial Sequence
  Synthetic
gctgaaaacggcaacaattaacttt

SEQ ID NO: 19329 - DNA, 25 bp, Artificial Sequence
  Synthetic
agtgttaaaacgcctactaagccta

SEQ ID NO: 19330 - DNA, 25 bp, Artificial Sequence
  Synthetic
cagcagcatataaaagcaagtcttt

SEQ ID NO: 19331 - DNA, 25 bp, Artificial Sequence
  Synthetic
aatggatagccagcactcttatcat

SEQ ID NO: 19332 - DNA, 25 bp, Artificial Sequence
  Synthetic
ccaccataaaatttagtggtgccta

SEQ ID NO: 19333 - DNA, 25 bp, Artificial Sequence
  Synthetic
gcttctgaagagcacgtatactaag

SEQ ID NO: 19334 - DNA, 22 bp, Artificial Sequence
  Synthetic
caagcattgtgtgttgtgaaca

SEQ ID NO: 19335 - DNA, 24 bp, Artificial Sequence
  Synthetic
aaggactcatcagtgaacttttgt

SEQ ID NO: 19336 - DNA, 25 bp, Artificial Sequence
  Synthetic
cgctctgtacattcattagctagta

SEQ ID NO: 19337 - DNA, 25 bp, Artificial Sequence
  Synthetic
acgtctcaagcacactataaacact

SEQ ID NO: 19338 - DNA, 25 bp, Artificial Sequence
  Synthetic
acacatacttacgagtggtgtcatt

SEQ ID NO: 19339 - DNA, 25 bp, Artificial Sequence
  Synthetic
gcttagctgcaaagttctgactatt

SEQ ID NO: 19340 - DNA, 25 bp, Artificial Sequence
  Synthetic
ccgctataactcttgctacaatctt

SEQ ID NO: 19341 - DNA, 25 bp, Artificial Sequence
  Synthetic
cacaacaaaatcaattcctgtggaa

SEQ ID NO: 19342 - DNA, 22 bp, Artificial Sequence
  Synthetic
tcacgccctacttttgcaaagt

SEQ ID NO: 19343 - DNA, 24 bp, Artificial Sequence
  Synthetic
tggttgggcatcatagaacttaaa

SEQ ID NO: 19344 - DNA, 25 bp, Artificial Sequence
  Synthetic
atccatatacacacaaggcgtatct

SEQ ID NO: 19345 - DNA, 25 bp, Artificial Sequence
  Synthetic
tcgatcttagccacaactttatcat

SEQ ID NO: 19346 - DNA, 23 bp, Artificial Sequence
  Synthetic
tcgtggaaatgtaaacgccatta

SEQ ID NO: 19347 - DNA, 25 bp, Artificial Sequence
  Synthetic
ccaccaataatcttctggttgaagt

SEQ ID NO: 19348 - DNA, 20 bp, Artificial Sequence
  Synthetic
ggcttccagtcagatgcagc

SEQ ID NO: 19349 - DNA, 25 bp, Artificial Sequence
  Synthetic
tctgcattccaagaaaactctgtta

SEQ ID NO: 19350 - DNA, 20 bp, Artificial Sequence
  Synthetic
tgtgtggcgctgtttgtatt

SEQ ID NO: 19351 - DNA, 23 bp, Artificial Sequence
  Synthetic
tgatgaggggttgatggtgattt

SEQ ID NO: 19352 - DNA, 24 bp, Artificial Sequence
  Synthetic
aaggcgtaaaattaacaccctcat

SEQ ID NO: 19353 - DNA, 25 bp, Artificial Sequence
  Synthetic
acagattgctttcgtaggaacagtt

SEQ ID NO: 19354 - DNA, 24 bp, Artificial Sequence
  Synthetic
tgattgtacgtggttgtactacca

SEQ ID NO: 19355 - DNA, 25 bp, Artificial Sequence
  Synthetic
gcttactattacaagtcagaggcat

SEQ ID NO: 19356 - DNA, 23 bp, Artificial Sequence
  Synthetic
tcccaatttaatggagagggcac

SEQ ID NO: 19357 - DNA, 25 bp, Artificial Sequence
  Synthetic
tcgaggcttaaaaacagaatcttct

SEQ ID NO: 19358 - DNA, 20 bp, Artificial Sequence
  Synthetic
caagacccgaacagtgctca

SEQ ID NO: 19359 - DNA, 20 bp, Artificial Sequence
  Synthetic
agagttagcgtgaaaggccg

SEQ ID NO: 19360 - DNA, 24 bp, Artificial Sequence
  Synthetic
gacaaatgcagcacaatcaatagt

SEQ ID NO: 19361 - DNA, 22 bp, Artificial Sequence
  Synthetic
actttgcacacaaatgaggtcc

SEQ ID NO: 19362 - DNA, 25 bp, Artificial Sequence
  Synthetic
gcggtaagacgaccattaataagtc

SEQ ID NO: 19363 - DNA, 25 bp, Artificial Sequence
  Synthetic
ccactcttaggagctatacctctat

SEQ ID NO: 19364 - DNA, 25 bp, Artificial Sequence
  Synthetic
ccttgagattgatgtagctctgatt

SEQ ID NO: 19365 - DNA, 25 bp, Artificial Sequence
  Synthetic
acaagcatcttctaattctgagaca

SEQ ID NO: 19366 - DNA, 25 bp, Artificial Sequence
  Synthetic
ggcctaacatacattgttcctttca

SEQ ID NO: 19367 - DNA, 25 bp, Artificial Sequence
  Synthetic
gcttaccaggagtaaaagacatcct

SEQ ID NO: 19368 - DNA, 21 bp, Artificial Sequence
  Synthetic
agcgacccagtagactccgtc

SEQ ID NO: 19369 - DNA, 21 bp, Artificial Sequence
  Synthetic
cagccatgtcaggtgttacac

SEQ ID NO: 19370 - DNA, 22 bp, Artificial Sequence
  Synthetic
aacctaattgcgccgttatagc

SEQ ID NO: 19371 - DNA, 20 bp, Artificial Sequence
  Synthetic
ggttaccaccagatgccgac

SEQ ID NO: 19372 - DNA, 22 bp, Artificial Sequence
  Synthetic
actttctgcttgggcattagca

SEQ ID NO: 19373 - DNA, 22 bp, Artificial Sequence
  Synthetic
tccattcaagtcctccgatgag

SEQ ID NO: 19374 - DNA, 22 bp, Artificial Sequence
  Synthetic
ggtcaaggaatggggcatcacc

SEQ ID NO: 19375 - DNA, 22 bp, Artificial Sequence
  Synthetic
gcttgggaatgagcattaacca

SEQ ID NO: 19376 - DNA, 22 bp, Artificial Sequence
  Synthetic
tccattcaagtcctccgatgag

SEQ ID NO: 19377 - DNA, 22 bp, Artificial Sequence
  Synthetic
tggaggctgcacgacactcgta

SEQ ID NO: 19378 - DNA, 20 bp, Artificial Sequence
  Synthetic
ccaacgatctgtccgccacc

SEQ ID NO: 19379 - DNA, 21 bp, Artificial Sequence
  Synthetic
ccccatgaggtcggcgaatcc

SEQ ID NO: 19380 - DNA, 22 bp, Artificial Sequence
  Synthetic
tggggtccagcacgtagatgta

SEQ ID NO: 19381 - DNA, 20 bp, Artificial Sequence
  Synthetic
ccaccaccatacccacagcg

SEQ ID NO: 19382 - DNA, 22 bp, Artificial Sequence
  Synthetic
ggtctgtcatcagaaggaccgg

SEQ ID NO: 19383 - DNA, 20 bp, Artificial Sequence
  Synthetic
gccgctgggacttcagcagg

SEQ ID NO: 19384 - DNA, 21 bp, Artificial Sequence
  Synthetic
cgatcctcgatatcgcagcgc

SEQ ID NO: 19385 - DNA, 21 bp, Artificial Sequence
  Synthetic
cagcgtgaccaggttctccaa

SEQ ID NO: 19386 - DNA, 22 bp, Artificial Sequence
  Synthetic
gtggccactgctaggtctttga

SEQ ID NO: 19387 - DNA, 20 bp, Artificial Sequence
  Synthetic
aggaaggtctgggtagccgt

SEQ ID NO: 19388 - DNA, 22 bp, Artificial Sequence
  Synthetic
gaagggcacataacgggacctc

SEQ ID NO: 19389 - DNA, 20 bp, Artificial Sequence
  Synthetic
gtgcggatgttggggtcgat

SEQ ID NO: 19390 - DNA, 20 bp, Artificial Sequence
  Synthetic
tctacctcgacccgttcggc

SEQ ID NO: 19391 - DNA, 20 bp, Artificial Sequence
  Synthetic
gcgcacacagtggcttggta

SEQ ID NO: 19392 - DNA, 21 bp, Artificial Sequence
  Synthetic
gtctggaacgagtgctggctt

SEQ ID NO: 19393 - DNA, 22 bp, Artificial Sequence
  Synthetic
tttggttggtcgtcaggggact

SEQ ID NO: 19394 - DNA, 19 bp, Artificial Sequence
  Synthetic
tgtcggcgcagtatggctg

SEQ ID NO: 19395 - DNA, 21 bp, Artificial Sequence
  Synthetic
ggaaatgaagggcagcccagg

SEQ ID NO: 19396 - DNA, 21 bp, Artificial Sequence
  Synthetic
cttggcacggacacttgagct

SEQ ID NO: 19397 - DNA, 21 bp, Artificial Sequence
  Synthetic
gatgaggcctatgcgtctggc

SEQ ID NO: 19398 - DNA, 21 bp, Artificial Sequence
  Synthetic
gtccttttcctccgaggggga

SEQ ID NO: 19399 - DNA, 22 bp, Artificial Sequence
  Synthetic
cgccggtccaagaatacgacat

SEQ ID NO: 19400 - DNA, 21 bp, Artificial Sequence
  Synthetic
ccctgctggacaaggagcgaa

SEQ ID NO: 19401 - DNA, 22 bp, Artificial Sequence
  Synthetic
gcctccggttcaaggttacagc

SEQ ID NO: 19402 - DNA, 22 bp, Artificial Sequence
  Synthetic
tcagccaccacgaccaaatcat

SEQ ID NO: 19403 - DNA, 23 bp, Artificial Sequence
  Synthetic
ccacggtggtttttgtgagtatc

SEQ ID NO: 19404 - DNA, 24 bp, Artificial Sequence
  Synthetic
gtcattggtccattcctattccac

SEQ ID NO: 19405 - DNA, 24 bp, Artificial Sequence
  Synthetic
ttggttatcgttagttgcgattcc

SEQ ID NO: 19406 - DNA, 21 bp, Artificial Sequence
  Synthetic
gtgggtctgctgatactgcag

SEQ ID NO: 19407 - DNA, 25 bp, Artificial Sequence
  Synthetic
cctcatgcactcttatcttcaatgt

SEQ ID NO: 19408 - DNA, 25 bp, Artificial Sequence
  Synthetic
cgcatccttctgaaaatgtcttaaa

SEQ ID NO: 19409 - DNA, 20 bp, Artificial Sequence
  Synthetic
ttcactgacctcctcgggag

SEQ ID NO: 19410 - DNA, 24 bp, Artificial Sequence
  Synthetic
cctcatttgttggaacagagttct

SEQ ID NO: 19411 - DNA, 21 bp, Artificial Sequence
  Synthetic
tcccctcagaacagcggactc

SEQ ID NO: 19412 - DNA, 21 bp, Artificial Sequence
  Synthetic
gccaacctctcaggacagcct

SEQ ID NO: 19413 - DNA, 22 bp, Artificial Sequence
  Synthetic
tccgcacactttggtgaatcca

SEQ ID NO: 19414 - DNA, 20 bp, Artificial Sequence
  Synthetic
tgagctcggacctgtccctg

SEQ ID NO: 19415 - DNA, 22 bp, Artificial Sequence
  Synthetic
cgcaaagcagaagaacacgagg

SEQ ID NO: 19416 - DNA, 21 bp, Artificial Sequence
  Synthetic
ggtccgaagatggccaggagt

SEQ ID NO: 19417 - DNA, 22 bp, Artificial Sequence
  Synthetic
cacgtgatgagcttggtctcca

SEQ ID NO: 19418 - DNA, 20 bp, Artificial Sequence
  Synthetic
gcgatggtcctcgttccggc

SEQ ID NO: 19419 - DNA, 22 bp, Artificial Sequence
  Synthetic
acaccggggatctcatggttgt

SEQ ID NO: 19420 - DNA, 21 bp, Artificial Sequence
  Synthetic
taagcacctcctgagcacccg

SEQ ID NO: 19421 - DNA, 21 bp, Artificial Sequence
  Synthetic
agtaggccacggcattgatgc

SEQ ID NO: 19422 - DNA, 21 bp, Artificial Sequence
  Synthetic
acagaggacggacgagtcgaa

SEQ ID NO: 19423 - DNA, 20 bp, Artificial Sequence
  Synthetic
gggtgcgtcagggtgacttc

SEQ ID NO: 19424 - DNA, 22 bp, Artificial Sequence
  Synthetic
ggtgataacctctgcttggcgg

SEQ ID NO: 19425 - DNA, 22 bp, Artificial Sequence
  Synthetic
ccctgcaagaatgtccacgagg

SEQ ID NO: 19426 - DNA, 19 bp, Artificial Sequence
  Synthetic
tatggcagtgacgcgggcg

SEQ ID NO: 19427 - DNA, 22 bp, Artificial Sequence
  Synthetic
ctccacatgttcctgcaggtcc

SEQ ID NO: 19428 - DNA, 21 bp, Artificial Sequence
  Synthetic
aggtaattgcgaccccaccgg

SEQ ID NO: 19429 - DNA, 22 bp, Artificial Sequence
  Synthetic
cgaatctccgagacttccgcag

SEQ ID NO: 19430 - DNA, 20 bp, Artificial Sequence
  Synthetic
gactcaacgtcggagtcggg

SEQ ID NO: 19431 - DNA, 22 bp, Artificial Sequence
  Synthetic
gctgcaagcttcctctacggat

SEQ ID NO: 19432 - DNA, 20 bp, Artificial Sequence
  Synthetic
ggccatcttctcgcacacgc

SEQ ID NO: 19433 - DNA, 19 bp, Artificial Sequence
  Synthetic
ttgtcagtacgccgctcgc

SEQ ID NO: 19434 - DNA, 20 bp, Artificial Sequence
  Synthetic
gtcttgctgtctcccacgcg

SEQ ID NO: 19435 - DNA, 20 bp, Artificial Sequence
  Synthetic
tgtctccaagctcgcaaggg

SEQ ID NO: 19436 - DNA, 20 bp, Artificial Sequence
  Synthetic
tgcacccatggacatagctt

SEQ ID NO: 19437 - DNA, 24 bp, Artificial Sequence
  Synthetic
tgtagcatctgatcagctgtgtat

SEQ ID NO: 19438 - DNA, 20 bp, Artificial Sequence
  Synthetic
tggttccaccgcatctgtat

SEQ ID NO: 19439 - DNA, 22 bp, Artificial Sequence
  Synthetic
ccccagctttatggcgtctagc

SEQ ID NO: 19440 - DNA, 23 bp, Artificial Sequence
  Synthetic
cattggcatggtagcacttgtat

SEQ ID NO: 19441 - DNA, 25 bp, Artificial Sequence
  Synthetic
gctcatacaaaagtatgatttgcca

SEQ ID NO: 19442 - DNA, 25 bp, Artificial Sequence
  Synthetic
accttcgaaaaaagcatttccaatt

SEQ ID NO: 19443 - DNA, 23 bp, Artificial Sequence
  Synthetic
accctcgtatgagacttttcctg

SEQ ID NO: 19444 - DNA, 22 bp, Artificial Sequence
  Synthetic
tctttggacccttgtcgctgct

SEQ ID NO: 19445 - DNA, 21 bp, Artificial Sequence
  Synthetic
ccaaaacaaacacagcagcag

SEQ ID NO: 19446 - DNA, 22 bp, Artificial Sequence
  Synthetic
ggtggtgccctctactttggga

SEQ ID NO: 19447 - DNA, 22 bp, Artificial Sequence
  Synthetic
gttgtggcagaggatgtaactt

SEQ ID NO: 19448 - DNA, 23 bp, Artificial Sequence
  Synthetic
ggttccatttcaatgtcctcgat

SEQ ID NO: 19449 - DNA, 22 bp, Artificial Sequence
  Synthetic
tccgtgctgagaactttagaca

SEQ ID NO: 19450 - DNA, 25 bp, Artificial Sequence
  Synthetic
aggcacgtcagacttatttaattgt

SEQ ID NO: 19451 - DNA, 23 bp, Artificial Sequence
  Synthetic
gccataatatccggggtcaatgt

SEQ ID NO: 19452 - DNA, 25 bp, Artificial Sequence
  Synthetic
cacaggaacagcaattacacaaatt

SEQ ID NO: 19453 - DNA, 20 bp, Artificial Sequence
  Synthetic
atcgtacacctgtcccacag

SEQ ID NO: 19454 - DNA, 25 bp, Artificial Sequence
  Synthetic
atccatatcgtctatcaggttggac

SEQ ID NO: 19455 - DNA, 25 bp, Artificial Sequence
  Synthetic
gtcccagtttgtataaggaaacaca

SEQ ID NO: 19456 - DNA, 20 bp, Artificial Sequence
  Synthetic
ggggtagaggggtatgcggt

SEQ ID NO: 19457 - DNA, 22 bp, Artificial Sequence
  Synthetic
gttcccactgcttcaggagctg

SEQ ID NO: 19458 - DNA, 25 bp, Artificial Sequence
  Synthetic
ctaacgatgaataacctgtagtccc

SEQ ID NO: 19459 - DNA, 24 bp, Artificial Sequence
  Synthetic
tcctggatcagcagtgataactat

SEQ ID NO: 19460 - DNA, 23 bp, Artificial Sequence
  Synthetic
tcatcatcaaaggcgggattttc

SEQ ID NO: 19461 - DNA, 25 bp, Artificial Sequence
  Synthetic
catcaggtactataggtctgtcagt

SEQ ID NO: 19462 - DNA, 25 bp, Artificial Sequence
  Synthetic
cccttctacatattcatccgtactc

SEQ ID NO: 19463 - DNA, 25 bp, Artificial Sequence
  Synthetic
gggatgacctgatgtactaatacct

SEQ ID NO: 19464 - DNA, 25 bp, Artificial Sequence
  Synthetic
acatgtcaccatcctgaatagtagt

SEQ ID NO: 19465 - DNA, 25 bp, Artificial Sequence
  Synthetic
cctgctgagcaccataaataaagtt

SEQ ID NO: 19466 - DNA, 20 bp, Artificial Sequence
  Synthetic
tggcgccaaaaacttaccga

SEQ ID NO: 19467 - DNA, 21 bp, Artificial Sequence
  Synthetic
ggtctaccgttgtctgtctca

SEQ ID NO: 19468 - DNA, 24 bp, Artificial Sequence
  Synthetic
ccttttcaaacccttcagtatccc

SEQ ID NO: 19469 - DNA, 25 bp, Artificial Sequence
  Synthetic
catcgttcccttcaatttttctctt

SEQ ID NO: 19470 - DNA, 21 bp, Artificial Sequence
  Synthetic
agctctagtgggtttgatgca

SEQ ID NO: 19471 - DNA, 24 bp, Artificial Sequence
  Synthetic
gctttttttcaatatccccctgca

SEQ ID NO: 19472 - DNA, 25 bp, Artificial Sequence
  Synthetic
cattgatcaaaaaggtcattgctcc

SEQ ID NO: 19473 - DNA, 23 bp, Artificial Sequence
  Synthetic
acgttatcattagctgtgcttgt

SEQ ID NO: 19474 - DNA, 25 bp, Artificial Sequence
  Synthetic
ggtcagttttcataacctcttggtc

SEQ ID NO: 19475 - DNA, 25 bp, Artificial Sequence
  Synthetic
ggttttgaaatctccaagatcaggg

SEQ ID NO: 19476 - DNA, 25 bp, Artificial Sequence
  Synthetic
gcatggataacagggaatcttgttt

SEQ ID NO: 19477 - DNA, 25 bp, Artificial Sequence
  Synthetic
agcgacaatctatcttcacatgatt

SEQ ID NO: 19478 - DNA, 24 bp, Artificial Sequence
  Synthetic
cacaatggacaagaaaaaccatcc

SEQ ID NO: 19479 - DNA, 25 bp, Artificial Sequence
  Synthetic
caccaagaattattaacgccaagaa

SEQ ID NO: 19480 - DNA, 24 bp, Artificial Sequence
  Synthetic
caccacacttacccatgtacatat

SEQ ID NO: 19481 - DNA, 25 bp, Artificial Sequence
  Synthetic
cagctttaacaagtctagcaacatt

SEQ ID NO: 19482 - DNA, 25 bp, Artificial Sequence
  Synthetic
gcaacataagacaagctacattcac

SEQ ID NO: 19483 - DNA, 21 bp, Artificial Sequence
  Synthetic
acctgcacaattacagccaat

SEQ ID NO: 19484 - DNA, 25 bp, Artificial Sequence
  Synthetic
tgagcacaaatatcatgtccaacta

SEQ ID NO: 19485 - DNA, 25 bp, Artificial Sequence
  Synthetic
accagctttattacaaccatagaca

SEQ ID NO: 19486 - DNA, 25 bp, Artificial Sequence
  Synthetic
caacatctgaatcaatggaacaaca

SEQ ID NO: 19487 - DNA, 25 bp, Artificial Sequence
  Synthetic
agcattcttcataacaccatctgaa

SEQ ID NO: 19488 - DNA, 20 bp, Artificial Sequence
  Synthetic
acaagttgacagccctgcat

SEQ ID NO: 19489 - DNA, 25 bp, Artificial Sequence
  Synthetic
gcaataacattaacagtctggacgt

SEQ ID NO: 19490 - DNA, 24 bp, Artificial Sequence
  Synthetic
gttagtaagtgctaggtctgccat

SEQ ID NO: 19491 - DNA, 25 bp, Artificial Sequence
  Synthetic
gcaccaccataagaatcttggttaa

SEQ ID NO: 19492 - DNA, 25 bp, Artificial Sequence
  Synthetic
accattgaccatacaaatcttggtt

SEQ ID NO: 19493 - DNA, 25 bp, Artificial Sequence
  Synthetic
ggtgtgtgtcaacatctaagttcat

SEQ ID NO: 19494 - DNA, 25 bp, Artificial Sequence
  Synthetic
gtgggcagaacattacgtttagtat

SEQ ID NO: 19495 - DNA, 25 bp, Artificial Sequence
  Synthetic
cgggccaaaactaaactactaacaa

SEQ ID NO: 19496 - DNA, 25 bp, Artificial Sequence
  Synthetic
gctctatcaaaagaacactgtcagt

SEQ ID NO: 19497 - DNA, 25 bp, Artificial Sequence
  Synthetic
tgccagaacataatcatcaacttct

SEQ ID NO: 19498 - DNA, 25 bp, Artificial Sequence
  Synthetic
acaccaatggaacactataaacact

SEQ ID NO: 19499 - DNA, 23 bp, Artificial Sequence
  Synthetic
tgttccaatgttttcgcgagtag

SEQ ID NO: 19500 - DNA, 25 bp, Artificial Sequence
  Synthetic
aaacctttaggattgcctatgtcat

SEQ ID NO: 19501 - DNA, 25 bp, Artificial Sequence
  Synthetic
gcgcttcttaaaggaacgtaatcaa

SEQ ID NO: 19502 - DNA, 25 bp, Artificial Sequence
  Synthetic
caactttatccacaatcacaccatt

SEQ ID NO: 19503 - DNA, 25 bp, Artificial Sequence
  Synthetic
cgcatattaacaggaacagctaatg

SEQ ID NO: 19504 - DNA, 21 bp, Artificial Sequence
  Synthetic
accaataggacaggaagcaga

SEQ ID NO: 19505 - DNA, 25 bp, Artificial Sequence
  Synthetic
cgaagaggaagaagaaggtgagtta

SEQ ID NO: 19506 - DNA, 25 bp, Artificial Sequence
  Synthetic
gcagttaaacgaccattaataagcc

SEQ ID NO: 19507 - DNA, 25 bp, Artificial Sequence
  Synthetic
tgaccacgaataacagtagcagtta

SEQ ID NO: 19508 - DNA, 21 bp, Artificial Sequence
  Synthetic
ggtcagcccaagaagttttct

SEQ ID NO: 19509 - DNA, 23 bp, Artificial Sequence
  Synthetic
gcttttggcgaggttttgttaaa

SEQ ID NO: 19510 - DNA, 25 bp, Artificial Sequence
  Synthetic
agagtcaaactgttctggtaattgt

SEQ ID NO: 19511 - DNA, 25 bp, Artificial Sequence
  Synthetic
cctctccatactctttcattgcttt

SEQ ID NO: 19512 - DNA, 21 bp, Artificial Sequence
  Synthetic
cctctgttggccatttcttgt

SEQ ID NO: 19513 - DNA, 23 bp, Artificial Sequence
  Synthetic
gtttgattggtcttggtgttgtc

SEQ ID NO: 19514 - DNA, 25 bp, Artificial Sequence
  Synthetic
tcatgtttttagtccttgggatctt

SEQ ID NO: 19515 - DNA, 22 bp, Artificial Sequence
  Synthetic
ctcctcatgcttgcaatgtact

SEQ ID NO: 19516 - DNA, 20 bp, Artificial Sequence
  Synthetic
atgtggctcaagtctcgggt

SEQ ID NO: 19517 - DNA, 25 bp, Artificial Sequence
  Synthetic
ggccatgcttctgatttattctcaa

SEQ ID NO: 19518 - DNA, 23 bp, Artificial Sequence
  Synthetic
caccaaccattcttccaacagat

SEQ ID NO: 19519 - DNA, 22 bp, Artificial Sequence
  Synthetic
tctccagaagttccggtcatta

SEQ ID NO: 19520 - DNA, 20 bp, Artificial Sequence
  Synthetic
tgagtgcagaccgtgccaga

SEQ ID NO: 19521 - DNA, 25 bp, Artificial Sequence
  Synthetic
gggatcactcttgttcctctaatga

SEQ ID NO: 19522 - DNA, 20 bp, Artificial Sequence
  Synthetic
attccaaaggacgacgcgac

SEQ ID NO: 19523 - DNA, 20 bp, Artificial Sequence
  Synthetic
tggatggggtgtccggggag

SEQ ID NO: 19524 - DNA, 23 bp, Artificial Sequence
  Synthetic
gcctcttcttgaagtcgtctaag

SEQ ID NO: 19525 - DNA, 25 bp, Artificial Sequence
  Synthetic
ctcgctttcttcttataggcatgtt

SEQ ID NO: 19526 - DNA, 20 bp, Artificial Sequence
  Synthetic
ttaccaaaaggacgcccagt

SEQ ID NO: 19527 - DNA, 23 bp, Artificial Sequence
  Synthetic
catccaatacagcagaaacaccc

SEQ ID NO: 19528 - DNA, 25 bp, Artificial Sequence
  Synthetic
gtctccaatctttgtgtaggagtac

SEQ ID NO: 19529 - DNA, 22 bp, Artificial Sequence
  Synthetic
ctggagcatactcagttaaccg

SEQ ID NO: 19530 - DNA, 23 bp, Artificial Sequence
  Synthetic
gctggtgcacatcctacaataaa

SEQ ID NO: 19531 - DNA, 25 bp, Artificial Sequence
  Synthetic
tgtcatccgtaaataatctggccat

SEQ ID NO: 19532 - DNA, 25 bp, Artificial Sequence
  Synthetic
aaaagctaattgccattgatcaagt

SEQ ID NO: 19533 - DNA, 25 bp, Artificial Sequence
  Synthetic
ccatttagcaggcctatctgataca

SEQ ID NO: 19534 - DNA, 24 bp, Artificial Sequence
  Synthetic
caccaactgttactgaagaactga

SEQ ID NO: 19535 - DNA, 25 bp, Artificial Sequence
  Synthetic
gaaacaaacttccaaatgtgtgcat

SEQ ID NO: 19536 - DNA, 25 bp, Artificial Sequence
  Synthetic
accggttctctttgtaatcatacaa

SEQ ID NO: 19537 - DNA, 21 bp, Artificial Sequence
  Synthetic
tcggactgacgaaaggaatcc

SEQ ID NO: 19538 - DNA, 21 bp, Artificial Sequence
  Synthetic
gccatattttcaccgagtgcc

SEQ ID NO: 19539 - DNA, 25 bp, Artificial Sequence
  Synthetic
gctgtaaaatagttcctcctcatgc

SEQ ID NO: 19540 - DNA, 20 bp, Artificial Sequence
  Synthetic
tcccatttgtgtggctccag

SEQ ID NO: 19541 - DNA, 25 bp, Artificial Sequence
  Synthetic
gccatgtttccgatttgttttcaaa

SEQ ID NO: 19542 - DNA, 25 bp, Artificial Sequence
  Synthetic
acatgtctctcatactgagtagctt

SEQ ID NO: 19543 - DNA, 21 bp, Artificial Sequence
  Synthetic
cctaggcatcagcatgtacca

SEQ ID NO: 19544 - DNA, 25 bp, Artificial Sequence
  Synthetic
cgctcgaattgagttatcattccat

SEQ ID NO: 19545 - DNA, 25 bp, Artificial Sequence
  Synthetic
cactcttctctttctctggaaatgt

SEQ ID NO: 19546 - DNA, 24 bp, Artificial Sequence
  Synthetic
gtccagattgctcaagtttttcac

SEQ ID NO: 19547 - DNA, 20 bp, Artificial Sequence
  Synthetic
gcccatcccaccagtatgtg

SEQ ID NO: 19548 - DNA, 25 bp, Artificial Sequence
  Synthetic
tcatgtcagccgattcattaattcc

SEQ ID NO: 19549 - DNA, 25 bp, Artificial Sequence
  Synthetic
tggtacatttgttcatcctcaagaa

SEQ ID NO: 19550 - DNA, 23 bp, Artificial Sequence
  Synthetic
attgccaaattcagccatcctat

SEQ ID NO: 19551 - DNA, 25 bp, Artificial Sequence
  Synthetic
acacaatgtcatgtacagtaggttt

SEQ ID NO: 19552 - DNA, 22 bp, Artificial Sequence
  Synthetic
cctgtgcatgtaatagcgcttg

SEQ ID NO: 19553 - DNA, 22 bp, Artificial Sequence
  Synthetic
ctcaggtgtgtctcctgttact

SEQ ID NO: 19554 - DNA, 22 bp, Artificial Sequence
  Synthetic
acactggattgccattgctatc

SEQ ID NO: 19555 - DNA, 25 bp, Artificial Sequence
  Synthetic
aatttgaaatgttggtaccacgtgg

SEQ ID NO: 19556 - DNA, 21 bp, Artificial Sequence
  Synthetic
agcaattgcagtagcggatac

SEQ ID NO: 19557 - DNA, 25 bp, Artificial Sequence
  Synthetic
ccacagattcaattacaacaggtgg

SEQ ID NO: 19558 - DNA, 25 bp, Artificial Sequence
  Synthetic
tcccagatgtaggggtagtaataaa

SEQ ID NO: 19559 - DNA, 25 bp, Artificial Sequence
  Synthetic
ggcctatgtaaacgaacaatatcca

SEQ ID NO: 19560 - DNA, 24 bp, Artificial Sequence
  Synthetic
tcaggtaatgtaacccgaaacact

SEQ ID NO: 19561 - DNA, 25 bp, Artificial Sequence
  Synthetic
gggtttgtttataatccactgacac

SEQ ID NO: 19562 - DNA, 20 bp, Artificial Sequence
  Synthetic
ctgtccccatatgcatctgc

SEQ ID NO: 19563 - DNA, 24 bp, Artificial Sequence
  Synthetic
tcttgtgactaaaacatccgagct

SEQ ID NO: 19564 - DNA, 24 bp, Artificial Sequence
  Synthetic
tgcattgttgtttggtcctgatat

SEQ ID NO: 19565 - DNA, 20 bp, Artificial Sequence
  Synthetic
ccaattgtccctgcatgtgc

SEQ ID NO: 19566 - DNA, 23 bp, Artificial Sequence
  Synthetic
gctgtgcttattgtcctccctag

SEQ ID NO: 19567 - DNA, 21 bp, Artificial Sequence
  Synthetic
gccatatggtccacagtggtc

SEQ ID NO: 19568 - DNA, 25 bp, Artificial Sequence
  Synthetic
agggtaatgaactgtacttgttgtt

SEQ ID NO: 19569 - DNA, 20 bp, Artificial Sequence
  Synthetic
gtacgccaccatcaagggag

SEQ ID NO: 19570 - DNA, 21 bp, Artificial Sequence
  Synthetic
tgctaatgggtctgctgacac

SEQ ID NO: 19571 - DNA, 24 bp, Artificial Sequence
  Synthetic
tcccaaccattgtgaattcttcat

SEQ ID NO: 19572 - DNA, 25 bp, Artificial Sequence
  Synthetic
cccacatcattgatgacgaataagt

SEQ ID NO: 19573 - DNA, 22 bp, Artificial Sequence
  Synthetic
gcagcaaaggggagaagtttta

SEQ ID NO: 19574 - DNA, 25 bp, Artificial Sequence
  Synthetic
gtcttctttgcccaaaatgagaaat

SEQ ID NO: 19575 - DNA, 25 bp, Artificial Sequence
  Synthetic
tcttggtttggattccatcagaatt

SEQ ID NO: 19576 - DNA, 25 bp, Artificial Sequence
  Synthetic
agcgtgtcaactctaaataattgct

SEQ ID NO: 19577 - DNA, 25 bp, Artificial Sequence
  Synthetic
gacactctttgtggagaaatgtgaa

SEQ ID NO: 19578 - DNA, 22 bp, Artificial Sequence
  Synthetic
acttcttcaggagatgggacac

SEQ ID NO: 19579 - DNA, 24 bp, Artificial Sequence
  Synthetic
cagcttcacctaatggtctgtaac

SEQ ID NO: 19580 - DNA, 25 bp, Artificial Sequence
  Synthetic
ggtagcagtagagtcagtgattgta

SEQ ID NO: 19581 - DNA, 20 bp, Artificial Sequence
  Synthetic
gctacttctgccaagtcccg

SEQ ID NO: 19582 - DNA, 25 bp, Artificial Sequence
  Synthetic
cgttgtagctagtatgtcgtcaact

SEQ ID NO: 19583 - DNA, 25 bp, Artificial Sequence
  Synthetic
ctttgttaaagtaaggatggcctgt

SEQ ID NO: 19584 - DNA, 25 bp, Artificial Sequence
  Synthetic
ctgctttatcttcttgtaaacggct

SEQ ID NO: 19585 - DNA, 21 bp, Artificial Sequence
  Synthetic
ggtgttaagaatgcaccccca

SEQ ID NO: 19586 - DNA, 22 bp, Artificial Sequence
  Synthetic
gtttctaatgccctcctccgtg

SEQ ID NO: 19587 - DNA, 25 bp, Artificial Sequence
  Synthetic
gcattttcatccccattagtcaatg

SEQ ID NO: 19588 - DNA, 25 bp, Artificial Sequence
  Synthetic
cgcggaggatctgttattatttgat

SEQ ID NO: 19589 - DNA, 25 bp, Artificial Sequence
  Synthetic
aaagcacttctcatatacacatcca

SEQ ID NO: 19590 - DNA, 21 bp, Artificial Sequence
  Synthetic
gtttgtatgccctgccttctg

SEQ ID NO: 19591 - DNA, 25 bp, Artificial Sequence
  Synthetic
atgtctataaagtacaggccatccg

SEQ ID NO: 19592 - DNA, 25 bp, Artificial Sequence
  Synthetic
gctgtgctaatacactgaaataagc

SEQ ID NO: 19593 - DNA, 21 bp, Artificial Sequence
  Synthetic
tgggaacatagccagaggccc

SEQ ID NO: 19594 - DNA, 24 bp, Artificial Sequence
  Synthetic
aggatgcccatatacagagatgta

SEQ ID NO: 19595 - DNA, 23 bp, Artificial Sequence
  Synthetic
aggccacttcttgtacgaatagt

SEQ ID NO: 19596 - DNA, 23 bp, Artificial Sequence
  Synthetic
agccacaaagacatctgcaaaat

SEQ ID NO: 19597 - DNA, 24 bp, Artificial Sequence
  Synthetic
caaacaaggagtacagcctactac

SEQ ID NO: 19598 - DNA, 22 bp, Artificial Sequence
  Synthetic
gccagcgtctgacttaacattt

SEQ ID NO: 19599 - DNA, 25 bp, Artificial Sequence
  Synthetic
ccagtttgagataaaaatctgcgac

SEQ ID NO: 19600 - DNA, 24 bp, Artificial Sequence
  Synthetic
aatattacaaaacatcgctgccgg

SEQ ID NO: 19601 - DNA, 21 bp, Artificial Sequence
  Synthetic
cctcctcctcaggatcaccat

SEQ ID NO: 19602 - DNA, 25 bp, Artificial Sequence
  Synthetic
tgcccctcatttaattcaagagaat

SEQ ID NO: 19603 - DNA, 21 bp, Artificial Sequence
  Synthetic
tgtgacagcttccaaccttgg

SEQ ID NO: 19604 - DNA, 25 bp, Artificial Sequence
  Synthetic
taacccagttttcacaacatgatct

SEQ ID NO: 19605 - DNA, 25 bp, Artificial Sequence
  Synthetic
atgtcccagtttgtgaatatgtttg

SEQ ID NO: 19606 - DNA, 20 bp, Artificial Sequence
  Synthetic
tgctcgttggatcttcggcg

SEQ ID NO: 19607 - DNA, 25 bp, Artificial Sequence
  Synthetic
gctggtgtaatgtctaatgtagcaa

SEQ ID NO: 19608 - DNA, 20 bp, Artificial Sequence
  Synthetic
aggtgtactggtacgtggag

SEQ ID NO: 19609 - DNA, 24 bp, Artificial Sequence
  Synthetic
ctgcagatgtttctgaaaaccgag

SEQ ID NO: 19610 - DNA, 25 bp, Artificial Sequence
  Synthetic
tgttgcaaatatcagctgtgcatta

SEQ ID NO: 19611 - DNA, 21 bp, Artificial Sequence
  Synthetic
cgtttgcgtcgcctaagaaga

SEQ ID NO: 19612 - DNA, 25 bp, Artificial Sequence
  Synthetic
gctctgtctatcattgcaaatttgt

SEQ ID NO: 19613 - DNA, 25 bp, Artificial Sequence
  Synthetic
gcatttgttttggatccattgaaac

SEQ ID NO: 19614 - DNA, 24 bp, Artificial Sequence
  Synthetic
agtgtgccaagtgattgtttctta

SEQ ID NO: 19615 - DNA, 20 bp, Artificial Sequence
  Synthetic
ctgcccatctccacgcgaag

SEQ ID NO: 19616 - DNA, 22 bp, Artificial Sequence
  Synthetic
gccgtgctgcacctcaaacatt

SEQ ID NO: 19617 - DNA, 22 bp, Artificial Sequence
  Synthetic
ctgaactaagactgggtgtcca

SEQ ID NO: 19618 - DNA, 21 bp, Artificial Sequence
  Synthetic
cgaggcaggcttacatgggag

SEQ ID NO: 19619 - DNA, 19 bp, Artificial Sequence
  Synthetic
cgggctggtccagggactt

SEQ ID NO: 19620 - DNA, 19 bp, Artificial Sequence
  Synthetic
cgcagggcaagacgaggga

SEQ ID NO: 19621 - DNA, 21 bp, Artificial Sequence
  Synthetic
cacgctggagggacattgtcc

SEQ ID NO: 19622 - DNA, 25 bp, Artificial Sequence
  Synthetic
cccagctcattttggaaaataaaca

SEQ ID NO: 19623 - DNA, 19 bp, Artificial Sequence
  Synthetic
tgcgccgcctaatgcatcc

SEQ ID NO: 19624 - DNA, 19 bp, Artificial Sequence
  Synthetic
tccttcttccacggcgccg

SEQ ID NO: 19625 - DNA, 19 bp, Artificial Sequence
  Synthetic
tcgagctcgctggcgtgag

SEQ ID NO: 19626 - DNA, 20 bp, Artificial Sequence
  Synthetic
acttgtaggcccggggaccc

SEQ ID NO: 19627 - DNA, 22 bp, Artificial Sequence
  Synthetic
cccacaccatcagcagcgtctt

SEQ ID NO: 19628 - DNA, 20 bp, Artificial Sequence
  Synthetic
cccccatcactctcccaggc

SEQ ID NO: 19629 - DNA, 19 bp, Artificial Sequence
  Synthetic
actcggcctggtctcggct

SEQ ID NO: 19630 - DNA, 20 bp, Artificial Sequence
  Synthetic
ccctgcgacccccttaaccc

SEQ ID NO: 19631 - DNA, 19 bp, Artificial Sequence
  Synthetic
agcactcggcggggctttc

SEQ ID NO: 19632 - DNA, 21 bp, Artificial Sequence
  Synthetic
aattaggaaggcgctgggggc

SEQ ID NO: 19633 - DNA, 19 bp, Artificial Sequence
  Synthetic
cgtccctggccacgaagga

SEQ ID NO: 19634 - DNA, 20 bp, Artificial Sequence
  Synthetic
gcaaccaggcccactgcaag

SEQ ID NO: 19635 - DNA, 19 bp, Artificial Sequence
  Synthetic
agacccaccacctcgtgcc

SEQ ID NO: 19636 - DNA, 20 bp, Artificial Sequence
  Synthetic
cggaagaggaggaggaggcg

SEQ ID NO: 19637 - DNA, 20 bp, Artificial Sequence
  Synthetic
ggggtggtgaggatgcagct

SEQ ID NO: 19638 - DNA, 22 bp, Artificial Sequence
  Synthetic
cgttgcaggcctccttcaaaag

SEQ ID NO: 19639 - DNA, 19 bp, Artificial Sequence
  Synthetic
tcatccccctgcgtgtcgg

SEQ ID NO: 19640 - DNA, 19 bp, Artificial Sequence
  Synthetic
tgtcaaccggccccgcaac

SEQ ID NO: 19641 - DNA, 19 bp, Artificial Sequence
  Synthetic
tgcggcagaggctaagcgc

SEQ ID NO: 19642 - DNA, 20 bp, Artificial Sequence
  Synthetic
ctctccagtgcggtgttgct

SEQ ID NO: 19643 - DNA, 19 bp, Artificial Sequence
  Synthetic
tctcgtcccacctggcgga

SEQ ID NO: 19644 - DNA, 19 bp, Artificial Sequence
  Synthetic
tcacgtccctggccgagct

SEQ ID NO: 19645 - DNA, 21 bp, Artificial Sequence
  Synthetic
accgcgttaacatctcggcca

SEQ ID NO: 19646 - DNA, 22 bp, Artificial Sequence
  Synthetic
ggcttccgcctgttttgtttgt

SEQ ID NO: 19647 - DNA, 21 bp, Artificial Sequence
  Synthetic
cggagttgatgaaaggggccg

SEQ ID NO: 19648 - DNA, 20 bp, Artificial Sequence
  Synthetic
aactccacgctgcgtccatc

SEQ ID NO: 19649 - DNA, 19 bp, Artificial Sequence
  Synthetic
agacgaggcacaggcaccc

SEQ ID NO: 19650 - DNA, 22 bp, Artificial Sequence
  Synthetic
accggtgacaccaagtccatct

SEQ ID NO: 19651 - DNA, 22 bp, Artificial Sequence
  Synthetic
tgttcaggttttgctcaaggaa

SEQ ID NO: 19652 - DNA, 22 bp, Artificial Sequence
  Synthetic
cgccaaccaacacctccctcta

SEQ ID NO: 19653 - DNA, 22 bp, Artificial Sequence
  Synthetic
ggagtccggacagtttcatgct

SEQ ID NO: 19654 - DNA, 22 bp, Artificial Sequence
  Synthetic
ggcagacatccgcgattacctt

SEQ ID NO: 19655 - DNA, 19 bp, Artificial Sequence
  Synthetic
tggccctgatcctgagccg

SEQ ID NO: 19656 - DNA, 20 bp, Artificial Sequence
  Synthetic
tcacgtcctctaccccggcg

SEQ ID NO: 19657 - DNA, 22 bp, Artificial Sequence
  Synthetic
cgtgtgctgcctggaacacaat

SEQ ID NO: 19658 - DNA, 19 bp, Artificial Sequence
  Synthetic
actcgggagtctctggccc

SEQ ID NO: 19659 - DNA, 22 bp, Artificial Sequence
  Synthetic
accgtctatagcgcctttgggt

SEQ ID NO: 19660 - DNA, 22 bp, Artificial Sequence
  Synthetic
cgcgcaggcttactttttgcat

SEQ ID NO: 19661 - DNA, 22 bp, Artificial Sequence
  Synthetic
cagggggatctttacgtgggtg

SEQ ID NO: 19662 - DNA, 22 bp, Artificial Sequence
  Synthetic
acctgggcttatgcagacgagt

SEQ ID NO: 19663 - DNA, 20 bp, Artificial Sequence
  Synthetic
ggtggtctgccaaagctgct

SEQ ID NO: 19664 - DNA, 21 bp, Artificial Sequence
  Synthetic
ctgcgaagagcgtcactgtgt

SEQ ID NO: 19665 - DNA, 20 bp, Artificial Sequence
  Synthetic
tgttcaacgcggtcaaggcc

SEQ ID NO: 19666 - DNA, 20 bp, Artificial Sequence
  Synthetic
tggttggggctgcttcccag

SEQ ID NO: 19667 - DNA, 19 bp, Artificial Sequence
  Synthetic
aactgcgagggggcctggt

SEQ ID NO: 19668 - DNA, 21 bp, Artificial Sequence
  Synthetic
acaggcaactacatggggccg

SEQ ID NO: 19669 - DNA, 19 bp, Artificial Sequence
  Synthetic
caacccggcagagctccag

SEQ ID NO: 19670 - DNA, 22 bp, Artificial Sequence
  Synthetic
agcgtcccctgttaggtccttg

SEQ ID NO: 19671 - DNA, 21 bp, Artificial Sequence
  Synthetic
ggtcctaactggtcaggggca

SEQ ID NO: 19672 - DNA, 19 bp, Artificial Sequence
  Synthetic
agcagctggccccgaatcc

SEQ ID NO: 19673 - DNA, 19 bp, Artificial Sequence
  Synthetic
cctacacgaccgccaaggg

SEQ ID NO: 19674 - DNA, 20 bp, Artificial Sequence
  Synthetic
gttgagaccgtcctggcagg

SEQ ID NO: 19675 - DNA, 19 bp, Artificial Sequence
  Synthetic
ttccccaggcagtcccagc

SEQ ID NO: 19676 - DNA, 22 bp, Artificial Sequence
  Synthetic
cccggactcgttttacggactc

SEQ ID NO: 19677 - DNA, 22 bp, Artificial Sequence
  Synthetic
caacgggactgtcatggaaatt

SEQ ID NO: 19678 - DNA, 20 bp, Artificial Sequence
  Synthetic
gcggctgaacgtgactaccc

SEQ ID NO: 19679 - DNA, 19 bp, Artificial Sequence
  Synthetic
atcctgccagcgggagagg

SEQ ID NO: 19680 - DNA, 19 bp, Artificial Sequence
  Synthetic
tggaggggggccaaagagg

SEQ ID NO: 19681 - DNA, 22 bp, Artificial Sequence
  Synthetic
caccagtttctttccgcggtgg

SEQ ID NO: 19682 - DNA, 22 bp, Artificial Sequence
  Synthetic
ggcacaggagcgattaagtcct

SEQ ID NO: 19683 - DNA, 22 bp, Artificial Sequence
  Synthetic
tggccaacatgacttccgtcaa

SEQ ID NO: 19684 - DNA, 22 bp, Artificial Sequence
  Synthetic
cagatccacgaccgcatccagt

SEQ ID NO: 19685 - DNA, 19 bp, Artificial Sequence
  Synthetic
aggcgaccccatgatgcgg

SEQ ID NO: 19686 - DNA, 21 bp, Artificial Sequence
  Synthetic
ggggtgacgaggatggaaagg

SEQ ID NO: 19687 - DNA, 19 bp, Artificial Sequence
  Synthetic
tggctcgctgctgtgacgc

SEQ ID NO: 19688 - DNA, 20 bp, Artificial Sequence
  Synthetic
cgagggtgccgcctttgaga

SEQ ID NO: 19689 - DNA, 19 bp, Artificial Sequence
  Synthetic
tggcggtgccggtgaatcc

SEQ ID NO: 19690 - DNA, 19 bp, Artificial Sequence
  Synthetic
tggaggcctcgcacgagac

SEQ ID NO: 19691 - DNA, 20 bp, Artificial Sequence
  Synthetic
acaggaggtagcggtggggc

SEQ ID NO: 19692 - DNA, 21 bp, Artificial Sequence
  Synthetic
cgctcctttgtggcatcaccg

SEQ ID NO: 19693 - DNA, 18 bp, Artificial Sequence
  Synthetic
tggtttgcgaggctgggc

SEQ ID NO: 19694 - DNA, 21 bp, Artificial Sequence
  Synthetic
gctcatcatcagcgtcctgcg

SEQ ID NO: 19695 - DNA, 22 bp, Artificial Sequence
  Synthetic
gctacctcatgttcagggccat

SEQ ID NO: 19696 - DNA, 20 bp, Artificial Sequence
  Synthetic
cccttggtcacgcttggctg

SEQ ID NO: 19697 - DNA, 25 bp, Artificial Sequence
  Synthetic
tgccaatatctaagttgccttagtt

SEQ ID NO: 19698 - DNA, 22 bp, Artificial Sequence
  Synthetic
gctggcaaattgctcgtgacaa

SEQ ID NO: 19699 - DNA, 25 bp, Artificial Sequence
  Synthetic
ttgccgtaccaattccatatatgat

SEQ ID NO: 19700 - DNA, 25 bp, Artificial Sequence
  Synthetic
tggtggttctattagcatgtttgtt

SEQ ID NO: 19701 - DNA, 25 bp, Artificial Sequence
  Synthetic
gcatctttcacatatttggcttgac

SEQ ID NO: 19702 - DNA, 22 bp, Artificial Sequence
  Synthetic
aaccgtaataggctcatgcaaa

SEQ ID NO: 19703 - DNA, 21 bp, Artificial Sequence
  Synthetic
gcacgtgttgccagtgtttaa

SEQ ID NO: 19704 - DNA, 20 bp, Artificial Sequence
  Synthetic
attgcttaggcactgcgtcc

SEQ ID NO: 19705 - DNA, 22 bp, Artificial Sequence
  Synthetic
ggtgtcctgggtgctagacaca

SEQ ID NO: 19706 - DNA, 22 bp, Artificial Sequence
  Synthetic
ggcctctatgcccttaggaata

SEQ ID NO: 19707 - DNA, 20 bp, Artificial Sequence
  Synthetic
gctggttgtgtggtagtcac

SEQ ID NO: 19708 - DNA, 20 bp, Artificial Sequence
  Synthetic
tagtggcatgggaggtggaa

SEQ ID NO: 19709 - DNA, 21 bp, Artificial Sequence
  Synthetic
acttgcctggcgaataggaaa

SEQ ID NO: 19710 - DNA, 25 bp, Artificial Sequence
  Synthetic
gcattttcagtgtcattaagcttgt

SEQ ID NO: 19711 - DNA, 21 bp, Artificial Sequence
  Synthetic
ccaagggaacgtcagacctat

SEQ ID NO: 19712 - DNA, 24 bp, Artificial Sequence
  Synthetic
aaggcttgttaaacaactgtgact

SEQ ID NO: 19713 - DNA, 23 bp, Artificial Sequence
  Synthetic
aagactagcagtaggaggtggta

SEQ ID NO: 19714 - DNA, 20 bp, Artificial Sequence
  Synthetic
caccggacagggggggttat

SEQ ID NO: 19715 - DNA, 25 bp, Artificial Sequence
  Synthetic
tgcacggtgagtaacacatgtatta

SEQ ID NO: 19716 - DNA, 25 bp, Artificial Sequence
  Synthetic
ccaaactttgattcaccttttcctg

SEQ ID NO: 19717 - DNA, 25 bp, Artificial Sequence
  Synthetic
cgacaaactctcttctgctaaaaga

SEQ ID NO: 19718 - DNA, 25 bp, Artificial Sequence
  Synthetic
gctttattgcaatcctctgctaact

SEQ ID NO: 19719 - DNA, 25 bp, Artificial Sequence
  Synthetic
ggtaaccgtttctctactttttcct

SEQ ID NO: 19720 - DNA, 25 bp, Artificial Sequence
  Synthetic
gtcatttggcgcatttcatatcttt

SEQ ID NO: 19721 - DNA, 25 bp, Artificial Sequence
  Synthetic
tgaaacagtttttgggttgggtatt

SEQ ID NO: 19722 - DNA, 22 bp, Artificial Sequence
  Synthetic
cttcgtcctccagctcgaagac

SEQ ID NO: 19723 - DNA, 20 bp, Artificial Sequence
  Synthetic
gacgaaatccagtggcaccc

SEQ ID NO: 19724 - DNA, 25 bp, Artificial Sequence
  Synthetic
gctatgtcttcttggccatgtagaa

SEQ ID NO: 19725 - DNA, 24 bp, Artificial Sequence
  Synthetic
tggtaatgcaccttttgtgtcaaa

SEQ ID NO: 19726 - DNA, 25 bp, Artificial Sequence
  Synthetic
tctacgtttcaataaagcaggatgt

SEQ ID NO: 19727 - DNA, 24 bp, Artificial Sequence
  Synthetic
acctgcttaggatccatactaaga

SEQ ID NO: 19728 - DNA, 25 bp, Artificial Sequence
  Synthetic
cgctctgttaaatctacgttccaaa

SEQ ID NO: 19729 - DNA, 21 bp, Artificial Sequence
  Synthetic
aacacgcaggttatgttcagg

SEQ ID NO: 19730 - DNA, 21 bp, Artificial Sequence
  Synthetic
cctcgccaaagcccagctatt

SEQ ID NO: 19731 - DNA, 22 bp, Artificial Sequence
  Synthetic
tctccaccaccagccttactgt

SEQ ID NO: 19732 - DNA, 22 bp, Artificial Sequence
  Synthetic
tccatccccgggatgcctacta

SEQ ID NO: 19733 - DNA, 22 bp, Artificial Sequence
  Synthetic
gtcgcgtcaatatccacttgcg

SEQ ID NO: 19734 - DNA, 20 bp, Artificial Sequence
  Synthetic
tgacaccctctgcaactgtg

SEQ ID NO: 19735 - DNA, 25 bp, Artificial Sequence
  Synthetic
ccaattatttcactagcattgccca

SEQ ID NO: 19736 - DNA, 20 bp, Artificial Sequence
  Synthetic
tgctctgcccgtttgtaatg

SEQ ID NO: 19737 - DNA, 22 bp, Artificial Sequence
  Synthetic
gtggagttggcataggaaatca

SEQ ID NO: 19738 - DNA, 25 bp, Artificial Sequence
  Synthetic
acaggaaatgcattaggaaaggtaa

SEQ ID NO: 19739 - DNA, 24 bp, Artificial Sequence
  Synthetic
tcatcatcaccgctttgtacatat

SEQ ID NO: 19740 - DNA, 21 bp, Artificial Sequence
  Synthetic
ccgagtcgctgacgcttatgc

SEQ ID NO: 19741 - DNA, 20 bp, Artificial Sequence
  Synthetic
gccaggtggaggttactttg

SEQ ID NO: 19742 - DNA, 25 bp, Artificial Sequence
  Synthetic
ggaaggatagacagccaaaagaaga

SEQ ID NO: 19743 - DNA, 21 bp, Artificial Sequence
  Synthetic
cccccccatctctatcacgta

SEQ ID NO: 19744 - DNA, 21 bp, Artificial Sequence
  Synthetic
gggatgtatccagtgcgccca

SEQ ID NO: 19745 - DNA, 25 bp, Artificial Sequence
  Synthetic
caggattgtcataggtaacaagtgt

SEQ ID NO: 19746 - DNA, 25 bp, Artificial Sequence
  Synthetic
cactatagggttttttcctgattgc

SEQ ID NO: 19747 - DNA, 23 bp, Artificial Sequence
  Synthetic
ccatagtaagattgtcccgggtg

SEQ ID NO: 19748 - DNA, 20 bp, Artificial Sequence
  Synthetic
caccatatggctcagctgcc

SEQ ID NO: 19749 - DNA, 21 bp, Artificial Sequence
  Synthetic
gcagataccattgttagggcc

SEQ ID NO: 19750 - DNA, 21 bp, Artificial Sequence
  Synthetic
aaggaacccgtgtacagacac

SEQ ID NO: 19751 - DNA, 20 bp, Artificial Sequence
  Synthetic
ccgaaatcggtccgggggta

SEQ ID NO: 19752 - DNA, 21 bp, Artificial Sequence
  Synthetic
cgccatggctagacgctttct

SEQ ID NO: 19753 - DNA, 22 bp, Artificial Sequence
  Synthetic
cggcaacaagtatactccgcca

SEQ ID NO: 19754 - DNA, 22 bp, Artificial Sequence
  Synthetic
gtaccccatgaggtcggcaaag

SEQ ID NO: 19755 - DNA, 22 bp, Artificial Sequence
  Synthetic
ccggtatccagcactgagatgc

SEQ ID NO: 19756 - DNA, 22 bp, Artificial Sequence
  Synthetic
cccaatgagccccgctaatgat

SEQ ID NO: 19757 - DNA, 22 bp, Artificial Sequence
  Synthetic
tcgggacatcctgacgagttga

SEQ ID NO: 19758 - DNA, 21 bp, Artificial Sequence
  Synthetic
gctctagtacggcagggtggt

SEQ ID NO: 19759 - DNA, 22 bp, Artificial Sequence
  Synthetic
cgtggtggagtgcaacaaagga

SEQ ID NO: 19760 - DNA, 22 bp, Artificial Sequence
  Synthetic
cccttgatgtaccaagcagcca

SEQ ID NO: 19761 - DNA, 20 bp, Artificial Sequence
  Synthetic
gtaagcaggcccaagcaccg

SEQ ID NO: 19762 - DNA, 21 bp, Artificial Sequence
  Synthetic
gaggacctcccgaccaagtcg

SEQ ID NO: 19763 - DNA, 20 bp, Artificial Sequence
  Synthetic
cgtgagccggccagagtctt

SEQ ID NO: 19764 - DNA, 22 bp, Artificial Sequence
  Synthetic
caggtggtgtgctgttgtcact

SEQ ID NO: 19765 - DNA, 22 bp, Artificial Sequence
  Synthetic
ccacggcatggcattcatcaca

SEQ ID NO: 19766 - DNA, 22 bp, Artificial Sequence
  Synthetic
cgaccactacgtctccctgagt

SEQ ID NO: 19767 - DNA, 22 bp, Artificial Sequence
  Synthetic
ggtctccgatggtgtgagctca

SEQ ID NO: 19768 - DNA, 22 bp, Artificial Sequence
  Synthetic
cacgggatgtgtgagggtgacc

SEQ ID NO: 19769 - DNA, 22 bp, Artificial Sequence
  Synthetic
gcctgcacagtgggttgtatgt

SEQ ID NO: 19770 - DNA, 21 bp, Artificial Sequence
  Synthetic
cgacgagagcccccgaaatgc

SEQ ID NO: 19771 - DNA, 22 bp, Artificial Sequence
  Synthetic
cactggccctccgtgtaacaat

SEQ ID NO: 19772 - DNA, 22 bp, Artificial Sequence
  Synthetic
gcagtctccgccgtgatatgag

SEQ ID NO: 19773 - DNA, 21 bp, Artificial Sequence
  Synthetic
ccggtaaagctggtgggaacc

SEQ ID NO: 19774 - DNA, 19 bp, Artificial Sequence
  Synthetic
tccaagctccccctcgagg

SEQ ID NO: 19775 - DNA, 22 bp, Artificial Sequence
  Synthetic
ggaggccgctagcttaatgtcc

SEQ ID NO: 19776 - DNA, 22 bp, Artificial Sequence
  Synthetic
ccatcaccgcctgaggaagttt

SEQ ID NO: 19777 - DNA, 22 bp, Artificial Sequence
  Synthetic
ccctgcagctttacaagccgct

SEQ ID NO: 19778 - DNA, 22 bp, Artificial Sequence
  Synthetic
gtggtagggtctctggtcaggt

SEQ ID NO: 19779 - DNA, 22 bp, Artificial Sequence
  Synthetic
ccccaagttttctgagggctga

SEQ ID NO: 19780 - DNA, 20 bp, Artificial Sequence
  Synthetic
caggctgcataggcaaggcg

SEQ ID NO: 19781 - DNA, 20 bp, Artificial Sequence
  Synthetic
gcacgggcaactaccaccaa

SEQ ID NO: 19782 - DNA, 20 bp, Artificial Sequence
  Synthetic
acgtcaaaggctgccaccag

SEQ ID NO: 19783 - DNA, 21 bp, Artificial Sequence
  Synthetic
gctccgaccgaacaacaacca

SEQ ID NO: 19784 - DNA, 20 bp, Artificial Sequence
  Synthetic
aacagtaccgacaagcccgg

SEQ ID NO: 19785 - DNA, 20 bp, Artificial Sequence
  Synthetic
ccttggctttgcagcttggc

SEQ ID NO: 19786 - DNA, 20 bp, Artificial Sequence
  Synthetic
gaccgcgccccagtatttcg

SEQ ID NO: 19787 - DNA, 22 bp, Artificial Sequence
  Synthetic
cgcgcagtttgccgttgacttg

SEQ ID NO: 19788 - DNA, 20 bp, Artificial Sequence
  Synthetic
ggcgttaaaaagccgagcgg

SEQ ID NO: 19789 - DNA, 21 bp, Artificial Sequence
  Synthetic
cccgaatggcagatacaggca

SEQ ID NO: 19790 - DNA, 18 bp, Artificial Sequence
  Synthetic
attggcacgccgatccgc

SEQ ID NO: 19791 - DNA, 19 bp, Artificial Sequence
  Synthetic
tcgggctgcccatgaccct

SEQ ID NO: 19792 - DNA, 20 bp, Artificial Sequence
  Synthetic
cgcgcggcagttgatacagg

SEQ ID NO: 19793 - DNA, 20 bp, Artificial Sequence
  Synthetic
gccgccaaaggcaaaggacg

SEQ ID NO: 19794 - DNA, 22 bp, Artificial Sequence
  Synthetic
gcccatttgtaaccggttctgc

SEQ ID NO: 19795 - DNA, 19 bp, Artificial Sequence
  Synthetic
aacggcggcctgattaccg

SEQ ID NO: 19796 - DNA, 19 bp, Artificial Sequence
  Synthetic
agttgccgcacctgccctc

SEQ ID NO: 19797 - DNA, 19 bp, Artificial Sequence
  Synthetic
gaatcggggcgaactcggg

SEQ ID NO: 19798 - DNA, 20 bp, Artificial Sequence
  Synthetic
cgccagttgaccgaatcggg

SEQ ID NO: 19799 - DNA, 22 bp, Artificial Sequence
  Synthetic
cgcaaagactaccgcagcaacg

SEQ ID NO: 19800 - DNA, 19 bp, Artificial Sequence
  Synthetic
acttcctcgaccgcctcgc

SEQ ID NO: 19801 - DNA, 22 bp, Artificial Sequence
  Synthetic
gcatcctgctcgacaacatcct

SEQ ID NO: 19802 - DNA, 21 bp, Artificial Sequence
  Synthetic
cgaggctttgggcttgggtcc

SEQ ID NO: 19803 - DNA, 21 bp, Artificial Sequence
  Synthetic
gtccgcaacaaaatcgccctg

SEQ ID NO: 19804 - DNA, 20 bp, Artificial Sequence
  Synthetic
agacattgccctccccgagg

SEQ ID NO: 19805 - DNA, 19 bp, Artificial Sequence
  Synthetic
acggcggcgaagagaaagg

SEQ ID NO: 19806 - DNA, 18 bp, Artificial Sequence
  Synthetic
ttggcgttggctcaggcg

SEQ ID NO: 19807 - DNA, 22 bp, Artificial Sequence
  Synthetic
ggcaatttgttcggcaatggcg

SEQ ID NO: 19808 - DNA, 18 bp, Artificial Sequence
  Synthetic
tcgaagatgcctgcgccg

SEQ ID NO: 19809 - DNA, 20 bp, Artificial Sequence
  Synthetic
ccgacaccatccgcctgatg

SEQ ID NO: 19810 - DNA, 19 bp, Artificial Sequence
  Synthetic
cgtgtgcatcggtcctgcc

SEQ ID NO: 19811 - DNA, 19 bp, Artificial Sequence
  Synthetic
tgccgctcgccaaagtcgg

SEQ ID NO: 19812 - DNA, 20 bp, Artificial Sequence
  Synthetic
ttggaaatcgtccgcaccga

SEQ ID NO: 19813 - DNA, 20 bp, Artificial Sequence
  Synthetic
cgcctgaccatgctgttgcg

SEQ ID NO: 19814 - DNA, 22 bp, Artificial Sequence
  Synthetic
cgccgatgccgtacaagaaacc

SEQ ID NO: 19815 - DNA, 18 bp, Artificial Sequence
  Synthetic
agtcgcgcccgtcgacaa

SEQ ID NO: 19816 - DNA, 20 bp, Artificial Sequence
  Synthetic
gcgcaggtggggcaggtaat

SEQ ID NO: 19817 - DNA, 21 bp, Artificial Sequence
  Synthetic
gctgttttcgggcatctggct

SEQ ID NO: 19818 - DNA, 20 bp, Artificial Sequence
  Synthetic
ccgatcataccggtcgcgcc

SEQ ID NO: 19819 - DNA, 20 bp, Artificial Sequence
  Synthetic
ccgatttccaaaaccgcgcc

SEQ ID NO: 19820 - DNA, 19 bp, Artificial Sequence
  Synthetic
acggcagggcggggttttg

SEQ ID NO: 19821 - DNA, 22 bp, Artificial Sequence
  Synthetic
cctgtcgctcggtaaatcagcg

SEQ ID NO: 19822 - DNA, 18 bp, Artificial Sequence
  Synthetic
actgcttcgcgcgcttcg

SEQ ID NO: 19823 - DNA, 20 bp, Artificial Sequence
  Synthetic
gcgttcttccctgcgtttgc

SEQ ID NO: 19824 - DNA, 21 bp, Artificial Sequence
  Synthetic
tcgagcgggcaggctgaaatc

SEQ ID NO: 19825 - DNA, 19 bp, Artificial Sequence
  Synthetic
accgcgccatgctcttggc

SEQ ID NO: 19826 - DNA, 21 bp, Artificial Sequence
  Synthetic
cgcctcgcccgtatccatgta

SEQ ID NO: 19827 - DNA, 19 bp, Artificial Sequence
  Synthetic
ccgcagcattcccacgact

SEQ ID NO: 19828 - DNA, 20 bp, Artificial Sequence
  Synthetic
gcgcgtgaacacggcattcc

SEQ ID NO: 19829 - DNA, 20 bp, Artificial Sequence
  Synthetic
actctccgccctgctcgacc

SEQ ID NO: 19830 - DNA, 22 bp, Artificial Sequence
  Synthetic
ggctgaaaaacgccgtcgaact

SEQ ID NO: 19831 - DNA, 22 bp, Artificial Sequence
  Synthetic
ccatgctgaacaccgccctttc

SEQ ID NO: 19832 - DNA, 22 bp, Artificial Sequence
  Synthetic
tcaagacagaaagctcctgccg

SEQ ID NO: 19833 - DNA, 22 bp, Artificial Sequence
  Synthetic
cgctgttttacacgctgaccga

SEQ ID NO: 19834 - DNA, 19 bp, Artificial Sequence
  Synthetic
tgctgcactttccggcgaa

SEQ ID NO: 19835 - DNA, 22 bp, Artificial Sequence
  Synthetic
gggactgacggtgtcggtattg

SEQ ID NO: 19836 - DNA, 19 bp, Artificial Sequence
  Synthetic
aagctgcgcggtgctgacc

SEQ ID NO: 19837 - DNA, 19 bp, Artificial Sequence
  Synthetic
cctccgcaacgacctgacc

SEQ ID NO: 19838 - DNA, 19 bp, Artificial Sequence
  Synthetic
cgtgcgcgcctaccagatt

SEQ ID NO: 19839 - DNA, 19 bp, Artificial Sequence
  Synthetic
tatggctgcacggcgaggc

SEQ ID NO: 19840 - DNA, 22 bp, Artificial Sequence
  Synthetic
ggcacatttttcacgcttgcca

SEQ ID NO: 19841 - DNA, 22 bp, Artificial Sequence
  Synthetic
cccagcagtttcgccgttttgt

SEQ ID NO: 19842 - DNA, 20 bp, Artificial Sequence
  Synthetic
tgaccgccatgtacaagccg

SEQ ID NO: 19843 - DNA, 21 bp, Artificial Sequence
  Synthetic
cgccgtttatgacgcccccaa

SEQ ID NO: 19844 - DNA, 22 bp, Artificial Sequence
  Synthetic
gctcgcgcgaaaacttaaacca

SEQ ID NO: 19845 - DNA, 19 bp, Artificial Sequence
  Synthetic
gcctgccggggctacatca

SEQ ID NO: 19846 - DNA, 18 bp, Artificial Sequence
  Synthetic
gtcccgaaagccgctgca

SEQ ID NO: 19847 - DNA, 18 bp, Artificial Sequence
  Synthetic
ggcaaggtgcggcagctt

SEQ ID NO: 19848 - DNA, 21 bp, Artificial Sequence
  Synthetic
cgatgacggtggtggcaacca

SEQ ID NO: 19849 - DNA, 20 bp, Artificial Sequence
  Synthetic
atcagcatcggggcggtttc

SEQ ID NO: 19850 - DNA, 19 bp, Artificial Sequence
  Synthetic
acacccgaaacccgcagcg

SEQ ID NO: 19851 - DNA, 19 bp, Artificial Sequence
  Synthetic
gcttcaggacggcatcgcc

SEQ ID NO: 19852 - DNA, 19 bp, Artificial Sequence
  Synthetic
ccgccgacttccgcatacg

SEQ ID NO: 19853 - DNA, 20 bp, Artificial Sequence
  Synthetic
actttccaagtctgcgcggc

SEQ ID NO: 19854 - DNA, 20 bp, Artificial Sequence
  Synthetic
ggagtagcgttgggattcgc

SEQ ID NO: 19855 - DNA, 21 bp, Artificial Sequence
  Synthetic
ttccgacccattctccggaga

SEQ ID NO: 19856 - DNA, 22 bp, Artificial Sequence
  Synthetic
ggtaggatgcggatttcctgct

SEQ ID NO: 19857 - DNA, 22 bp, Artificial Sequence
  Synthetic
gcccacgtcgtttatccgcaag

SEQ ID NO: 19858 - DNA, 22 bp, Artificial Sequence
  Synthetic
gcaactgccttatgccctgacg

SEQ ID NO: 19859 - DNA, 20 bp, Artificial Sequence
  Synthetic
tatgctgccgattgccgccg

SEQ ID NO: 19860 - DNA, 19 bp, Artificial Sequence
  Synthetic
cgcccatgtgcgtgctgat

SEQ ID NO: 19861 - DNA, 21 bp, Artificial Sequence
  Synthetic
cgtcgacggtctgacacacct

SEQ ID NO: 19862 - DNA, 21 bp, Artificial Sequence
  Synthetic
gcaaatatacagccgcagcgg

SEQ ID NO: 19863 - DNA, 20 bp, Artificial Sequence
  Synthetic
tttccggttgccgatacgcc

SEQ ID NO: 19864 - DNA, 20 bp, Artificial Sequence
  Synthetic
gccattaccgccgaaccgag

SEQ ID NO: 19865 - DNA, 22 bp, Artificial Sequence
  Synthetic
cggtattcctgagcgtcggatc

SEQ ID NO: 19866 - DNA, 22 bp, Artificial Sequence
  Synthetic
cggcttggacgttgcacacttt

SEQ ID NO: 19867 - DNA, 20 bp, Artificial Sequence
  Synthetic
cgcgccctatcatgatgccg

SEQ ID NO: 19868 - DNA, 20 bp, Artificial Sequence
  Synthetic
acggcggcatggcaatactg

SEQ ID NO: 19869 - DNA, 19 bp, Artificial Sequence
  Synthetic
gaccaaagccgccaatgcc

SEQ ID NO: 19870 - DNA, 19 bp, Artificial Sequence
  Synthetic
agcttgcccggaaagccgc

SEQ ID NO: 19871 - DNA, 20 bp, Artificial Sequence
  Synthetic
gcaggtcgtcgtcgctgtac

SEQ ID NO: 19872 - DNA, 19 bp, Artificial Sequence
  Synthetic
tctgcctgtccctcagcgc

SEQ ID NO: 19873 - DNA, 21 bp, Artificial Sequence
  Synthetic
ccgtctgcaagcctacgaagg

SEQ ID NO: 19874 - DNA, 19 bp, Artificial Sequence
  Synthetic
ccacgttggcacgcctgtg

SEQ ID NO: 19875 - DNA, 21 bp, Artificial Sequence
  Synthetic
cgcaagaacacaggcaaagcc

SEQ ID NO: 19876 - DNA, 20 bp, Artificial Sequence
  Synthetic
cgctttgccgaactcgacgg

SEQ ID NO: 19877 - DNA, 19 bp, Artificial Sequence
  Synthetic
aaatcccgccctgctcgcc

SEQ ID NO: 19878 - DNA, 19 bp, Artificial Sequence
  Synthetic
ctgaccggcacacccacac

SEQ ID NO: 19879 - DNA, 19 bp, Artificial Sequence
  Synthetic
acgccgacgacctcgaagc

SEQ ID NO: 19880 - DNA, 22 bp, Artificial Sequence
  Synthetic
ccaaaaccgccgtcctacacca

SEQ ID NO: 19881 - DNA, 21 bp, Artificial Sequence
  Synthetic
caacagcatctccgtcagcga

SEQ ID NO: 19882 - DNA, 22 bp, Artificial Sequence
  Synthetic
gccatattcgcaggattgctgc

SEQ ID NO: 19883 - DNA, 20 bp, Artificial Sequence
  Synthetic
ccgacaaagaccgcgcatgg

SEQ ID NO: 19884 - DNA, 22 bp, Artificial Sequence
  Synthetic
catcacccgcatcggtttcaac

SEQ ID NO: 19885 - DNA, 22 bp, Artificial Sequence
  Synthetic
gctatcggagttggaccaggtg

SEQ ID NO: 19886 - DNA, 19 bp, Artificial Sequence
  Synthetic
agccggcggattctgcctg

SEQ ID NO: 19887 - DNA, 19 bp, Artificial Sequence
  Synthetic
accccggggcaaaccatcc

SEQ ID NO: 19888 - DNA, 25 bp, Artificial Sequence
  Synthetic
tccattatttaccaattcctcaccg

SEQ ID NO: 19889 - DNA, 19 bp, Artificial Sequence
  Synthetic
cgccgctacgccatcaacg

SEQ ID NO: 19890 - DNA, 22 bp, Artificial Sequence
  Synthetic
ggcgaacccaaacccagcatca

SEQ ID NO: 19891 - DNA, 22 bp, Artificial Sequence
  Synthetic
gggaaatctttacccacggcgg

SEQ ID NO: 19892 - DNA, 18 bp, Artificial Sequence
  Synthetic
acgcaccgttgccgacat

SEQ ID NO: 19893 - DNA, 19 bp, Artificial Sequence
  Synthetic
agcaggcgcgattaccggc

SEQ ID NO: 19894 - DNA, 19 bp, Artificial Sequence
  Synthetic
acgtcttgagcgtcggccc

SEQ ID NO: 19895 - DNA, 22 bp, Artificial Sequence
  Synthetic
ggcacaccaattgaaccttgcc

SEQ ID NO: 19896 - DNA, 20 bp, Artificial Sequence
  Synthetic
cgacgcactggtcggcaaag

SEQ ID NO: 19897 - DNA, 21 bp, Artificial Sequence
  Synthetic
cgacagcgcatcgaagccatg

SEQ ID NO: 19898 - DNA, 18 bp, Artificial Sequence
  Synthetic
gctgaccgccgacgatgt

SEQ ID NO: 19899 - DNA, 20 bp, Artificial Sequence
  Synthetic
accggttgccgccaaaaaag

SEQ ID NO: 19900 - DNA, 20 bp, Artificial Sequence
  Synthetic
gcgtcaaccgtatgccgctc

SEQ ID NO: 19901 - DNA, 20 bp, Artificial Sequence
  Synthetic
aaacccaagcccgaagacgc

SEQ ID NO: 19902 - DNA, 20 bp, Artificial Sequence
  Synthetic
tcctacggctggttcggctt

SEQ ID NO: 19903 - DNA, 19 bp, Artificial Sequence
  Synthetic
tcggcggcattgcccgatc

SEQ ID NO: 19904 - DNA, 21 bp, Artificial Sequence
  Synthetic
gatgggttggttcgatgccgt

SEQ ID NO: 19905 - DNA, 19 bp, Artificial Sequence
  Synthetic
ccttgccgtcgccatcctg

SEQ ID NO: 19906 - DNA, 20 bp, Artificial Sequence
  Synthetic
tacgccttttcggacggcgc

SEQ ID NO: 19907 - DNA, 19 bp, Artificial Sequence
  Synthetic
aactgaccgcgctgctcgg

SEQ ID NO: 19908 - DNA, 19 bp, Artificial Sequence
  Synthetic
accgactacgtcgtcgccg

SEQ ID NO: 19909 - DNA, 22 bp, Artificial Sequence
  Synthetic
gctccataagccctaccgcctg

SEQ ID NO: 19910 - DNA, 20 bp, Artificial Sequence
  Synthetic
cgatgccgaatacgaccgcc

SEQ ID NO: 19911 - DNA, 20 bp, Artificial Sequence
  Synthetic
ccgcactggacgcattctgc

SEQ ID NO: 19912 - DNA, 19 bp, Artificial Sequence
  Synthetic
ccatcccgggcatccgcta

SEQ ID NO: 19913 - DNA, 22 bp, Artificial Sequence
  Synthetic
gcgttttccatcggcatcgaac

SEQ ID NO: 19914 - DNA, 22 bp, Artificial Sequence
  Synthetic
ggaaaagctgtttgccaaccgg

SEQ ID NO: 19915 - DNA, 22 bp, Artificial Sequence
  Synthetic
ccgatacgcgccatcgatactt

SEQ ID NO: 19916 - DNA, 21 bp, Artificial Sequence
  Synthetic
acggaacagcagcaaaggctc

SEQ ID NO: 19917 - DNA, 20 bp, Artificial Sequence
  Synthetic
cgcgcagttgttccagcgat

SEQ ID NO: 19918 - DNA, 21 bp, Artificial Sequence
  Synthetic
caccctgtacgaaacgctcgc

SEQ ID NO: 19919 - DNA, 22 bp, Artificial Sequence
  Synthetic
gccataatgcgcgctttgtagg

SEQ ID NO: 19920 - DNA, 20 bp, Artificial Sequence
  Synthetic
tcggcggtggtgatgtgttc

SEQ ID NO: 19921 - DNA, 20 bp, Artificial Sequence
  Synthetic
ggtaacggcggcgaccaatg

SEQ ID NO: 19922 - DNA, 20 bp, Artificial Sequence
  Synthetic
tccatcgcgtccgccagtat

SEQ ID NO: 19923 - DNA, 19 bp, Artificial Sequence
  Synthetic
acatccacaccgccgagcg

SEQ ID NO: 19924 - DNA, 20 bp, Artificial Sequence
  Synthetic
gcggaagcggtcgacgtatc

SEQ ID NO: 19925 - DNA, 22 bp, Artificial Sequence
  Synthetic
ggcaggaaatcctatgccgtcg

SEQ ID NO: 19926 - DNA, 18 bp, Artificial Sequence
  Synthetic
ggaaaccgccgccgacaa

SEQ ID NO: 19927 - DNA, 19 bp, Artificial Sequence
  Synthetic
tgccggtggacattggtgc

SEQ ID NO: 19928 - DNA, 22 bp, Artificial Sequence
  Synthetic
cctgcatcagatagctgcggaa

SEQ ID NO: 19929 - DNA, 21 bp, Artificial Sequence
  Synthetic
cggcgcgaatttaaacggaaa

SEQ ID NO: 19930 - DNA, 20 bp, Artificial Sequence
  Synthetic
atccccaatatgccgtcagc

SEQ ID NO: 19931 - DNA, 18 bp, Artificial Sequence
  Synthetic
tgggacagctcggggcaa

SEQ ID NO: 19932 - DNA, 19 bp, Artificial Sequence
  Synthetic
ctcgcgcatatggacgcgg

SEQ ID NO: 19933 - DNA, 22 bp, Artificial Sequence
  Synthetic
gcgtctgcctcgatacccaaac

SEQ ID NO: 19934 - DNA, 19 bp, Artificial Sequence
  Synthetic
tccacgcgcctgccagttg

SEQ ID NO: 19935 - DNA, 20 bp, Artificial Sequence
  Synthetic
tgaggctgttgcggacggat

SEQ ID NO: 19936 - DNA, 20 bp, Artificial Sequence
  Synthetic
ttcaagacgacggcggactg

SEQ ID NO: 19937 - DNA, 18 bp, Artificial Sequence
  Synthetic
tccatcgcgcgcggctat

SEQ ID NO: 19938 - DNA, 22 bp, Artificial Sequence
  Synthetic
gcctgcttccggccattctgat

SEQ ID NO: 19939 - DNA, 19 bp, Artificial Sequence
  Synthetic
acgacgtttccggcctgcc

SEQ ID NO: 19940 - DNA, 20 bp, Artificial Sequence
  Synthetic
ggtgtacggaatcgtcgccg

SEQ ID NO: 19941 - DNA, 20 bp, Artificial Sequence
  Synthetic
ttcggttcgggcttgttggg

SEQ ID NO: 19942 - DNA, 21 bp, Artificial Sequence
  Synthetic
tggcgcacggcatcgatatgt

SEQ ID NO: 19943 - DNA, 20 bp, Artificial Sequence
  Synthetic
tttccgtggcgatgtcgtaa

SEQ ID NO: 19944 - DNA, 20 bp, Artificial Sequence
  Synthetic
ttgacggccttccattttgg

SEQ ID NO: 19945 - DNA, 24 bp, Artificial Sequence
  Synthetic
ccctttggatattgcgctcaattt

SEQ ID NO: 19946 - DNA, 20 bp, Artificial Sequence
  Synthetic
cacagcattcccggggtgtc

SEQ ID NO: 19947 - DNA, 22 bp, Artificial Sequence
  Synthetic
cctcaggcaaatacgcggacaa

SEQ ID NO: 19948 - DNA, 21 bp, Artificial Sequence
  Synthetic
tgccgtctgaagcaccgtttg

SEQ ID NO: 19949 - DNA, 19 bp, Artificial Sequence
  Synthetic
cgcgccacccatgcattgg

SEQ ID NO: 19950 - DNA, 25 bp, Artificial Sequence
  Synthetic
gttgatttgaaaaaaatgccgtctg

SEQ ID NO: 19951 - DNA, 22 bp, Artificial Sequence
  Synthetic
acacccgaccaccaaaagctgg

SEQ ID NO: 19952 - DNA, 25 bp, Artificial Sequence
  Synthetic
gtctgaatgtttcgacaatccgatt

SEQ ID NO: 19953 - DNA, 20 bp, Artificial Sequence
  Synthetic
cacaaccgccgacatcaagc

SEQ ID NO: 19954 - DNA, 22 bp, Artificial Sequence
  Synthetic
gtcaattcgcaccggactgcgt

SEQ ID NO: 19955 - DNA, 19 bp, Artificial Sequence
  Synthetic
tcctcaggctccgccacac

SEQ ID NO: 19956 - DNA, 25 bp, Artificial Sequence
  Synthetic
cattggcaaaaatagcagcacaata

SEQ ID NO: 19957 - DNA, 19 bp, Artificial Sequence
  Synthetic
cgcaccttcgggcagactg

SEQ ID NO: 19958 - DNA, 19 bp, Artificial Sequence
  Synthetic
ttgccggttcggaagccgc

SEQ ID NO: 19959 - DNA, 21 bp, Artificial Sequence
  Synthetic
cgcatgaagattggcttccgc

SEQ ID NO: 19960 - DNA, 22 bp, Artificial Sequence
  Synthetic
cgcttcaaggtagccttttgcc

SEQ ID NO: 19961 - DNA, 19 bp, Artificial Sequence
  Synthetic
ggcgtgttggttgatgccg

SEQ ID NO: 19962 - DNA, 25 bp, Artificial Sequence
  Synthetic
gcgaaagtttccgtaaaaatatcgg

SEQ ID NO: 19963 - DNA, 20 bp, Artificial Sequence
  Synthetic
ccgccgcccaagattggaat

SEQ ID NO: 19964 - DNA, 22 bp, Artificial Sequence
  Synthetic
acttcaaactgcgcggacaacc

SEQ ID NO: 19965 - DNA, 22 bp, Artificial Sequence
  Synthetic
cgccgtacctatgcgtgtgaaa

SEQ ID NO: 19966 - DNA, 20 bp, Artificial Sequence
  Synthetic
acggtttcgtcgacggcacg

SEQ ID NO: 19967 - DNA, 22 bp, Artificial Sequence
  Synthetic
gctctacttcgcagccgtcaac

SEQ ID NO: 19968 - DNA, 22 bp, Artificial Sequence
  Synthetic
tggtattcgtcatcggcatcgc

SEQ ID NO: 19969 - DNA, 22 bp, Artificial Sequence
  Synthetic
gcatttccaatcccgacaccgt

SEQ ID NO: 19970 - DNA, 20 bp, Artificial Sequence
  Synthetic
catcgtcaggcgagcaaccg

SEQ ID NO: 19971 - DNA, 22 bp, Artificial Sequence
  Synthetic
atcggacgaattggcacggatt

SEQ ID NO: 19972 - DNA, 19 bp, Artificial Sequence
  Synthetic
tgctcgacaacggcgttcc

SEQ ID NO: 19973 - DNA, 19 bp, Artificial Sequence
  Synthetic
cgtcgccgccataaaacgc

SEQ ID NO: 19974 - DNA, 19 bp, Artificial Sequence
  Synthetic
atccgcagcccgacggttc

SEQ ID NO: 19975 - DNA, 19 bp, Artificial Sequence
  Synthetic
attgcgcgacatcgtccga

SEQ ID NO: 19976 - DNA, 22 bp, Artificial Sequence
  Synthetic
cgcccgataaagctgcgtaagt

SEQ ID NO: 19977 - DNA, 22 bp, Artificial Sequence
  Synthetic
gcccgaaccgatgaagcaatcc

SEQ ID NO: 19978 - DNA, 20 bp, Artificial Sequence
  Synthetic
gccgattttgcctttgccgc

SEQ ID NO: 19979 - DNA, 21 bp, Artificial Sequence
  Synthetic
acgaagtggaagccgtgttgg

SEQ ID NO: 19980 - DNA, 19 bp, Artificial Sequence
  Synthetic
agtcgaacccgccgccaag

SEQ ID NO: 19981 - DNA, 22 bp, Artificial Sequence
  Synthetic
tcttcgcggaagatttcgcctt

SEQ ID NO: 19982 - DNA, 19 bp, Artificial Sequence
  Synthetic
agtccgctacacgcaaggc

SEQ ID NO: 19983 - DNA, 21 bp, Artificial Sequence
  Synthetic
ggcttccaacgcgtcatccag

SEQ ID NO: 19984 - DNA, 20 bp, Artificial Sequence
  Synthetic
tgtcttcggcaaccacaccg

SEQ ID NO: 19985 - DNA, 20 bp, Artificial Sequence
  Synthetic
gcgcattttgcccgaacgca

SEQ ID NO: 19986 - DNA, 20 bp, Artificial Sequence
  Synthetic
aacggtctttgaggcggctg

SEQ ID NO: 19987 - DNA, 18 bp, Artificial Sequence
  Synthetic
aagctcggcggcgcaaag

SEQ ID NO: 19988 - DNA, 20 bp, Artificial Sequence
  Synthetic
cgaagccccggaatttgcct

SEQ ID NO: 19989 - DNA, 20 bp, Artificial Sequence
  Synthetic
gccaaaccgccgtggacatc

SEQ ID NO: 19990 - DNA, 22 bp, Artificial Sequence
  Synthetic
cggaattccgcgcatttgcaga

SEQ ID NO: 19991 - DNA, 22 bp, Artificial Sequence
  Synthetic
ctgccctttctgcaaagccgtt

SEQ ID NO: 19992 - DNA, 21 bp, Artificial Sequence
  Synthetic
gaacaggtattccggcgcgga

SEQ ID NO: 19993 - DNA, 20 bp, Artificial Sequence
  Synthetic
atcggcaggctgaaacactc

SEQ ID NO: 19994 - DNA, 19 bp, Artificial Sequence
  Synthetic
gcgcgctggatgccaaagt

SEQ ID NO: 19995 - DNA, 18 bp, Artificial Sequence
  Synthetic
gcgtgctgctgccggaaa

SEQ ID NO: 19996 - DNA, 21 bp, Artificial Sequence
  Synthetic
gctgaccactgaaaacacgcc

SEQ ID NO: 19997 - DNA, 23 bp, Artificial Sequence
  Synthetic
accgtcatatgccttattgtcgt

SEQ ID NO: 19998 - DNA, 22 bp, Artificial Sequence
  Synthetic
gcccggtcaaaagcgcaaaaag

SEQ ID NO: 19999 - DNA, 21 bp, Artificial Sequence
  Synthetic
agctacaccccgaaacatccg

SEQ ID NO: 20000 - DNA, 19 bp, Artificial Sequence
  Synthetic
gcacggcgatgcggaagtg

SEQ ID NO: 20001 - DNA, 21 bp, Artificial Sequence
  Synthetic
gcggcggcggtttttgtagat

SEQ ID NO: 20002 - DNA, 19 bp, Artificial Sequence
  Synthetic
ccagcggtttgcaatcgcc

SEQ ID NO: 20003 - DNA, 20 bp, Artificial Sequence
  Synthetic
taccgcgtctttgccgactg

SEQ ID NO: 20004 - DNA, 22 bp, Artificial Sequence
  Synthetic
ccgatacggggtaaggcaggat

SEQ ID NO: 20005 - DNA, 19 bp, Artificial Sequence
  Synthetic
gtttgcgccgccgtctttg

SEQ ID NO: 20006 - DNA, 21 bp, Artificial Sequence
  Synthetic
gttcctcgtaggctgcctgcg

SEQ ID NO: 20007 - DNA, 20 bp, Artificial Sequence
  Synthetic
ggtcgtacagggcgttgccg

SEQ ID NO: 20008 - DNA, 25 bp, Artificial Sequence
  Synthetic
agtgccatttcattctaacttcctt

SEQ ID NO: 20009 - DNA, 22 bp, Artificial Sequence
  Synthetic
gcttcatctgctttgtgcgggt

SEQ ID NO: 20010 - DNA, 21 bp, Artificial Sequence
  Synthetic
cgaccacatcggacaatcccg

SEQ ID NO: 20011 - DNA, 22 bp, Artificial Sequence
  Synthetic
gtttccgttcgggcaatggttc

SEQ ID NO: 20012 - DNA, 20 bp, Artificial Sequence
  Synthetic
gcccgtcgtcttccacgttg

SEQ ID NO: 20013 - DNA, 22 bp, Artificial Sequence
  Synthetic
ggcggttacttttttgcctgcc

SEQ ID NO: 20014 - DNA, 18 bp, Artificial Sequence
  Synthetic
gcagcttcggcttcggct

SEQ ID NO: 20015 - DNA, 20 bp, Artificial Sequence
  Synthetic
cgcccgatataggcttccgc

SEQ ID NO: 20016 - DNA, 19 bp, Artificial Sequence
  Synthetic
cgttgacactgcccgcgaa

SEQ ID NO: 20017 - DNA, 19 bp, Artificial Sequence
  Synthetic
ccctgcgtttcaagcccga

SEQ ID NO: 20018 - DNA, 19 bp, Artificial Sequence
  Synthetic
tccaatacgccgcccaggg

SEQ ID NO: 20019 - DNA, 21 bp, Artificial Sequence
  Synthetic
ccgcctgataaatgttgcgcg

SEQ ID NO: 20020 - DNA, 18 bp, Artificial Sequence
  Synthetic
tcaaacccgcgttgcgcc

SEQ ID NO: 20021 - DNA, 18 bp, Artificial Sequence
  Synthetic
atcgcggctgtcctgctc

SEQ ID NO: 20022 - DNA, 19 bp, Artificial Sequence
  Synthetic
cgggcgtgtgtctgaaccg

SEQ ID NO: 20023 - DNA, 22 bp, Artificial Sequence
  Synthetic
cgaacgggaacacatccgcctt

SEQ ID NO: 20024 - DNA, 20 bp, Artificial Sequence
  Synthetic
cggcaagaagcggcggtatg

SEQ ID NO: 20025 - DNA, 22 bp, Artificial Sequence
  Synthetic
cggacaggagggcgtttgatgt

SEQ ID NO: 20026 - DNA, 19 bp, Artificial Sequence
  Synthetic
gcgggggcttcgagtttcg

SEQ ID NO: 20027 - DNA, 19 bp, Artificial Sequence
  Synthetic
acaccgccgcaccgtatcc

SEQ ID NO: 20028 - DNA, 18 bp, Artificial Sequence
  Synthetic
ttcccaccgcttccccga

SEQ ID NO: 20029 - DNA, 19 bp, Artificial Sequence
  Synthetic
tccgggcggttttggcgtg

SEQ ID NO: 20030 - DNA, 22 bp, Artificial Sequence
  Synthetic
gccttgagcttgtcgattgccg

SEQ ID NO: 20031 - DNA, 21 bp, Artificial Sequence
  Synthetic
cgcccatcaaccccatcactg

SEQ ID NO: 20032 - DNA, 22 bp, Artificial Sequence
  Synthetic
gcgaagtgggcgaactgatcgt

SEQ ID NO: 20033 - DNA, 18 bp, Artificial Sequence
  Synthetic
ttttggcgggcgcggtgt

SEQ ID NO: 20034 - DNA, 20 bp, Artificial Sequence
  Synthetic
ggctggcaggcgagttttct

SEQ ID NO: 20035 - DNA, 20 bp, Artificial Sequence
  Synthetic
cgacaggggttctttttgct

SEQ ID NO: 20036 - DNA, 20 bp, Artificial Sequence
  Synthetic
ttttcgcaaatcttccgccc

SEQ ID NO: 20037 - DNA, 19 bp, Artificial Sequence
  Synthetic
caggaaatcatcgcgcgcg

SEQ ID NO: 20038 - DNA, 19 bp, Artificial Sequence
  Synthetic
gcacatcgcccccgaaacc

SEQ ID NO: 20039 - DNA, 19 bp, Artificial Sequence
  Synthetic
actgccgacgtgcttgccc

SEQ ID NO: 20040 - DNA, 19 bp, Artificial Sequence
  Synthetic
cgccgacgcccgatttcac

SEQ ID NO: 20041 - DNA, 22 bp, Artificial Sequence
  Synthetic
cggaagacaaatccatgccgcc

SEQ ID NO: 20042 - DNA, 19 bp, Artificial Sequence
  Synthetic
atcagcgcgggcttgtgcc

SEQ ID NO: 20043 - DNA, 21 bp, Artificial Sequence
  Synthetic
cttgcattggaagccttgggc

SEQ ID NO: 20044 - DNA, 21 bp, Artificial Sequence
  Synthetic
gctggccggaaaccatatctc

SEQ ID NO: 20045 - DNA, 19 bp, Artificial Sequence
  Synthetic
tccacccgcacccgacctt

SEQ ID NO: 20046 - DNA, 19 bp, Artificial Sequence
  Synthetic
ccgtacgacgctgaacggc

SEQ ID NO: 20047 - DNA, 20 bp, Artificial Sequence
  Synthetic
ggcatcagcagctccacgct

SEQ ID NO: 20048 - DNA, 20 bp, Artificial Sequence
  Synthetic
ctccgatcggcaactggcaa

SEQ ID NO: 20049 - DNA, 21 bp, Artificial Sequence
  Synthetic
aaggcgcatctgctcgatgtg

SEQ ID NO: 20050 - DNA, 20 bp, Artificial Sequence
  Synthetic
cgccgcgttcgtactgcatg

SEQ ID NO: 20051 - DNA, 19 bp, Artificial Sequence
  Synthetic
atcaggctgcggtgggagc

SEQ ID NO: 20052 - DNA, 18 bp, Artificial Sequence
  Synthetic
aaggcggtgcggacgttg

SEQ ID NO: 20053 - DNA, 22 bp, Artificial Sequence
  Synthetic
cggtgaaacacggcatttggtt

SEQ ID NO: 20054 - DNA, 18 bp, Artificial Sequence
  Synthetic
ggcgggcggcaaagtgtt

SEQ ID NO: 20055 - DNA, 20 bp, Artificial Sequence
  Synthetic
gcagcagcaatgtcggcatt

SEQ ID NO: 20056 - DNA, 20 bp, Artificial Sequence
  Synthetic
cccgcccataaagccatcgg

SEQ ID NO: 20057 - DNA, 20 bp, Artificial Sequence
  Synthetic
gctcgacagccttgccgaca

SEQ ID NO: 20058 - DNA, 19 bp, Artificial Sequence
  Synthetic
tgtttgccgcgctgatccg

SEQ ID NO: 20059 - DNA, 22 bp, Artificial Sequence
  Synthetic
cgacaggcagggagtcggcata

SEQ ID NO: 20060 - DNA, 20 bp, Artificial Sequence
  Synthetic
cggtgtcaacgataaggcac

SEQ ID NO: 20061 - DNA, 22 bp, Artificial Sequence
  Synthetic
accgtaaacgcaggtctgaaat

SEQ ID NO: 20062 - DNA, 22 bp, Artificial Sequence
  Synthetic
gcagcgcaacctcaaaccgaaa

SEQ ID NO: 20063 - DNA, 20 bp, Artificial Sequence
  Synthetic
cgacatctcgacggcaaccg

SEQ ID NO: 20064 - DNA, 20 bp, Artificial Sequence
  Synthetic
cgcccttgcccaacgctata

SEQ ID NO: 20065 - DNA, 19 bp, Artificial Sequence
  Synthetic
tggaaatccgcggcgcagg

SEQ ID NO: 20066 - DNA, 20 bp, Artificial Sequence
  Synthetic
cgaccacgcttctggtcgag

SEQ ID NO: 20067 - DNA, 18 bp, Artificial Sequence
  Synthetic
tcgccctgcacaagctcg

SEQ ID NO: 20068 - DNA, 21 bp, Artificial Sequence
  Synthetic
tgttgttcgtaccggttgcca

SEQ ID NO: 20069 - DNA, 19 bp, Artificial Sequence
  Synthetic
tcctcgccgcctacatcca

SEQ ID NO: 20070 - DNA, 19 bp, Artificial Sequence
  Synthetic
tacagcacccgccacctgc

SEQ ID NO: 20071 - DNA, 22 bp, Artificial Sequence
  Synthetic
cgatctcatccgtatcgccccg

SEQ ID NO: 20072 - DNA, 20 bp, Artificial Sequence
  Synthetic
ggtatcgccgtcggtatggc

SEQ ID NO: 20073 - DNA, 20 bp, Artificial Sequence
  Synthetic
gcaacgacgaactggcgcac

SEQ ID NO: 20074 - DNA, 22 bp, Artificial Sequence
  Synthetic
ccaagttcgcccaatacctgct

SEQ ID NO: 20075 - DNA, 21 bp, Artificial Sequence
  Synthetic
cgggcatcgttgcttttcatt

SEQ ID NO: 20076 - DNA, 22 bp, Artificial Sequence
  Synthetic
tgcccctgcccgatgacataat

SEQ ID NO: 20077 - DNA, 22 bp, Artificial Sequence
  Synthetic
cgcagtcaggggcagaaacttc

SEQ ID NO: 20078 - DNA, 19 bp, Artificial Sequence
  Synthetic
atggtaggcagcacgcgcg

SEQ ID NO: 20079 - DNA, 20 bp, Artificial Sequence
  Synthetic
cggcgcattggcaaaaggtc

SEQ ID NO: 20080 - DNA, 22 bp, Artificial Sequence
  Synthetic
cggcgtttcaaggtggttacga

SEQ ID NO: 20081 - DNA, 22 bp, Artificial Sequence
  Synthetic
cgcacgaccggttcttcgttaa

SEQ ID NO: 20082 - DNA, 19 bp, Artificial Sequence
  Synthetic
ggcgggaatggcggcaaat

SEQ ID NO: 20083 - DNA, 20 bp, Artificial Sequence
  Synthetic
ccagaccgatatgccgtcgc

SEQ ID NO: 20084 - DNA, 18 bp, Artificial Sequence
  Synthetic
ggtttgcgcccgcatgtg

SEQ ID NO: 20085 - DNA, 19 bp, Artificial Sequence
  Synthetic
aaccaccccgacccctgtg

SEQ ID NO: 20086 - DNA, 22 bp, Artificial Sequence
  Synthetic
gcagcgaacacgatacccgtat

SEQ ID NO: 20087 - DNA, 20 bp, Artificial Sequence
  Synthetic
ggcaaagcaaccttagccgc

SEQ ID NO: 20088 - DNA, 18 bp, Artificial Sequence
  Synthetic
atcaccgcgccgctgcaa

SEQ ID NO: 20089 - DNA, 25 bp, Artificial Sequence
  Synthetic
accgcctttaaacaattgaaagaaa

SEQ ID NO: 20090 - DNA, 22 bp, Artificial Sequence
  Synthetic
tcgacattaccgaacaccgcaa

SEQ ID NO: 20091 - DNA, 22 bp, Artificial Sequence
  Synthetic
ccagcttcgccgacatcttctt

SEQ ID NO: 20092 - DNA, 21 bp, Artificial Sequence
  Synthetic
aatcccgccgaagaaaccgat

SEQ ID NO: 20093 - DNA, 19 bp, Artificial Sequence
  Synthetic
tccacccacggcgcattcg

SEQ ID NO: 20094 - DNA, 18 bp, Artificial Sequence
  Synthetic
agcgcgccaaatcgaccg

SEQ ID NO: 20095 - DNA, 21 bp, Artificial Sequence
  Synthetic
cggatagacaagttcgcccgc

SEQ ID NO: 20096 - DNA, 22 bp, Artificial Sequence
  Synthetic
gcgtgccattatgggtttccac

SEQ ID NO: 20097 - DNA, 21 bp, Artificial Sequence
  Synthetic
aaatgccggcgatgaaggtca

SEQ ID NO: 20098 - DNA, 19 bp, Artificial Sequence
  Synthetic
ttgtcttgcccacgcccgg

SEQ ID NO: 20099 - DNA, 19 bp, Artificial Sequence
  Synthetic
ggatttgcgcgcccaagct

SEQ ID NO: 20100 - DNA, 21 bp, Artificial Sequence
  Synthetic
tctttgacgaagcggcgcatt

SEQ ID NO: 20101 - DNA, 21 bp, Artificial Sequence
  Synthetic
ccaaagcccttgatcgcgtcc

SEQ ID NO: 20102 - DNA, 18 bp, Artificial Sequence
  Synthetic
gattcccgccgccgtcat

SEQ ID NO: 20103 - DNA, 21 bp, Artificial Sequence
  Synthetic
tgcctgaaacggctaaatcct

SEQ ID NO: 20104 - DNA, 23 bp, Artificial Sequence
  Synthetic
cctgcactcatcaatcctgattt

SEQ ID NO: 20105 - DNA, 22 bp, Artificial Sequence
  Synthetic
gccatttgccgatgattggggc

SEQ ID NO: 20106 - DNA, 19 bp, Artificial Sequence
  Synthetic
tgttgtcgttgtgggcggg

SEQ ID NO: 20107 - DNA, 20 bp, Artificial Sequence
  Synthetic
ccgggtttcacatcgccgta

SEQ ID NO: 20108 - DNA, 22 bp, Artificial Sequence
  Synthetic
ggaacacggcatcgacacactc

SEQ ID NO: 20109 - DNA, 18 bp, Artificial Sequence
  Synthetic
gcgcatcgatttgggcgc

SEQ ID NO: 20110 - DNA, 20 bp, Artificial Sequence
  Synthetic
cgtatgtccggcgcgtcagg

SEQ ID NO: 20111 - DNA, 19 bp, Artificial Sequence
  Synthetic
cagcgcgaagtgttggcgg

SEQ ID NO: 20112 - DNA, 20 bp, Artificial Sequence
  Synthetic
cgtgccacttgttgccgtcg

SEQ ID NO: 20113 - DNA, 20 bp, Artificial Sequence
  Synthetic
gagccgtccacgttggagac

SEQ ID NO: 20114 - DNA, 20 bp, Artificial Sequence
  Synthetic
atttcgtggtgtccgggcag

SEQ ID NO: 20115 - DNA, 21 bp, Artificial Sequence
  Synthetic
cactcttcgccattcccgcga

SEQ ID NO: 20116 - DNA, 19 bp, Artificial Sequence
  Synthetic
caacgtcggcgcactggac

SEQ ID NO: 20117 - DNA, 19 bp, Artificial Sequence
  Synthetic
acggacgcgggcaagacac

SEQ ID NO: 20118 - DNA, 20 bp, Artificial Sequence
  Synthetic
acgagtgcggctacggaatc

SEQ ID NO: 20119 - DNA, 22 bp, Artificial Sequence
  Synthetic
cgcgggaatccggtaaccgaaa

SEQ ID NO: 20120 - DNA, 19 bp, Artificial Sequence
  Synthetic
acgcctacctgctgaccgg

SEQ ID NO: 20121 - DNA, 22 bp, Artificial Sequence
  Synthetic
gttccacacgctcaacaaagcc

SEQ ID NO: 20122 - DNA, 21 bp, Artificial Sequence
  Synthetic
aagtcatgctccatgccgtca

SEQ ID NO: 20123 - DNA, 20 bp, Artificial Sequence
  Synthetic
tggctgcggtacacaatgcc

SEQ ID NO: 20124 - DNA, 20 bp, Artificial Sequence
  Synthetic
gcatcgccaaccgcctgttg

SEQ ID NO: 20125 - DNA, 22 bp, Artificial Sequence
  Synthetic
gcgcaccttatcgccgaacaaa

SEQ ID NO: 20126 - DNA, 20 bp, Artificial Sequence
  Synthetic
agctgatgcggcagatggtg

SEQ ID NO: 20127 - DNA, 20 bp, Artificial Sequence
  Synthetic
ccttcatcgcccgatacggc

SEQ ID NO: 20128 - DNA, 24 bp, Artificial Sequence
  Synthetic
cgaatgctgcaaatttgtttgatg

SEQ ID NO: 20129 - DNA, 22 bp, Artificial Sequence
  Synthetic
ccaagccaaaccggtaacctgt

SEQ ID NO: 20130 - DNA, 21 bp, Artificial Sequence
  Synthetic
gcgtgggtcattttggcgttg

SEQ ID NO: 20131 - DNA, 23 bp, Artificial Sequence
  Synthetic
atgaccaaggacaaaatggactt

SEQ ID NO: 20132 - DNA, 21 bp, Artificial Sequence
  Synthetic
cgccaagcgtaaaccattcat

SEQ ID NO: 20133 - DNA, 23 bp, Artificial Sequence
  Synthetic
gctttggttccttcacatgtcag

SEQ ID NO: 20134 - DNA, 23 bp, Artificial Sequence
  Synthetic
acacggtgcttgatacctttcaa

SEQ ID NO: 20135 - DNA, 21 bp, Artificial Sequence
  Synthetic
ggactactgtggctaccgtaa

SEQ ID NO: 20136 - DNA, 24 bp, Artificial Sequence
  Synthetic
ctgaatttttcagttgcctcacct

SEQ ID NO: 20137 - DNA, 24 bp, Artificial Sequence
  Synthetic
ttgtctgtttgggtgtatgaatca

SEQ ID NO: 20138 - DNA, 25 bp, Artificial Sequence
  Synthetic
gccaaagtaaatggtactaaagctg

SEQ ID NO: 20139 - DNA, 22 bp, Artificial Sequence
  Synthetic
accgcccggacagcttttgata

SEQ ID NO: 20140 - DNA, 22 bp, Artificial Sequence
  Synthetic
cgtggaagaaggcggcaaggta

SEQ ID NO: 20141 - DNA, 21 bp, Artificial Sequence
  Synthetic
ctttggcagtggcgatgttgc

SEQ ID NO: 20142 - DNA, 20 bp, Artificial Sequence
  Synthetic
ccgtcggcaatcagcggaac

SEQ ID NO: 20143 - DNA, 20 bp, Artificial Sequence
  Synthetic
cttggctcatcgcgcccaag

SEQ ID NO: 20144 - DNA, 19 bp, Artificial Sequence
  Synthetic
cgttcgatgcgcccctgat

SEQ ID NO: 20145 - DNA, 19 bp, Artificial Sequence
  Synthetic
acgggtttgacgatgcccg

SEQ ID NO: 20146 - DNA, 20 bp, Artificial Sequence
  Synthetic
ccgatgaccttgcccgcttc

SEQ ID NO: 20147 - DNA, 20 bp, Artificial Sequence
  Synthetic
cgcttcggtcaggcagttca

SEQ ID NO: 20148 - DNA, 18 bp, Artificial Sequence
  Synthetic
tcgtccacgcctgcggtt

SEQ ID NO: 20149 - DNA, 20 bp, Artificial Sequence
  Synthetic
atcctcgccgtcctcgagcc

SEQ ID NO: 20150 - DNA, 19 bp, Artificial Sequence
  Synthetic
atatgccggactcgcgccg

SEQ ID NO: 20151 - DNA, 20 bp, Artificial Sequence
  Synthetic
acacggtgagggacgaagcc

SEQ ID NO: 20152 - DNA, 19 bp, Artificial Sequence
  Synthetic
ttgtgcggacgcgtggtcg

SEQ ID NO: 20153 - DNA, 21 bp, Artificial Sequence
  Synthetic
ccggacagatattgccggtgt

SEQ ID NO: 20154 - DNA, 18 bp, Artificial Sequence
  Synthetic
agccgtggtcgaagccga

SEQ ID NO: 20155 - DNA, 21 bp, Artificial Sequence
  Synthetic
gcaattccaccatccccaccg

SEQ ID NO: 20156 - DNA, 18 bp, Artificial Sequence
  Synthetic
acctaccgccgccgcaat

SEQ ID NO: 20157 - DNA, 20 bp, Artificial Sequence
  Synthetic
tatcggcatcaggcagcagc

SEQ ID NO: 20158 - DNA, 19 bp, Artificial Sequence
  Synthetic
ggcggcatcgaaggcttcg

SEQ ID NO: 20159 - DNA, 20 bp, Artificial Sequence
  Synthetic
gctgcgtgaggactcggtcg

SEQ ID NO: 20160 - DNA, 20 bp, Artificial Sequence
  Synthetic
caaaccgcaaaccgtccgca

SEQ ID NO: 20161 - DNA, 20 bp, Artificial Sequence
  Synthetic
aggacggggtgctgaaacac

SEQ ID NO: 20162 - DNA, 20 bp, Artificial Sequence
  Synthetic
tctgttcattgtcccgcgcc

SEQ ID NO: 20163 - DNA, 22 bp, Artificial Sequence
  Synthetic
gcgtgcggattgaaatgcatct

SEQ ID NO: 20164 - DNA, 21 bp, Artificial Sequence
  Synthetic
ggtatccgaacacctgccgac

SEQ ID NO: 20165 - DNA, 22 bp, Artificial Sequence
  Synthetic
tggttttgtctgcctatgccgt

SEQ ID NO: 20166 - DNA, 21 bp, Artificial Sequence
  Synthetic
tgcgagaattggcggaggaaa

SEQ ID NO: 20167 - DNA, 19 bp, Artificial Sequence
  Synthetic
gcgcatcgtcatccggcat

SEQ ID NO: 20168 - DNA, 20 bp, Artificial Sequence
  Synthetic
gcctcgctgccttcgagatt

SEQ ID NO: 20169 - DNA, 20 bp, Artificial Sequence
  Synthetic
acgacggacagcaaaacgcc

SEQ ID NO: 20170 - DNA, 20 bp, Artificial Sequence
  Synthetic
aaagccgcgagtggtcatgg

SEQ ID NO: 20171 - DNA, 23 bp, Artificial Sequence
  Synthetic
gttcagacggcattttgtatgga

SEQ ID NO: 20172 - DNA, 19 bp, Artificial Sequence
  Synthetic
tcttcgaggcgttcgcggg

SEQ ID NO: 20173 - DNA, 22 bp, Artificial Sequence
  Synthetic
cgggtaatctttccgaaaccgt

SEQ ID NO: 20174 - DNA, 21 bp, Artificial Sequence
  Synthetic
agcctgctttgcgtatccacg

SEQ ID NO: 20175 - DNA, 22 bp, Artificial Sequence
  Synthetic
aggtattcgagataggcgcggg

SEQ ID NO: 20176 - DNA, 19 bp, Artificial Sequence
  Synthetic
acgaatcgccgtcttgcgc

SEQ ID NO: 20177 - DNA, 18 bp, Artificial Sequence
  Synthetic
acccccaagccgcattgg

SEQ ID NO: 20178 - DNA, 20 bp, Artificial Sequence
  Synthetic
tttgccgtcttcgatgccca

SEQ ID NO: 20179 - DNA, 20 bp, Artificial Sequence
  Synthetic
ttgccgaagccagatcgcac

SEQ ID NO: 20180 - DNA, 20 bp, Artificial Sequence
  Synthetic
tcgaccaaatcgccgatggg

SEQ ID NO: 20181 - DNA, 19 bp, Artificial Sequence
  Synthetic
tcctttcgggcgcgagact

SEQ ID NO: 20182 - DNA, 19 bp, Artificial Sequence
  Synthetic
tccgcatcagccacatcgg

SEQ ID NO: 20183 - DNA, 22 bp, Artificial Sequence
  Synthetic
ccgataccacacccgaatacgc

SEQ ID NO: 20184 - DNA, 18 bp, Artificial Sequence
  Synthetic
tgggcaagccattccgcc

SEQ ID NO: 20185 - DNA, 18 bp, Artificial Sequence
  Synthetic
cctcaaccgccgcatgca

SEQ ID NO: 20186 - DNA, 20 bp, Artificial Sequence
  Synthetic
ccgctgattgcaccgctcat

SEQ ID NO: 20187 - DNA, 21 bp, Artificial Sequence
  Synthetic
caccgtaagcgagcgtcaact

SEQ ID NO: 20188 - DNA, 20 bp, Artificial Sequence
  Synthetic
ggtactgcttcctttgccgg

SEQ ID NO: 20189 - DNA, 21 bp, Artificial Sequence
  Synthetic
ccttcggcgtgcatttggaca

SEQ ID NO: 20190 - DNA, 22 bp, Artificial Sequence
  Synthetic
cgatgtttgggcaaagtggctg

SEQ ID NO: 20191 - DNA, 19 bp, Artificial Sequence
  Synthetic
tcaggtgcgcgctcatcgg

SEQ ID NO: 20192 - DNA, 20 bp, Artificial Sequence
  Synthetic
acatcaatgccaagccgggc

SEQ ID NO: 20193 - DNA, 19 bp, Artificial Sequence
  Synthetic
tcacccacgccgtgctgtc

SEQ ID NO: 20194 - DNA, 18 bp, Artificial Sequence
  Synthetic
tccgcgccggctttttcg

SEQ ID NO: 20195 - DNA, 20 bp, Artificial Sequence
  Synthetic
gcaaagagtttcggggcggc

SEQ ID NO: 20196 - DNA, 20 bp, Artificial Sequence
  Synthetic
cggatatttctgcctgcccg

SEQ ID NO: 20197 - DNA, 19 bp, Artificial Sequence
  Synthetic
ccgtctggttgcgttggcg

SEQ ID NO: 20198 - DNA, 21 bp, Artificial Sequence
  Synthetic
cgggaactgggtgtgggaaat

SEQ ID NO: 20199 - DNA, 22 bp, Artificial Sequence
  Synthetic
aaagtgcgtcaaggcagagtct

SEQ ID NO: 20200 - DNA, 19 bp, Artificial Sequence
  Synthetic
aaatcccgtcccgcacgcg

SEQ ID NO: 20201 - DNA, 20 bp, Artificial Sequence
  Synthetic
tgcgccccctcatgattgag

SEQ ID NO: 20202 - DNA, 18 bp, Artificial Sequence
  Synthetic
tgccgcgcacgatgcttg

SEQ ID NO: 20203 - DNA, 19 bp, Artificial Sequence
  Synthetic
acgtcggtcagggcaacgc

SEQ ID NO: 20204 - DNA, 20 bp, Artificial Sequence
  Synthetic
atggttttgcccggcgagtc

SEQ ID NO: 20205 - DNA, 22 bp, Artificial Sequence
  Synthetic
gggcgaggaatagtcgatgacg

SEQ ID NO: 20206 - DNA, 22 bp, Artificial Sequence
  Synthetic
cgtagaagcggctgaacagggt

SEQ ID NO: 20207 - DNA, 22 bp, Artificial Sequence
  Synthetic
ggtcagcagtgccaaaacccaa

SEQ ID NO: 20208 - DNA, 20 bp, Artificial Sequence
  Synthetic
aaacggcatattcgcccgcg

SEQ ID NO: 20209 - DNA, 23 bp, Artificial Sequence
  Synthetic
cgtacccgaaaacgaatacatcg

SEQ ID NO: 20210 - DNA, 19 bp, Artificial Sequence
  Synthetic
ggtttggcggcggaaaccg

SEQ ID NO: 20211 - DNA, 23 bp, Artificial Sequence
  Synthetic
gcatcgtattgactgcctttcaa

SEQ ID NO: 20212 - DNA, 20 bp, Artificial Sequence
  Synthetic
ccaattcgtgcgtgtcttca

SEQ ID NO: 20213 - DNA, 20 bp, Artificial Sequence
  Synthetic
aaccgaagtcaaaccgccgg

SEQ ID NO: 20214 - DNA, 24 bp, Artificial Sequence
  Synthetic
cacagggtcaaaatacagttcagt

SEQ ID NO: 20215 - DNA, 22 bp, Artificial Sequence
  Synthetic
ggacagtttggcagacggtgtg

SEQ ID NO: 20216 - DNA, 21 bp, Artificial Sequence
  Synthetic
gtgccaccgtcttttttgtga

SEQ ID NO: 20217 - DNA, 22 bp, Artificial Sequence
  Synthetic
tcgggcttttggtcattttcag

SEQ ID NO: 20218 - DNA, 21 bp, Artificial Sequence
  Synthetic
ccgtcttggttttccagtgca

SEQ ID NO: 20219 - DNA, 22 bp, Artificial Sequence
  Synthetic
tcgaattgcagcgtgaatgcgc

SEQ ID NO: 20220 - DNA, 19 bp, Artificial Sequence
  Synthetic
tcggtggtccgctcggaag

SEQ ID NO: 20221 - DNA, 20 bp, Artificial Sequence
  Synthetic
atccattccctctcccgtgg

SEQ ID NO: 20222 - DNA, 23 bp, Artificial Sequence
  Synthetic
ctcaaaaaataccagcccgagag

SEQ ID NO: 20223 - DNA, 22 bp, Artificial Sequence
  Synthetic
gcgcgttgagatagacggcgag

SEQ ID NO: 20224 - DNA, 21 bp, Artificial Sequence
  Synthetic
gcggagaactgtttgaccgcg

SEQ ID NO: 20225 - DNA, 21 bp, Artificial Sequence
  Synthetic
acgccgtctgaaaaaaccttt

SEQ ID NO: 20226 - DNA, 20 bp, Artificial Sequence
  Synthetic
gccatgcgcccaaacagatg

SEQ ID NO: 20227 - DNA, 22 bp, Artificial Sequence
  Synthetic
gcgcctgctgcttaagatatgc

SEQ ID NO: 20228 - DNA, 19 bp, Artificial Sequence
  Synthetic
tttccagtcgccgccgtct

SEQ ID NO: 20229 - DNA, 22 bp, Artificial Sequence
  Synthetic
aaacacccgcttcaaaacccac

SEQ ID NO: 20230 - DNA, 18 bp, Artificial Sequence
  Synthetic
tttgaccgcgccgacacg

SEQ ID NO: 20231 - DNA, 20 bp, Artificial Sequence
  Synthetic
aaacggcggtcgattttgtc

SEQ ID NO: 20232 - DNA, 18 bp, Artificial Sequence
  Synthetic
tgccgcccgtgcaaactg

SEQ ID NO: 20233 - DNA, 22 bp, Artificial Sequence
  Synthetic
acgaaccgttgggctacatcaa

SEQ ID NO: 20234 - DNA, 22 bp, Artificial Sequence
  Synthetic
tcttcgccgtaaattaccgcca

SEQ ID NO: 20235 - DNA, 21 bp, Artificial Sequence
  Synthetic
ccgaacttgctgtccactccg

SEQ ID NO: 20236 - DNA, 19 bp, Artificial Sequence
  Synthetic
ggaatgtgccgctgccgaa

SEQ ID NO: 20237 - DNA, 21 bp, Artificial Sequence
  Synthetic
cctgttgggtttgcgcgatga

SEQ ID NO: 20238 - DNA, 22 bp, Artificial Sequence
  Synthetic
tcttgatgggcgtcttgcgtat

SEQ ID NO: 20239 - DNA, 20 bp, Artificial Sequence
  Synthetic
atcagaagcggtagcgcacg

SEQ ID NO: 20240 - DNA, 22 bp, Artificial Sequence
  Synthetic
ccgataagtttccgtgcggaca

SEQ ID NO: 20241 - DNA, 21 bp, Artificial Sequence
  Synthetic
ctcttgtcgtgcggacggttt

SEQ ID NO: 20242 - DNA, 20 bp, Artificial Sequence
  Synthetic
aaacgatacggcaagcgcga

SEQ ID NO: 20243 - DNA, 20 bp, Artificial Sequence
  Synthetic
cctgtcaagcccgtgtgcag

SEQ ID NO: 20244 - DNA, 22 bp, Artificial Sequence
  Synthetic
ggcggatgatacggaggctttg

SEQ ID NO: 20245 - DNA, 19 bp, Artificial Sequence
  Synthetic
gcgggggtgcgaaggaaat

SEQ ID NO: 20246 - DNA, 19 bp, Artificial Sequence
  Synthetic
gcgcgtttccccgttgacg

SEQ ID NO: 20247 - DNA, 20 bp, Artificial Sequence
  Synthetic
tcggggataaggcgggcgag

SEQ ID NO: 20248 - DNA, 20 bp, Artificial Sequence
  Synthetic
gcgacgcggctttcgaacag

SEQ ID NO: 20249 - DNA, 20 bp, Artificial Sequence
  Synthetic
ggcttatccggtgatggcgg

SEQ ID NO: 20250 - DNA, 22 bp, Artificial Sequence
  Synthetic
cccgtgatgaagtcccgggatt

SEQ ID NO: 20251 - DNA, 18 bp, Artificial Sequence
  Synthetic
acgagctgggcggtgtgt

SEQ ID NO: 20252 - DNA, 20 bp, Artificial Sequence
  Synthetic
gcggttacggaggcggacaa

SEQ ID NO: 20253 - DNA, 21 bp, Artificial Sequence
  Synthetic
ctgttgtcgcagcgtgtggag

SEQ ID NO: 20254 - DNA, 19 bp, Artificial Sequence
  Synthetic
ttgcggaatcggcgggcag

SEQ ID NO: 20255 - DNA, 19 bp, Artificial Sequence
  Synthetic
gggctgtacgcgcttaccg

SEQ ID NO: 20256 - DNA, 19 bp, Artificial Sequence
  Synthetic
acgagaagggggcggcttt

SEQ ID NO: 20257 - DNA, 20 bp, Artificial Sequence
  Synthetic
accaactcctaccgcagcca

SEQ ID NO: 20258 - DNA, 22 bp, Artificial Sequence
  Synthetic
gcggaagtatggtacaggcggt

SEQ ID NO: 20259 - DNA, 19 bp, Artificial Sequence
  Synthetic
gggcaatgcacgccgaaca

SEQ ID NO: 20260 - DNA, 20 bp, Artificial Sequence
  Synthetic
gccgcctgcccgatattggg

SEQ ID NO: 20261 - DNA, 18 bp, Artificial Sequence
  Synthetic
atcgggcgttcgggcatc

SEQ ID NO: 20262 - DNA, 22 bp, Artificial Sequence
  Synthetic
cggcctgtaaattccgcgtacg

SEQ ID NO: 20263 - DNA, 19 bp, Artificial Sequence
  Synthetic
ttacggcccggaccaacgc

SEQ ID NO: 20264 - DNA, 19 bp, Artificial Sequence
  Synthetic
gcggtccgcagtcgcattt

SEQ ID NO: 20265 - DNA, 20 bp, Artificial Sequence
  Synthetic
cgaagtatcgcccgccgaaa

SEQ ID NO: 20266 - DNA, 25 bp, Artificial Sequence
  Synthetic
aggttatccaaaaggtttacagcct

SEQ ID NO: 20267 - DNA, 19 bp, Artificial Sequence
  Synthetic
aacagcctgctgtcgcccg

SEQ ID NO: 20268 - DNA, 20 bp, Artificial Sequence
  Synthetic
atacgcggcggcaaagaaca

SEQ ID NO: 20269 - DNA, 22 bp, Artificial Sequence
  Synthetic
cggctgttgaccaaaatctgcg

SEQ ID NO: 20270 - DNA, 18 bp, Artificial Sequence
  Synthetic
cgcgcagggtgttgcctt

SEQ ID NO: 20271 - DNA, 19 bp, Artificial Sequence
  Synthetic
tggtggacaattccgcgcc

SEQ ID NO: 20272 - DNA, 21 bp, Artificial Sequence
  Synthetic
acgtaaaacctgcaatgcgcc

SEQ ID NO: 20273 - DNA, 22 bp, Artificial Sequence
  Synthetic
gtcgccttcgatgatgacggtt

SEQ ID NO: 20274 - DNA, 20 bp, Artificial Sequence
  Synthetic
cgatggttggcaaccgtgcg

SEQ ID NO: 20275 - DNA, 21 bp, Artificial Sequence
  Synthetic
attaatacgccccagccgccc

SEQ ID NO: 20276 - DNA, 20 bp, Artificial Sequence
  Synthetic
ataggcagaatgaccgcagc

SEQ ID NO: 20277 - DNA, 20 bp, Artificial Sequence
  Synthetic
accggagtggacgaacctct

SEQ ID NO: 20278 - DNA, 18 bp, Artificial Sequence
  Synthetic
cgcaagctgtttcggcgg

SEQ ID NO: 20279 - DNA, 20 bp, Artificial Sequence
  Synthetic
cggtcgaggaggcaatccgt

SEQ ID NO: 20280 - DNA, 21 bp, Artificial Sequence
  Synthetic
gcaccttcgtcgcggatttcg

SEQ ID NO: 20281 - DNA, 19 bp, Artificial Sequence
  Synthetic
ttggtcgccgagctgccag

SEQ ID NO: 20282 - DNA, 19 bp, Artificial Sequence
  Synthetic
accatttggtcgcggtggg

SEQ ID NO: 20283 - DNA, 22 bp, Artificial Sequence
  Synthetic
cgatttgcccgtttacgccctg

SEQ ID NO: 20284 - DNA, 22 bp, Artificial Sequence
  Synthetic
acaggatggatttcgcccagcc

SEQ ID NO: 20285 - DNA, 19 bp, Artificial Sequence
  Synthetic
ggacgacttcgcgttccgc

SEQ ID NO: 20286 - DNA, 20 bp, Artificial Sequence
  Synthetic
acgagggcatgacgaccgtg

SEQ ID NO: 20287 - DNA, 22 bp, Artificial Sequence
  Synthetic
gctacggcaatcagtgtcaggt

SEQ ID NO: 20288 - DNA, 19 bp, Artificial Sequence
  Synthetic
atgccgtgcagggcttggg

SEQ ID NO: 20289 - DNA, 22 bp, Artificial Sequence
  Synthetic
cggcccattcgtcttggttgat

SEQ ID NO: 20290 - DNA, 18 bp, Artificial Sequence
  Synthetic
cgttgcgcggcagcttgt

SEQ ID NO: 20291 - DNA, 19 bp, Artificial Sequence
  Synthetic
ccgggtgcaagcagggttt

SEQ ID NO: 20292 - DNA, 23 bp, Artificial Sequence
  Synthetic
gaggcaaccggcaattattatga

SEQ ID NO: 20293 - DNA, 22 bp, Artificial Sequence
  Synthetic
cgggcgttgtgtgttttgttgt

SEQ ID NO: 20294 - DNA, 21 bp, Artificial Sequence
  Synthetic
gcaggttgtcggctttgacgt

SEQ ID NO: 20295 - DNA, 20 bp, Artificial Sequence
  Synthetic
cgtacatcacgccggtcagg

SEQ ID NO: 20296 - DNA, 19 bp, Artificial Sequence
  Synthetic
cttggcaggcttcgcagcg

SEQ ID NO: 20297 - DNA, 18 bp, Artificial Sequence
  Synthetic
aaaggcagacgcggtcgc

SEQ ID NO: 20298 - DNA, 18 bp, Artificial Sequence
  Synthetic
tgggcgcgcaagaagtcg

SEQ ID NO: 20299 - DNA, 20 bp, Artificial Sequence
  Synthetic
acgtgcagcaggcggatttg

SEQ ID NO: 20300 - DNA, 20 bp, Artificial Sequence
  Synthetic
gcggtgtggcgcaggaattg

SEQ ID NO: 20301 - DNA, 21 bp, Artificial Sequence
  Synthetic
acatcggcagcatcctcgaaa

SEQ ID NO: 20302 - DNA, 19 bp, Artificial Sequence
  Synthetic
acggtttgcaggcagtcgc

SEQ ID NO: 20303 - DNA, 20 bp, Artificial Sequence
  Synthetic
ccgatgacccagaagccgac

SEQ ID NO: 20304 - DNA, 19 bp, Artificial Sequence
  Synthetic
aactcgccttcgcctgcgg

SEQ ID NO: 20305 - DNA, 22 bp, Artificial Sequence
  Synthetic
cggggaaggaaataccgatggg

SEQ ID NO: 20306 - DNA, 19 bp, Artificial Sequence
  Synthetic
tccattttggtcggcggcg

SEQ ID NO: 20307 - DNA, 22 bp, Artificial Sequence
  Synthetic
ggcgcggatgcacttgaagaag

SEQ ID NO: 20308 - DNA, 22 bp, Artificial Sequence
  Synthetic
ccagtatttcagacggccccgc

SEQ ID NO: 20309 - DNA, 21 bp, Artificial Sequence
  Synthetic
tttggcaaaaccgggcggaac

SEQ ID NO: 20310 - DNA, 22 bp, Artificial Sequence
  Synthetic
cgggcaggttgagggtgaaatc

SEQ ID NO: 20311 - DNA, 20 bp, Artificial Sequence
  Synthetic
cctgccggattgcttgtccg

SEQ ID NO: 20312 - DNA, 18 bp, Artificial Sequence
  Synthetic
cgacttcgatgccgccgt

SEQ ID NO: 20313 - DNA, 20 bp, Artificial Sequence
  Synthetic
tgccttggaacatccccatc

SEQ ID NO: 20314 - DNA, 22 bp, Artificial Sequence
  Synthetic
ggaaaggtaaaacacgacgcgc

SEQ ID NO: 20315 - DNA, 21 bp, Artificial Sequence
  Synthetic
cccaggtcttttgcgtcgtcc

SEQ ID NO: 20316 - DNA, 22 bp, Artificial Sequence
  Synthetic
ggcgtattcgagataggcgcgt

SEQ ID NO: 20317 - DNA, 22 bp, Artificial Sequence
  Synthetic
gcgggttgagggtggaaaagaa

SEQ ID NO: 20318 - DNA, 22 bp, Artificial Sequence
  Synthetic
gcacggtcgatgtatctgaccg

SEQ ID NO: 20319 - DNA, 19 bp, Artificial Sequence
  Synthetic
cggcaaggtgttcgccgag

SEQ ID NO: 20320 - DNA, 24 bp, Artificial Sequence
  Synthetic
cgggttcttgccatcaaatttaac

SEQ ID NO: 20321 - DNA, 23 bp, Artificial Sequence
  Synthetic
agttcaaaggctacacgtcaaat

SEQ ID NO: 20322 - DNA, 20 bp, Artificial Sequence
  Synthetic
acaagtaatcccgcgtcccg

SEQ ID NO: 20323 - DNA, 25 bp, Artificial Sequence
  Synthetic
ccgtccgttctaaaatttgaccaat

SEQ ID NO: 20324 - DNA, 21 bp, Artificial Sequence
  Synthetic
ggttcgggctttcacaacgga

SEQ ID NO: 20325 - DNA, 20 bp, Artificial Sequence
  Synthetic
gacttggggcttctggctgc

SEQ ID NO: 20326 - DNA, 19 bp, Artificial Sequence
  Synthetic
tatggcaatcggcgcctgc

SEQ ID NO: 20327 - DNA, 22 bp, Artificial Sequence
  Synthetic
cggctcagggattcgacaatgt

SEQ ID NO: 20328 - DNA, 22 bp, Artificial Sequence
  Synthetic
ctcgccggacaattcattgctg

SEQ ID NO: 20329 - DNA, 20 bp, Artificial Sequence
  Synthetic
gctcgggcttttaccgcgtc

SEQ ID NO: 20330 - DNA, 22 bp, Artificial Sequence
  Synthetic
acggctttttctttgggctcgg

SEQ ID NO: 20331 - DNA, 22 bp, Artificial Sequence
  Synthetic
cggatatcgagctgcacagccg

SEQ ID NO: 20332 - DNA, 20 bp, Artificial Sequence
  Synthetic
ccaccacacgccatgtcgaa

SEQ ID NO: 20333 - DNA, 19 bp, Artificial Sequence
  Synthetic
tggttcgagggcaggctgg

SEQ ID NO: 20334 - DNA, 19 bp, Artificial Sequence
  Synthetic
tggcggcaaccttcggtac

SEQ ID NO: 20335 - DNA, 20 bp, Artificial Sequence
  Synthetic
caatccctgcgtgcttcggg

SEQ ID NO: 20336 - DNA, 22 bp, Artificial Sequence
  Synthetic
tccactgcttgccctcaacaag

SEQ ID NO: 20337 - DNA, 19 bp, Artificial Sequence
  Synthetic
tcgccagcttgcctgtccg

SEQ ID NO: 20338 - DNA, 21 bp, Artificial Sequence
  Synthetic
cccgttgcgtttcggaatgcc

SEQ ID NO: 20339 - DNA, 21 bp, Artificial Sequence
  Synthetic
gttggaagtttgacgggggct

SEQ ID NO: 20340 - DNA, 25 bp, Artificial Sequence
  Synthetic
tccgttcaattgcttatttgttcaa

SEQ ID NO: 20341 - DNA, 20 bp, Artificial Sequence
  Synthetic
ctgcctgcgggaatgtcgaa

SEQ ID NO: 20342 - DNA, 22 bp, Artificial Sequence
  Synthetic
acggacagatggatcggcattt

SEQ ID NO: 20343 - DNA, 19 bp, Artificial Sequence
  Synthetic
tatgcggcggcagggcttc

SEQ ID NO: 20344 - DNA, 18 bp, Artificial Sequence
  Synthetic
tacagttccgcgccgcac

SEQ ID NO: 20345 - DNA, 21 bp, Artificial Sequence
  Synthetic
cggcttgaccacccagaactg

SEQ ID NO: 20346 - DNA, 20 bp, Artificial Sequence
  Synthetic
attgctcaacgccgcttcga

SEQ ID NO: 20347 - DNA, 19 bp, Artificial Sequence
  Synthetic
tgctcttctcgccgacagc

SEQ ID NO: 20348 - DNA, 19 bp, Artificial Sequence
  Synthetic
ggcggtcgcttcgtccaac

SEQ ID NO: 20349 - DNA, 19 bp, Artificial Sequence
  Synthetic
cgctgtgggtgtcggtcag

SEQ ID NO: 20350 - DNA, 21 bp, Artificial Sequence
  Synthetic
ggttcgatcatcagcgtgccg

SEQ ID NO: 20351 - DNA, 19 bp, Artificial Sequence
  Synthetic
cgcgagagtacggatgcgc

SEQ ID NO: 20352 - DNA, 19 bp, Artificial Sequence
  Synthetic
agacaagggtgcggcagcc

SEQ ID NO: 20353 - DNA, 19 bp, Artificial Sequence
  Synthetic
gcgcagggacgcatcgtta

SEQ ID NO: 20354 - DNA, 20 bp, Artificial Sequence
  Synthetic
ccacacaagccatcctgccc

SEQ ID NO: 20355 - DNA, 19 bp, Artificial Sequence
  Synthetic
agcgcacacccaaacctgg

SEQ ID NO: 20356 - DNA, 20 bp, Artificial Sequence
  Synthetic
aagtcatcgacaacgcggcg

SEQ ID NO: 20357 - DNA, 20 bp, Artificial Sequence
  Synthetic
tgggcttgaaagtcgtgcgc

SEQ ID NO: 20358 - DNA, 21 bp, Artificial Sequence
  Synthetic
gcctgtaccgttgccgtcatg

SEQ ID NO: 20359 - DNA, 22 bp, Artificial Sequence
  Synthetic
gcccaagcccttatcctgcaaa

SEQ ID NO: 20360 - DNA, 19 bp, Artificial Sequence
  Synthetic
tgggacgaaacccggggct

SEQ ID NO: 20361 - DNA, 19 bp, Artificial Sequence
  Synthetic
ggcggacgcgttgaaggtg

SEQ ID NO: 20362 - DNA, 18 bp, Artificial Sequence
  Synthetic
aaggcgtggctttcggcg

SEQ ID NO: 20363 - DNA, 19 bp, Artificial Sequence
  Synthetic
agccgtgcgctatacccgc

SEQ ID NO: 20364 - DNA, 20 bp, Artificial Sequence
  Synthetic
tgaatggttgtggcagcccg

SEQ ID NO: 20365 - DNA, 20 bp, Artificial Sequence
  Synthetic
cggcttgggacattgcctcc

SEQ ID NO: 20366 - DNA, 20 bp, Artificial Sequence
  Synthetic
gcggtcggacacgtcaaact

SEQ ID NO: 20367 - DNA, 18 bp, Artificial Sequence
  Synthetic
cccggtgccgtgcagatt

SEQ ID NO: 20368 - DNA, 19 bp, Artificial Sequence
  Synthetic
agccggggcggaagtttcc

SEQ ID NO: 20369 - DNA, 21 bp, Artificial Sequence
  Synthetic
gcgcagacgttttctgacggc

SEQ ID NO: 20370 - DNA, 19 bp, Artificial Sequence
  Synthetic
gccaatatcggtgcggcgc

SEQ ID NO: 20371 - DNA, 22 bp, Artificial Sequence
  Synthetic
agcagcagctacaatgtcggac

SEQ ID NO: 20372 - DNA, 20 bp, Artificial Sequence
  Synthetic
cctcgaatggggcggacagt

SEQ ID NO: 20373 - DNA, 20 bp, Artificial Sequence
  Synthetic
cgacatccgcaccgcattgg

SEQ ID NO: 20374 - DNA, 22 bp, Artificial Sequence
  Synthetic
gaccgaagaccaaggcttcgtt

SEQ ID NO: 20375 - DNA, 21 bp, Artificial Sequence
  Synthetic
ccgaaacctatatcggggcgc

SEQ ID NO: 20376 - DNA, 20 bp, Artificial Sequence
  Synthetic
ccaaacatcccgccaaaggc

SEQ ID NO: 20377 - DNA, 21 bp, Artificial Sequence
  Synthetic
ccgcttcctcgacagcgaaag

SEQ ID NO: 20378 - DNA, 21 bp, Artificial Sequence
  Synthetic
cgacggtcggagaatgggtgg

SEQ ID NO: 20379 - DNA, 21 bp, Artificial Sequence
  Synthetic
cctggaagcaggcggtagacc

SEQ ID NO: 20380 - DNA, 20 bp, Artificial Sequence
  Synthetic
gggcaacgtcatcgaagcgg

SEQ ID NO: 20381 - DNA, 20 bp, Artificial Sequence
  Synthetic
tttggggcggcaagttcgtg

SEQ ID NO: 20382 - DNA, 21 bp, Artificial Sequence
  Synthetic
gccgctattccgacgaatggc

SEQ ID NO: 20383 - DNA, 20 bp, Artificial Sequence
  Synthetic
atgcggcaggtttgatggat

SEQ ID NO: 20384 - DNA, 21 bp, Artificial Sequence
  Synthetic
gcgttttgctggcggatgtag

SEQ ID NO: 20385 - DNA, 18 bp, Artificial Sequence
  Synthetic
tcgcgcaaaagcccggag

SEQ ID NO: 20386 - DNA, 21 bp, Artificial Sequence
  Synthetic
ccgaatacgccgacaccgacg

SEQ ID NO: 20387 - DNA, 20 bp, Artificial Sequence
  Synthetic
gggcaacataagcggcggac

SEQ ID NO: 20388 - DNA, 22 bp, Artificial Sequence
  Synthetic
cgccgtctttgcctacacccat

SEQ ID NO: 20389 - DNA, 21 bp, Artificial Sequence
  Synthetic
accacggcaggttacggattg

SEQ ID NO: 20390 - DNA, 22 bp, Artificial Sequence
  Synthetic
gttccgctgattaaggccttgc

SEQ ID NO: 20391 - DNA, 18 bp, Artificial Sequence
  Synthetic
ccgaaccgtgcctgctgt

SEQ ID NO: 20392 - DNA, 19 bp, Artificial Sequence
  Synthetic
cgccgaagaacagtccggt

SEQ ID NO: 20393 - DNA, 20 bp, Artificial Sequence
  Synthetic
tggcaatgctgtcttcgcgg

SEQ ID NO: 20394 - DNA, 19 bp, Artificial Sequence
  Synthetic
ttgtccgcacgaaccgccg

SEQ ID NO: 20395 - DNA, 18 bp, Artificial Sequence
  Synthetic
gcgcgctttggcaaacga

SEQ ID NO: 20396 - DNA, 18 bp, Artificial Sequence
  Synthetic
tgcccgcgccgattttgg

SEQ ID NO: 20397 - DNA, 22 bp, Artificial Sequence
  Synthetic
acagataacctgcggcggcaaa

SEQ ID NO: 20398 - DNA, 19 bp, Artificial Sequence
  Synthetic
gccttgccgaacgcgaacg

SEQ ID NO: 20399 - DNA, 20 bp, Artificial Sequence
  Synthetic
cgtgttgcacagccggatgg

SEQ ID NO: 20400 - DNA, 19 bp, Artificial Sequence
  Synthetic
agcagcgcgtctccatcgc

SEQ ID NO: 20401 - DNA, 21 bp, Artificial Sequence
  Synthetic
cgtcgtcgccgtagacatcaa

SEQ ID NO: 20402 - DNA, 22 bp, Artificial Sequence
  Synthetic
cccttctgccttctggacgaag

SEQ ID NO: 20403 - DNA, 22 bp, Artificial Sequence
  Synthetic
ccctgatcaacgccaaacgcta

SEQ ID NO: 20404 - DNA, 19 bp, Artificial Sequence
  Synthetic
tggcggaagagcagaccgt

SEQ ID NO: 20405 - DNA, 21 bp, Artificial Sequence
  Synthetic
gcaggcggcatggctttcaga

SEQ ID NO: 20406 - DNA, 20 bp, Artificial Sequence
  Synthetic
agcaggaagccgccgacttt

SEQ ID NO: 20407 - DNA, 19 bp, Artificial Sequence
  Synthetic
cgaggcaaaccgcatccgc

SEQ ID NO: 20408 - DNA, 20 bp, Artificial Sequence
  Synthetic
ggcaaaactgcccgccacat

SEQ ID NO: 20409 - DNA, 22 bp, Artificial Sequence
  Synthetic
ggcgatttgctgctgaatcgga

SEQ ID NO: 20410 - DNA, 22 bp, Artificial Sequence
  Synthetic
gccttcttcgacttggctgtcg

SEQ ID NO: 20411 - DNA, 20 bp, Artificial Sequence
  Synthetic
tgctctacctggccgggttt

SEQ ID NO: 20412 - DNA, 22 bp, Artificial Sequence
  Synthetic
cacttgcccgcttttttgcagc

SEQ ID NO: 20413 - DNA, 22 bp, Artificial Sequence
  Synthetic
gatgttttcggggaacacggct

SEQ ID NO: 20414 - DNA, 19 bp, Artificial Sequence
  Synthetic
cggtcatcagggcggtgtc

SEQ ID NO: 20415 - DNA, 21 bp, Artificial Sequence
  Synthetic
gtaggtctcggtgtcatcgcc

SEQ ID NO: 20416 - DNA, 20 bp, Artificial Sequence
  Synthetic
acgtgattgccgaacagggc

SEQ ID NO: 20417 - DNA, 20 bp, Artificial Sequence
  Synthetic
aaagcaggtgccaaccgctt

SEQ ID NO: 20418 - DNA, 18 bp, Artificial Sequence
  Synthetic
acgccaccgacaccacca

SEQ ID NO: 20419 - DNA, 21 bp, Artificial Sequence
  Synthetic
ccgccgcgaaaaactggaaac

SEQ ID NO: 20420 - DNA, 21 bp, Artificial Sequence
  Synthetic
cggcgtatcgctcaaaatgcc

SEQ ID NO: 20421 - DNA, 18 bp, Artificial Sequence
  Synthetic
tgccgccgcattgctgac

SEQ ID NO: 20422 - DNA, 19 bp, Artificial Sequence
  Synthetic
caaaccgaaagcgcgggcc

SEQ ID NO: 20423 - DNA, 20 bp, Artificial Sequence
  Synthetic
ggcacaccaaaaatcatggc

SEQ ID NO: 20424 - DNA, 22 bp, Artificial Sequence
  Synthetic
gctgctgattatctgccgtaaa

SEQ ID NO: 20425 - DNA, 21 bp, Artificial Sequence
  Synthetic
cggtgtgccattggtagattt

SEQ ID NO: 20426 - DNA, 23 bp, Artificial Sequence
  Synthetic
gtcccacaattcaaaaccgtctt

SEQ ID NO: 20427 - DNA, 25 bp, Artificial Sequence
  Synthetic
ggctgtttttcaggttgcttaattt

SEQ ID NO: 20428 - DNA, 21 bp, Artificial Sequence
  Synthetic
tttgagcttgtcagcagccga

SEQ ID NO: 20429 - DNA, 23 bp, Artificial Sequence
  Synthetic
tgccaaacaccgacataatcatc

SEQ ID NO: 20430 - DNA, 25 bp, Artificial Sequence
  Synthetic
cgcttgtttacgagttttcaaacaa

SEQ ID NO: 20431 - DNA, 20 bp, Artificial Sequence
  Synthetic
gccctgccacaaacagattt

SEQ ID NO: 20432 - DNA, 24 bp, Artificial Sequence
  Synthetic
gtggcaatgaatggaatattgtcc

SEQ ID NO: 20433 - DNA, 21 bp, Artificial Sequence
  Synthetic
agactgttcccgataactcgc

SEQ ID NO: 20434 - DNA, 25 bp, Artificial Sequence
  Synthetic
gccttaatccaacaaaaaatgacga

SEQ ID NO: 20435 - DNA, 21 bp, Artificial Sequence
  Synthetic
agcgcgttattgttcaacagc

SEQ ID NO: 20436 - DNA, 22 bp, Artificial Sequence
  Synthetic
gtcggtgtgattgccgccatta

SEQ ID NO: 20437 - DNA, 19 bp, Artificial Sequence
  Synthetic
tatcgacctgcgccgccct

SEQ ID NO: 20438 - DNA, 24 bp, Artificial Sequence
  Synthetic
cagaaatcggttattgacgaagtg

SEQ ID NO: 20439 - DNA, 18 bp, Artificial Sequence
  Synthetic
tgcggtgatgtcggcagg

SEQ ID NO: 20440 - DNA, 19 bp, Artificial Sequence
  Synthetic
ggcgcgtaccgttttggca

SEQ ID NO: 20441 - DNA, 19 bp, Artificial Sequence
  Synthetic
gcgtcggcgtggatggaga

SEQ ID NO: 20442 - DNA, 22 bp, Artificial Sequence
  Synthetic
gcttctcttcggcaggattgga

SEQ ID NO: 20443 - DNA, 19 bp, Artificial Sequence
  Synthetic
aggtcgaggcgggcgaaac

SEQ ID NO: 20444 - DNA, 19 bp, Artificial Sequence
  Synthetic
cgacgcattgggcaagccc

SEQ ID NO: 20445 - DNA, 22 bp, Artificial Sequence
  Synthetic
acgccgaacaaatcaggcagtt

SEQ ID NO: 20446 - DNA, 19 bp, Artificial Sequence
  Synthetic
atggatgggcggatggcgg

SEQ ID NO: 20447 - DNA, 22 bp, Artificial Sequence
  Synthetic
gcggcaatcaagcatttcggac

SEQ ID NO: 20448 - DNA, 19 bp, Artificial Sequence
  Synthetic
tgcccccgttttggctgcc

SEQ ID NO: 20449 - DNA, 22 bp, Artificial Sequence
  Synthetic
cgcaccggcattcacatctgtt

SEQ ID NO: 20450 - DNA, 22 bp, Artificial Sequence
  Synthetic
tcttgatgggcgtcttgcgtat

SEQ ID NO: 20451 - DNA, 21 bp, Artificial Sequence
  Synthetic
cggggaatcagaagcggtagc

SEQ ID NO: 20452 - DNA, 18 bp, Artificial Sequence
  Synthetic
acgcggggtttgggcaac

SEQ ID NO: 20453 - DNA, 20 bp, Artificial Sequence
  Synthetic
cccaaagccgttcccgttgc

SEQ ID NO: 20454 - DNA, 22 bp, Artificial Sequence
  Synthetic
acacgccgtcgatttggtgatt

SEQ ID NO: 20455 - DNA, 19 bp, Artificial Sequence
  Synthetic
tttcccggcctgcccaacg

SEQ ID NO: 20456 - DNA, 20 bp, Artificial Sequence
  Synthetic
gaagtgcgcttcgggcatcc

SEQ ID NO: 20457 - DNA, 20 bp, Artificial Sequence
  Synthetic
ccgattacaccgcctccagc

SEQ ID NO: 20458 - DNA, 18 bp, Artificial Sequence
  Synthetic
tgcgtccgccggcgattt

SEQ ID NO: 20459 - DNA, 22 bp, Artificial Sequence
  Synthetic
ccaaatgcctgacggtgcagtg

SEQ ID NO: 20460 - DNA, 21 bp, Artificial Sequence
  Synthetic
tcgaatttttcggcgagggcg

SEQ ID NO: 20461 - DNA, 20 bp, Artificial Sequence
  Synthetic
gcggtttggaagcggaaacc

SEQ ID NO: 20462 - DNA, 22 bp, Artificial Sequence
  Synthetic
cccgatacggttgaggtcgtcc

SEQ ID NO: 20463 - DNA, 22 bp, Artificial Sequence
  Synthetic
gcgacatcaagttgccaaacgg

SEQ ID NO: 20464 - DNA, 19 bp, Artificial Sequence
  Synthetic
tcgggcgcggagagtggtt

SEQ ID NO: 20465 - DNA, 18 bp, Artificial Sequence
  Synthetic
gatgcgccgcaaatccgc

SEQ ID NO: 20466 - DNA, 16 bp, Artificial Sequence
  Synthetic
aaaacggcgggcgcgt

SEQ ID NO: 20467 - DNA, 21 bp, Artificial Sequence
  Synthetic
ccgcaaacccacctcgtcaaa

SEQ ID NO: 20468 - DNA, 22 bp, Artificial Sequence
  Synthetic
tgagtttgaacgatgtggcgga

SEQ ID NO: 20469 - DNA, 22 bp, Artificial Sequence
  Synthetic
gggcgcggataaagtcgtcgta

SEQ ID NO: 20470 - DNA, 20 bp, Artificial Sequence
  Synthetic
ccgtcaacaaggcgcaacag

SEQ ID NO: 20471 - DNA, 18 bp, Artificial Sequence
  Synthetic
agcgaacagcggcgcaac

SEQ ID NO: 20472 - DNA, 21 bp, Artificial Sequence
  Synthetic
gcacacgtcatcggatttacc

SEQ ID NO: 20473 - DNA, 22 bp, Artificial Sequence
  Synthetic
gcgcacacgaattaagcatcga

SEQ ID NO: 20474 - DNA, 21 bp, Artificial Sequence
  Synthetic
tgaagaaaaggcgggcgagcc

SEQ ID NO: 20475 - DNA, 22 bp, Artificial Sequence
  Synthetic
tgccgtctgaaacacattaagg

SEQ ID NO: 20476 - DNA, 22 bp, Artificial Sequence
  Synthetic
ccgttttggaacgcgtcatcgc

SEQ ID NO: 20477 - DNA, 21 bp, Artificial Sequence
  Synthetic
cggaaatgccgttgccttcgt

SEQ ID NO: 20478 - DNA, 19 bp, Artificial Sequence
  Synthetic
tcgcgcacttcggcaatgg

SEQ ID NO: 20479 - DNA, 21 bp, Artificial Sequence
  Synthetic
ggtttgttcggcaggtttggc

SEQ ID NO: 20480 - DNA, 19 bp, Artificial Sequence
  Synthetic
gttgatcaggcgcgccact

SEQ ID NO: 20481 - DNA, 20 bp, Artificial Sequence
  Synthetic
ccgagtaggaagccagcggg

SEQ ID NO: 20482 - DNA, 21 bp, Artificial Sequence
  Synthetic
tccccagttgtggtagcggta

SEQ ID NO: 20483 - DNA, 19 bp, Artificial Sequence
  Synthetic
tgccgctgtgggtcagtgc

SEQ ID NO: 20484 - DNA, 20 bp, Artificial Sequence
  Synthetic
gctgccggtggcgaaggtaa

SEQ ID NO: 20485 - DNA, 22 bp, Artificial Sequence
  Synthetic
cctcgcctttcagacgatggat

SEQ ID NO: 20486 - DNA, 20 bp, Artificial Sequence
  Synthetic
ggcggcttcgtcgcacaaac

SEQ ID NO: 20487 - DNA, 19 bp, Artificial Sequence
  Synthetic
tgccgacggacgaacgctg

SEQ ID NO: 20488 - DNA, 19 bp, Artificial Sequence
  Synthetic
cgcacgcgaacagggcttg

SEQ ID NO: 20489 - DNA, 18 bp, Artificial Sequence
  Synthetic
attgccgccgcccaacaa

SEQ ID NO: 20490 - DNA, 21 bp, Artificial Sequence
  Synthetic
tgtttgtgctggcgtttgtgc

SEQ ID NO: 20491 - DNA, 22 bp, Artificial Sequence
  Synthetic
gaacaaaagctgctccgtcccg

SEQ ID NO: 20492 - DNA, 22 bp, Artificial Sequence
  Synthetic
tctcaatctgcaggtgctgaaa

SEQ ID NO: 20493 - DNA, 20 bp, Artificial Sequence
  Synthetic
gtctgtgcctgtgtcctgca

SEQ ID NO: 20494 - DNA, 20 bp, Artificial Sequence
  Synthetic
ggcaatcccgccgatgttca

SEQ ID NO: 20495 - DNA, 19 bp, Artificial Sequence
  Synthetic
cggagagcgcgtcggattt

SEQ ID NO: 20496 - DNA, 22 bp, Artificial Sequence
  Synthetic
cacagtttcggcaaggctttcc

SEQ ID NO: 20497 - DNA, 20 bp, Artificial Sequence
  Synthetic
cgtattgaccgcaccggcag

SEQ ID NO: 20498 - DNA, 19 bp, Artificial Sequence
  Synthetic
ctgggtgtcggctacctgc

SEQ ID NO: 20499 - DNA, 19 bp, Artificial Sequence
  Synthetic
gcaaccatggcctcgaccg

SEQ ID NO: 20500 - DNA, 22 bp, Artificial Sequence
  Synthetic
ggcaggcactttaatcatggcg

SEQ ID NO: 20501 - DNA, 22 bp, Artificial Sequence
  Synthetic
ggcgacaacttggatatgggca

SEQ ID NO: 20502 - DNA, 20 bp, Artificial Sequence
  Synthetic
aaaagctgcacgcggtttgc

SEQ ID NO: 20503 - DNA, 22 bp, Artificial Sequence
  Synthetic
cgggcgaggttttgggtgtaac

SEQ ID NO: 20504 - DNA, 20 bp, Artificial Sequence
  Synthetic
cgcccaaacactgctgcaaa

SEQ ID NO: 20505 - DNA, 22 bp, Artificial Sequence
  Synthetic
ttggtgcaacgcctctacacat

SEQ ID NO: 20506 - DNA, 22 bp, Artificial Sequence
  Synthetic
acggctacaacgaggtcaacct

SEQ ID NO: 20507 - DNA, 20 bp, Artificial Sequence
  Synthetic
ccgacggataagcgacgtgc

SEQ ID NO: 20508 - DNA, 21 bp, Artificial Sequence
  Synthetic
tatgcgggctttttccacgcc

SEQ ID NO: 20509 - DNA, 19 bp, Artificial Sequence
  Synthetic
tggacgcttggcaaccggc

SEQ ID NO: 20510 - DNA, 21 bp, Artificial Sequence
  Synthetic
gcgaatgtctgccatgttcgg

SEQ ID NO: 20511 - DNA, 19 bp, Artificial Sequence
  Synthetic
cgctcctgaccgccctgtt

SEQ ID NO: 20512 - DNA, 22 bp, Artificial Sequence
  Synthetic
gtacaagtaatcccgcgtcccg

SEQ ID NO: 20513 - DNA, 19 bp, Artificial Sequence
  Synthetic
ccgacaaacaggccgcacc

SEQ ID NO: 20514 - DNA, 19 bp, Artificial Sequence
  Synthetic
agggccgcaccaaatcggc

SEQ ID NO: 20515 - DNA, 23 bp, Artificial Sequence
  Synthetic
gccattaaaagaccagggcattc

SEQ ID NO: 20516 - DNA, 22 bp, Artificial Sequence
  Synthetic
tgctgattgtcgtattcggcgg

SEQ ID NO: 20517 - DNA, 20 bp, Artificial Sequence
  Synthetic
agtcgcgcatgtgcctgaaa

SEQ ID NO: 20518 - DNA, 22 bp, Artificial Sequence
  Synthetic
ggaagaaacggcaatgacggct

SEQ ID NO: 20519 - DNA, 21 bp, Artificial Sequence
  Synthetic
gtggacgatgcctacgaagcc

SEQ ID NO: 20520 - DNA, 21 bp, Artificial Sequence
  Synthetic
tgccgcaactgccacttcaaa

SEQ ID NO: 20521 - DNA, 20 bp, Artificial Sequence
  Synthetic
caggttcggtcgtcgtgtcc

SEQ ID NO: 20522 - DNA, 22 bp, Artificial Sequence
  Synthetic
gccgcacccaccatcattgaag

SEQ ID NO: 20523 - DNA, 19 bp, Artificial Sequence
  Synthetic
ggtgggcggacgctattcc

SEQ ID NO: 20524 - DNA, 20 bp, Artificial Sequence
  Synthetic
cgctgcatacggctttgcgc

SEQ ID NO: 20525 - DNA, 19 bp, Artificial Sequence
  Synthetic
ccgattccgccggtcagtc

SEQ ID NO: 20526 - DNA, 24 bp, Artificial Sequence
  Synthetic
ccgcgtacatactcaactccataa

SEQ ID NO: 20527 - DNA, 20 bp, Artificial Sequence
  Synthetic
cccgaggttgaagccgtgtg

SEQ ID NO: 20528 - DNA, 19 bp, Artificial Sequence
  Synthetic
gcacacatggcggctgcac

SEQ ID NO: 20529 - DNA, 21 bp, Artificial Sequence
  Synthetic
cgaaaagcgtgccgccttgtg

SEQ ID NO: 20530 - DNA, 21 bp, Artificial Sequence
  Synthetic
gcgttcttcccactgctgcaa

SEQ ID NO: 20531 - DNA, 25 bp, Artificial Sequence
  Synthetic
gcttgaaaaaacgtgttttaaggga

SEQ ID NO: 20532 - DNA, 22 bp, Artificial Sequence
  Synthetic
cggaaaaaatgtcggggatggc

SEQ ID NO: 20533 - DNA, 20 bp, Artificial Sequence
  Synthetic
cctgtccggcatccagacag

SEQ ID NO: 20534 - DNA, 22 bp, Artificial Sequence
  Synthetic
cgcatcatcagcgtgttgtcgg

SEQ ID NO: 20535 - DNA, 22 bp, Artificial Sequence
  Synthetic
ggcagaaaaaatccgcgctcaa

SEQ ID NO: 20536 - DNA, 19 bp, Artificial Sequence
  Synthetic
cgaagtcagcaccgcgcct

SEQ ID NO: 20537 - DNA, 19 bp, Artificial Sequence
  Synthetic
gccattcgatgacggcggc

SEQ ID NO: 20538 - DNA, 19 bp, Artificial Sequence
  Synthetic
ttgccgccgcgttgttcta

SEQ ID NO: 20539 - DNA, 20 bp, Artificial Sequence
  Synthetic
tttgagtgccgacgagaacc

SEQ ID NO: 20540 - DNA, 22 bp, Artificial Sequence
  Synthetic
gccgccgatttggatgtcactt

SEQ ID NO: 20541 - DNA, 22 bp, Artificial Sequence
  Synthetic
cgtcatcctgcccaaacttgcc

SEQ ID NO: 20542 - DNA, 21 bp, Artificial Sequence
  Synthetic
tcggtagggctgaacattgcc

SEQ ID NO: 20543 - DNA, 21 bp, Artificial Sequence
  Synthetic
gctcaaacccggacaggtcgg

SEQ ID NO: 20544 - DNA, 20 bp, Artificial Sequence
  Synthetic
cggcgcggaaagtaccatcc

SEQ ID NO: 20545 - DNA, 22 bp, Artificial Sequence
  Synthetic
cattgccgaaaaagtccgccag

SEQ ID NO: 20546 - DNA, 19 bp, Artificial Sequence
  Synthetic
gtcaaagctgccgccacgg

SEQ ID NO: 20547 - DNA, 18 bp, Artificial Sequence
  Synthetic
accgaacaaggcggacgg

SEQ ID NO: 20548 - DNA, 19 bp, Artificial Sequence
  Synthetic
accctcggttcgacctgcc

SEQ ID NO: 20549 - DNA, 20 bp, Artificial Sequence
  Synthetic
tttgcaccctgcggcaaatg

SEQ ID NO: 20550 - DNA, 22 bp, Artificial Sequence
  Synthetic
cggtgtttgccgcgtatcgaat

SEQ ID NO: 20551 - DNA, 22 bp, Artificial Sequence
  Synthetic
gctttcgtcggagaggacggta

SEQ ID NO: 20552 - DNA, 21 bp, Artificial Sequence
  Synthetic
gctccctgcttagcggaacgg

SEQ ID NO: 20553 - DNA, 19 bp, Artificial Sequence
  Synthetic
gcgtttccggcccgaacag

SEQ ID NO: 20554 - DNA, 19 bp, Artificial Sequence
  Synthetic
gggcggcggtaaaggcgtt

SEQ ID NO: 20555 - DNA, 19 bp, Artificial Sequence
  Synthetic
tcttctgcaaccgcccgcg

SEQ ID NO: 20556 - DNA, 19 bp, Artificial Sequence
  Synthetic
ccattgccgccagttccca

SEQ ID NO: 20557 - DNA, 18 bp, Artificial Sequence
  Synthetic
tttgggcgcgcaccgtaa

SEQ ID NO: 20558 - DNA, 20 bp, Artificial Sequence
  Synthetic
ctgccactcgacgtgttcgc

SEQ ID NO: 20559 - DNA, 22 bp, Artificial Sequence
  Synthetic
cgttttttgcgggtgctggctt

SEQ ID NO: 20560 - DNA, 18 bp, Artificial Sequence
  Synthetic
agctggcggcaggtttcg

SEQ ID NO: 20561 - DNA, 22 bp, Artificial Sequence
  Synthetic
cgccattacctacgcgctgatg

SEQ ID NO: 20562 - DNA, 19 bp, Artificial Sequence
  Synthetic
gcattacggcgcgttggca

SEQ ID NO: 20563 - DNA, 20 bp, Artificial Sequence
  Synthetic
atcggcacaattcccgctgc

SEQ ID NO: 20564 - DNA, 20 bp, Artificial Sequence
  Synthetic
gacggaaggggagggcaaag

SEQ ID NO: 20565 - DNA, 22 bp, Artificial Sequence
  Synthetic
agcgcgatgatttggatgctga

SEQ ID NO: 20566 - DNA, 20 bp, Artificial Sequence
  Synthetic
aggggagggcgttcagacgg

SEQ ID NO: 20567 - DNA, 19 bp, Artificial Sequence
  Synthetic
tttccgcacacgcccagcc

SEQ ID NO: 20568 - DNA, 21 bp, Artificial Sequence
  Synthetic
ccgtgcgcgaaaaaagcaacc

SEQ ID NO: 20569 - DNA, 19 bp, Artificial Sequence
  Synthetic
agtccggatgccaagccgc

SEQ ID NO: 20570 - DNA, 18 bp, Artificial Sequence
  Synthetic
gtgtgggcggcgttgttg

SEQ ID NO: 20571 - DNA, 22 bp, Artificial Sequence
  Synthetic
tgtgtaatcacgatgccgccga

SEQ ID NO: 20572 - DNA, 20 bp, Artificial Sequence
  Synthetic
gcgggattggtttcggtggg

SEQ ID NO: 20573 - DNA, 20 bp, Artificial Sequence
  Synthetic
gcatattggtgcgcggatcg

SEQ ID NO: 20574 - DNA, 20 bp, Artificial Sequence
  Synthetic
gcttcggtctcggaagcagg

SEQ ID NO: 20575 - DNA, 20 bp, Artificial Sequence
  Synthetic
gtcccaaaactggctgccca

SEQ ID NO: 20576 - DNA, 21 bp, Artificial Sequence
  Synthetic
caagaaatcctcgccgtcggc

SEQ ID NO: 20577 - DNA, 18 bp, Artificial Sequence
  Synthetic
tccacgaaaccggccacg

SEQ ID NO: 20578 - DNA, 19 bp, Artificial Sequence
  Synthetic
ggcatcaccgaacgcgtcg

SEQ ID NO: 20579 - DNA, 22 bp, Artificial Sequence
  Synthetic
ccgccggagattttgtagctgt

SEQ ID NO: 20580 - DNA, 20 bp, Artificial Sequence
  Synthetic
cgttggtcggggcggtaacg

SEQ ID NO: 20581 - DNA, 19 bp, Artificial Sequence
  Synthetic
acgccgacttcgccctgac

SEQ ID NO: 20582 - DNA, 18 bp, Artificial Sequence
  Synthetic
gggctttttcggcggcga

SEQ ID NO: 20583 - DNA, 21 bp, Artificial Sequence
  Synthetic
gcttccgatggcggcttacgg

SEQ ID NO: 20584 - DNA, 19 bp, Artificial Sequence
  Synthetic
agacggagttggggcagcc

SEQ ID NO: 20585 - DNA, 21 bp, Artificial Sequence
  Synthetic
tgcgttcgttgcgtttgaggt

SEQ ID NO: 20586 - DNA, 21 bp, Artificial Sequence
  Synthetic
cggaagttgtcgcgcattgtg

SEQ ID NO: 20587 - DNA, 21 bp, Artificial Sequence
  Synthetic
ggtcatccgatggcacagctt

SEQ ID NO: 20588 - DNA, 19 bp, Artificial Sequence
  Synthetic
cgcgtgcgtttgaggtggt

SEQ ID NO: 20589 - DNA, 21 bp, Artificial Sequence
  Synthetic
ccaaagcgggtttcaggcgtt

SEQ ID NO: 20590 - DNA, 21 bp, Artificial Sequence
  Synthetic
caggaaggtggcgacatcgac

SEQ ID NO: 20591 - DNA, 17 bp, Artificial Sequence
  Synthetic
tcgttgcggctgccgtt

SEQ ID NO: 20592 - DNA, 20 bp, Artificial Sequence
  Synthetic
agcggatcggcaatgctgac

SEQ ID NO: 20593 - DNA, 19 bp, Artificial Sequence
  Synthetic
ttcccgtgcctgttccgcc

SEQ ID NO: 20594 - DNA, 19 bp, Artificial Sequence
  Synthetic
accgcgctcgatttggcgg

SEQ ID NO: 20595 - DNA, 22 bp, Artificial Sequence
  Synthetic
ccgatgtggattttgccggaca

SEQ ID NO: 20596 - DNA, 22 bp, Artificial Sequence
  Synthetic
cggcgtaacaaatcgtgcaggt

SEQ ID NO: 20597 - DNA, 18 bp, Artificial Sequence
  Synthetic
acgctgtgctgggtgcga

SEQ ID NO: 20598 - DNA, 22 bp, Artificial Sequence
  Synthetic
gacggtaaatttggcggcttcg

SEQ ID NO: 20599 - DNA, 20 bp, Artificial Sequence
  Synthetic
gcgccgatgaggacgttcat

SEQ ID NO: 20600 - DNA, 22 bp, Artificial Sequence
  Synthetic
gaccatgcgtgcgttgatttgg

SEQ ID NO: 20601 - DNA, 19 bp, Artificial Sequence
  Synthetic
gccggatttcgctgccgtt

SEQ ID NO: 20602 - DNA, 22 bp, Artificial Sequence
  Synthetic
cgcatattggtgctgagccaga

SEQ ID NO: 20603 - DNA, 21 bp, Artificial Sequence
  Synthetic
cgcggatggctttctcgactt

SEQ ID NO: 20604 - DNA, 19 bp, Artificial Sequence
  Synthetic
tgccgctgaaatacgcgca

SEQ ID NO: 20605 - DNA, 22 bp, Artificial Sequence
  Synthetic
cgactttgacgggcaggtagtt

SEQ ID NO: 20606 - DNA, 20 bp, Artificial Sequence
  Synthetic
cgatgtgtccgaccgtaccg

SEQ ID NO: 20607 - DNA, 19 bp, Artificial Sequence
  Synthetic
accactgcagtcgccacgc

SEQ ID NO: 20608 - DNA, 21 bp, Artificial Sequence
  Synthetic
tcgtgaaatactcgcgcgtcc

SEQ ID NO: 20609 - DNA, 19 bp, Artificial Sequence
  Synthetic
gtttcggggaaacgggcga

SEQ ID NO: 20610 - DNA, 25 bp, Artificial Sequence
  Synthetic
gctactcgtgctaaattgatttgtg

SEQ ID NO: 20611 - DNA, 23 bp, Artificial Sequence
  Synthetic
ggagttaaccatggctgaacaaa

SEQ ID NO: 20612 - DNA, 20 bp, Artificial Sequence
  Synthetic
agctgctgttcggtgttcaa

SEQ ID NO: 20613 - DNA, 25 bp, Artificial Sequence
  Synthetic
gcaaacagatttaaggcaaaacaac

SEQ ID NO: 20614 - DNA, 19 bp, Artificial Sequence
  Synthetic
aaagcctcgccctcctgcc

SEQ ID NO: 20615 - DNA, 20 bp, Artificial Sequence
  Synthetic
cggttacctgacccgtcgtc

SEQ ID NO: 20616 - DNA, 21 bp, Artificial Sequence
  Synthetic
caacctctgggcggtaaagct

SEQ ID NO: 20617 - DNA, 22 bp, Artificial Sequence
  Synthetic
cgataccgatgccgtctgaacc

SEQ ID NO: 20618 - DNA, 19 bp, Artificial Sequence
  Synthetic
ggcagaaatggggcgcgaa

SEQ ID NO: 20619 - DNA, 22 bp, Artificial Sequence
  Synthetic
cgtgcgggttcgactttaacct

SEQ ID NO: 20620 - DNA, 20 bp, Artificial Sequence
  Synthetic
gcaaaaagaagccgcgtggg

SEQ ID NO: 20621 - DNA, 20 bp, Artificial Sequence
  Synthetic
ccagcggctgtatcgaacgg

SEQ ID NO: 20622 - DNA, 19 bp, Artificial Sequence
  Synthetic
tgtgggagtgggcgaacgc

SEQ ID NO: 20623 - DNA, 21 bp, Artificial Sequence
  Synthetic
ggcggtttcggcggaacacat

SEQ ID NO: 20624 - DNA, 19 bp, Artificial Sequence
  Synthetic
gtcgtggtcggtgctggtt

SEQ ID NO: 20625 - DNA, 18 bp, Artificial Sequence
  Synthetic
gcgcgcggtcgttgatgt

SEQ ID NO: 20626 - DNA, 25 bp, Artificial Sequence
  Synthetic
gctttctgttgaaatggagtctgat

SEQ ID NO: 20627 - DNA, 18 bp, Artificial Sequence
  Synthetic
acgtggtgaaagccggcg

SEQ ID NO: 20628 - DNA, 19 bp, Artificial Sequence
  Synthetic
atccatcggcgtggggcag

SEQ ID NO: 20629 - DNA, 20 bp, Artificial Sequence
  Synthetic
ggaatgcccgaaagcagcct

SEQ ID NO: 20630 - DNA, 20 bp, Artificial Sequence
  Synthetic
ggctggacgatacgcagctg

SEQ ID NO: 20631 - DNA, 22 bp, Artificial Sequence
  Synthetic
tgcgatgaagctgtggaaggaa

SEQ ID NO: 20632 - DNA, 21 bp, Artificial Sequence
  Synthetic
cgaccttggacggcaaagtca

SEQ ID NO: 20633 - DNA, 20 bp, Artificial Sequence
  Synthetic
aaagcccttccttcgacagc

SEQ ID NO: 20634 - DNA, 19 bp, Artificial Sequence
  Synthetic
cagccgttacctcggggga

SEQ ID NO: 20635 - DNA, 22 bp, Artificial Sequence
  Synthetic
tccacgatacggtcgacggttt

SEQ ID NO: 20636 - DNA, 21 bp, Artificial Sequence
  Synthetic
ccatactttccctgctgcgga

SEQ ID NO: 20637 - DNA, 19 bp, Artificial Sequence
  Synthetic
gggttcgcctagctgccag

SEQ ID NO: 20638 - DNA, 21 bp, Artificial Sequence
  Synthetic
aggatgatggcggtgctgtac

SEQ ID NO: 20639 - DNA, 19 bp, Artificial Sequence
  Synthetic
ggtggcggatgtcgggact

SEQ ID NO: 20640 - DNA, 21 bp, Artificial Sequence
  Synthetic
acgcctgattcgaggttcagc

SEQ ID NO: 20641 - DNA, 19 bp, Artificial Sequence
  Synthetic
agtacggtgccggcgatgc

SEQ ID NO: 20642 - DNA, 21 bp, Artificial Sequence
  Synthetic
ggagatgtagccggtcagggc

SEQ ID NO: 20643 - DNA, 19 bp, Artificial Sequence
  Synthetic
tgcggagggtgccgagttc

SEQ ID NO: 20644 - DNA, 19 bp, Artificial Sequence
  Synthetic
ttccctttgagccggggcg

SEQ ID NO: 20645 - DNA, 22 bp, Artificial Sequence
  Synthetic
cgcgctgttctttgaacgacga

SEQ ID NO: 20646 - DNA, 20 bp, Artificial Sequence
  Synthetic
atcaatacgccggcgcaggc

SEQ ID NO: 20647 - DNA, 21 bp, Artificial Sequence
  Synthetic
ggcaacgtcggcgatgtcttt

SEQ ID NO: 20648 - DNA, 21 bp, Artificial Sequence
  Synthetic
cttcggcacactgcttaccct

SEQ ID NO: 20649 - DNA, 22 bp, Artificial Sequence
  Synthetic
ggcttcgttggggatggagatt

SEQ ID NO: 20650 - DNA, 20 bp, Artificial Sequence
  Synthetic
tttccccgaaaccctgccag

SEQ ID NO: 20651 - DNA, 19 bp, Artificial Sequence
  Synthetic
aagtcggcgcgggcaaagg

SEQ ID NO: 20652 - DNA, 20 bp, Artificial Sequence
  Synthetic
tccacaggtttgttcaagcc

SEQ ID NO: 20653 - DNA, 20 bp, Artificial Sequence
  Synthetic
tctgcaatctgttccgcacg

SEQ ID NO: 20654 - DNA, 21 bp, Artificial Sequence
  Synthetic
gcctgttttaatcggatcggt

SEQ ID NO: 20655 - DNA, 25 bp, Artificial Sequence
  Synthetic
cctttttttcaaatgcgccaactta

SEQ ID NO: 20656 - DNA, 20 bp, Artificial Sequence
  Synthetic
ccgtcggcatcaccctcatc

SEQ ID NO: 20657 - DNA, 21 bp, Artificial Sequence
  Synthetic
gcgcggtgttcgacaaatacc

SEQ ID NO: 20658 - DNA, 20 bp, Artificial Sequence
  Synthetic
agcctcccttcccgacttgg

SEQ ID NO: 20659 - DNA, 21 bp, Artificial Sequence
  Synthetic
cgggcaggctttgggtttgaa

SEQ ID NO: 20660 - DNA, 19 bp, Artificial Sequence
  Synthetic
tcaagggcggccgcctttc

SEQ ID NO: 20661 - DNA, 22 bp, Artificial Sequence
  Synthetic
agctgtttaaagaccgcctgct

SEQ ID NO: 20662 - DNA, 20 bp, Artificial Sequence
  Synthetic
aaatcccgtcctggttcggc

SEQ ID NO: 20663 - DNA, 22 bp, Artificial Sequence
  Synthetic
cgcgcaggttatttcttcacgc

SEQ ID NO: 20664 - DNA, 21 bp, Artificial Sequence
  Synthetic
cccggctcggatgtcgatttg

SEQ ID NO: 20665 - DNA, 19 bp, Artificial Sequence
  Synthetic
tttcggcagcaccccttcc

SEQ ID NO: 20666 - DNA, 23 bp, Artificial Sequence
  Synthetic
tgatggagcacctactagtatgg

SEQ ID NO: 20667 - DNA, 19 bp, Artificial Sequence
  Synthetic
caaaccgcctcgcgcaaac

SEQ ID NO: 20668 - DNA, 21 bp, Artificial Sequence
  Synthetic
ccagcaggttgccgaaaatgc

SEQ ID NO: 20669 - DNA, 20 bp, Artificial Sequence
  Synthetic
cccaacccgaacaccaccac

SEQ ID NO: 20670 - DNA, 22 bp, Artificial Sequence
  Synthetic
tgcgccaaaacaaccaaaccaa

SEQ ID NO: 20671 - DNA, 19 bp, Artificial Sequence
  Synthetic
gcaccgcccgcattcagga

SEQ ID NO: 20672 - DNA, 19 bp, Artificial Sequence
  Synthetic
ctttggcgaggcagacgcg

SEQ ID NO: 20673 - DNA, 19 bp, Artificial Sequence
  Synthetic
gggtggatttgccggcgtt

SEQ ID NO: 20674 - DNA, 21 bp, Artificial Sequence
  Synthetic
gtgtttgaggaagcggtggcc

SEQ ID NO: 20675 - DNA, 21 bp, Artificial Sequence
  Synthetic
cgcggttgctccaccatgtat

SEQ ID NO: 20676 - DNA, 19 bp, Artificial Sequence
  Synthetic
gcggcgaatacatcagcgc

SEQ ID NO: 20677 - DNA, 20 bp, Artificial Sequence
  Synthetic
gcgggcgcgaaaaatatgcg

SEQ ID NO: 20678 - DNA, 19 bp, Artificial Sequence
  Synthetic
aagttgccgccgccgatat

SEQ ID NO: 20679 - DNA, 20 bp, Artificial Sequence
  Synthetic
cgttgagctgctgcggcttc

SEQ ID NO: 20680 - DNA, 22 bp, Artificial Sequence
  Synthetic
agcgaacccaactcatactgcg

SEQ ID NO: 20681 - DNA, 21 bp, Artificial Sequence
  Synthetic
cacggaaaccgacctgtcgtc

SEQ ID NO: 20682 - DNA, 19 bp, Artificial Sequence
  Synthetic
tatgcgccccgccgaatcc

SEQ ID NO: 20683 - DNA, 22 bp, Artificial Sequence
  Synthetic
caaacacggcaggcttctttcc

SEQ ID NO: 20684 - DNA, 19 bp, Artificial Sequence
  Synthetic
acaccgccgtctcacgcag

SEQ ID NO: 20685 - DNA, 19 bp, Artificial Sequence
  Synthetic
accccggctacatcgccag

SEQ ID NO: 20686 - DNA, 19 bp, Artificial Sequence
  Synthetic
atcccccgagcacaccagc

SEQ ID NO: 20687 - DNA, 19 bp, Artificial Sequence
  Synthetic
tgcaggaaaacggcagcct

SEQ ID NO: 20688 - DNA, 19 bp, Artificial Sequence
  Synthetic
tttcctggctgccgctggc

SEQ ID NO: 20689 - DNA, 18 bp, Artificial Sequence
  Synthetic
cagcacgggtacgctgct

SEQ ID NO: 20690 - DNA, 22 bp, Artificial Sequence
  Synthetic
ccagacgggcgaggtaaaccat

SEQ ID NO: 20691 - DNA, 20 bp, Artificial Sequence
  Synthetic
cgcggataggcgtttttgcg

SEQ ID NO: 20692 - DNA, 20 bp, Artificial Sequence
  Synthetic
ctgccgagcaggtctttggc

SEQ ID NO: 20693 - DNA, 22 bp, Artificial Sequence
  Synthetic
gccatacctttgctgttgccga

SEQ ID NO: 20694 - DNA, 18 bp, Artificial Sequence
  Synthetic
aaccggcatcgcccaacg

SEQ ID NO: 20695 - DNA, 19 bp, Artificial Sequence
  Synthetic
ggcaggctggcggtttacc

SEQ ID NO: 20696 - DNA, 22 bp, Artificial Sequence
  Synthetic
tgccattacgtcgtcgttgact

SEQ ID NO: 20697 - DNA, 20 bp, Artificial Sequence
  Synthetic
ttccaagttgcgttgggcgt

SEQ ID NO: 20698 - DNA, 21 bp, Artificial Sequence
  Synthetic
ggtcaggtgcaccatcagcag

SEQ ID NO: 20699 - DNA, 21 bp, Artificial Sequence
  Synthetic
tccgcacacacttccaaggtt

SEQ ID NO: 20700 - DNA, 21 bp, Artificial Sequence
  Synthetic
gccccatcatggttttgggct

SEQ ID NO: 20701 - DNA, 22 bp, Artificial Sequence
  Synthetic
gccgctgttcgaacgcaaatcc

SEQ ID NO: 20702 - DNA, 19 bp, Artificial Sequence
  Synthetic
agtctgcgcccaaatcggc

SEQ ID NO: 20703 - DNA, 20 bp, Artificial Sequence
  Synthetic
ttgccgcatcgaagttcggc

SEQ ID NO: 20704 - DNA, 25 bp, Artificial Sequence
  Synthetic
tgacatttttagaatgatgccgtct

SEQ ID NO: 20705 - DNA, 21 bp, Artificial Sequence
  Synthetic
gcggacgtgatggcgaaaatg

SEQ ID NO: 20706 - DNA, 22 bp, Artificial Sequence
  Synthetic
gccctcgccgaagtagtcgttg

SEQ ID NO: 20707 - DNA, 18 bp, Artificial Sequence
  Synthetic
cggacgcttgcagcacct

SEQ ID NO: 20708 - DNA, 18 bp, Artificial Sequence
  Synthetic
aattgcgcgtccggccag

SEQ ID NO: 20709 - DNA, 19 bp, Artificial Sequence
  Synthetic
cgtcaacgccgccaacgac

SEQ ID NO: 20710 - DNA, 18 bp, Artificial Sequence
  Synthetic
ccccgtgttgccgcaaac

SEQ ID NO: 20711 - DNA, 21 bp, Artificial Sequence
  Synthetic
gcaaaatcaaacgcgtgcgcc

SEQ ID NO: 20712 - DNA, 20 bp, Artificial Sequence
  Synthetic
acgcataccgccgacctttc

SEQ ID NO: 20713 - DNA, 19 bp, Artificial Sequence
  Synthetic
cctcggctgcgccaatttg

SEQ ID NO: 20714 - DNA, 22 bp, Artificial Sequence
  Synthetic
cggcaagcaggaaaaaaacgct

SEQ ID NO: 20715 - DNA, 18 bp, Artificial Sequence
  Synthetic
ctgccgcatctgtgccca

SEQ ID NO: 20716 - DNA, 20 bp, Artificial Sequence
  Synthetic
gtacgttccacgccgtttct

SEQ ID NO: 20717 - DNA, 19 bp, Artificial Sequence
  Synthetic
acaagccccgattccccgg

SEQ ID NO: 20718 - DNA, 21 bp, Artificial Sequence
  Synthetic
catcgttgccgggtattgccc

SEQ ID NO: 20719 - DNA, 22 bp, Artificial Sequence
  Synthetic
ccaaatccgccaactctaccga

SEQ ID NO: 20720 - DNA, 19 bp, Artificial Sequence
  Synthetic
tcgccttgggctgacgcag

SEQ ID NO: 20721 - DNA, 20 bp, Artificial Sequence
  Synthetic
gcgcccgaaaaacagcttgc

SEQ ID NO: 20722 - DNA, 19 bp, Artificial Sequence
  Synthetic
acattccggaccgcccctc

SEQ ID NO: 20723 - DNA, 21 bp, Artificial Sequence
  Synthetic
gcataccgcccgccaaaaaga

SEQ ID NO: 20724 - DNA, 21 bp, Artificial Sequence
  Synthetic
gtccagccacgtctttaccgc

SEQ ID NO: 20725 - DNA, 19 bp, Artificial Sequence
  Synthetic
ggcttccaaaccagccgcc

SEQ ID NO: 20726 - DNA, 22 bp, Artificial Sequence
  Synthetic
tgcaccgatatgcccgaactct

SEQ ID NO: 20727 - DNA, 20 bp, Artificial Sequence
  Synthetic
gcaaccgcagcaactacgcc

SEQ ID NO: 20728 - DNA, 22 bp, Artificial Sequence
  Synthetic
ccgtcggacaactcgtcttctt

SEQ ID NO: 20729 - DNA, 19 bp, Artificial Sequence
  Synthetic
aaccaggcaggccggcttg

SEQ ID NO: 20730 - DNA, 19 bp, Artificial Sequence
  Synthetic
ttgcgacaggacgggcagc

SEQ ID NO: 20731 - DNA, 19 bp, Artificial Sequence
  Synthetic
cgcgacattctgcgcggag

SEQ ID NO: 20732 - DNA, 21 bp, Artificial Sequence
  Synthetic
cgagttccacacccaagccaa

SEQ ID NO: 20733 - DNA, 19 bp, Artificial Sequence
  Synthetic
cggtatgttcggcggcgtt

SEQ ID NO: 20734 - DNA, 19 bp, Artificial Sequence
  Synthetic
ggcgcgccatccatgttcc

SEQ ID NO: 20735 - DNA, 18 bp, Artificial Sequence
  Synthetic
gcctccgtcggcgcattt

SEQ ID NO: 20736 - DNA, 21 bp, Artificial Sequence
  Synthetic
gccgtctgaaagccgtttgcg

SEQ ID NO: 20737 - DNA, 20 bp, Artificial Sequence
  Synthetic
cgtccgaagcgtttggcgta

SEQ ID NO: 20738 - DNA, 22 bp, Artificial Sequence
  Synthetic
tccggctacaagtgataaggtg

SEQ ID NO: 20739 - DNA, 21 bp, Artificial Sequence
  Synthetic
ccggctgacgattttggggct

SEQ ID NO: 20740 - DNA, 20 bp, Artificial Sequence
  Synthetic
tcgccgcaaaattccgaccc

SEQ ID NO: 20741 - DNA, 20 bp, Artificial Sequence
  Synthetic
cgctgcaaacccacggcaaa

SEQ ID NO: 20742 - DNA, 22 bp, Artificial Sequence
  Synthetic
cgggttactttggcagggtcga

SEQ ID NO: 20743 - DNA, 21 bp, Artificial Sequence
  Synthetic
tggcataatcgagcagcagca

SEQ ID NO: 20744 - DNA, 20 bp, Artificial Sequence
  Synthetic
gcctgcgtaattccggcaac

SEQ ID NO: 20745 - DNA, 20 bp, Artificial Sequence
  Synthetic
ccatacagccggccgccttc

SEQ ID NO: 20746 - DNA, 22 bp, Artificial Sequence
  Synthetic
gagggttttgtcaccggagagg

SEQ ID NO: 20747 - DNA, 19 bp, Artificial Sequence
  Synthetic
acatcggcatcagcgcggg

SEQ ID NO: 20748 - DNA, 20 bp, Artificial Sequence
  Synthetic
cgacctgcgccaaatcggta

SEQ ID NO: 20749 - DNA, 19 bp, Artificial Sequence
  Synthetic
acgcgggcttcagctacgg

SEQ ID NO: 20750 - DNA, 19 bp, Artificial Sequence
  Synthetic
gtcatcgacagcgaccccg

SEQ ID NO: 20751 - DNA, 22 bp, Artificial Sequence
  Synthetic
cgttcaacgtcgtcatccgcac

SEQ ID NO: 20752 - DNA, 19 bp, Artificial Sequence
  Synthetic
cagacccgaaaaaccgcgc

SEQ ID NO: 20753 - DNA, 21 bp, Artificial Sequence
  Synthetic
cggcatttccacgccgcaatc

SEQ ID NO: 20754 - DNA, 21 bp, Artificial Sequence
  Synthetic
ccgtcaaagccgttgccgaaa

SEQ ID NO: 20755 - DNA, 22 bp, Artificial Sequence
  Synthetic
ggggttttcaggcggcatgaaa

SEQ ID NO: 20756 - DNA, 20 bp, Artificial Sequence
  Synthetic
cagccaggcaaacgccatca

SEQ ID NO: 20757 - DNA, 19 bp, Artificial Sequence
  Synthetic
tcagggtaacgcctgccgc

SEQ ID NO: 20758 - DNA, 19 bp, Artificial Sequence
  Synthetic
ccgcgttcgaccacggttt

SEQ ID NO: 20759 - DNA, 18 bp, Artificial Sequence
  Synthetic
ttgccgccgcattgggca

SEQ ID NO: 20760 - DNA, 21 bp, Artificial Sequence
  Synthetic
gcggtagtagccgtagcggat

SEQ ID NO: 20761 - DNA, 19 bp, Artificial Sequence
  Synthetic
gctgatggtgcgcgaaacg

SEQ ID NO: 20762 - DNA, 19 bp, Artificial Sequence
  Synthetic
tgcctgcccttccaatgcc

SEQ ID NO: 20763 - DNA, 20 bp, Artificial Sequence
  Synthetic
ccccaaatgccgaccagggt

SEQ ID NO: 20764 - DNA, 18 bp, Artificial Sequence
  Synthetic
acgcgtttgttggcggcg

SEQ ID NO: 20765 - DNA, 21 bp, Artificial Sequence
  Synthetic
gggcatcgccgtattggtacg

SEQ ID NO: 20766 - DNA, 19 bp, Artificial Sequence
  Synthetic
ggcaaatgccgtctgcgcg

SEQ ID NO: 20767 - DNA, 22 bp, Artificial Sequence
  Synthetic
ggcgcgtatgtgctgcacctta

SEQ ID NO: 20768 - DNA, 19 bp, Artificial Sequence
  Synthetic
gcccgaagaaacccgccaa

SEQ ID NO: 20769 - DNA, 21 bp, Artificial Sequence
  Synthetic
cgcgccattttgaaagacgcg

SEQ ID NO: 20770 - DNA, 19 bp, Artificial Sequence
  Synthetic
gccgacggcgtatgtgcat

SEQ ID NO: 20771 - DNA, 21 bp, Artificial Sequence
  Synthetic
cccctgatcaaccacggcttt

SEQ ID NO: 20772 - DNA, 21 bp, Artificial Sequence
  Synthetic
gccaaagaagccggagccaaa

SEQ ID NO: 20773 - DNA, 19 bp, Artificial Sequence
  Synthetic
ttcggcaaccccgcaaccg

SEQ ID NO: 20774 - DNA, 25 bp, Artificial Sequence
  Synthetic
gtgctaaatctaccaagttgcaaat

SEQ ID NO: 20775 - DNA, 21 bp, Artificial Sequence
  Synthetic
tggtaaggtgtcacttgctcc

SEQ ID NO: 20776 - DNA, 25 bp, Artificial Sequence
  Synthetic
tgcttagtctttctttttctggaga

SEQ ID NO: 20777 - DNA, 25 bp, Artificial Sequence
  Synthetic
gtaacccagctaggcaatttgttat

SEQ ID NO: 20778 - DNA, 22 bp, Artificial Sequence
  Synthetic
cgatgcccatttgtattgcaac

SEQ ID NO: 20779 - DNA, 25 bp, Artificial Sequence
  Synthetic
tcctggcatcttcaaaaaacaatag

SEQ ID NO: 20780 - DNA, 24 bp, Artificial Sequence
  Synthetic
tccatctatacctccagcacttta

SEQ ID NO: 20781 - DNA, 23 bp, Artificial Sequence
  Synthetic
gaacaatagatgaagcaccaggc

SEQ ID NO: 20782 - DNA, 25 bp, Artificial Sequence
  Synthetic
tggaacctgtgttgtgtatctagta

SEQ ID NO: 20783 - DNA, 23 bp, Artificial Sequence
  Synthetic
ccctgtgtgtctgtagtggtaac

SEQ ID NO: 20784 - DNA, 25 bp, Artificial Sequence
  Synthetic
caaactaaccgttctctttgaggat

SEQ ID NO: 20785 - DNA, 25 bp, Artificial Sequence
  Synthetic
tgacgagcataaagttgttctcttt

SEQ ID NO: 20786 - DNA, 25 bp, Artificial Sequence
  Synthetic
gggatccattgcattaatatgagct

SEQ ID NO: 20787 - DNA, 25 bp, Artificial Sequence
  Synthetic
aagcagtcaggatattcaagtacaa

SEQ ID NO: 20788 - DNA, 24 bp, Artificial Sequence
  Synthetic
tcttctccatactctttcattgcc

SEQ ID NO: 20789 - DNA, 25 bp, Artificial Sequence
  Synthetic
tccttgtaatcatacaaatctggca

SEQ ID NO: 20790 - DNA, 21 bp, Artificial Sequence
  Synthetic
ctgaaaacaaggaggcccatc

SEQ ID NO: 20791 - DNA, 24 bp, Artificial Sequence
  Synthetic
agctgactcgttttcttcatgttt

SEQ ID NO: 20792 - DNA, 23 bp, Artificial Sequence
  Synthetic
tctcatgcttgcaatgtgttcaa

SEQ ID NO: 20793 - DNA, 21 bp, Artificial Sequence
  Synthetic
tcacaaagtttaccacgtcgg

SEQ ID NO: 20794 - DNA, 25 bp, Artificial Sequence
  Synthetic
gtctttctctttgacagaggactcg

SEQ ID NO: 20795 - DNA, 21 bp, Artificial Sequence
  Synthetic
tctgttcgctgaaggggtcct

SEQ ID NO: 20796 - DNA, 20 bp, Artificial Sequence
  Synthetic
tggctccactggtccccaat

SEQ ID NO: 20797 - DNA, 20 bp, Artificial Sequence
  Synthetic
gacgcacgtccactcggatg

SEQ ID NO: 20798 - DNA, 21 bp, Artificial Sequence
  Synthetic
catgcaaggagtcccggagtc

SEQ ID NO: 20799 - DNA, 21 bp, Artificial Sequence
  Synthetic
ccaggggaggattcaccgaca

SEQ ID NO: 20800 - DNA, 23 bp, Artificial Sequence
  Synthetic
aggatcctcgaacatagctgttt

SEQ ID NO: 20801 - DNA, 25 bp, Artificial Sequence
  Synthetic
ggcatttgacatctatgacacctta

SEQ ID NO: 20802 - DNA, 20 bp, Artificial Sequence
  Synthetic
gttcgtagcagcgtaggtca

SEQ ID NO: 20803 - DNA, 24 bp, Artificial Sequence
  Synthetic
ctcctcatttgtaccttcacagtc

SEQ ID NO: 20804 - DNA, 22 bp, Artificial Sequence
  Synthetic
ttaaattgcgcactgcctttgt

SEQ ID NO: 20805 - DNA, 24 bp, Artificial Sequence
  Synthetic
ccaaatctaatctggaccaggtgg

SEQ ID NO: 20806 - DNA, 25 bp, Artificial Sequence
  Synthetic
cgtgtttattaacgactgcaatgct

SEQ ID NO: 20807 - DNA, 25 bp, Artificial Sequence
  Synthetic
cgtaatactgcttatatgccccttg

SEQ ID NO: 20808 - DNA, 21 bp, Artificial Sequence
  Synthetic
cggtggtgtcaggtccactga

SEQ ID NO: 20809 - DNA, 24 bp, Artificial Sequence
  Synthetic
aggggctccagattgtataatact

SEQ ID NO: 20810 - DNA, 20 bp, Artificial Sequence
  Synthetic
agatgtaagggccggacgat

SEQ ID NO: 20811 - DNA, 24 bp, Artificial Sequence
  Synthetic
atgttgtaggggaatatgacatgc

SEQ ID NO: 20812 - DNA, 23 bp, Artificial Sequence
  Synthetic
gcatacgtttacggcgtttatgg

SEQ ID NO: 20813 - DNA, 20 bp, Artificial Sequence
  Synthetic
aggatcaggtaggtgcactc

SEQ ID NO: 20814 - DNA, 25 bp, Artificial Sequence
  Synthetic
cacgttgtgtctgtgtatttttaca

SEQ ID NO: 20815 - DNA, 25 bp, Artificial Sequence
  Synthetic
cccccgccttattataaaaatgtct

SEQ ID NO: 20816 - DNA, 25 bp, Artificial Sequence
  Synthetic
acacaccttacataacataccacaa

SEQ ID NO: 20817 - DNA, 20 bp, Artificial Sequence
  Synthetic
ctccacccttctgcagacgg

SEQ ID NO: 20818 - DNA, 22 bp, Artificial Sequence
  Synthetic
ggaccctatcaggcagtacggt

SEQ ID NO: 20819 - DNA, 22 bp, Artificial Sequence
  Synthetic
ccagcaagcgtactatctggca

SEQ ID NO: 20820 - DNA, 20 bp, Artificial Sequence
  Synthetic
tgtacggattggcgggaacc

SEQ ID NO: 20821 - DNA, 23 bp, Artificial Sequence
  Synthetic
caccagggattgtataggggtac

SEQ ID NO: 20822 - DNA, 25 bp, Artificial Sequence
  Synthetic
gtggaattcacagggtcataaaagt

SEQ ID NO: 20823 - DNA, 22 bp, Artificial Sequence
  Synthetic
agctgaagcaggcgtaaccaaa

SEQ ID NO: 20824 - DNA, 21 bp, Artificial Sequence
  Synthetic
cgatgctgcactggatgttaa

SEQ ID NO: 20825 - DNA, 22 bp, Artificial Sequence
  Synthetic
gcatagccaaccctgcgaaaac

SEQ ID NO: 20826 - DNA, 22 bp, Artificial Sequence
  Synthetic
ccagctccacatggtggttgat

SEQ ID NO: 20827 - DNA, 23 bp, Artificial Sequence
  Synthetic
tgggggcaattaaaatttgcact

SEQ ID NO: 20828 - DNA, 21 bp, Artificial Sequence
  Synthetic
ggtgtagggattactccaggg

SEQ ID NO: 20829 - DNA, 24 bp, Artificial Sequence
  Synthetic
agtttgagcttctgttgatgacaa

SEQ ID NO: 20830 - DNA, 25 bp, Artificial Sequence
  Synthetic
cccaagaaaggtgttaagtttttca

SEQ ID NO: 20831 - DNA, 22 bp, Artificial Sequence
  Synthetic
ggccactcacccatcaagcatt

SEQ ID NO: 20832 - DNA, 20 bp, Artificial Sequence
  Synthetic
tcagttgggtccggtctagc

SEQ ID NO: 20833 - DNA, 22 bp, Artificial Sequence
  Synthetic
ggtggtgaaggagggaggtttg

SEQ ID NO: 20834 - DNA, 24 bp, Artificial Sequence
  Synthetic
cagttttgaagctaatcacgtcgg

SEQ ID NO: 20835 - DNA, 20 bp, Artificial Sequence
  Synthetic
gtccagaacagccttgcggg

SEQ ID NO: 20836 - DNA, 22 bp, Artificial Sequence
  Synthetic
cctcgggtgtgatggtactgtc

SEQ ID NO: 20837 - DNA, 22 bp, Artificial Sequence
  Synthetic
gcgctcttccaaattacggtgc

SEQ ID NO: 20838 - DNA, 22 bp, Artificial Sequence
  Synthetic
gcagatcttctacaggcaccgt

SEQ ID NO: 20839 - DNA, 20 bp, Artificial Sequence
  Synthetic
aaagtggtgtaccgagccac

SEQ ID NO: 20840 - DNA, 22 bp, Artificial Sequence
  Synthetic
ggcttcacccgaaacggttctg

SEQ ID NO: 20841 - DNA, 23 bp, Artificial Sequence
  Synthetic
cagtggttatcaggatggcaatt

SEQ ID NO: 20842 - DNA, 25 bp, Artificial Sequence
  Synthetic
ggaaagcctaatcgaattgtcctta

SEQ ID NO: 20843 - DNA, 20 bp, Artificial Sequence
  Synthetic
acacaaacatgcagccatgc

SEQ ID NO: 20844 - DNA, 20 bp, Artificial Sequence
  Synthetic
gaggatagcaggagcactcc

SEQ ID NO: 20845 - DNA, 20 bp, Artificial Sequence
  Synthetic
tccatcatcaaaggcccagc

SEQ ID NO: 20846 - DNA, 25 bp, Artificial Sequence
  Synthetic
atcgtacttttcagcagtatccaat

SEQ ID NO: 20847 - DNA, 25 bp, Artificial Sequence
  Synthetic
tgaagtagcaaaaacacacactctt

SEQ ID NO: 20848 - DNA, 25 bp, Artificial Sequence
  Synthetic
tgtgaagcattatccacatcatcaa

SEQ ID NO: 20849 - DNA, 24 bp, Artificial Sequence
  Synthetic
tgtacctgagaaacatttgcagtt

SEQ ID NO: 20850 - DNA, 25 bp, Artificial Sequence
  Synthetic
tcgtctaacaagccaattttaccat

SEQ ID NO: 20851 - DNA, 21 bp, Artificial Sequence
  Synthetic
gcgatggggtcttggagtacc

SEQ ID NO: 20852 - DNA, 20 bp, Artificial Sequence
  Synthetic
cttgtcgcgcaagtagtcga

SEQ ID NO: 20853 - DNA, 25 bp, Artificial Sequence
  Synthetic
ggaagtgcttcaggaattggtttta

SEQ ID NO: 20854 - DNA, 21 bp, Artificial Sequence
  Synthetic
gaaagtaggatccggtgcagc

SEQ ID NO: 20855 - DNA, 25 bp, Artificial Sequence
  Synthetic
gcattaggattttctgtgtcaagca

SEQ ID NO: 20856 - DNA, 25 bp, Artificial Sequence
  Synthetic
cctgatttgtcctgttgtaatcgtc

SEQ ID NO: 20857 - DNA, 21 bp, Artificial Sequence
  Synthetic
cagaaccggtatgcaatagcc

SEQ ID NO: 20858 - DNA, 24 bp, Artificial Sequence
  Synthetic
ctgatgatctttcgacgatgtagg

SEQ ID NO: 20859 - DNA, 23 bp, Artificial Sequence
  Synthetic
cgaaaagaatgctctttcccctg

SEQ ID NO: 20860 - DNA, 24 bp, Artificial Sequence
  Synthetic
tgaaagaacgtgtccataccatgg

SEQ ID NO: 20861 - DNA, 20 bp, Artificial Sequence
  Synthetic
taccagccagcgactagtcc

SEQ ID NO: 20862 - DNA, 25 bp, Artificial Sequence
  Synthetic
atgctcatcgagtgttttttgattt

SEQ ID NO: 20863 - DNA, 22 bp, Artificial Sequence
  Synthetic
cggttccgcagaccactatggc

SEQ ID NO: 20864 - DNA, 22 bp, Artificial Sequence
  Synthetic
gcggcaacaagtaaactccacc

SEQ ID NO: 20865 - DNA, 21 bp, Artificial Sequence
  Synthetic
tgacagcgtgggggtgatttg

SEQ ID NO: 20866 - DNA, 21 bp, Artificial Sequence
  Synthetic
acagtatgggtgcggccatca

SEQ ID NO: 20867 - DNA, 20 bp, Artificial Sequence
  Synthetic
ttggtcgaatgcggcaaggg

SEQ ID NO: 20868 - DNA, 22 bp, Artificial Sequence
  Synthetic
acaaaccccgtggagttcatcc

SEQ ID NO: 20869 - DNA, 20 bp, Artificial Sequence
  Synthetic
gtgtggtggtgtgcaggagc

SEQ ID NO: 20870 - DNA, 19 bp, Artificial Sequence
  Synthetic
cccatgattccctgcggcc

SEQ ID NO: 20871 - DNA, 21 bp, Artificial Sequence
  Synthetic
ccacccttaacctgcaacggg

SEQ ID NO: 20872 - DNA, 22 bp, Artificial Sequence
  Synthetic
cgcggagaatacgatgggttct

SEQ ID NO: 20873 - DNA, 21 bp, Artificial Sequence
  Synthetic
gccccatggaagagtgtccac

SEQ ID NO: 20874 - DNA, 20 bp, Artificial Sequence
  Synthetic
aacacctaccacatgcccgg

SEQ ID NO: 20875 - DNA, 21 bp, Artificial Sequence
  Synthetic
ctccggtcctgatgttggggt

SEQ ID NO: 20876 - DNA, 22 bp, Artificial Sequence
  Synthetic
acgcccagactggtcaattgtt

SEQ ID NO: 20877 - DNA, 20 bp, Artificial Sequence
  Synthetic
tctccctgtacggcccctac

SEQ ID NO: 20878 - DNA, 22 bp, Artificial Sequence
  Synthetic
gagtggggccagttaaagtcgg

SEQ ID NO: 20879 - DNA, 20 bp, Artificial Sequence
  Synthetic
aagaggggaggtcaccgcgg

SEQ ID NO: 20880 - DNA, 18 bp, Artificial Sequence
  Synthetic
atgtggcgccgcagaacg

SEQ ID NO: 20881 - DNA, 20 bp, Artificial Sequence
  Synthetic
aagggcactccggggagttg

SEQ ID NO: 20882 - DNA, 20 bp, Artificial Sequence
  Synthetic
acgccatccagctccgtgaa

SEQ ID NO: 20883 - DNA, 20 bp, Artificial Sequence
  Synthetic
gcaggtggccttgagagagg

SEQ ID NO: 20884 - DNA, 19 bp, Artificial Sequence
  Synthetic
gcaggtggtatcgggcagc

SEQ ID NO: 20885 - DNA, 22 bp, Artificial Sequence
  Synthetic
gccccagtccaggtgtatgaca

SEQ ID NO: 20886 - DNA, 22 bp, Artificial Sequence
  Synthetic
cgccgtatccgtacttggaacg

SEQ ID NO: 20887 - DNA, 22 bp, Artificial Sequence
  Synthetic
gtcgtcaccacataccaggagc

SEQ ID NO: 20888 - DNA, 21 bp, Artificial Sequence
  Synthetic
gcactatccgagcccacaagg

SEQ ID NO: 20889 - DNA, 20 bp, Artificial Sequence
  Synthetic
atggcggccctacctccctg

SEQ ID NO: 20890 - DNA, 20 bp, Artificial Sequence
  Synthetic
tactgcgtaggtgcactagg

SEQ ID NO: 20891 - DNA, 22 bp, Artificial Sequence
  Synthetic
ggtgttcacgtgcctccgatag

SEQ ID NO: 20892 - DNA, 25 bp, Artificial Sequence
  Synthetic
gtggttgaatgactttgacttttga

SEQ ID NO: 20893 - DNA, 25 bp, Artificial Sequence
  Synthetic
cgcttattatagcagccaacatagg

SEQ ID NO: 20894 - DNA, 20 bp, Artificial Sequence
  Synthetic
tccaagcaccttttacgggc

SEQ ID NO: 20895 - DNA, 25 bp, Artificial Sequence
  Synthetic
gaccaccagttacatatgccataat

SEQ ID NO: 20896 - DNA, 22 bp, Artificial Sequence
  Synthetic
acctaagttgagtgatcgcaac

SEQ ID NO: 20897 - DNA, 21 bp, Artificial Sequence
  Synthetic
caggagacaatgcgcagtatt

SEQ ID NO: 20898 - DNA, 21 bp, Artificial Sequence
  Synthetic
tgcatcgtcctcttcttcctc

SEQ ID NO: 20899 - DNA, 25 bp, Artificial Sequence
  Synthetic
aggtgtatgttagcagcatttacaa

SEQ ID NO: 20900 - DNA, 22 bp, Artificial Sequence
  Synthetic
aagactgaagtggtttagcacc

SEQ ID NO: 20901 - DNA, 22 bp, Artificial Sequence
  Synthetic
tcacctaccatgtaaggtgcat

SEQ ID NO: 20902 - DNA, 25 bp, Artificial Sequence
  Synthetic
gctctaacatccatgcatataggca

SEQ ID NO: 20903 - DNA, 24 bp, Artificial Sequence
  Synthetic
tgatgacgaagtgaggtatccatt

SEQ ID NO: 20904 - DNA, 24 bp, Artificial Sequence
  Synthetic
agcttcactacgtagtgtgtcatc

SEQ ID NO: 20905 - DNA, 25 bp, Artificial Sequence
  Synthetic
ggtagtagttttctgaccacaatgt

SEQ ID NO: 20906 - DNA, 23 bp, Artificial Sequence
  Synthetic
tggtcctttgtactctgacatct

SEQ ID NO: 20907 - DNA, 22 bp, Artificial Sequence
  Synthetic
ccactacatcgccattcaagtc

SEQ ID NO: 20908 - DNA, 25 bp, Artificial Sequence
  Synthetic
tggtttaagtatgacattgcctaca

SEQ ID NO: 20909 - DNA, 25 bp, Artificial Sequence
  Synthetic
ggaaaagaaccttcacagaaatcca

SEQ ID NO: 20910 - DNA, 21 bp, Artificial Sequence
  Synthetic
ctaaccattgcagaaacgggt

SEQ ID NO: 20911 - DNA, 23 bp, Artificial Sequence
  Synthetic
gtcagtagggttgattggtcttt

SEQ ID NO: 20912 - DNA, 25 bp, Artificial Sequence
  Synthetic
gcaacaagtgccttaagtttttcca

SEQ ID NO: 20913 - DNA, 25 bp, Artificial Sequence
  Synthetic
gcagctgttcagataaagacatgta

SEQ ID NO: 20914 - DNA, 25 bp, Artificial Sequence
  Synthetic
accagcatgtttatttgcaaaacaa

SEQ ID NO: 20915 - DNA, 25 bp, Artificial Sequence
  Synthetic
tctggacgaagctcactataagaaa

SEQ ID NO: 20916 - DNA, 20 bp, Artificial Sequence
  Synthetic
ccaccagccactactgaagc

SEQ ID NO: 20917 - DNA, 25 bp, Artificial Sequence
  Synthetic
cgctacgcaattttaggtacatttc

SEQ ID NO: 20918 - DNA, 20 bp, Artificial Sequence
  Synthetic
aaccactctgcagaacagca

SEQ ID NO: 20919 - DNA, 25 bp, Artificial Sequence
  Synthetic
cggacaaatttatacttgggtgtct

SEQ ID NO: 20920 - DNA, 25 bp, Artificial Sequence
  Synthetic
acatgatcttgtgtcaaaggttcat

SEQ ID NO: 20921 - DNA, 24 bp, Artificial Sequence
  Synthetic
gaccactgtgtactttgaacaaga

SEQ ID NO: 20922 - DNA, 25 bp, Artificial Sequence
  Synthetic
cgacaccagaatagttagaggttac

SEQ ID NO: 20923 - DNA, 25 bp, Artificial Sequence
  Synthetic
cctccaatacccaacaacttaatgt

SEQ ID NO: 20924 - DNA, 25 bp, Artificial Sequence
  Synthetic
acaacctattaatgtctacagcacc

SEQ ID NO: 20925 - DNA, 24 bp, Artificial Sequence
  Synthetic
gcactagttacttttgccctcttg

SEQ ID NO: 20926 - DNA, 22 bp, Artificial Sequence
  Synthetic
gtcgtagtgctactggactcag

SEQ ID NO: 20927 - DNA, 24 bp, Artificial Sequence
  Synthetic
gcaggtacttctgtagcatttcca

SEQ ID NO: 20928 - DNA, 22 bp, Artificial Sequence
  Synthetic
gggtcattagcacaagtggtag

SEQ ID NO: 20929 - DNA, 25 bp, Artificial Sequence
  Synthetic
ccatgtcaccatctactctaaactt

SEQ ID NO: 20930 - DNA, 20 bp, Artificial Sequence
  Synthetic
cctacaatgcctgcatcacg

SEQ ID NO: 20931 - DNA, 25 bp, Artificial Sequence
  Synthetic
ggatacacctatcatccaaacagtt

SEQ ID NO: 20932 - DNA, 25 bp, Artificial Sequence
  Synthetic
tgacagtttgaaaagcaacattgtt

SEQ ID NO: 20933 - DNA, 23 bp, Artificial Sequence
  Synthetic
acagatagagacaccagctacgg

SEQ ID NO: 20934 - DNA, 23 bp, Artificial Sequence
  Synthetic
cgttagctaacctgtagaaacgg

SEQ ID NO: 20935 - DNA, 25 bp, Artificial Sequence
  Synthetic
cggcatcatcagaaagaatcatcat

SEQ ID NO: 20936 - DNA, 25 bp, Artificial Sequence
  Synthetic
agacatcagcatactcctgattagg

SEQ ID NO: 20937 - DNA, 25 bp, Artificial Sequence
  Synthetic
gcaaacatagggattaacagacaac

SEQ ID NO: 20938 - DNA, 20 bp, Artificial Sequence
  Synthetic
ttcctcagtggctttgagcg

SEQ ID NO: 20939 - DNA, 22 bp, Artificial Sequence
  Synthetic
gtgttgggtacaagccagtaat

SEQ ID NO: 20940 - DNA, 25 bp, Artificial Sequence
  Synthetic
agcattgacaacactcaagtcataa

SEQ ID NO: 20941 - DNA, 25 bp, Artificial Sequence
  Synthetic
tgattgcagatgaaacatcatgtgt

SEQ ID NO: 20942 - DNA, 25 bp, Artificial Sequence
  Synthetic
cgacgtggtatttctagacttgtaa

SEQ ID NO: 20943 - DNA, 20 bp, Artificial Sequence
  Synthetic
aaagccaatccacgcacgaa

SEQ ID NO: 20944 - DNA, 20 bp, Artificial Sequence
  Synthetic
gtaagctcaaagccatgcgc

SEQ ID NO: 20945 - DNA, 23 bp, Artificial Sequence
  Synthetic
caatgcagacttcacaaccatgt

SEQ ID NO: 20946 - DNA, 23 bp, Artificial Sequence
  Synthetic
catcacagcctggtaagttcaag

SEQ ID NO: 20947 - DNA, 25 bp, Artificial Sequence
  Synthetic
cctggtaaatgtattccacaggtta

SEQ ID NO: 20948 - DNA, 25 bp, Artificial Sequence
  Synthetic
acaagacagtaagtgaagaacaagc

SEQ ID NO: 20949 - DNA, 25 bp, Artificial Sequence
  Synthetic
cctcgagcttatatcgctgtatgaa

SEQ ID NO: 20950 - DNA, 25 bp, Artificial Sequence
  Synthetic
ccaaagcatgaatgaaatttcagca

SEQ ID NO: 20951 - DNA, 25 bp, Artificial Sequence
  Synthetic
ccaattaaagtagaatctgcgtcgg

SEQ ID NO: 20952 - DNA, 23 bp, Artificial Sequence
  Synthetic
tgccaagatagttagccccaatt

SEQ ID NO: 20953 - DNA, 21 bp, Artificial Sequence
  Synthetic
tgtctgtgtacccatgggttt

SEQ ID NO: 20954 - DNA, 25 bp, Artificial Sequence
  Synthetic
acttgagcataaatgtagttggctt

SEQ ID NO: 20955 - DNA, 25 bp, Artificial Sequence
  Synthetic
gcaaagatcattcaacttagtggca

SEQ ID NO: 20956 - DNA, 25 bp, Artificial Sequence
  Synthetic
gccaataacaattaagagcaggtgg

SEQ ID NO: 20957 - DNA, 25 bp, Artificial Sequence
  Synthetic
agcatttgttccaggtgtaattaca

SEQ ID NO: 20958 - DNA, 25 bp, Artificial Sequence
  Synthetic
agcaatggtgttattagagtaagca

SEQ ID NO: 20959 - DNA, 24 bp, Artificial Sequence
  Synthetic
gcattcgccatattgcttcatgaa

SEQ ID NO: 20960 - DNA, 25 bp, Artificial Sequence
  Synthetic
tgcagttgatgttgttgtaagtgat

SEQ ID NO: 20961 - DNA, 23 bp, Artificial Sequence
  Synthetic
ggacataaggtggtagccctttc

SEQ ID NO: 20962 - DNA, 25 bp, Artificial Sequence
  Synthetic
gctcttctttgaatgagtcaagctc

SEQ ID NO: 20963 - DNA, 20 bp, Artificial Sequence
  Synthetic
aagagcatgcacccttgagg

SEQ ID NO: 20964 - DNA, 23 bp, Artificial Sequence
  Synthetic
gcaaatgaactggaagcccttat

SEQ ID NO: 20965 - DNA, 25 bp, Artificial Sequence
  Synthetic
gtgaaatagccatgtacaacgacat

SEQ ID NO: 20966 - DNA, 25 bp, Artificial Sequence
  Synthetic
gcaagaataccacgaaagcaagaaa

SEQ ID NO: 20967 - DNA, 25 bp, Artificial Sequence
  Synthetic
cctgttccgattagaataggcaaat

SEQ ID NO: 20968 - DNA, 20 bp, Artificial Sequence
  Synthetic
acagcgccctagggagtgtc

SEQ ID NO: 20969 - DNA, 24 bp, Artificial Sequence
  Synthetic
cctgatagtgatatagctcgcaag

SEQ ID NO: 20970 - DNA, 25 bp, Artificial Sequence
  Synthetic
acatgaggtttattagatgcacagc

SEQ ID NO: 20971 - DNA, 22 bp, Artificial Sequence
  Synthetic
ccattgcgtcctccattctggt

SEQ ID NO: 20972 - DNA, 22 bp, Artificial Sequence
  Synthetic
tgccaatgtggtctttgggtgt

SEQ ID NO: 20973 - DNA, 25 bp, Artificial Sequence
  Synthetic
agcagatttcttagtgacagtttgg

SEQ ID NO: 20974 - DNA, 23 bp, Artificial Sequence
  Synthetic
gttcagcagtatgacgttgtctt

SEQ ID NO: 20975 - DNA, 25 bp, Artificial Sequence
  Synthetic
cctacttgtgctgtttagttacgag

SEQ ID NO: 20976 - DNA, 21 bp, Artificial Sequence
  Synthetic
gggaagggtgggaaaaactgg

SEQ ID NO: 20977 - DNA, 21 bp, Artificial Sequence
  Synthetic
caagaagggtgagcaggcagc

SEQ ID NO: 20978 - DNA, 25 bp, Artificial Sequence
  Synthetic
gcacccatgatgacaatctatacac

SEQ ID NO: 20979 - DNA, 22 bp, Artificial Sequence
  Synthetic
cacaagcttcaactgttggtga

SEQ ID NO: 20980 - DNA, 20 bp, Artificial Sequence
  Synthetic
agggcatcaggcaatttcca

SEQ ID NO: 20981 - DNA, 25 bp, Artificial Sequence
  Synthetic
ccaactgtcatcactaggtctttta

SEQ ID NO: 20982 - DNA, 25 bp, Artificial Sequence
  Synthetic
ctgagtggtactaaacacaacctta

SEQ ID NO: 20983 - DNA, 25 bp, Artificial Sequence
  Synthetic
ggttgtgaggcaatatctactggta

SEQ ID NO: 20984 - DNA, 22 bp, Artificial Sequence
  Synthetic
ccccacatcccacactaaatgt

SEQ ID NO: 20985 - DNA, 23 bp, Artificial Sequence
  Synthetic
tgtgagtactccttcttgtgtgt

SEQ ID NO: 20986 - DNA, 25 bp, Artificial Sequence
  Synthetic
ttcctgattgccatgtgtaatcatc

SEQ ID NO: 20987 - DNA, 24 bp, Artificial Sequence
  Synthetic
cgaggacaccatgcttttatatgt

SEQ ID NO: 20988 - DNA, 25 bp, Artificial Sequence
  Synthetic
tcacatcattaccttcagtgtttgt

SEQ ID NO: 20989 - DNA, 25 bp, Artificial Sequence
  Synthetic
cacactggaattttctcaggtcaat

SEQ ID NO: 20990 - DNA, 25 bp, Artificial Sequence
  Synthetic
acgcacagagtttctctttaagaaa

SEQ ID NO: 20991 - DNA, 23 bp, Artificial Sequence
  Synthetic
tttaggatctgggggcaaagaat

SEQ ID NO: 20992 - DNA, 25 bp, Artificial Sequence
  Synthetic
tgaagatactgttggtggtgttagt

SEQ ID NO: 20993 - DNA, 24 bp, Artificial Sequence
  Synthetic
accctgaagtgtacagaacaattt

SEQ ID NO: 20994 - DNA, 25 bp, Artificial Sequence
  Synthetic
gcaaatcataggaatcagagacctt

SEQ ID NO: 20995 - DNA, 22 bp, Artificial Sequence
  Synthetic
ccttgtacaaaacacccccaca

SEQ ID NO: 20996 - DNA, 25 bp, Artificial Sequence
  Synthetic
gtgactatacctgggtttttgtgga

SEQ ID NO: 20997 - DNA, 25 bp, Artificial Sequence
  Synthetic
ctcatcagctctgaatcctctttta

SEQ ID NO: 20998 - DNA, 25 bp, Artificial Sequence
  Synthetic
ggtagaagcactaacacacagtcta

SEQ ID NO: 20999 - DNA, 25 bp, Artificial Sequence
  Synthetic
cttcacaagctacctgtacattaga

SEQ ID NO: 21000 - DNA, 25 bp, Artificial Sequence
  Synthetic
ccatcaaatgcatttctcatatgca

SEQ ID NO: 21001 - DNA, 25 bp, Artificial Sequence
  Synthetic
tgtgatgtgatctctaaggtctgta

SEQ ID NO: 21002 - DNA, 25 bp, Artificial Sequence
  Synthetic
tgacaggagcaagaatagttttgtt

SEQ ID NO: 21003 - DNA, 20 bp, Artificial Sequence
  Synthetic
ttcacagtcatgccccaacc

SEQ ID NO: 21004 - DNA, 23 bp, Artificial Sequence
  Synthetic
ggaagatgctccaggttctactg

SEQ ID NO: 21005 - DNA, 24 bp, Artificial Sequence
  Synthetic
ctctgtgattggtacctgctctat

SEQ ID NO: 21006 - DNA, 25 bp, Artificial Sequence
  Synthetic
tcggggacaaatacctttaaaactg

SEQ ID NO: 21007 - DNA, 23 bp, Artificial Sequence
  Synthetic
gacgttccctgtctgaattgtat

SEQ ID NO: 21008 - DNA, 25 bp, Artificial Sequence
  Synthetic
gctgttctcgctttccaaaaaagaa

SEQ ID NO: 21009 - DNA, 25 bp, Artificial Sequence
  Synthetic
gccattcttccaatattctgggatt

SEQ ID NO: 21010 - DNA, 24 bp, Artificial Sequence
  Synthetic
tgaccccatgagtcagataaaaca

SEQ ID NO: 21011 - DNA, 24 bp, Artificial Sequence
  Synthetic
gaaggtaacaccaactcttccaaa

SEQ ID NO: 21012 - DNA, 25 bp, Artificial Sequence
  Synthetic
ccaatctgcagtttgtaattcaaga

SEQ ID NO: 21013 - DNA, 25 bp, Artificial Sequence
  Synthetic
agtctcggactcaaatctacaagat

SEQ ID NO: 21014 - DNA, 22 bp, Artificial Sequence
  Synthetic
tgatcctgcagtacatcgaaac

SEQ ID NO: 21015 - DNA, 25 bp, Artificial Sequence
  Synthetic
tggaactagtaacgacagaggaaat

SEQ ID NO: 21016 - DNA, 22 bp, Artificial Sequence
  Synthetic
ggctcttggttctctggtggtt

SEQ ID NO: 21017 - DNA, 25 bp, Artificial Sequence
  Synthetic
cctctggatttatcacatccaaagg

SEQ ID NO: 21018 - DNA, 24 bp, Artificial Sequence
  Synthetic
ggtttgaacctgttgtacaaaacg

SEQ ID NO: 21019 - DNA, 25 bp, Artificial Sequence
  Synthetic
gttgaaaaaggtccagttggctatc

SEQ ID NO: 21020 - DNA, 23 bp, Artificial Sequence
  Synthetic
tgctttgccttctccatcttcta

SEQ ID NO: 21021 - DNA, 25 bp, Artificial Sequence
  Synthetic
acatcttctcatttttctctcagct

SEQ ID NO: 21022 - DNA, 23 bp, Artificial Sequence
  Synthetic
tgtctttgctgtgttcatagctg

SEQ ID NO: 21023 - DNA, 25 bp, Artificial Sequence
  Synthetic
agtttccatctgttcataagatcgt

SEQ ID NO: 21024 - DNA, 25 bp, Artificial Sequence
  Synthetic
tcctctttgtcatacagaatcagct

SEQ ID NO: 21025 - DNA, 20 bp, Artificial Sequence
  Synthetic
tgagtgcagaccgtgccaga

SEQ ID NO: 21026 - DNA, 24 bp, Artificial Sequence
  Synthetic
ctgatgaagcttgagactctcaga

SEQ ID NO: 21027 - DNA, 25 bp, Artificial Sequence
  Synthetic
cccaaaagagctctttcatttgatc

SEQ ID NO: 21028 - DNA, 25 bp, Artificial Sequence
  Synthetic
gccaccccaaataaacaaaggatta

SEQ ID NO: 21029 - DNA, 20 bp, Artificial Sequence
  Synthetic
tccatcttgctttctggcgc

SEQ ID NO: 21030 - DNA, 25 bp, Artificial Sequence
  Synthetic
gaggcgtgtataaaaagaaatgtgt

SEQ ID NO: 21031 - DNA, 25 bp, Artificial Sequence
  Synthetic
cagtaccttccattgattagccttt

SEQ ID NO: 21032 - DNA, 25 bp, Artificial Sequence
  Synthetic
gcaaaaggataattagcagcttctg

SEQ ID NO: 21033 - DNA, 25 bp, Artificial Sequence
  Synthetic
tgcaaaacattaaactctgctactg

SEQ ID NO: 21034 - DNA, 25 bp, Artificial Sequence
  Synthetic
ttcagtaagaccgatagcttccaaa

SEQ ID NO: 21035 - DNA, 25 bp, Artificial Sequence
  Synthetic
agccataaaaccaatattgtgcttt

SEQ ID NO: 21036 - DNA, 25 bp, Artificial Sequence
  Synthetic
ccaactttgattcggttaaattcct

SEQ ID NO: 21037 - DNA, 24 bp, Artificial Sequence
  Synthetic
caaagaagcaagcctaagcctaaa

SEQ ID NO: 21038 - DNA, 25 bp, Artificial Sequence
  Synthetic
gcctgcaaaatcttacctaagtcat

SEQ ID NO: 21039 - DNA, 22 bp, Artificial Sequence
  Synthetic
agcacaacaaaacaagccattt

SEQ ID NO: 21040 - DNA, 25 bp, Artificial Sequence
  Synthetic
cacaaaacctttcaagagacgtttg

SEQ ID NO: 21041 - DNA, 23 bp, Artificial Sequence
  Synthetic
gcaattaatggctgatttgcgga

SEQ ID NO: 21042 - DNA, 25 bp, Artificial Sequence
  Synthetic
cccaaatctacggctgataaagatt

SEQ ID NO: 21043 - DNA, 20 bp, Artificial Sequence
  Synthetic
tacgagatccccaacgttgg

SEQ ID NO: 21044 - DNA, 20 bp, Artificial Sequence
  Synthetic
gcagggcgtaactttgctaa

SEQ ID NO: 21045 - DNA, 24 bp, Artificial Sequence
  Synthetic
gcaatagctcctccattgacatta

SEQ ID NO: 21046 - DNA, 22 bp, Artificial Sequence
  Synthetic
accagtgcatcaattaacgctt

SEQ ID NO: 21047 - DNA, 25 bp, Artificial Sequence
  Synthetic
tgaggttaatcgaccaaaatcttct

SEQ ID NO: 21048 - DNA, 25 bp, Artificial Sequence
  Synthetic
gagcaacccttcaagataaacatct

SEQ ID NO: 21049 - DNA, 25 bp, Artificial Sequence
  Synthetic
gcttcttttgtagctactagtgtcg

SEQ ID NO: 21050 - DNA, 20 bp, Artificial Sequence
  Synthetic
acaatggggcatttccgatg

SEQ ID NO: 21051 - DNA, 24 bp, Artificial Sequence
  Synthetic
gaccttgaaagtggcaaagtttta

SEQ ID NO: 21052 - DNA, 25 bp, Artificial Sequence
  Synthetic
gcatttttattaccacaagctgcca

SEQ ID NO: 21053 - DNA, 25 bp, Artificial Sequence
  Synthetic
ccagtcacaaaatcttctgctgtta

SEQ ID NO: 21054 - DNA, 25 bp, Artificial Sequence
  Synthetic
caacattcttagcatcccagtagtt

SEQ ID NO: 21055 - DNA, 25 bp, Artificial Sequence
  Synthetic
acgaaaatccttgttgttaagagct

SEQ ID NO: 21056 - DNA, 25 bp, Artificial Sequence
  Synthetic
ctaattgaactgggaaggttacacc

SEQ ID NO: 21057 - DNA, 20 bp, Artificial Sequence
  Synthetic
tgtgtcatcagccagctgta

SEQ ID NO: 21058 - DNA, 20 bp, Artificial Sequence
  Synthetic
ggtgtccactcttgtgcctg

SEQ ID NO: 21059 - DNA, 22 bp, Artificial Sequence
  Synthetic
tgcttggggtaatggctcactg

SEQ ID NO: 21060 - DNA, 23 bp, Artificial Sequence
  Synthetic
cattggattgtaggcatggtttg

SEQ ID NO: 21061 - DNA, 22 bp, Artificial Sequence
  Synthetic
tctgtaatactgccgcgatctg

SEQ ID NO: 21062 - DNA, 20 bp, Artificial Sequence
  Synthetic
caggttttcgaggtgttgca

SEQ ID NO: 21063 - DNA, 24 bp, Artificial Sequence
  Synthetic
cagttggatgagttaggatcatcc

SEQ ID NO: 21064 - DNA, 25 bp, Artificial Sequence
  Synthetic
ggtttgaccatagagtcatattggt

SEQ ID NO: 21065 - DNA, 25 bp, Artificial Sequence
  Synthetic
ccaaaatcatctgattgagcagcta

SEQ ID NO: 21066 - DNA, 23 bp, Artificial Sequence
  Synthetic
ggacgtaattgccctcactattg

SEQ ID NO: 21067 - DNA, 25 bp, Artificial Sequence
  Synthetic
gctgctggtgttttagcaatgataa

SEQ ID NO: 21068 - DNA, 25 bp, Artificial Sequence
  Synthetic
cttctgtgccatacataccatagtt

SEQ ID NO: 21069 - DNA, 25 bp, Artificial Sequence
  Synthetic
aggaatagctcgctctttagggtaa

SEQ ID NO: 21070 - DNA, 21 bp, Artificial Sequence
  Synthetic
tgaaactgattggggctaacg

SEQ ID NO: 21071 - DNA, 23 bp, Artificial Sequence
  Synthetic
tgccttcaaaaatggcagctaaa

SEQ ID NO: 21072 - DNA, 25 bp, Artificial Sequence
  Synthetic
gctccgtatggtaaatagcttgtaa

SEQ ID NO: 21073 - DNA, 25 bp, Artificial Sequence
  Synthetic
gccgattagccttaagtttggttaa

SEQ ID NO: 21074 - DNA, 25 bp, Artificial Sequence
  Synthetic
cgtcatacaacctggtaaataaggt

SEQ ID NO: 21075 - DNA, 22 bp, Artificial Sequence
  Synthetic
ggcttatgcgcttgtttgtaag

SEQ ID NO: 21076 - DNA, 25 bp, Artificial Sequence
  Synthetic
ccgatttttacacacagttgtccta

SEQ ID NO: 21077 - DNA, 25 bp, Artificial Sequence
  Synthetic
agctaattgaacatctgctccaaca

SEQ ID NO: 21078 - DNA, 25 bp, Artificial Sequence
  Synthetic
aatcagattggcctttggtaattgt

SEQ ID NO: 21079 - DNA, 25 bp, Artificial Sequence
  Synthetic
gtgattcttgaagagtaccagcttt

SEQ ID NO: 21080 - DNA, 25 bp, Artificial Sequence
  Synthetic
cggtaccagtcttttctttgttgta

SEQ ID NO: 21081 - DNA, 24 bp, Artificial Sequence
  Synthetic
cacctccccataaaaatcccattt

SEQ ID NO: 21082 - DNA, 25 bp, Artificial Sequence
  Synthetic
cggtatattaagcgacataccagtc

SEQ ID NO: 21083 - DNA, 25 bp, Artificial Sequence
  Synthetic
gcgtcgtaaatggtattggattgat

SEQ ID NO: 21084 - DNA, 25 bp, Artificial Sequence
  Synthetic
ggtgattgacatgttcttgagtcaa

SEQ ID NO: 21085 - DNA, 25 bp, Artificial Sequence
  Synthetic
ggcaacaaatcagcaatcttgttaa

SEQ ID NO: 21086 - DNA, 25 bp, Artificial Sequence
  Synthetic
gatcgcctttgttactagattctct

SEQ ID NO: 21087 - DNA, 25 bp, Artificial Sequence
  Synthetic
ccacatatttgctttcttctagggt

SEQ ID NO: 21088 - DNA, 25 bp, Artificial Sequence
  Synthetic
ggtctaaaagagcaactcgattcaa

SEQ ID NO: 21089 - DNA, 22 bp, Artificial Sequence
  Synthetic
gccccaaagccttagaaagatt

SEQ ID NO: 21090 - DNA, 24 bp, Artificial Sequence
  Synthetic
cccttaagcatggtgataccgttt

SEQ ID NO: 21091 - DNA, 25 bp, Artificial Sequence
  Synthetic
ggtctccatgcaaatgagtaatgaa

SEQ ID NO: 21092 - DNA, 25 bp, Artificial Sequence
  Synthetic
cgtctagggttccttctaagtcttt

SEQ ID NO: 21093 - DNA, 21 bp, Artificial Sequence
  Synthetic
gcttcatgagcgatttgtgct

SEQ ID NO: 21094 - DNA, 21 bp, Artificial Sequence
  Synthetic
tccaactcgaggcattctttg

SEQ ID NO: 21095 - DNA, 21 bp, Artificial Sequence
  Synthetic
tccgataagggcaaacttggt

SEQ ID NO: 21096 - DNA, 25 bp, Artificial Sequence
  Synthetic
ccgctgttaaaaactcatctaaggc

SEQ ID NO: 21097 - DNA, 22 bp, Artificial Sequence
  Synthetic
ttaggcgtgtcaagaagacctt

SEQ ID NO: 21098 - DNA, 23 bp, Artificial Sequence
  Synthetic
tgagggcttcaactaaagcatcc

SEQ ID NO: 21099 - DNA, 21 bp, Artificial Sequence
  Synthetic
agccccatcagcaatcatttg

SEQ ID NO: 21100 - DNA, 25 bp, Artificial Sequence
  Synthetic
caaacgtcttgtgttacctcttgat

SEQ ID NO: 21101 - DNA, 21 bp, Artificial Sequence
  Synthetic
tgacatcgtgtacgcgtacaa

SEQ ID NO: 21102 - DNA, 23 bp, Artificial Sequence
  Synthetic
gttcacaaatcgcacctgctaaa

SEQ ID NO: 21103 - DNA, 25 bp, Artificial Sequence
  Synthetic
aagagattgctcaatagcttgtgtt

SEQ ID NO: 21104 - DNA, 23 bp, Artificial Sequence
  Synthetic
ggaaaagccaagaaatctgctgg

SEQ ID NO: 21105 - DNA, 23 bp, Artificial Sequence
  Synthetic
agcacccgcattcataaaaacag

SEQ ID NO: 21106 - DNA, 25 bp, Artificial Sequence
  Synthetic
gccctttaagatttgcttccatgat

SEQ ID NO: 21107 - DNA, 24 bp, Artificial Sequence
  Synthetic
ggttacttgattttcgttgtgcag

SEQ ID NO: 21108 - DNA, 24 bp, Artificial Sequence
  Synthetic
ggccttcaattcccttgtcaaatt

SEQ ID NO: 21109 - DNA, 22 bp, Artificial Sequence
  Synthetic
agcaacacgttggcaaaccatt

SEQ ID NO: 21110 - DNA, 22 bp, Artificial Sequence
  Synthetic
tattgccaccccatttgccatt

SEQ ID NO: 21111 - DNA, 25 bp, Artificial Sequence
  Synthetic
tggaggaattatggaaaatcaggaa

SEQ ID NO: 21112 - DNA, 23 bp, Artificial Sequence
  Synthetic
ttacctttcctttgcctacgttg

SEQ ID NO: 21113 - DNA, 25 bp, Artificial Sequence
  Synthetic
cggaagaaaaagatggtattgatgc

SEQ ID NO: 21114 - DNA, 25 bp, Artificial Sequence
  Synthetic
acaggctggtaccaattactcatta

SEQ ID NO: 21115 - DNA, 25 bp, Artificial Sequence
  Synthetic
ccagttacgtctttggaaaatgttt

SEQ ID NO: 21116 - DNA, 24 bp, Artificial Sequence
  Synthetic
gaatgtgccaagttgcaaaaatct

SEQ ID NO: 21117 - DNA, 23 bp, Artificial Sequence
  Synthetic
cttagtgactacacgcccaaaag

SEQ ID NO: 21118 - DNA, 20 bp, Artificial Sequence
  Synthetic
tgacgtgacagtcgaaagca

SEQ ID NO: 21119 - DNA, 24 bp, Artificial Sequence
  Synthetic
aggtctgcgctaagatatggtata

SEQ ID NO: 21120 - DNA, 21 bp, Artificial Sequence
  Synthetic
gaaggagatttcggacgaacc

SEQ ID NO: 21121 - DNA, 25 bp, Artificial Sequence
  Synthetic
tgcatttaatcttggagagcaagaa

SEQ ID NO: 21122 - DNA, 25 bp, Artificial Sequence
  Synthetic
tgctcttcctagatctcaaaaaagg

SEQ ID NO: 21123 - DNA, 21 bp, Artificial Sequence
  Synthetic
ggtggcggtgtagtggtttta

SEQ ID NO: 21124 - DNA, 22 bp, Artificial Sequence
  Synthetic
tgcagccttgcttgttaaacaa

SEQ ID NO: 21125 - DNA, 25 bp, Artificial Sequence
  Synthetic
aggaactatcatatcaggaggtctt

SEQ ID NO: 21126 - DNA, 25 bp, Artificial Sequence
  Synthetic
actcgaaaccatacagaagaaatga

SEQ ID NO: 21127 - DNA, 25 bp, Artificial Sequence
  Synthetic
cgcgaaatgctaagattatcggtaa

SEQ ID NO: 21128 - DNA, 25 bp, Artificial Sequence
  Synthetic
tcagccttctatcttgattttgcta

SEQ ID NO: 21129 - DNA, 23 bp, Artificial Sequence
  Synthetic
gcagatattcttcgactttgggt

SEQ ID NO: 21130 - DNA, 24 bp, Artificial Sequence
  Synthetic
ccaaatggcgagtttacaaaagaa

SEQ ID NO: 21131 - DNA, 24 bp, Artificial Sequence
  Synthetic
tctgtttctgatttccgtcaagat

SEQ ID NO: 21132 - DNA, 21 bp, Artificial Sequence
  Synthetic
gttacccttgagtcagggaca

SEQ ID NO: 21133 - DNA, 25 bp, Artificial Sequence
  Synthetic
cgattcaacctctttatactacgcc

SEQ ID NO: 21134 - DNA, 25 bp, Artificial Sequence
  Synthetic
cgtaaggagatggatttagcagaat

SEQ ID NO: 21135 - DNA, 20 bp, Artificial Sequence
  Synthetic
aaacagcctttccaatgcgc

SEQ ID NO: 21136 - DNA, 25 bp, Artificial Sequence
  Synthetic
agaggtaaatctcagtgaaacacaa

SEQ ID NO: 21137 - DNA, 25 bp, Artificial Sequence
  Synthetic
aggattaaaccgagtataagcgtag

SEQ ID NO: 21138 - DNA, 20 bp, Artificial Sequence
  Synthetic
ccttttcacggcggtaacac

SEQ ID NO: 21139 - DNA, 22 bp, Artificial Sequence
  Synthetic
gccccctgtgagataaggtagt

SEQ ID NO: 21140 - DNA, 22 bp, Artificial Sequence
  Synthetic
tggacttaccgctggtgtacca

SEQ ID NO: 21141 - DNA, 22 bp, Artificial Sequence
  Synthetic
gggcttagtgatccggtggtac

SEQ ID NO: 21142 - DNA, 22 bp, Artificial Sequence
  Synthetic
cgcagtgaataggcccaagcaa

SEQ ID NO: 21143 - DNA, 20 bp, Artificial Sequence
  Synthetic
gagtccggctaagcagtgag

SEQ ID NO: 21144 - DNA, 22 bp, Artificial Sequence
  Synthetic
tgtaccggggctaaaacagttt

SEQ ID NO: 21145 - DNA, 22 bp, Artificial Sequence
  Synthetic
cctacaacaagttcgagcccgt

SEQ ID NO: 21146 - DNA, 20 bp, Artificial Sequence
  Synthetic
tgagaggtcttgtggggcct

SEQ ID NO: 21147 - DNA, 25 bp, Artificial Sequence
  Synthetic
cgaaacgtaaagaagaagttgacct

SEQ ID NO: 21148 - DNA, 20 bp, Artificial Sequence
  Synthetic
gcagacaaccaaccagctgt

SEQ ID NO: 21149 - DNA, 24 bp, Artificial Sequence
  Synthetic
tgcaggattgtcattgtcagaaat

SEQ ID NO: 21150 - DNA, 24 bp, Artificial Sequence
  Synthetic
tccttgaattaggtgatggtgtct

SEQ ID NO: 21151 - DNA, 25 bp, Artificial Sequence
  Synthetic
tcgtacaactccttcagtagtatca

SEQ ID NO: 21152 - DNA, 25 bp, Artificial Sequence
  Synthetic
ccagcgatggtagttgtttataact

SEQ ID NO: 21153 - DNA, 21 bp, Artificial Sequence
  Synthetic
tcgttctcaggatctggcaaa

SEQ ID NO: 21154 - DNA, 25 bp, Artificial Sequence
  Synthetic
cgtaggtctgttagtttggtaaaca

SEQ ID NO: 21155 - DNA, 25 bp, Artificial Sequence
  Synthetic
gcagtttgctattccaagaaacttt

SEQ ID NO: 21156 - DNA, 23 bp, Artificial Sequence
  Synthetic
tggcaaaactagagaagttggga

SEQ ID NO: 21157 - DNA, 23 bp, Artificial Sequence
  Synthetic
gtcacatcacctcgtctatcacg

SEQ ID NO: 21158 - DNA, 20 bp, Artificial Sequence
  Synthetic
atttggtgagcacgagggat

SEQ ID NO: 21159 - DNA, 25 bp, Artificial Sequence
  Synthetic
acgatcgctggattctaaatttttg

SEQ ID NO: 21160 - DNA, 20 bp, Artificial Sequence
  Synthetic
ttgccgtattgctgttccgt

SEQ ID NO: 21161 - DNA, 25 bp, Artificial Sequence
  Synthetic
tctggtagtttttctttgaccttct

SEQ ID NO: 21162 - DNA, 25 bp, Artificial Sequence
  Synthetic
cataggctggcgatcaataaagatc

SEQ ID NO: 21163 - DNA, 25 bp, Artificial Sequence
  Synthetic
gagtttatcaaacgcttgaaaggct

SEQ ID NO: 21164 - DNA, 24 bp, Artificial Sequence
  Synthetic
agggtttgattttgccaaatcttg

SEQ ID NO: 21165 - DNA, 24 bp, Artificial Sequence
  Synthetic
cccgttcaaattggctcttgtatt

SEQ ID NO: 21166 - DNA, 20 bp, Artificial Sequence
  Synthetic
ggcttcttgttcagggaggg

SEQ ID NO: 21167 - DNA, 20 bp, Artificial Sequence
  Synthetic
acatgatgcgctcagaaggg

SEQ ID NO: 21168 - DNA, 25 bp, Artificial Sequence
  Synthetic
cagaaaaagcagctgaattggtaca

SEQ ID NO: 21169 - DNA, 25 bp, Artificial Sequence
  Synthetic
aggaccgtcatgaatactaaaatgt

SEQ ID NO: 21170 - DNA, 20 bp, Artificial Sequence
  Synthetic
attgcggtgtgaagacctgc

SEQ ID NO: 21171 - DNA, 25 bp, Artificial Sequence
  Synthetic
tccctacctagaagtttgtacttgt

SEQ ID NO: 21172 - DNA, 24 bp, Artificial Sequence
  Synthetic
gccaaatcgtaaacaacgttggaa

SEQ ID NO: 21173 - DNA, 23 bp, Artificial Sequence
  Synthetic
agaagcttcgcaatcactatcaa

SEQ ID NO: 21174 - DNA, 25 bp, Artificial Sequence
  Synthetic
cgatcagtgggttattggttatacg

SEQ ID NO: 21175 - DNA, 21 bp, Artificial Sequence
  Synthetic
agcgtgacaaccaatccattg

SEQ ID NO: 21176 - DNA, 25 bp, Artificial Sequence
  Synthetic
agtgaaaatccgactttcagaagtt

SEQ ID NO: 21177 - DNA, 22 bp, Artificial Sequence
  Synthetic
gcattagcaaaggcggtagccg

SEQ ID NO: 21178 - DNA, 21 bp, Artificial Sequence
  Synthetic
atgcaacggcggatgttgttg

SEQ ID NO: 21179 - DNA, 20 bp, Artificial Sequence
  Synthetic
gtccggcaacaacgcctcag

SEQ ID NO: 21180 - DNA, 21 bp, Artificial Sequence
  Synthetic
gggcatggggcaaggatttgc

SEQ ID NO: 21181 - DNA, 21 bp, Artificial Sequence
  Synthetic
gtgagggcgtactcatcggtg

SEQ ID NO: 21182 - DNA, 22 bp, Artificial Sequence
  Synthetic
tgacacccaatcccgacactgt

SEQ ID NO: 21183 - DNA, 22 bp, Artificial Sequence
  Synthetic
gcgcggatggtccaattatcca

SEQ ID NO: 21184 - DNA, 20 bp, Artificial Sequence
  Synthetic
ccaagatgcaggcgggggag

SEQ ID NO: 21185 - DNA, 22 bp, Artificial Sequence
  Synthetic
cctcataaactgccgccccatc

SEQ ID NO: 21186 - DNA, 21 bp, Artificial Sequence
  Synthetic
actcctgataggccacctgca

SEQ ID NO: 21187 - DNA, 22 bp, Artificial Sequence
  Synthetic
gccctccattgcgccttaagtt

SEQ ID NO: 21188 - DNA, 22 bp, Artificial Sequence
  Synthetic
actgtagccgccattctgttgg

SEQ ID NO: 21189 - DNA, 20 bp, Artificial Sequence
  Synthetic
gcctgtggccgaatgcttcg

SEQ ID NO: 21190 - DNA, 20 bp, Artificial Sequence
  Synthetic
aacagacggagcgactcccg

SEQ ID NO: 21191 - DNA, 21 bp, Artificial Sequence
  Synthetic
cgaacggagcaggtggtacaa

SEQ ID NO: 21192 - DNA, 22 bp, Artificial Sequence
  Synthetic
ctgcgtacgagccaacatcact

SEQ ID NO: 21193 - DNA, 19 bp, Artificial Sequence
  Synthetic
ttgagggccagaccaggct

SEQ ID NO: 21194 - DNA, 19 bp, Artificial Sequence
  Synthetic
attggtccgttggggcggg

SEQ ID NO: 21195 - DNA, 20 bp, Artificial Sequence
  Synthetic
ccaccgacgtggggactgtt

SEQ ID NO: 21196 - DNA, 22 bp, Artificial Sequence
  Synthetic
gcgatattcaacctggagggcg

SEQ ID NO: 21197 - DNA, 22 bp, Artificial Sequence
  Synthetic
ctctgcagagggcaaggtcacc

SEQ ID NO: 21198 - DNA, 25 bp, Artificial Sequence
  Synthetic
ctatcagagtcagtggtgttgtaat

SEQ ID NO: 21199 - DNA, 25 bp, Artificial Sequence
  Synthetic
cctaaccagtttacaaacttgacga

SEQ ID NO: 21200 - DNA, 21 bp, Artificial Sequence
  Synthetic
ccaaaagcaacaaaacggcat

SEQ ID NO: 21201 - DNA, 25 bp, Artificial Sequence
  Synthetic
ccacaattgcatttaacaaaagcat

SEQ ID NO: 21202 - DNA, 25 bp, Artificial Sequence
  Synthetic
gctagcagcaaatttaacatcttct

SEQ ID NO: 21203 - DNA, 25 bp, Artificial Sequence
  Synthetic
caacaatcttacctttagggcaaac

SEQ ID NO: 21204 - DNA, 25 bp, Artificial Sequence
  Synthetic
gctcccaaacattataacagtcctt

SEQ ID NO: 21205 - DNA, 25 bp, Artificial Sequence
  Synthetic
caagcaattttaccaaaacacgtct

SEQ ID NO: 21206 - DNA, 25 bp, Artificial Sequence
  Synthetic
gcaacttaatatgttgcccaatgac

SEQ ID NO: 21207 - DNA, 25 bp, Artificial Sequence
  Synthetic
acaacactcacctttttgaaaaagt

SEQ ID NO: 21208 - DNA, 25 bp, Artificial Sequence
  Synthetic
agaaacacagtttacaaggtgtgaa

SEQ ID NO: 21209 - DNA, 25 bp, Artificial Sequence
  Synthetic
cacacaacgaccaagatttttatca

SEQ ID NO: 21210 - DNA, 25 bp, Artificial Sequence
  Synthetic
tggagctacagataagacagtatca

SEQ ID NO: 21211 - DNA, 23 bp, Artificial Sequence
  Synthetic
aaccatctttaagcacactagca

SEQ ID NO: 21212 - DNA, 25 bp, Artificial Sequence
  Synthetic
caaacttagcctcatgccattgatt

SEQ ID NO: 21213 - DNA, 25 bp, Artificial Sequence
  Synthetic
acacgtccatcattaacataccatt

SEQ ID NO: 21214 - DNA, 24 bp, Artificial Sequence
  Synthetic
gcataatctaacatagccttggct

SEQ ID NO: 21215 - DNA, 24 bp, Artificial Sequence
  Synthetic
gacactgaaaaattatgcaaacgc

SEQ ID NO: 21216 - DNA, 25 bp, Artificial Sequence
  Synthetic
actaggttggtcatcaaaattacca

SEQ ID NO: 21217 - DNA, 25 bp, Artificial Sequence
  Synthetic
tgaagtccattagcaaccatgtatt

SEQ ID NO: 21218 - DNA, 25 bp, Artificial Sequence
  Synthetic
ggcacgcttcaattgtttaataagt

SEQ ID NO: 21219 - DNA, 25 bp, Artificial Sequence
  Synthetic
gaacaggtctaccatcattgtcttt

SEQ ID NO: 21220 - DNA, 25 bp, Artificial Sequence
  Synthetic
tccagaattaacagccaattcagtt

SEQ ID NO: 21221 - DNA, 25 bp, Artificial Sequence
  Synthetic
caacaaccacaaacattacacacat

SEQ ID NO: 21222 - DNA, 24 bp, Artificial Sequence
  Synthetic
gccaaagcaccagaaaagttaagt

SEQ ID NO: 21223 - DNA, 23 bp, Artificial Sequence
  Synthetic
acgcatttaagcatagctctagc

SEQ ID NO: 21224 - DNA, 25 bp, Artificial Sequence
  Synthetic
cctaactgagtgtgtgttaacatct

SEQ ID NO: 21225 - DNA, 25 bp, Artificial Sequence
  Synthetic
gcacgttctttaccactaatagcat

SEQ ID NO: 21226 - DNA, 25 bp, Artificial Sequence
  Synthetic
gcctataaaacctatctgttgcagt

SEQ ID NO: 21227 - DNA, 25 bp, Artificial Sequence
  Synthetic
ggtaccatctttgtcaactatttgc

SEQ ID NO: 21228 - DNA, 24 bp, Artificial Sequence
  Synthetic
ccagcagcttgcaatattgtagaa

SEQ ID NO: 21229 - DNA, 25 bp, Artificial Sequence
  Synthetic
gctagaatacttctcttggtttgca

SEQ ID NO: 21230 - DNA, 22 bp, Artificial Sequence
  Synthetic
gccacaaacatgagcactttca

SEQ ID NO: 21231 - DNA, 21 bp, Artificial Sequence
  Synthetic
ggaaccaacataaccccactg

SEQ ID NO: 21232 - DNA, 25 bp, Artificial Sequence
  Synthetic
tgggttgcataatcataatccaaca

SEQ ID NO: 21233 - DNA, 25 bp, Artificial Sequence
  Synthetic
gcaacattagtaggcaatgttgttt

SEQ ID NO: 21234 - DNA, 23 bp, Artificial Sequence
  Synthetic
caccacaacatccacctataagg

SEQ ID NO: 21235 - DNA, 21 bp, Artificial Sequence
  Synthetic
acacctttgtcagaaccagca

SEQ ID NO: 21236 - DNA, 25 bp, Artificial Sequence
  Synthetic
gttgaagaattgtcaggaacaccta

SEQ ID NO: 21237 - DNA, 25 bp, Artificial Sequence
  Synthetic
tggcacataaaaagtacgagttaca

SEQ ID NO: 21238 - DNA, 20 bp, Artificial Sequence
  Synthetic
agaccccgtccactagtgtg

SEQ ID NO: 21239 - DNA, 25 bp, Artificial Sequence
  Synthetic
atgagtagtgttgatagtgctgttt

SEQ ID NO: 21240 - DNA, 25 bp, Artificial Sequence
  Synthetic
agtctcaggcaaaacattatcatca

SEQ ID NO: 21241 - DNA, 22 bp, Artificial Sequence
  Synthetic
gtctggttggttacatggtgtc

SEQ ID NO: 21242 - DNA, 25 bp, Artificial Sequence
  Synthetic
gctaaacaacaaatcttccaaagca

SEQ ID NO: 21243 - DNA, 25 bp, Artificial Sequence
  Synthetic
gcctgaattgaattagaaatggcct

SEQ ID NO: 21244 - DNA, 20 bp, Artificial Sequence
  Synthetic
ggttgacgcagaacatagcc

SEQ ID NO: 21245 - DNA, 25 bp, Artificial Sequence
  Synthetic
caacaaaacacaagaagactcaaca

SEQ ID NO: 21246 - DNA, 25 bp, Artificial Sequence
  Synthetic
ggcacactactattagacatcgttt

SEQ ID NO: 21247 - DNA, 24 bp, Artificial Sequence
  Synthetic
gcagccatcaccggtaagtaataa

SEQ ID NO: 21248 - DNA, 24 bp, Artificial Sequence
  Synthetic
ggaaatttcttcctagcagctctg

SEQ ID NO: 21249 - DNA, 22 bp, Artificial Sequence
  Synthetic
cgtttgcgattaccaagactgg

SEQ ID NO: 21250 - DNA, 25 bp, Artificial Sequence
  Synthetic
ggtgacttcgactggttatcaaaac

SEQ ID NO: 21251 - DNA, 25 bp, Artificial Sequence
  Synthetic
cagtgctaacctcactatcaaagaa

SEQ ID NO: 21252 - DNA, 25 bp, Artificial Sequence
  Synthetic
cggtacctcataagactcctgataa

SEQ ID NO: 21253 - DNA, 24 bp, Artificial Sequence
  Synthetic
tcaccaagtgaggtttcctctaac

SEQ ID NO: 21254 - DNA, 23 bp, Artificial Sequence
  Synthetic
acaggttttgttgctcttgtacg

SEQ ID NO: 21255 - DNA, 25 bp, Artificial Sequence
  Synthetic
ccccatgtaaaaacagttgaagaca

SEQ ID NO: 21256 - DNA, 25 bp, Artificial Sequence
  Synthetic
gcgaaatggaaaagaacttgttctt

SEQ ID NO: 21257 - DNA, 20 bp, Artificial Sequence
  Synthetic
aacctcaagtgtgctgccac

SEQ ID NO: 21258 - DNA, 20 bp, Artificial Sequence
  Synthetic
tgctgggcggtgtcactctc

SEQ ID NO: 21259 - DNA, 23 bp, Artificial Sequence
  Synthetic
caagaaacttctctcgttgagcc

SEQ ID NO: 21260 - DNA, 25 bp, Artificial Sequence
  Synthetic
tcagcaattgttgtatgctcaattt

SEQ ID NO: 21261 - DNA, 25 bp, Artificial Sequence
  Synthetic
gttggtattgggaagtctctaccta

SEQ ID NO: 21262 - DNA, 21 bp, Artificial Sequence
  Synthetic
ctaccaaggggatatcctcgc

SEQ ID NO: 21263 - DNA, 22 bp, Artificial Sequence
  Synthetic
cactggtgtctgagcaagagca

SEQ ID NO: 21264 - DNA, 25 bp, Artificial Sequence
  Synthetic
tggaactaatgactgttgtttgact

SEQ ID NO: 21265 - DNA, 23 bp, Artificial Sequence
  Synthetic
gttgcatggtagaagagattggt

SEQ ID NO: 21266 - DNA, 25 bp, Artificial Sequence
  Synthetic
ttgtctagaatctccatttgcatga

SEQ ID NO: 21267 - DNA, 25 bp, Artificial Sequence
  Synthetic
gcttgaacaacatctaaagggacat

SEQ ID NO: 21268 - DNA, 22 bp, Artificial Sequence
  Synthetic
tcgctgaagccagtaagatcta

SEQ ID NO: 21269 - DNA, 25 bp, Artificial Sequence
  Synthetic
gggattaacaaaaagaaaggacagc

SEQ ID NO: 21270 - DNA, 20 bp, Artificial Sequence
  Synthetic
gttggcaaaccgtctttggg

SEQ ID NO: 21271 - DNA, 22 bp, Artificial Sequence
  Synthetic
cagttctctgatggagagcaga

SEQ ID NO: 21272 - DNA, 22 bp, Artificial Sequence
  Synthetic
ggaatttccctgactttgtggt

SEQ ID NO: 21273 - DNA, 23 bp, Artificial Sequence
  Synthetic
tgtcaacttcatttggcaacgat

SEQ ID NO: 21274 - DNA, 25 bp, Artificial Sequence
  Synthetic
gcaatatccattcaggtgtttttcc

SEQ ID NO: 21275 - DNA, 25 bp, Artificial Sequence
  Synthetic
gctgcaaccaaaaatgacttttact

SEQ ID NO: 21276 - DNA, 25 bp, Artificial Sequence
  Synthetic
gcacttgctcttgttttattaaggt

SEQ ID NO: 21277 - DNA, 24 bp, Artificial Sequence
  Synthetic
cctctaccagttccaataccaaga

SEQ ID NO: 21278 - DNA, 24 bp, Artificial Sequence
  Synthetic
ggaagatcagaagcagggtgaatt

SEQ ID NO: 21279 - DNA, 20 bp, Artificial Sequence
  Synthetic
gtgtcaaagctggatgcacg

SEQ ID NO: 21280 - DNA, 25 bp, Artificial Sequence
  Synthetic
ctcctgctttgtcatgatcactatt

SEQ ID NO: 21281 - DNA, 25 bp, Artificial Sequence
  Synthetic
gggcacatcagataaatttccttgt

SEQ ID NO: 21282 - DNA, 25 bp, Artificial Sequence
  Synthetic
tgggaacagcaaaataattgtctgt

SEQ ID NO: 21283 - DNA, 25 bp, Artificial Sequence
  Synthetic
cataccgtacttaaggagtcacatc

SEQ ID NO: 21284 - DNA, 22 bp, Artificial Sequence
  Synthetic
gacccacctcaatttgtgttgt

SEQ ID NO: 21285 - DNA, 22 bp, Artificial Sequence
  Synthetic
gctcaaacccttcaattccagc

SEQ ID NO: 21286 - DNA, 20 bp, Artificial Sequence
  Synthetic
gggtgcttgaggaaggttcc

SEQ ID NO: 21287 - DNA, 20 bp, Artificial Sequence
  Synthetic
gactcccaccgcagtttcag

SEQ ID NO: 21288 - DNA, 25 bp, Artificial Sequence
  Synthetic
gggaaaatttagcctatagcctagg

SEQ ID NO: 21289 - DNA, 20 bp, Artificial Sequence
  Synthetic
acactgcaaggtgacgttcc

SEQ ID NO: 21290 - DNA, 25 bp, Artificial Sequence
  Synthetic
gcagtcctatcaactgattgaatca

SEQ ID NO: 21291 - DNA, 25 bp, Artificial Sequence
  Synthetic
atgccaaatcttgcatatgtatggt

SEQ ID NO: 21292 - DNA, 25 bp, Artificial Sequence
  Synthetic
accaaactctaattgtcaattccca

SEQ ID NO: 21293 - DNA, 25 bp, Artificial Sequence
  Synthetic
atgagtaattttgatcccaccaccc

SEQ ID NO: 21294 - DNA, 25 bp, Artificial Sequence
  Synthetic
gccaggaacaaaacaaaacagtaat

SEQ ID NO: 21295 - DNA, 25 bp, Artificial Sequence
  Synthetic
cgttagaaggagaggtcaatctgtt

SEQ ID NO: 21296 - DNA, 21 bp, Artificial Sequence
  Synthetic
tgttgtgatagctcccacagg

SEQ ID NO: 21297 - DNA, 25 bp, Artificial Sequence
  Synthetic
tgaaacaagttgaaaaaccacctca

SEQ ID NO: 21298 - DNA, 25 bp, Artificial Sequence
  Synthetic
gcttcctgcattctatatgactctc

SEQ ID NO: 21299 - DNA, 25 bp, Artificial Sequence
  Synthetic
aatccaaacctccttaaagctctag

SEQ ID NO: 21300 - DNA, 22 bp, Artificial Sequence
  Synthetic
cctcatctgttgtgttttggcc

SEQ ID NO: 21301 - DNA, 25 bp, Artificial Sequence
  Synthetic
caacccacttgtgattagtaacaga

SEQ ID NO: 21302 - DNA, 24 bp, Artificial Sequence
  Synthetic
caactccaaactgaaccaagttct

SEQ ID NO: 21303 - DNA, 22 bp, Artificial Sequence
  Synthetic
tgcccaagattgcattctgtat

SEQ ID NO: 21304 - DNA, 25 bp, Artificial Sequence
  Synthetic
gccattggatcaatttcagctttag

SEQ ID NO: 21305 - DNA, 25 bp, Artificial Sequence
  Synthetic
gcaataaaccattttcatccaacca

SEQ ID NO: 21306 - DNA, 25 bp, Artificial Sequence
  Synthetic
cctgtatggaaacctggattcaaat

SEQ ID NO: 21307 - DNA, 20 bp, Artificial Sequence
  Synthetic
ttgccgtgctgttgtcattt

SEQ ID NO: 21308 - DNA, 22 bp, Artificial Sequence
  Synthetic
tttgctgcgttcaacaaaaagg

SEQ ID NO: 21309 - DNA, 25 bp, Artificial Sequence
  Synthetic
cccccaaatgtacagtttgtcaaat

SEQ ID NO: 21310 - DNA, 24 bp, Artificial Sequence
  Synthetic
cgtattttgaagtaaccccgagga

SEQ ID NO: 21311 - DNA, 25 bp, Artificial Sequence
  Synthetic
ccattttctatgaaacccgcgattg

SEQ ID NO: 21312 - DNA, 23 bp, Artificial Sequence
  Synthetic
cgcgttgtatgaccagagatcta

SEQ ID NO: 21313 - DNA, 25 bp, Artificial Sequence
  Synthetic
aggatccaatctttgtatcctgact

SEQ ID NO: 21314 - DNA, 25 bp, Artificial Sequence
  Synthetic
tccatctcaacaatgaacagagatc

SEQ ID NO: 21315 - DNA, 25 bp, Artificial Sequence
  Synthetic
tcgtcccttgactgttttttcataa

SEQ ID NO: 21316 - DNA, 20 bp, Artificial Sequence
  Synthetic
caggtcaatgggcaggacaa

SEQ ID NO: 21317 - DNA, 25 bp, Artificial Sequence
  Synthetic
acacccttctttaggatcaatacct

SEQ ID NO: 21318 - DNA, 22 bp, Artificial Sequence
  Synthetic
gctaagctgctgcaactctttc

SEQ ID NO: 21319 - DNA, 25 bp, Artificial Sequence
  Synthetic
cccgacaacaagtcttattgctatt

SEQ ID NO: 21320 - DNA, 20 bp, Artificial Sequence
  Synthetic
tgaagccacccatgaccatg

SEQ ID NO: 21321 - DNA, 20 bp, Artificial Sequence
  Synthetic
atgtgccagctgccttacag

SEQ ID NO: 21322 - DNA, 20 bp, Artificial Sequence
  Synthetic
actgaaggtgcaacagggtc

SEQ ID NO: 21323 - DNA, 20 bp, Artificial Sequence
  Synthetic
ttgagtgccaacctgtgctc

SEQ ID NO: 21324 - DNA, 23 bp, Artificial Sequence
  Synthetic
accacaatgatgacatctgcaaa

SEQ ID NO: 21325 - DNA, 22 bp, Artificial Sequence
  Synthetic
cggtaagtgtaccctaaaggcc

SEQ ID NO: 21326 - DNA, 20 bp, Artificial Sequence
  Synthetic
ccaatgttcccccaagcagg

SEQ ID NO: 21327 - DNA, 25 bp, Artificial Sequence
  Synthetic
cctctacaaaacatatgtctggcat

SEQ ID NO: 21328 - DNA, 25 bp, Artificial Sequence
  Synthetic
caatgtcacagtagttaccaggatg

SEQ ID NO: 21329 - DNA, 21 bp, Artificial Sequence
  Synthetic
cagcagaaagccggattgaat

SEQ ID NO: 21330 - DNA, 22 bp, Artificial Sequence
  Synthetic
tgacacaaacatgcaaccatgc

SEQ ID NO: 21331 - DNA, 22 bp, Artificial Sequence
  Synthetic
tcgaggataacaggaacactcc

SEQ ID NO: 21332 - DNA, 20 bp, Artificial Sequence
  Synthetic
tcccatccacacgtcatctc

SEQ ID NO: 21333 - DNA, 18 bp, Artificial Sequence
  Synthetic
gctgctccagcgtgtcgt

SEQ ID NO: 21334 - DNA, 21 bp, Artificial Sequence
  Synthetic
gctctcccactccaacacggg

SEQ ID NO: 21335 - DNA, 22 bp, Artificial Sequence
  Synthetic
tgcggagatgtggagagaaacg

SEQ ID NO: 21336 - DNA, 22 bp, Artificial Sequence
  Synthetic
acgtatacgaagggtggctcgt

SEQ ID NO: 21337 - DNA, 18 bp, Artificial Sequence
  Synthetic
tccgttgtgctcgacgcc

SEQ ID NO: 21338 - DNA, 22 bp, Artificial Sequence
  Synthetic
gcgtatcctcgtctgccctctg

SEQ ID NO: 21339 - DNA, 22 bp, Artificial Sequence
  Synthetic
gcggggctttctttgagttcgc

SEQ ID NO: 21340 - DNA, 19 bp, Artificial Sequence
  Synthetic
tctcgccgaggacgcgttc

SEQ ID NO: 21341 - DNA, 21 bp, Artificial Sequence
  Synthetic
ataccattcccaaccatccct

SEQ ID NO: 21342 - DNA, 20 bp, Artificial Sequence
  Synthetic
tggttaagctgggcgattgt

SEQ ID NO: 21343 - DNA, 20 bp, Artificial Sequence
  Synthetic
tgtgagtcaaaacggaggct

SEQ ID NO: 21344 - DNA, 21 bp, Artificial Sequence
  Synthetic
ccatttcccacaaagtctgcc

SEQ ID NO: 21345 - DNA, 22 bp, Artificial Sequence
  Synthetic
tgcaagtttgtaaggcgtgttt

SEQ ID NO: 21346 - DNA, 25 bp, Artificial Sequence
  Synthetic
cctctatgttgcgaaagtatgcttt

SEQ ID NO: 21347 - DNA, 23 bp, Artificial Sequence
  Synthetic
tctgcggtaaacctgtactagat

SEQ ID NO: 21348 - DNA, 20 bp, Artificial Sequence
  Synthetic
cagtgcgacacaactaacga

SEQ ID NO: 21349 - DNA, 21 bp, Artificial Sequence
  Synthetic
cgccccggctttataacattt

SEQ ID NO: 21350 - DNA, 21 bp, Artificial Sequence
  Synthetic
gttgctgtccggttgtaacat

SEQ ID NO: 21351 - DNA, 20 bp, Artificial Sequence
  Synthetic
ttttccccccctgatcggag

SEQ ID NO: 21352 - DNA, 20 bp, Artificial Sequence
  Synthetic
accctcgggaaggttctctt

SEQ ID NO: 21353 - DNA, 20 bp, Artificial Sequence
  Synthetic
atcgcgcaatcgaaccattc

SEQ ID NO: 21354 - DNA, 23 bp, Artificial Sequence
  Synthetic
gcaatgtgatcaacgacgtttta

SEQ ID NO: 21355 - DNA, 24 bp, Artificial Sequence
  Synthetic
caaagcaattcctctatcgcagaa

SEQ ID NO: 21356 - DNA, 22 bp, Artificial Sequence
  Synthetic
cctgtaaactggtctgcttgca

SEQ ID NO: 21357 - DNA, 22 bp, Artificial Sequence
  Synthetic
aatctctaacccgtcatctcca

SEQ ID NO: 21358 - DNA, 25 bp, Artificial Sequence
  Synthetic
cacaaatcatcgtcgaacaataagg

SEQ ID NO: 21359 - DNA, 22 bp, Artificial Sequence
  Synthetic
gattccgccgtactgaaaaaac

SEQ ID NO: 21360 - DNA, 21 bp, Artificial Sequence
  Synthetic
ggcagaacagagaccccccct

SEQ ID NO: 21361 - DNA, 19 bp, Artificial Sequence
  Synthetic
cgcgaagtgttccgcgacg

SEQ ID NO: 21362 - DNA, 20 bp, Artificial Sequence
  Synthetic
gggcgttcgttccgcacata

SEQ ID NO: 21363 - DNA, 19 bp, Artificial Sequence
  Synthetic
gcgatctccacctcgcgtg

SEQ ID NO: 21364 - DNA, 21 bp, Artificial Sequence
  Synthetic
aggaaaacgagtacgcgcacc

SEQ ID NO: 21365 - DNA, 24 bp, Artificial Sequence
  Synthetic
ccgacttcgataaacctcttggtt

SEQ ID NO: 21366 - DNA, 25 bp, Artificial Sequence
  Synthetic
tcctttttcaatttcttcttcccct

SEQ ID NO: 21367 - DNA, 22 bp, Artificial Sequence
  Synthetic
tggaacttctggtagctcatgg

SEQ ID NO: 21368 - DNA, 20 bp, Artificial Sequence
  Synthetic
catctcctgtggcccacttg

SEQ ID NO: 21369 - DNA, 25 bp, Artificial Sequence
  Synthetic
agggagccaattttaaagacagtat

SEQ ID NO: 21370 - DNA, 25 bp, Artificial Sequence
  Synthetic
tgagtcccaatactgaaagttttgg

SEQ ID NO: 21371 - DNA, 25 bp, Artificial Sequence
  Synthetic
gaaggttaacagagtgtgttactgt

SEQ ID NO: 21372 - DNA, 20 bp, Artificial Sequence
  Synthetic
tcctgggtaacacgttccat

SEQ ID NO: 21373 - DNA, 23 bp, Artificial Sequence
  Synthetic
agagactttgttggtcagcacta

SEQ ID NO: 21374 - DNA, 25 bp, Artificial Sequence
  Synthetic
cgtggactggtgtatctgaaatgat

SEQ ID NO: 21375 - DNA, 20 bp, Artificial Sequence
  Synthetic
tctaccatccctgtccaccc

SEQ ID NO: 21376 - DNA, 19 bp, Artificial Sequence
  Synthetic
agcacgagccaaggggacg

SEQ ID NO: 21377 - DNA, 19 bp, Artificial Sequence
  Synthetic
aggtgcgtacacggccacc

SEQ ID NO: 21378 - DNA, 20 bp, Artificial Sequence
  Synthetic
tcgttcaggtcaagcgccag

SEQ ID NO: 21379 - DNA, 21 bp, Artificial Sequence
  Synthetic
gcaggagtcggtcgatcgtct

SEQ ID NO: 21380 - DNA, 19 bp, Artificial Sequence
  Synthetic
gccggcgagcgtttgcttg

SEQ ID NO: 21381 - DNA, 20 bp, Artificial Sequence
  Synthetic
ctcatacgccacggggtccc

SEQ ID NO: 21382 - DNA, 19 bp, Artificial Sequence
  Synthetic
gcctccgctgcctatcgga

SEQ ID NO: 21383 - DNA, 20 bp, Artificial Sequence
  Synthetic
ggagaagaggtggcggctca

SEQ ID NO: 21384 - DNA, 19 bp, Artificial Sequence
  Synthetic
ttgcgtcgcttcgagcccg

SEQ ID NO: 21385 - DNA, 21 bp, Artificial Sequence
  Synthetic
gccaagctgtctcgcggatac

SEQ ID NO: 21386 - DNA, 20 bp, Artificial Sequence
  Synthetic
gtatgacggccccagattcg

SEQ ID NO: 21387 - DNA, 21 bp, Artificial Sequence
  Synthetic
atgagaacagctgctctctgt

SEQ ID NO: 21388 - DNA, 22 bp, Artificial Sequence
  Synthetic
cgtctgactgtttgcgattctg

SEQ ID NO: 21389 - DNA, 20 bp, Artificial Sequence
  Synthetic
cgtgcctgctttttagcgtg

SEQ ID NO: 21390 - DNA, 21 bp, Artificial Sequence
  Synthetic
tctcggattgcgtcgttatga

SEQ ID NO: 21391 - DNA, 23 bp, Artificial Sequence
  Synthetic
gcccagagagattgcaactactt

SEQ ID NO: 21392 - DNA, 20 bp, Artificial Sequence
  Synthetic
cggcccattggaacgaacat

SEQ ID NO: 21393 - DNA, 25 bp, Artificial Sequence
  Synthetic
cggtatacgcgtttagtagaatgct

SEQ ID NO: 21394 - DNA, 20 bp, Artificial Sequence
  Synthetic
gcgtgtttagtgggtgcagt

SEQ ID NO: 21395 - DNA, 24 bp, Artificial Sequence
  Synthetic
tcagacctctcatcgttcacataa

SEQ ID NO: 21396 - DNA, 22 bp, Artificial Sequence
  Synthetic
tggaagtccgacagatgcaata

SEQ ID NO: 21397 - DNA, 24 bp, Artificial Sequence
  Synthetic
agtcttagtgaggactgactttga

SEQ ID NO: 21398 - DNA, 24 bp, Artificial Sequence
  Synthetic
tcagacatgggaagcaagatacaa

SEQ ID NO: 21399 - DNA, 21 bp, Artificial Sequence
  Synthetic
acacaaggcaattttagccct

SEQ ID NO: 21400 - DNA, 21 bp, Artificial Sequence
  Synthetic
cgcccatatgctaaacgaacg

SEQ ID NO: 21401 - DNA, 25 bp, Artificial Sequence
  Synthetic
ggactagtgttcgcattagagaatc

SEQ ID NO: 21402 - DNA, 21 bp, Artificial Sequence
  Synthetic
cggcctggaatacaagaccat

SEQ ID NO: 21403 - DNA, 22 bp, Artificial Sequence
  Synthetic
accatgacctcgagaatctctc

SEQ ID NO: 21404 - DNA, 22 bp, Artificial Sequence
  Synthetic
agacgttcgagacctgttcaaa

SEQ ID NO: 21405 - DNA, 23 bp, Artificial Sequence
  Synthetic
acaaccattgagtgagaatacgc

SEQ ID NO: 21406 - DNA, 19 bp, Artificial Sequence
  Synthetic
cgagccaaggggacgatcc

SEQ ID NO: 21407 - DNA, 21 bp, Artificial Sequence
  Synthetic
cgtctccgatccgtcaggacc

SEQ ID NO: 21408 - DNA, 21 bp, Artificial Sequence
  Synthetic
tctcgctccgcttggttttcc

SEQ ID NO: 21409 - DNA, 21 bp, Artificial Sequence
  Synthetic
gtctgcggaccccgatgtaaa

SEQ ID NO: 21410 - DNA, 20 bp, Artificial Sequence
  Synthetic
cctcgccttgcaaactccgt

SEQ ID NO: 21411 - DNA, 25 bp, Artificial Sequence
  Synthetic
ccctcttgagcttcctatacagttt

SEQ ID NO: 21412 - DNA, 23 bp, Artificial Sequence
  Synthetic
agcgacggtaaatgcatttgaaa

SEQ ID NO: 21413 - DNA, 22 bp, Artificial Sequence
  Synthetic
ccgatcaaggaatggggcatca

SEQ ID NO: 21414 - DNA, 25 bp, Artificial Sequence
  Synthetic
ggcctattatcttttgcctaggcat

SEQ ID NO: 21415 - DNA, 25 bp, Artificial Sequence
  Synthetic
agtttctccaagcgaatctctgtat

SEQ ID NO: 21416 - DNA, 23 bp, Artificial Sequence
  Synthetic
ccagatcaggttttttgggttgg

SEQ ID NO: 21417 - DNA, 24 bp, Artificial Sequence
  Synthetic
tcttcttccactgttggtgcatat

SEQ ID NO: 21418 - DNA, 21 bp, Artificial Sequence
  Synthetic
ggttgctcacgctgtctattg

SEQ ID NO: 21419 - DNA, 21 bp, Artificial Sequence
  Synthetic
tctgtacctgaatcgtctgcc

SEQ ID NO: 21420 - DNA, 25 bp, Artificial Sequence
  Synthetic
cggactaagttgctgtataacatca

SEQ ID NO: 21421 - DNA, 22 bp, Artificial Sequence
  Synthetic
tgccgcactactgtttctctat

SEQ ID NO: 21422 - DNA, 22 bp, Artificial Sequence
  Synthetic
cccattatcatatgcccactgc

SEQ ID NO: 21423 - DNA, 20 bp, Artificial Sequence
  Synthetic
tcctggcacaaatctaggcg

SEQ ID NO: 21424 - DNA, 25 bp, Artificial Sequence
  Synthetic
cgtccatggctctaagttatattca

SEQ ID NO: 21425 - DNA, 24 bp, Artificial Sequence
  Synthetic
tgtttccagtgtccacgtattttc

SEQ ID NO: 21426 - DNA, 25 bp, Artificial Sequence
  Synthetic
ggtgtgtggtagatgtaacatgtac

SEQ ID NO: 21427 - DNA, 22 bp, Artificial Sequence
  Synthetic
cacaggcaaatatggtgtacct

SEQ ID NO: 21428 - DNA, 25 bp, Artificial Sequence
  Synthetic
ctctgtattgatgtccagacacttt

SEQ ID NO: 21429 - DNA, 25 bp, Artificial Sequence
  Synthetic
acccataccccaatattctccaata

SEQ ID NO: 21430 - DNA, 25 bp, Artificial Sequence
  Synthetic
cacacatacacaatcatcgttttgt

SEQ ID NO: 21431 - DNA, 25 bp, Artificial Sequence
  Synthetic
agtgtaattaaaggtgtggcaacct

SEQ ID NO: 21432 - DNA, 25 bp, Artificial Sequence
  Synthetic
tggtcgctcttctgtattttcaaat

SEQ ID NO: 21433 - DNA, 21 bp, Artificial Sequence
  Synthetic
gccccgtacactgaacaattg

SEQ ID NO: 21434 - DNA, 25 bp, Artificial Sequence
  Synthetic
caggtcaatctcagtttgtggtata

SEQ ID NO: 21435 - DNA, 24 bp, Artificial Sequence
  Synthetic
cgttttaatttctgcagcgtctgt

SEQ ID NO: 21436 - DNA, 23 bp, Artificial Sequence
  Synthetic
cacatccatatcacttcctgacc

SEQ ID NO: 21437 - DNA, 25 bp, Artificial Sequence
  Synthetic
ccactgcaccattttagatagttca

SEQ ID NO: 21438 - DNA, 22 bp, Artificial Sequence
  Synthetic
tgtactattggcttccagtccc

SEQ ID NO: 21439 - DNA, 25 bp, Artificial Sequence
  Synthetic
ggaccatgtcctttcaaaaaaacat

SEQ ID NO: 21440 - DNA, 22 bp, Artificial Sequence
  Synthetic
acgttttatggccgtcatgtat

SEQ ID NO: 21441 - DNA, 20 bp, Artificial Sequence
  Synthetic
cgggctctgtggttctggga

SEQ ID NO: 21442 - DNA, 25 bp, Artificial Sequence
  Synthetic
gcacagtttacatttgtccaatgat

SEQ ID NO: 21443 - DNA, 25 bp, Artificial Sequence
  Synthetic
gcaaaaacacaaaactaacacacaa

SEQ ID NO: 21444 - DNA, 20 bp, Artificial Sequence
  Synthetic
tacctcaccagtttggggga

SEQ ID NO: 21445 - DNA, 20 bp, Artificial Sequence
  Synthetic
atcaggatcaggtgccacac

SEQ ID NO: 21446 - DNA, 21 bp, Artificial Sequence
  Synthetic
gccataacgcaaatgtggagc

SEQ ID NO: 21447 - DNA, 22 bp, Artificial Sequence
  Synthetic
tgtcctctaagctagtggcaac

SEQ ID NO: 21448 - DNA, 23 bp, Artificial Sequence
  Synthetic
gtaaaagcatagttggcagccta

SEQ ID NO: 21449 - DNA, 20 bp, Artificial Sequence
  Synthetic
gaggggagggaaaaactggc

SEQ ID NO: 21450 - DNA, 22 bp, Artificial Sequence
  Synthetic
aggctggaccactgttaccagt

SEQ ID NO: 21451 - DNA, 22 bp, Artificial Sequence
  Synthetic
gcctcaacagatggtgattgta

SEQ ID NO: 21452 - DNA, 23 bp, Artificial Sequence
  Synthetic
caccagaaaattcagcacacatg

SEQ ID NO: 21453 - DNA, 25 bp, Artificial Sequence
  Synthetic
caaaggctgtgatgtaatgtctact

SEQ ID NO: 21454 - DNA, 21 bp, Artificial Sequence
  Synthetic
tccaacatcccacacaacatg

SEQ ID NO: 21455 - DNA, 24 bp, Artificial Sequence
  Synthetic
tgtcctgtccattatagtcagtgt

SEQ ID NO: 21456 - DNA, 25 bp, Artificial Sequence
  Synthetic
ccagaatattgacatattggtgcct

SEQ ID NO: 21457 - DNA, 25 bp, Artificial Sequence
  Synthetic
cagcacagtgaaattgtctaagatc

SEQ ID NO: 21458 - DNA, 22 bp, Artificial Sequence
  Synthetic
tggtgaaccattgcaaccaatt

SEQ ID NO: 21459 - DNA, 25 bp, Artificial Sequence
  Synthetic
tgtctccttcttttgtcttcttcca

SEQ ID NO: 21460 - DNA, 25 bp, Artificial Sequence
  Synthetic
cctcagcttgtacttacctggataa

SEQ ID NO: 21461 - DNA, 25 bp, Artificial Sequence
  Synthetic
agcaacgaatagtaatgctctgtaa

SEQ ID NO: 21462 - DNA, 25 bp, Artificial Sequence
  Synthetic
tgaaccatctgtactttcatcgaaa

SEQ ID NO: 21463 - DNA, 25 bp, Artificial Sequence
  Synthetic
tgcctcaattacttcttctaaagca

SEQ ID NO: 21464 - DNA, 25 bp, Artificial Sequence
  Synthetic
accatttgactgcaatctctaacat

SEQ ID NO: 21465 - DNA, 25 bp, Artificial Sequence
  Synthetic
ggtagtttaatttgttgtgggactc

SEQ ID NO: 21466 - DNA, 25 bp, Artificial Sequence
  Synthetic
ctcagaggcatactgtgatttactt

SEQ ID NO: 21467 - DNA, 22 bp, Artificial Sequence
  Synthetic
ggcctcctctcaggggaattga

SEQ ID NO: 21468 - DNA, 24 bp, Artificial Sequence
  Synthetic
cacgtttatttctacctgctctgt

SEQ ID NO: 21469 - DNA, 21 bp, Artificial Sequence
  Synthetic
tggattaccccctacaccacc

SEQ ID NO: 21470 - DNA, 20 bp, Artificial Sequence
  Synthetic
agtctgcatcaggagcagct

SEQ ID NO: 21471 - DNA, 25 bp, Artificial Sequence
  Synthetic
gctctgtttgtgatggtataatggt

SEQ ID NO: 21472 - DNA, 25 bp, Artificial Sequence
  Synthetic
tgggtatgtgttaggattttcaaca

SEQ ID NO: 21473 - DNA, 25 bp, Artificial Sequence
  Synthetic
gggaagcaagtttattatcctgctt

SEQ ID NO: 21474 - DNA, 25 bp, Artificial Sequence
  Synthetic
gcgtaagggtcagttttttccttat

SEQ ID NO: 21475 - DNA, 19 bp, Artificial Sequence
  Synthetic
actgtcgccagtggggtgc

SEQ ID NO: 21476 - DNA, 25 bp, Artificial Sequence
  Synthetic
acactatttgtcaccataagcaagt

SEQ ID NO: 21477 - DNA, 23 bp, Artificial Sequence
  Synthetic
tgcttcaacagttggtgacatta

SEQ ID NO: 21478 - DNA, 21 bp, Artificial Sequence
  Synthetic
acagattttgcccgaagatgc

SEQ ID NO: 21479 - DNA, 25 bp, Artificial Sequence
  Synthetic
agggtcccattacaattaaagaagg

SEQ ID NO: 21480 - DNA, 20 bp, Artificial Sequence
  Synthetic
cttggcagccgtgttggtaa

SEQ ID NO: 21481 - DNA, 25 bp, Artificial Sequence
  Synthetic
gtggtagaaaagagagtgttgctaa

SEQ ID NO: 21482 - DNA, 24 bp, Artificial Sequence
  Synthetic
accttgtctatgtagtcctcaact

SEQ ID NO: 21483 - DNA, 25 bp, Artificial Sequence
  Synthetic
catgctcttggaagtttatatccca

SEQ ID NO: 21484 - DNA, 25 bp, Artificial Sequence
  Synthetic
tctggggacatcataaccatcataa

SEQ ID NO: 21485 - DNA, 25 bp, Artificial Sequence
  Synthetic
tcagtcctgtggttaataaagtgtt

SEQ ID NO: 21486 - DNA, 25 bp, Artificial Sequence
  Synthetic
gtcgtgtgcttctaatttaactggt

SEQ ID NO: 21487 - DNA, 23 bp, Artificial Sequence
  Synthetic
gctaccaaaggcactccctaatt

SEQ ID NO: 21488 - DNA, 25 bp, Artificial Sequence
  Synthetic
ggtctagtgatgtttaaccactgac

SEQ ID NO: 21489 - DNA, 25 bp, Artificial Sequence
  Synthetic
acttcttgttgatcatacccatcaa

SEQ ID NO: 21490 - DNA, 25 bp, Artificial Sequence
  Synthetic
ggtacccttgcaagatcttaagatc

SEQ ID NO: 21491 - DNA, 23 bp, Artificial Sequence
  Synthetic
ccaagccctgaaatatagctgtt

SEQ ID NO: 21492 - DNA, 23 bp, Artificial Sequence
  Synthetic
actcaggtttcttcttgggtgta

SEQ ID NO: 21493 - DNA, 24 bp, Artificial Sequence
  Synthetic
cctatgatattacctgtgttggcc

SEQ ID NO: 21494 - DNA, 22 bp, Artificial Sequence
  Synthetic
gtgaggtctacttccaatcgtg

SEQ ID NO: 21495 - DNA, 25 bp, Artificial Sequence
  Synthetic
ccttgtgtctttagtagcgttgttt

SEQ ID NO: 21496 - DNA, 23 bp, Artificial Sequence
  Synthetic
gcatgcatttgtgaccaaaacac

SEQ ID NO: 21497 - DNA, 25 bp, Artificial Sequence
  Synthetic
tgcattgagtaaacaggatgtatca

SEQ ID NO: 21498 - DNA, 25 bp, Artificial Sequence
  Synthetic
cttctcttgtcttcctgatgtgtat

SEQ ID NO: 21499 - DNA, 20 bp, Artificial Sequence
  Synthetic
ttgtcggcccattcctgttc

SEQ ID NO: 21500 - DNA, 25 bp, Artificial Sequence
  Synthetic
ggagctcttctttcttctcttttgt

SEQ ID NO: 21501 - DNA, 25 bp, Artificial Sequence
  Synthetic
tgtgaattcttcatacccctcatgt

SEQ ID NO: 21502 - DNA, 21 bp, Artificial Sequence
  Synthetic
cctcaggagttgatgcatggg

SEQ ID NO: 21503 - DNA, 25 bp, Artificial Sequence
  Synthetic
tgtttcactaacctcttcaggagat

SEQ ID NO: 21504 - DNA, 20 bp, Artificial Sequence
  Synthetic
gacttgcttccgggctaggc

SEQ ID NO: 21505 - DNA, 21 bp, Artificial Sequence
  Synthetic
ggatttaacacggacgcggaa

SEQ ID NO: 21506 - DNA, 20 bp, Artificial Sequence
  Synthetic
cttcgtttgggtcgttctcc

SEQ ID NO: 21507 - DNA, 22 bp, Artificial Sequence
  Synthetic
ggtctgttcccggtgatattga

SEQ ID NO: 21508 - DNA, 22 bp, Artificial Sequence
  Synthetic
cccacgtcctgcaacaaatcct

SEQ ID NO: 21509 - DNA, 20 bp, Artificial Sequence
  Synthetic
gtctccaaaacccggagcac

SEQ ID NO: 21510 - DNA, 20 bp, Artificial Sequence
  Synthetic
tctgtccccgctgcctcatc

SEQ ID NO: 21511 - DNA, 20 bp, Artificial Sequence
  Synthetic
cttgcaatctgggcgcaggg

SEQ ID NO: 21512 - DNA, 22 bp, Artificial Sequence
  Synthetic
cggtacagactcccaggtagca

SEQ ID NO: 21513 - DNA, 21 bp, Artificial Sequence
  Synthetic
gatgccgttcaggttcaccct

SEQ ID NO: 21514 - DNA, 19 bp, Artificial Sequence
  Synthetic
tgctggaagcactgggcgc

SEQ ID NO: 21515 - DNA, 20 bp, Artificial Sequence
  Synthetic
cacctctaccgggtcctgga

SEQ ID NO: 21516 - DNA, 20 bp, Artificial Sequence
  Synthetic
tgcacaacatgaacccccgg

SEQ ID NO: 21517 - DNA, 19 bp, Artificial Sequence
  Synthetic
aaccgggtgcggcaagtcc

SEQ ID NO: 21518 - DNA, 22 bp, Artificial Sequence
  Synthetic
ccccgaaacgaggaagtctgct

SEQ ID NO: 21519 - DNA, 21 bp, Artificial Sequence
  Synthetic
ctgtacgccctgcaatccctc

SEQ ID NO: 21520 - DNA, 22 bp, Artificial Sequence
  Synthetic
gccttcgtctcagagtggtccg

SEQ ID NO: 21521 - DNA, 21 bp, Artificial Sequence
  Synthetic
tgacaacctgagtgccgaggt

SEQ ID NO: 21522 - DNA, 19 bp, Artificial Sequence
  Synthetic
cgcgtcaggattgtgcccg

SEQ ID NO: 21523 - DNA, 19 bp, Artificial Sequence
  Synthetic
tacgtgcgcgccagcatcc

SEQ ID NO: 21524 - DNA, 20 bp, Artificial Sequence
  Synthetic
cgctcaagcttacgccctcc

SEQ ID NO: 21525 - DNA, 22 bp, Artificial Sequence
  Synthetic
cgcccgcgattcatggaactat

SEQ ID NO: 21526 - DNA, 19 bp, Artificial Sequence
  Synthetic
ccccaagctggtcgccctt

SEQ ID NO: 21527 - DNA, 22 bp, Artificial Sequence
  Synthetic
cgccactcctgaagttcctcct

SEQ ID NO: 21528 - DNA, 20 bp, Artificial Sequence
  Synthetic
gttcaaagtcacggggcccg

SEQ ID NO: 21529 - DNA, 19 bp, Artificial Sequence
  Synthetic
cgccgtctttacgcggcac

SEQ ID NO: 21530 - DNA, 20 bp, Artificial Sequence
  Synthetic
ccaccgcccccagaggaaat

SEQ ID NO: 21531 - DNA, 21 bp, Artificial Sequence
  Synthetic
cggtcgatcttgacgcgctta

SEQ ID NO: 21532 - DNA, 19 bp, Artificial Sequence
  Synthetic
gctcaggggcgttggggtt

SEQ ID NO: 21533 - DNA, 19 bp, Artificial Sequence
  Synthetic
atgctcgaggacctggccc

SEQ ID NO: 21534 - DNA, 19 bp, Artificial Sequence
  Synthetic
ctcgaaccggggtacacgc

SEQ ID NO: 21535 - DNA, 19 bp, Artificial Sequence
  Synthetic
aaaagggggctcgctcgcc

SEQ ID NO: 21536 - DNA, 22 bp, Artificial Sequence
  Synthetic
ggtgcgcacgtggttgttgaaa

SEQ ID NO: 21537 - DNA, 22 bp, Artificial Sequence
  Synthetic
gggcacgtacggcgtcttgtaa

SEQ ID NO: 21538 - DNA, 22 bp, Artificial Sequence
  Synthetic
gggcttgctgctgggacatcta

SEQ ID NO: 21539 - DNA, 19 bp, Artificial Sequence
  Synthetic
gctgttgtagcggcccacg

SEQ ID NO: 21540 - DNA, 22 bp, Artificial Sequence
  Synthetic
cccgcgtaggttcttgaaagcc

SEQ ID NO: 21541 - DNA, 22 bp, Artificial Sequence
  Synthetic
cgtactgcggcggaattttctg

SEQ ID NO: 21542 - DNA, 21 bp, Artificial Sequence
  Synthetic
cgggagccaatgcgggttcaa

SEQ ID NO: 21543 - DNA, 22 bp, Artificial Sequence
  Synthetic
agcgtaggtcttccagcggttt

SEQ ID NO: 21544 - DNA, 21 bp, Artificial Sequence
  Synthetic
catcacgctctcgtacgaggg

SEQ ID NO: 21545 - DNA, 22 bp, Artificial Sequence
  Synthetic
ggtcccagcccagcttgaaatt

SEQ ID NO: 21546 - DNA, 25 bp, Artificial Sequence
  Synthetic
aggagcattaactttagcagcattt

SEQ ID NO: 21547 - DNA, 21 bp, Artificial Sequence
  Synthetic
gctgggtggagcgaaaggtga

SEQ ID NO: 21548 - DNA, 20 bp, Artificial Sequence
  Synthetic
tgcccagggccttgtagacg

SEQ ID NO: 21549 - DNA, 22 bp, Artificial Sequence
  Synthetic
gcgtcagcgactacggagtcaa

SEQ ID NO: 21550 - DNA, 19 bp, Artificial Sequence
  Synthetic
tttccgcgcctgggtctgg

SEQ ID NO: 21551 - DNA, 19 bp, Artificial Sequence
  Synthetic
caacacgcgctgcaccctg

SEQ ID NO: 21552 - DNA, 19 bp, Artificial Sequence
  Synthetic
ggtgtccagcacgtcctcc

SEQ ID NO: 21553 - DNA, 19 bp, Artificial Sequence
  Synthetic
aggctcggtggccgtggat

SEQ ID NO: 21554 - DNA, 22 bp, Artificial Sequence
  Synthetic
cggcgggatcttcctcggtaat

SEQ ID NO: 21555 - DNA, 21 bp, Artificial Sequence
  Synthetic
cgttccaggtgcccatgaacg

SEQ ID NO: 21556 - DNA, 22 bp, Artificial Sequence
  Synthetic
gcatcttccatctccaccaccg

SEQ ID NO: 21557 - DNA, 19 bp, Artificial Sequence
  Synthetic
tgccagttctgggcctggc

SEQ ID NO: 21558 - DNA, 22 bp, Artificial Sequence
  Synthetic
ggagccaccgtggggtttctaa

SEQ ID NO: 21559 - DNA, 22 bp, Artificial Sequence
  Synthetic
aattgttatgtcagcgcctccc

SEQ ID NO: 21560 - DNA, 23 bp, Artificial Sequence
  Synthetic
acccagagaatctagcaaaagct

SEQ ID NO: 21561 - DNA, 20 bp, Artificial Sequence
  Synthetic
tggtgttggtgggcagtgtg

SEQ ID NO: 21562 - DNA, 20 bp, Artificial Sequence
  Synthetic
gttgcccagggaactctgca

SEQ ID NO: 21563 - DNA, 22 bp, Artificial Sequence
  Synthetic
acgctgcgcttaatctcgaact

SEQ ID NO: 21564 - DNA, 19 bp, Artificial Sequence
  Synthetic
cctggcgcatggtaggtgc

SEQ ID NO: 21565 - DNA, 20 bp, Artificial Sequence
  Synthetic
gtagacggcctcgatgacgc

SEQ ID NO: 21566 - DNA, 19 bp, Artificial Sequence
  Synthetic
tctgcttaagccggcggtc

SEQ ID NO: 21567 - DNA, 22 bp, Artificial Sequence
  Synthetic
gcacctgtggcgattgtagcat

SEQ ID NO: 21568 - DNA, 22 bp, Artificial Sequence
  Synthetic
ccccgagattgctgttcccaaa

SEQ ID NO: 21569 - DNA, 20 bp, Artificial Sequence
  Synthetic
tacccgaatatgcagcgcgg

SEQ ID NO: 21570 - DNA, 21 bp, Artificial Sequence
  Synthetic
gctcaagtgtctgcacgggac

SEQ ID NO: 21571 - DNA, 20 bp, Artificial Sequence
  Synthetic
tgctgatggaacgctaccgc

SEQ ID NO: 21572 - DNA, 22 bp, Artificial Sequence
  Synthetic
cgaggaggacgtggttccactg

SEQ ID NO: 21573 - DNA, 22 bp, Artificial Sequence
  Synthetic
tcctgtgggggttctagacgag

SEQ ID NO: 21574 - DNA, 20 bp, Artificial Sequence
  Synthetic
tcgacgctgcgcttaagcac

SEQ ID NO: 21575 - DNA, 22 bp, Artificial Sequence
  Synthetic
tgtagtgcagggtctcctcgac

SEQ ID NO: 21576 - DNA, 22 bp, Artificial Sequence
  Synthetic
gcccgtccacaacgttttaagg

SEQ ID NO: 21577 - DNA, 19 bp, Artificial Sequence
  Synthetic
actcaagcagcccctcgcc

SEQ ID NO: 21578 - DNA, 21 bp, Artificial Sequence
  Synthetic
gatcgtgccctgggtgatgac

SEQ ID NO: 21579 - DNA, 20 bp, Artificial Sequence
  Synthetic
acgaggaggcttgaccggag

SEQ ID NO: 21580 - DNA, 22 bp, Artificial Sequence
  Synthetic
gctgacctcgactctgctgaaa

SEQ ID NO: 21581 - DNA, 22 bp, Artificial Sequence
  Synthetic
gccagctggacacctgagttag

SEQ ID NO: 21582 - DNA, 20 bp, Artificial Sequence
  Synthetic
ggcctggggagcctgaaaag

SEQ ID NO: 21583 - DNA, 25 bp, Artificial Sequence
  Synthetic
tccagagtagagtcttatttcagct

SEQ ID NO: 21584 - DNA, 25 bp, Artificial Sequence
  Synthetic
caccagggaaaggataattagcaaa

SEQ ID NO: 21585 - DNA, 24 bp, Artificial Sequence
  Synthetic
acctgacataaagcaggccataat

SEQ ID NO: 21586 - DNA, 23 bp, Artificial Sequence
  Synthetic
agctatgcttgatttgtgggttt

SEQ ID NO: 21587 - DNA, 25 bp, Artificial Sequence
  Synthetic
ctttgagcagtattaccttgtccaa

SEQ ID NO: 21588 - DNA, 25 bp, Artificial Sequence
  Synthetic
gaggttctttggtatgtggcttaat

SEQ ID NO: 21589 - DNA, 25 bp, Artificial Sequence
  Synthetic
acaaagtacaaaagaaccacgagaa

SEQ ID NO: 21590 - DNA, 21 bp, Artificial Sequence
  Synthetic
gcagacaatgctgcagacgca

SEQ ID NO: 21591 - DNA, 25 bp, Artificial Sequence
  Synthetic
cgagatcaaaacaggggtagatcat

SEQ ID NO: 21592 - DNA, 22 bp, Artificial Sequence
  Synthetic
cccgtctgctgggtgatgacta

SEQ ID NO: 21593 - DNA, 20 bp, Artificial Sequence
  Synthetic
tgagtgacagaaccccaggg

SEQ ID NO: 21594 - DNA, 25 bp, Artificial Sequence
  Synthetic
aaatgctaccaagtctccattatca

SEQ ID NO: 21595 - DNA, 25 bp, Artificial Sequence
  Synthetic
gccaaggtagatgtttccataaact

SEQ ID NO: 21596 - DNA, 21 bp, Artificial Sequence
  Synthetic
aaggccacccgtactgagaga

SEQ ID NO: 21597 - DNA, 25 bp, Artificial Sequence
  Synthetic
tgggctgctgaataacataatgatt

SEQ ID NO: 21598 - DNA, 23 bp, Artificial Sequence
  Synthetic
cctgggatatgatcctgaccaca

SEQ ID NO: 21599 - DNA, 22 bp, Artificial Sequence
  Synthetic
ggcagcattaactggatgggga

SEQ ID NO: 21600 - DNA, 25 bp, Artificial Sequence
  Synthetic
tggacttacaccaacaatttgtaga

SEQ ID NO: 21601 - DNA, 25 bp, Artificial Sequence
  Synthetic
cctggctttatcacttacattttgg

SEQ ID NO: 21602 - DNA, 21 bp, Artificial Sequence
  Synthetic
ccgatgtgatttttgccggaa

SEQ ID NO: 21603 - DNA, 24 bp, Artificial Sequence
  Synthetic
cgtcagtgtaagttgcctttaagt

SEQ ID NO: 21604 - DNA, 21 bp, Artificial Sequence
  Synthetic
gatgctctcacttctcctgga

SEQ ID NO: 21605 - DNA, 25 bp, Artificial Sequence
  Synthetic
caggatatccatatgtctgaagcaa

SEQ ID NO: 21606 - DNA, 20 bp, Artificial Sequence
  Synthetic
agctccacagtgctggatag

SEQ ID NO: 21607 - DNA, 21 bp, Artificial Sequence
  Synthetic
ccagttcttgttgtcccgatc

SEQ ID NO: 21608 - DNA, 24 bp, Artificial Sequence
  Synthetic
cattctcatagtcagcatcactgc

SEQ ID NO: 21609 - DNA, 22 bp, Artificial Sequence
  Synthetic
cttctccaatttctgtgggctt

SEQ ID NO: 21610 - DNA, 25 bp, Artificial Sequence
  Synthetic
gttgatcaaggattctagcatgtgt

SEQ ID NO: 21611 - DNA, 25 bp, Artificial Sequence
  Synthetic
cttgggttggtaatgacatcagtta

SEQ ID NO: 21612 - DNA, 23 bp, Artificial Sequence
  Synthetic
gctgctgactcttcgttctttga

SEQ ID NO: 21613 - DNA, 24 bp, Artificial Sequence
  Synthetic
tgtctttcccttttgtgaagactg

SEQ ID NO: 21614 - DNA, 24 bp, Artificial Sequence
  Synthetic
gagaggttctactgtcccattttc

SEQ ID NO: 21615 - DNA, 23 bp, Artificial Sequence
  Synthetic
ggagcatggatcgaatctaccat

SEQ ID NO: 21616 - DNA, 24 bp, Artificial Sequence
  Synthetic
ttgagttcggtaatgcaagatctg

SEQ ID NO: 21617 - DNA, 25 bp, Artificial Sequence
  Synthetic
tccattaaaggatagcaaactgctt

SEQ ID NO: 21618 - DNA, 24 bp, Artificial Sequence
  Synthetic
gctgagctttttgagactcttgtc

SEQ ID NO: 21619 - DNA, 25 bp, Artificial Sequence
  Synthetic
gcaccaaagaatctagtttgtggat

SEQ ID NO: 21620 - DNA, 25 bp, Artificial Sequence
  Synthetic
acctgttcagtgtaaatgatgtcat

SEQ ID NO: 21621 - DNA, 25 bp, Artificial Sequence
  Synthetic
gaatgtaactcctcttgagcgatct

SEQ ID NO: 21622 - DNA, 25 bp, Artificial Sequence
  Synthetic
gactggattgtctttaaccctaagt

SEQ ID NO: 21623 - DNA, 21 bp, Artificial Sequence
  Synthetic
cagaaatcgtgtgggtccaga

SEQ ID NO: 21624 - DNA, 23 bp, Artificial Sequence
  Synthetic
tcctgcagctattacagaacatg

SEQ ID NO: 21625 - DNA, 25 bp, Artificial Sequence
  Synthetic
cgtaccctaggaaaatgagtgtatt

SEQ ID NO: 21626 - DNA, 23 bp, Artificial Sequence
  Synthetic
agtgccaacctgaagatctagta

SEQ ID NO: 21627 - DNA, 22 bp, Artificial Sequence
  Synthetic
tggtgggattaacacgtgatgt

SEQ ID NO: 21628 - DNA, 25 bp, Artificial Sequence
  Synthetic
cggataaggttcaaaagtgtaacga

SEQ ID NO: 21629 - DNA, 20 bp, Artificial Sequence
  Synthetic
cgagtcgtccagctgaagac

SEQ ID NO: 21630 - DNA, 25 bp, Artificial Sequence
  Synthetic
cccattttcactgaataactcacct

SEQ ID NO: 21631 - DNA, 25 bp, Artificial Sequence
  Synthetic
tgctatagcttgattgtctccttgt

SEQ ID NO: 21632 - DNA, 25 bp, Artificial Sequence
  Synthetic
gctgtagacatatagttgaaccctc

SEQ ID NO: 21633 - DNA, 25 bp, Artificial Sequence
  Synthetic
gtggattggtcttccataagttaga

SEQ ID NO: 21634 - DNA, 25 bp, Artificial Sequence
  Synthetic
ttctctaaacttaagttagccctgg

SEQ ID NO: 21635 - DNA, 20 bp, Artificial Sequence
  Synthetic
tccctctgacgtttaacccg

SEQ ID NO: 21636 - DNA, 23 bp, Artificial Sequence
  Synthetic
agcatactatcggcatcaggatc

SEQ ID NO: 21637 - DNA, 25 bp, Artificial Sequence
  Synthetic
ggtaagttccaatgctttcaaacaa

SEQ ID NO: 21638 - DNA, 24 bp, Artificial Sequence
  Synthetic
aggatctccagtataagggaatgt

SEQ ID NO: 21639 - DNA, 25 bp, Artificial Sequence
  Synthetic
gtttgtccactcttgtttgttgaat

SEQ ID NO: 21640 - DNA, 25 bp, Artificial Sequence
  Synthetic
tggtcatgttgtctcttactcttct

SEQ ID NO: 21641 - DNA, 24 bp, Artificial Sequence
  Synthetic
ccttcttttcattacctccaaccg

SEQ ID NO: 21642 - DNA, 24 bp, Artificial Sequence
  Synthetic
tcgaacatgtaacctttccctagt

SEQ ID NO: 21643 - DNA, 20 bp, Artificial Sequence
  Synthetic
agtccgtcccaccagtatgt

SEQ ID NO: 21644 - DNA, 24 bp, Artificial Sequence
  Synthetic
agccgattcattaattccagacac

SEQ ID NO: 21645 - DNA, 21 bp, Artificial Sequence
  Synthetic
gcctcccctgatagtcttcat

SEQ ID NO: 21646 - DNA, 25 bp, Artificial Sequence
  Synthetic
actgctagggaagaatttctcaaat

SEQ ID NO: 21647 - DNA, 25 bp, Artificial Sequence
  Synthetic
tgcagagcaggaaaatattagttgg

SEQ ID NO: 21648 - DNA, 22 bp, Artificial Sequence
  Synthetic
ccgtcctgttgtctgttccaca

SEQ ID NO: 21649 - DNA, 22 bp, Artificial Sequence
  Synthetic
acgcacactatcctcctcctct

SEQ ID NO: 21650 - DNA, 25 bp, Artificial Sequence
  Synthetic
gctagtccaaataggtccttgaatt

SEQ ID NO: 21651 - DNA, 25 bp, Artificial Sequence
  Synthetic
ggtatgtttaacagttttcccatgc

SEQ ID NO: 21652 - DNA, 23 bp, Artificial Sequence
  Synthetic
cctcatttcccagcaatgcatat

SEQ ID NO: 21653 - DNA, 22 bp, Artificial Sequence
  Synthetic
gcaaaatagcgacttccctgtg

SEQ ID NO: 21654 - DNA, 24 bp, Artificial Sequence
  Synthetic
ggtctagtaatttctcctggcacg

SEQ ID NO: 21655 - DNA, 21 bp, Artificial Sequence
  Synthetic
tttccaaagaggtggtttgca

SEQ ID NO: 21656 - DNA, 25 bp, Artificial Sequence
  Synthetic
gcacaacaatcctacatatatggca

SEQ ID NO: 21657 - DNA, 20 bp, Artificial Sequence
  Synthetic
tacagtaggaggccgggtgc

SEQ ID NO: 21658 - DNA, 22 bp, Artificial Sequence
  Synthetic
cccctgcctgaggaggttcaat

SEQ ID NO: 21659 - DNA, 22 bp, Artificial Sequence
  Synthetic
ggcaccaaaggctgtaactcca

SEQ ID NO: 21660 - DNA, 25 bp, Artificial Sequence
  Synthetic
gcaacaaataaaaatcagagccctg

SEQ ID NO: 21661 - DNA, 21 bp, Artificial Sequence
  Synthetic
gtgtttttcttgccctgcagc

SEQ ID NO: 21662 - DNA, 25 bp, Artificial Sequence
  Synthetic
agcagccatttgtaaataatcagga

SEQ ID NO: 21663 - DNA, 21 bp, Artificial Sequence
  Synthetic
ataccattgttgtggccctgg

SEQ ID NO: 21664 - DNA, 25 bp, Artificial Sequence
  Synthetic
ggactgcaaaaacctatatgtgtct

SEQ ID NO: 21665 - DNA, 23 bp, Artificial Sequence
  Synthetic
acatgcacaacaacagcatacag

SEQ ID NO: 21666 - DNA, 22 bp, Artificial Sequence
  Synthetic
acagaaatggggaagctgcaca

SEQ ID NO: 21667 - DNA, 25 bp, Artificial Sequence
  Synthetic
cacagtaattgcacaacatgtcaaa

SEQ ID NO: 21668 - DNA, 23 bp, Artificial Sequence
  Synthetic
gctgttatattgcgggcataagt

SEQ ID NO: 21669 - DNA, 25 bp, Artificial Sequence
  Synthetic
tctgtatagtttgagcgttgaaaga

SEQ ID NO: 21670 - DNA, 19 bp, Artificial Sequence
  Synthetic
ggacatgggctgccagacc

SEQ ID NO: 21671 - DNA, 19 bp, Artificial Sequence
  Synthetic
acgggattggtcggccgaa

SEQ ID NO: 21672 - DNA, 20 bp, Artificial Sequence
  Synthetic
taagcaaaggggggatgggt

SEQ ID NO: 21673 - DNA, 20 bp, Artificial Sequence
  Synthetic
tatcccgcatgtaagctggc

SEQ ID NO: 21674 - DNA, 18 bp, Artificial Sequence
  Synthetic
tacaccatgcgcggcggt

SEQ ID NO: 21675 - DNA, 19 bp, Artificial Sequence
  Synthetic
tacgtgcaggcgccacacg

SEQ ID NO: 21676 - DNA, 21 bp, Artificial Sequence
  Synthetic
gctggacacgcccatctcctc

SEQ ID NO: 21677 - DNA, 21 bp, Artificial Sequence
  Synthetic
gcagcacgcaaaagagcaggt

SEQ ID NO: 21678 - DNA, 19 bp, Artificial Sequence
  Synthetic
ccccattgacgcgtctgcc

SEQ ID NO: 21679 - DNA, 21 bp, Artificial Sequence
  Synthetic
ccgaacagaagatgggacgcc

SEQ ID NO: 21680 - DNA, 22 bp, Artificial Sequence
  Synthetic
accgcatctcttggcgtttacc

SEQ ID NO: 21681 - DNA, 20 bp, Artificial Sequence
  Synthetic
acaggcaaaacacgccgtgg

SEQ ID NO: 21682 - DNA, 18 bp, Artificial Sequence
  Synthetic
cgcgcttcagtgcaccgt

SEQ ID NO: 21683 - DNA, 23 bp, Artificial Sequence
  Synthetic
cactgataacatgtaactccgcc

SEQ ID NO: 21684 - DNA, 22 bp, Artificial Sequence
  Synthetic
ggtcacgggcgtgttcagtaat

SEQ ID NO: 21685 - DNA, 20 bp, Artificial Sequence
  Synthetic
cctgccgttgttctttgcgg

SEQ ID NO: 21686 - DNA, 19 bp, Artificial Sequence
  Synthetic
tttgtgggagcgtccggcc

SEQ ID NO: 21687 - DNA, 19 bp, Artificial Sequence
  Synthetic
cggcaccgttgtcgcagta

SEQ ID NO: 21688 - DNA, 19 bp, Artificial Sequence
  Synthetic
ggcttctggttgggcgagc

SEQ ID NO: 21689 - DNA, 22 bp, Artificial Sequence
  Synthetic
ccccgtgttgttctgccgtatt

SEQ ID NO: 21690 - DNA, 20 bp, Artificial Sequence
  Synthetic
gcccgggtatgcgaaaccat

SEQ ID NO: 21691 - DNA, 19 bp, Artificial Sequence
  Synthetic
tgcacctctggcgccacag

SEQ ID NO: 21692 - DNA, 19 bp, Artificial Sequence
  Synthetic
tcagggcgcgtctggtctc

SEQ ID NO: 21693 - DNA, 22 bp, Artificial Sequence
  Synthetic
gtgaatgagggcgcatctacct

SEQ ID NO: 21694 - DNA, 19 bp, Artificial Sequence
  Synthetic
acgcctctgaggacgctgc

SEQ ID NO: 21695 - DNA, 21 bp, Artificial Sequence
  Synthetic
ggccaccgcgtccttcatttc

SEQ ID NO: 21696 - DNA, 22 bp, Artificial Sequence
  Synthetic
cctgttggacgatctcgcacat

SEQ ID NO: 21697 - DNA, 21 bp, Artificial Sequence
  Synthetic
ggcgatgtgctgggggtgata

SEQ ID NO: 21698 - DNA, 21 bp, Artificial Sequence
  Synthetic
cgcgtgaggtgaggtggacat

SEQ ID NO: 21699 - DNA, 19 bp, Artificial Sequence
  Synthetic
ttggggtaacggcgggcac

SEQ ID NO: 21700 - DNA, 18 bp, Artificial Sequence
  Synthetic
tgcgagcaggagggacct

SEQ ID NO: 21701 - DNA, 20 bp, Artificial Sequence
  Synthetic
tccctgggcaggcggaatag

SEQ ID NO: 21702 - DNA, 21 bp, Artificial Sequence
  Synthetic
gcagcagcaggatgagcagca

SEQ ID NO: 21703 - DNA, 22 bp, Artificial Sequence
  Synthetic
gcactcttaccccccgtaacca

SEQ ID NO: 21704 - DNA, 19 bp, Artificial Sequence
  Synthetic
tgtcagaggtgctgcgggc

SEQ ID NO: 21705 - DNA, 21 bp, Artificial Sequence
  Synthetic
ccccggacgtaaaggtcgaag

SEQ ID NO: 21706 - DNA, 19 bp, Artificial Sequence
  Synthetic
ttctgccgggagctgggag

SEQ ID NO: 21707 - DNA, 20 bp, Artificial Sequence
  Synthetic
catgctggccgagagggtgg

SEQ ID NO: 21708 - DNA, 22 bp, Artificial Sequence
  Synthetic
gcgcatcttggagaccctgaag

SEQ ID NO: 21709 - DNA, 25 bp, Artificial Sequence
  Synthetic
ccaaaccatactctttgcaaagcaa

SEQ ID NO: 21710 - DNA, 19 bp, Artificial Sequence
  Synthetic
ccgcactcaaccaccagcc

SEQ ID NO: 21711 - DNA, 20 bp, Artificial Sequence
  Synthetic
tcccccgttacctcctctgg

SEQ ID NO: 21712 - DNA, 20 bp, Artificial Sequence
  Synthetic
catggccgtcttgtaccagt

SEQ ID NO: 21713 - DNA, 25 bp, Artificial Sequence
  Synthetic
cgccttttaggaacaatttaaaggc

SEQ ID NO: 21714 - DNA, 25 bp, Artificial Sequence
  Synthetic
gttgttatcattaggggtggacact

SEQ ID NO: 21715 - DNA, 20 bp, Artificial Sequence
  Synthetic
gagggcaggcacagctgtac

SEQ ID NO: 21716 - DNA, 19 bp, Artificial Sequence
  Synthetic
ttcgtcgtccgaggcgctg

SEQ ID NO: 21717 - DNA, 25 bp, Artificial Sequence
  Synthetic
cccttaggtatactgactcttgtca

SEQ ID NO: 21718 - DNA, 25 bp, Artificial Sequence
  Synthetic
acaaacggacataaaacatcaacaa

SEQ ID NO: 21719 - DNA, 22 bp, Artificial Sequence
  Synthetic
gggtctgtaacggtggaggttg

SEQ ID NO: 21720 - DNA, 22 bp, Artificial Sequence
  Synthetic
gcaatggctgaaggacatccga

SEQ ID NO: 21721 - DNA, 24 bp, Artificial Sequence
  Synthetic
ccgtactgatcacctttgaaacag

SEQ ID NO: 21722 - DNA, 23 bp, Artificial Sequence
  Synthetic
gacttatttgactgcagagtggc

SEQ ID NO: 21723 - DNA, 23 bp, Artificial Sequence
  Synthetic
gggttatcttgcacagttggaag

SEQ ID NO: 21724 - DNA, 25 bp, Artificial Sequence
  Synthetic
acagttacagaacacacaacacatg

SEQ ID NO: 21725 - DNA, 20 bp, Artificial Sequence
  Synthetic
ttgctttcttgcagcagctg

SEQ ID NO: 21726 - DNA, 22 bp, Artificial Sequence
  Synthetic
ggcaatctggagagacagactc

SEQ ID NO: 21727 - DNA, 25 bp, Artificial Sequence
  Synthetic
tctgtagcatcatctataagcccaa

SEQ ID NO: 21728 - DNA, 20 bp, Artificial Sequence
  Synthetic
ggaacatgctgcaggcctag

SEQ ID NO: 21729 - DNA, 22 bp, Artificial Sequence
  Synthetic
ggtttctccggtttgtgcaacc

SEQ ID NO: 21730 - DNA, 25 bp, Artificial Sequence
  Synthetic
ggccaccaaagtatactaaactact

SEQ ID NO: 21731 - DNA, 25 bp, Artificial Sequence
  Synthetic
gttctgtagttatgtcaaagcctgt

SEQ ID NO: 21732 - DNA, 20 bp, Artificial Sequence
  Synthetic
aggatctggagcagcagttg

SEQ ID NO: 21733 - DNA, 22 bp, Artificial Sequence
  Synthetic
tgagggtgagacacaaagagtc

SEQ ID NO: 21734 - DNA, 25 bp, Artificial Sequence
  Synthetic
gccgtggaagtatatttctgtttct

SEQ ID NO: 21735 - DNA, 25 bp, Artificial Sequence
  Synthetic
cgtttaacttatttagcaaggggtg

SEQ ID NO: 21736 - DNA, 25 bp, Artificial Sequence
  Synthetic
cccaaatccaatatcacacatgtct

SEQ ID NO: 21737 - DNA, 20 bp, Artificial Sequence
  Synthetic
gcctgagtaccttgaccagg

SEQ ID NO: 21738 - DNA, 25 bp, Artificial Sequence
  Synthetic
tctgatagatccacatcccaaaagt

SEQ ID NO: 21739 - DNA, 21 bp, Artificial Sequence
  Synthetic
cgtgttgagacagcaccattt

SEQ ID NO: 21740 - DNA, 25 bp, Artificial Sequence
  Synthetic
gcttcccttgagcaatcaaatcaaa

SEQ ID NO: 21741 - DNA, 24 bp, Artificial Sequence
  Synthetic
ctgaaatgttggacccatcagtac

SEQ ID NO: 21742 - DNA, 25 bp, Artificial Sequence
  Synthetic
cctgttcagaagaatttgcagtttc

SEQ ID NO: 21743 - DNA, 23 bp, Artificial Sequence
  Synthetic
gatgttgcactttggtgattcac

SEQ ID NO: 21744 - DNA, 21 bp, Artificial Sequence
  Synthetic
gcgtcacctcctcgctttctc

SEQ ID NO: 21745 - DNA, 25 bp, Artificial Sequence
  Synthetic
ggcaatgtggtagtgactaaaaaca

SEQ ID NO: 21746 - DNA, 25 bp, Artificial Sequence
  Synthetic
ccaaaatagaccacacttccaaaca

SEQ ID NO: 21747 - DNA, 24 bp, Artificial Sequence
  Synthetic
gggggtctagcactgttactatat

SEQ ID NO: 21748 - DNA, 25 bp, Artificial Sequence
  Synthetic
accaaaagactgtgcatctacaaat

SEQ ID NO: 21749 - DNA, 22 bp, Artificial Sequence
  Synthetic
ccatagtgacgtcctcctcaaa

SEQ ID NO: 21750 - DNA, 25 bp, Artificial Sequence
  Synthetic
aggttgcacaggaatataaggtgta

SEQ ID NO: 21751 - DNA, 25 bp, Artificial Sequence
  Synthetic
tcaaagaaaggatgtccaactgtta

SEQ ID NO: 21752 - DNA, 25 bp, Artificial Sequence
  Synthetic
ggattttctgtatcctgcaatttgt

SEQ ID NO: 21753 - DNA, 25 bp, Artificial Sequence
  Synthetic
cgaaccactcggaattgtaaagtaa

SEQ ID NO: 21754 - DNA, 25 bp, Artificial Sequence
  Synthetic
ccacatgagtcaagtcaacatcatt

SEQ ID NO: 21755 - DNA, 25 bp, Artificial Sequence
  Synthetic
cccctgatgtgagtaatagggttaa

SEQ ID NO: 21756 - DNA, 22 bp, Artificial Sequence
  Synthetic
ttcctttgatctctccgaacct

SEQ ID NO: 21757 - DNA, 20 bp, Artificial Sequence
  Synthetic
accatcatggcatgcggatc

SEQ ID NO: 21758 - DNA, 21 bp, Artificial Sequence
  Synthetic
gctccactcttcctgttggaa

SEQ ID NO: 21759 - DNA, 21 bp, Artificial Sequence
  Synthetic
tccaagccacttgtctccatt

SEQ ID NO: 21760 - DNA, 25 bp, Artificial Sequence
  Synthetic
caagtatcttttccaccatcgtgta

SEQ ID NO: 21761 - DNA, 21 bp, Artificial Sequence
  Synthetic
cgcccgattgaaacttaccgt

SEQ ID NO: 21762 - DNA, 25 bp, Artificial Sequence
  Synthetic
ctggccaaactcttcttgtagtatt

SEQ ID NO: 21763 - DNA, 23 bp, Artificial Sequence
  Synthetic
tgaggacacaagaattgcagttc

SEQ ID NO: 21764 - DNA, 21 bp, Artificial Sequence
  Synthetic
ctcaaattcctgctggcgaag

SEQ ID NO: 21765 - DNA, 23 bp, Artificial Sequence
  Synthetic
aggtcaaattgcatagcatctgc

SEQ ID NO: 21766 - DNA, 25 bp, Artificial Sequence
  Synthetic
gtgtccaaagcctttcaaaaaaaga

SEQ ID NO: 21767 - DNA, 20 bp, Artificial Sequence
  Synthetic
cggaggtacgggttgatacc

SEQ ID NO: 21768 - DNA, 25 bp, Artificial Sequence
  Synthetic
ttccatccttataatatgcacctgc

SEQ ID NO: 21769 - DNA, 20 bp, Artificial Sequence
  Synthetic
ggtgtctcgtcgacggtgtc

SEQ ID NO: 21770 - DNA, 22 bp, Artificial Sequence
  Synthetic
ggaccctctggatcctctggaa

SEQ ID NO: 21771 - DNA, 22 bp, Artificial Sequence
  Synthetic
gctagcctcctccagtaacctt

SEQ ID NO: 21772 - DNA, 21 bp, Artificial Sequence
  Synthetic
tccacctattggttgaccacc

SEQ ID NO: 21773 - DNA, 25 bp, Artificial Sequence
  Synthetic
tgctacgtccctttcaaatatttgt

SEQ ID NO: 21774 - DNA, 25 bp, Artificial Sequence
  Synthetic
accagaatgttcccctaatagtgat

SEQ ID NO: 21775 - DNA, 25 bp, Artificial Sequence
  Synthetic
cacagcataaccttccaaatcttgt

SEQ ID NO: 21776 - DNA, 20 bp, Artificial Sequence
  Synthetic
tccgtgctttgtacccttgc

SEQ ID NO: 21777 - DNA, 20 bp, Artificial Sequence
  Synthetic
aacacctaaaggctggccac

SEQ ID NO: 21778 - DNA, 22 bp, Artificial Sequence
  Synthetic
gcagtattgggtatcgcatccc

SEQ ID NO: 21779 - DNA, 25 bp, Artificial Sequence
  Synthetic
gctcatatggatctttcctttctgg

SEQ ID NO: 21780 - DNA, 25 bp, Artificial Sequence
  Synthetic
gctttcaatgtgatgtttttgtcca

SEQ ID NO: 21781 - DNA, 24 bp, Artificial Sequence
  Synthetic
gccccaacagtaagaatgcatttc

SEQ ID NO: 21782 - DNA, 25 bp, Artificial Sequence
  Synthetic
agcttctcttaaaggttgagcaatt

SEQ ID NO: 21783 - DNA, 25 bp, Artificial Sequence
  Synthetic
cctctggagtgtcatcaatggataa

SEQ ID NO: 21784 - DNA, 25 bp, Artificial Sequence
  Synthetic
gcaactgtaggttccgtagaacttt

SEQ ID NO: 21785 - DNA, 25 bp, Artificial Sequence
  Synthetic
gcatacttggatttagccaaacttt

SEQ ID NO: 21786 - DNA, 25 bp, Artificial Sequence
  Synthetic
cagtccatgtaccagtttttccata

SEQ ID NO: 21787 - DNA, 23 bp, Artificial Sequence
  Synthetic
agtgacgctagtgtcaagcaata

SEQ ID NO: 21788 - DNA, 22 bp, Artificial Sequence
  Synthetic
agggcggagagatagaccaaca

SEQ ID NO: 21789 - DNA, 25 bp, Artificial Sequence
  Synthetic
tgtgcttagtactttgtcagtgtta

SEQ ID NO: 21790 - DNA, 20 bp, Artificial Sequence
  Synthetic
cacgtacccttttgacctgg

SEQ ID NO: 21791 - DNA, 20 bp, Artificial Sequence
  Synthetic
cagggatactgtcgccaaca

SEQ ID NO: 21792 - DNA, 24 bp, Artificial Sequence
  Synthetic
gcgtctttaggacagatagtagct

SEQ ID NO: 21793 - DNA, 23 bp, Artificial Sequence
  Synthetic
ggttacaatggtcacagcatgtg

SEQ ID NO: 21794 - DNA, 22 bp, Artificial Sequence
  Synthetic
tgaagagtgccagggaatttcc

SEQ ID NO: 21795 - DNA, 25 bp, Artificial Sequence
  Synthetic
gcactcttctacctgtgatagttca

SEQ ID NO: 21796 - DNA, 25 bp, Artificial Sequence
  Synthetic
gcactagccatttgatgattaacaa

SEQ ID NO: 21797 - DNA, 21 bp, Artificial Sequence
  Synthetic
ccttcccacttcttcagcaga

SEQ ID NO: 21798 - DNA, 23 bp, Artificial Sequence
  Synthetic
ccaaatggtctgtagccagtagc

SEQ ID NO: 21799 - DNA, 23 bp, Artificial Sequence
  Synthetic
tcttcagcagttattgtaggccc

SEQ ID NO: 21800 - DNA, 25 bp, Artificial Sequence
  Synthetic
ggcctactcaggtaattgatatctc

SEQ ID NO: 21801 - DNA, 25 bp, Artificial Sequence
  Synthetic
acaaagggttttctgaatctccata

SEQ ID NO: 21802 - DNA, 25 bp, Artificial Sequence
  Synthetic
tgctgatctgtcttgagaaaatgtt

SEQ ID NO: 21803 - DNA, 25 bp, Artificial Sequence
  Synthetic
tggtactttacaaagacgaaagact

SEQ ID NO: 21804 - DNA, 25 bp, Artificial Sequence
  Synthetic
acatgagtcagtattttgcaaacac

SEQ ID NO: 21805 - DNA, 24 bp, Artificial Sequence
  Synthetic
ccgccaaattttgagtcagtcaaa

SEQ ID NO: 21806 - DNA, 22 bp, Artificial Sequence
  Synthetic
gcttttctgctgcatccaacaa

SEQ ID NO: 21807 - DNA, 20 bp, Artificial Sequence
  Synthetic
atcgacgagctccagagtcg

SEQ ID NO: 21808 - DNA, 25 bp, Artificial Sequence
  Synthetic
tgagttagtgtctacctgtgtaaga

SEQ ID NO: 21809 - DNA, 25 bp, Artificial Sequence
  Synthetic
gcagctgattgatgttctaccaata

SEQ ID NO: 21810 - DNA, 20 bp, Artificial Sequence
  Synthetic
tcggtgtcggtggtcccacc

SEQ ID NO: 21811 - DNA, 22 bp, Artificial Sequence
  Synthetic
ggatcccgagcttcttcttgta

SEQ ID NO: 21812 - DNA, 25 bp, Artificial Sequence
  Synthetic
ggtgtagatggtgtcaatggtctat

SEQ ID NO: 21813 - DNA, 25 bp, Artificial Sequence
  Synthetic
actacagtaggtgtactttctggta

SEQ ID NO: 21814 - DNA, 25 bp, Artificial Sequence
  Synthetic
cttgtttttggtgggttaatagagc

SEQ ID NO: 21815 - DNA, 25 bp, Artificial Sequence
  Synthetic
gtttgtttgggatcaaaagacacat

SEQ ID NO: 21816 - DNA, 24 bp, Artificial Sequence
  Synthetic
ggccatttgcaagtactgtgaata

SEQ ID NO: 21817 - DNA, 25 bp, Artificial Sequence
  Synthetic
agcgtttacctaaagaaaactgtga

SEQ ID NO: 21818 - DNA, 21 bp, Artificial Sequence
  Synthetic
tcataggtaaacaggggtgcg

SEQ ID NO: 21819 - DNA, 25 bp, Artificial Sequence
  Synthetic
cctcttgttaaaacttgacctacct

SEQ ID NO: 21820 - DNA, 25 bp, Artificial Sequence
  Synthetic
cccatcagtttccatctgttcataa

SEQ ID NO: 21821 - DNA, 25 bp, Artificial Sequence
  Synthetic
ccctctcaatatcaatgcagatctt

SEQ ID NO: 21822 - DNA, 25 bp, Artificial Sequence
  Synthetic
ccctctgatgaagcttaacaatctt

SEQ ID NO: 21823 - DNA, 20 bp, Artificial Sequence
  Synthetic
ccagtgaatgctgccatgat

SEQ ID NO: 21824 - DNA, 20 bp, Artificial Sequence
  Synthetic
aagccatgggtacactgtcc

SEQ ID NO: 21825 - DNA, 23 bp, Artificial Sequence
  Synthetic
aggtcaatttcagtttgcggtac

SEQ ID NO: 21826 - DNA, 23 bp, Artificial Sequence
  Synthetic
gcagcgtctgtgtatctgcatat

SEQ ID NO: 21827 - DNA, 25 bp, Artificial Sequence
  Synthetic
gcctatatccatatcactgtctgct

SEQ ID NO: 21828 - DNA, 23 bp, Artificial Sequence
  Synthetic
cgtcattatcaaatgcccattgc

SEQ ID NO: 21829 - DNA, 25 bp, Artificial Sequence
  Synthetic
gaagtcgaccccttgatatcttaaa

SEQ ID NO: 21830 - DNA, 21 bp, Artificial Sequence
  Synthetic
cccatatgcacttcccatgtg

SEQ ID NO: 21831 - DNA, 25 bp, Artificial Sequence
  Synthetic
gcaaagcaaaaacacaaaactaaca

SEQ ID NO: 21832 - DNA, 25 bp, Artificial Sequence
  Synthetic
gccctacacaaagcaaaagtgtaat

SEQ ID NO: 21833 - DNA, 24 bp, Artificial Sequence
  Synthetic
cctcaataactgggggttcaacaa

SEQ ID NO: 21834 - DNA, 20 bp, Artificial Sequence
  Synthetic
gtcaggatcaggtgccacac

SEQ ID NO: 21835 - DNA, 25 bp, Artificial Sequence
  Synthetic
gcctacgccttaaaaagtatacagg

SEQ ID NO: 21836 - DNA, 25 bp, Artificial Sequence
  Synthetic
catctgttttggaattaccagcctt

SEQ ID NO: 21837 - DNA, 22 bp, Artificial Sequence
  Synthetic
tttgtgttcctagtggtgtcca

SEQ ID NO: 21838 - DNA, 20 bp, Artificial Sequence
  Synthetic
ctaagcttgtggcagctggg

SEQ ID NO: 21839 - DNA, 20 bp, Artificial Sequence
  Synthetic
tgcgtttggctgatggtgta

SEQ ID NO: 21840 - DNA, 21 bp, Artificial Sequence
  Synthetic
aaaagggtggaggacataggg

SEQ ID NO: 21841 - DNA, 24 bp, Artificial Sequence
  Synthetic
ccaacagcagtaaagtatgctgat

SEQ ID NO: 21842 - DNA, 25 bp, Artificial Sequence
  Synthetic
cctcaggattgggaaaaaacatttc

SEQ ID NO: 21843 - DNA, 24 bp, Artificial Sequence
  Synthetic
actcgtaacatgtaaggtcagtct

SEQ ID NO: 21844 - DNA, 23 bp, Artificial Sequence
  Synthetic
cccaattacctgaatcagccatc

SEQ ID NO: 21845 - DNA, 25 bp, Artificial Sequence
  Synthetic
tgagataggtcaaattgacagtcct

SEQ ID NO: 21846 - DNA, 20 bp, Artificial Sequence
  Synthetic
tgtccagcatgcaggtgttg

SEQ ID NO: 21847 - DNA, 25 bp, Artificial Sequence
  Synthetic
tgccttccagttttcattagtaagt

SEQ ID NO: 21848 - DNA, 21 bp, Artificial Sequence
  Synthetic
tcgtgatactgcaaggcttgg

SEQ ID NO: 21849 - DNA, 22 bp, Artificial Sequence
  Synthetic
attgccctcaacctttggaatt

SEQ ID NO: 21850 - DNA, 20 bp, Artificial Sequence
  Synthetic
ggcactatggaggtaggacc

SEQ ID NO: 21851 - DNA, 25 bp, Artificial Sequence
  Synthetic
aagcaggcctatgtaactttacaat

SEQ ID NO: 21852 - DNA, 25 bp, Artificial Sequence
  Synthetic
gccacatctgcaaaaaaatatgaca

SEQ ID NO: 21853 - DNA, 22 bp, Artificial Sequence
  Synthetic
gtaccccaatgttcccctaagg

SEQ ID NO: 21854 - DNA, 25 bp, Artificial Sequence
  Synthetic
gccctgttaaataggtgtctaacaa

SEQ ID NO: 21855 - DNA, 22 bp, Artificial Sequence
  Synthetic
aagcggtcgcagaataacttta

SEQ ID NO: 21856 - DNA, 24 bp, Artificial Sequence
  Synthetic
tccattattgtgtcaacctgctct

SEQ ID NO: 21857 - DNA, 20 bp, Artificial Sequence
  Synthetic
gaggtcattggctggactgg

SEQ ID NO: 21858 - DNA, 25 bp, Artificial Sequence
  Synthetic
gtgaatcccccacagtactaaaaga

SEQ ID NO: 21859 - DNA, 25 bp, Artificial Sequence
  Synthetic
ccctttcttgacaattttgtatgca

SEQ ID NO: 21860 - DNA, 25 bp, Artificial Sequence
  Synthetic
catcctccctctataaaacctgcta

SEQ ID NO: 21861 - DNA, 25 bp, Artificial Sequence
  Synthetic
aagttcagcattataagtccagaca

SEQ ID NO: 21862 - DNA, 25 bp, Artificial Sequence
  Synthetic
cccattgattccaattttactccac

SEQ ID NO: 21863 - DNA, 25 bp, Artificial Sequence
  Synthetic
catcagtctccatctgttcgtaaga

SEQ ID NO: 21864 - DNA, 25 bp, Artificial Sequence
  Synthetic
ctcttctgtatataggtcctccagt

SEQ ID NO: 21865 - DNA, 24 bp, Artificial Sequence
  Synthetic
aattccatcaccattgttccaact

SEQ ID NO: 21866 - DNA, 25 bp, Artificial Sequence
  Synthetic
ccctttgatgaagctcaatactctt

SEQ ID NO: 21867 - DNA, 25 bp, Artificial Sequence
  Synthetic
ctcctcggttactaattcatcacat

SEQ ID NO: 21868 - DNA, 21 bp, Artificial Sequence
  Synthetic
gttgcagtcttgggctcaaat

SEQ ID NO: 21869 - DNA, 23 bp, Artificial Sequence
  Synthetic
acatcattactgtaacgcccgtc

SEQ ID NO: 21870 - DNA, 23 bp, Artificial Sequence
  Synthetic
cccatctactagtggttgcaacc

SEQ ID NO: 21871 - DNA, 20 bp, Artificial Sequence
  Synthetic
ccatctgagctgtcgtctgg

SEQ ID NO: 21872 - DNA, 25 bp, Artificial Sequence
  Synthetic
actgcattgtcctcattatttccat

SEQ ID NO: 21873 - DNA, 24 bp, Artificial Sequence
  Synthetic
gtgtctattaggcagtcgatgtcc

SEQ ID NO: 21874 - DNA, 25 bp, Artificial Sequence
  Synthetic
ggccatataccgatatgtaagaagg

SEQ ID NO: 21875 - DNA, 21 bp, Artificial Sequence
  Synthetic
agccatcaacaatagaggcca

SEQ ID NO: 21876 - DNA, 23 bp, Artificial Sequence
  Synthetic
accatccacaacaataggaggtt

SEQ ID NO: 21877 - DNA, 23 bp, Artificial Sequence
  Synthetic
caaccaacaacaaacaactgtgt

SEQ ID NO: 21878 - DNA, 24 bp, Artificial Sequence
  Synthetic
gcaaaatataaagagggagccagc

SEQ ID NO: 21879 - DNA, 22 bp, Artificial Sequence
  Synthetic
ccttttccttaggaggctctgc

SEQ ID NO: 21880 - DNA, 24 bp, Artificial Sequence
  Synthetic
gaacatacctgctggcaaaattgg

SEQ ID NO: 21881 - DNA, 21 bp, Artificial Sequence
  Synthetic
gtccgtctctctgttttggcc

SEQ ID NO: 21882 - DNA, 24 bp, Artificial Sequence
  Synthetic
ttagcagaaatggttcaatggtgt

SEQ ID NO: 21883 - DNA, 23 bp, Artificial Sequence
  Synthetic
cttgttggctgttcatggatact

SEQ ID NO: 21884 - DNA, 20 bp, Artificial Sequence
  Synthetic
ggtttgcaaccccttcctag

SEQ ID NO: 21885 - DNA, 19 bp, Artificial Sequence
  Synthetic
ctcccacccaggcggcata

SEQ ID NO: 21886 - DNA, 21 bp, Artificial Sequence
  Synthetic
ctgctggagaagtgggaagcg

SEQ ID NO: 21887 - DNA, 25 bp, Artificial Sequence
  Synthetic
aaagcagtttctaagtagtgtgtct

SEQ ID NO: 21888 - DNA, 23 bp, Artificial Sequence
  Synthetic
aagaatcaggtcctagcactagc

SEQ ID NO: 21889 - DNA, 25 bp, Artificial Sequence
  Synthetic
cggacattaagtagaccaacattca

SEQ ID NO: 21890 - DNA, 22 bp, Artificial Sequence
  Synthetic
agatgcattagctgagtctgct

SEQ ID NO: 21891 - DNA, 25 bp, Artificial Sequence
  Synthetic
ttgttcaataaatatgctgacgtgg

SEQ ID NO: 21892 - DNA, 23 bp, Artificial Sequence
  Synthetic
ttgctccctacacgtattttcca

SEQ ID NO: 21893 - DNA, 25 bp, Artificial Sequence
  Synthetic
ctatggatctgtctgaaagactgtc

SEQ ID NO: 21894 - DNA, 20 bp, Artificial Sequence
  Synthetic
gctgtggacagtgtggtcag

SEQ ID NO: 21895 - DNA, 25 bp, Artificial Sequence
  Synthetic
actgaaaaatgagaggtaatgctcc

SEQ ID NO: 21896 - DNA, 21 bp, Artificial Sequence
  Synthetic
atcctgtgcaagaaaccgtgg

SEQ ID NO: 21897 - DNA, 24 bp, Artificial Sequence
  Synthetic
ctaaaagtccagaagttgcagttg

SEQ ID NO: 21898 - DNA, 25 bp, Artificial Sequence
  Synthetic
acctaaaacatccagaaggagatgg

SEQ ID NO: 21899 - DNA, 22 bp, Artificial Sequence
  Synthetic
aggagagtcctgctaggagacg

SEQ ID NO: 21900 - DNA, 22 bp, Artificial Sequence
  Synthetic
gcttgggatccgccaataattc

SEQ ID NO: 21901 - DNA, 23 bp, Artificial Sequence
  Synthetic
gacccacaattcctgttgacact

SEQ ID NO: 21902 - DNA, 24 bp, Artificial Sequence
  Synthetic
ttagcaatgcagaagaaggtgtag

SEQ ID NO: 21903 - DNA, 25 bp, Artificial Sequence
  Synthetic
ctgaatttgaaattgaagcccctcc

SEQ ID NO: 21904 - DNA, 25 bp, Artificial Sequence
  Synthetic
taggacgtcctagatacagtgaaac

SEQ ID NO: 21905 - DNA, 23 bp, Artificial Sequence
  Synthetic
cgcaaacgaaaacgaatagctat

SEQ ID NO: 21906 - DNA, 22 bp, Artificial Sequence
  Synthetic
agttcctcatgtctcaggaagt

SEQ ID NO: 21907 - DNA, 25 bp, Artificial Sequence
  Synthetic
acccaactatttattgtaggctgtg

SEQ ID NO: 21908 - DNA, 24 bp, Artificial Sequence
  Synthetic
tagtggttctctagtttccagtga

SEQ ID NO: 21909 - DNA, 21 bp, Artificial Sequence
  Synthetic
tagtggtctgcggaaccggtg

SEQ ID NO: 21910 - DNA, 20 bp, Artificial Sequence
  Synthetic
ggccctagattgggtgtgcg

SEQ ID NO: 21911 - DNA, 19 bp, Artificial Sequence
  Synthetic
ccagggctctggcacatgg

SEQ ID NO: 21912 - DNA, 20 bp, Artificial Sequence
  Synthetic
ccactttggcggtccgctat

SEQ ID NO: 21913 - DNA, 20 bp, Artificial Sequence
  Synthetic
ttgccgcttacgctgtgaga

SEQ ID NO: 21914 - DNA, 22 bp, Artificial Sequence
  Synthetic
cagtgactttgaccaggggtgg

SEQ ID NO: 21915 - DNA, 21 bp, Artificial Sequence
  Synthetic
cccagggtgcccagagtaaca

SEQ ID NO: 21916 - DNA, 22 bp, Artificial Sequence
  Synthetic
tgctccattccactacggagct

SEQ ID NO: 21917 - DNA, 22 bp, Artificial Sequence
  Synthetic
gggaacccatggtatctggtgg

SEQ ID NO: 21918 - DNA, 20 bp, Artificial Sequence
  Synthetic
tccctcctctcaaccctcgg

SEQ ID NO: 21919 - DNA, 22 bp, Artificial Sequence
  Synthetic
cgttgcagtcgagcccgtgata

SEQ ID NO: 21920 - DNA, 22 bp, Artificial Sequence
  Synthetic
tccacctcaacgcagaccttcc

SEQ ID NO: 21921 - DNA, 21 bp, Artificial Sequence
  Synthetic
gcccccaaagtcattgcgttg

SEQ ID NO: 21922 - DNA, 20 bp, Artificial Sequence
  Synthetic
accacgggggctcccataac

SEQ ID NO: 21923 - DNA, 22 bp, Artificial Sequence
  Synthetic
aaatgtgatgagcttgccggga

SEQ ID NO: 21924 - DNA, 21 bp, Artificial Sequence
  Synthetic
gctctcagagacgtgggagga

SEQ ID NO: 21925 - DNA, 22 bp, Artificial Sequence
  Synthetic
tggaagagtgctccaaagctcc

SEQ ID NO: 21926 - DNA, 22 bp, Artificial Sequence
  Synthetic
agtcaacatcctgggtgggtgg

SEQ ID NO: 21927 - DNA, 21 bp, Artificial Sequence
  Synthetic
ggcataccggcactagtgagg

SEQ ID NO: 21928 - DNA, 22 bp, Artificial Sequence
  Synthetic
ggcatcatgaacaccaagtgcc

SEQ ID NO: 21929 - DNA, 22 bp, Artificial Sequence
  Synthetic
tccttcccccgaattcttcagc

SEQ ID NO: 21930 - DNA, 19 bp, Artificial Sequence
  Synthetic
tccaccacccaggcggaag

SEQ ID NO: 21931 - DNA, 22 bp, Artificial Sequence
  Synthetic
ctacaggacatgaccaccccga

SEQ ID NO: 21932 - DNA, 22 bp, Artificial Sequence
  Synthetic
tatcagtgctgcaacctcgacc

SEQ ID NO: 21933 - DNA, 22 bp, Artificial Sequence
  Synthetic
cgagagcaagggagtcgaacgg

SEQ ID NO: 21934 - DNA, 20 bp, Artificial Sequence
  Synthetic
ctggccggctcgatctttcg

SEQ ID NO: 21935 - DNA, 25 bp, Artificial Sequence
  Synthetic
aagaatgaacatcttcccctaatgt

SEQ ID NO: 21936 - DNA, 21 bp, Artificial Sequence
  Synthetic
tcttgggagtggagtcaatga

SEQ ID NO: 21937 - DNA, 24 bp, Artificial Sequence
  Synthetic
cgtgattagaacacacgagtactc

SEQ ID NO: 21938 - DNA, 23 bp, Artificial Sequence
  Synthetic
gacaaattgactcaggggagaca

SEQ ID NO: 21939 - DNA, 23 bp, Artificial Sequence
  Synthetic
agaaggccaaactatcaaatgca

SEQ ID NO: 21940 - DNA, 25 bp, Artificial Sequence
  Synthetic
gcacaaacagccatacaattattca

SEQ ID NO: 21941 - DNA, 24 bp, Artificial Sequence
  Synthetic
acaacataatggaccctgagtaca

SEQ ID NO: 21942 - DNA, 23 bp, Artificial Sequence
  Synthetic
tttgaggcttgctttaacagtgc

SEQ ID NO: 21943 - DNA, 25 bp, Artificial Sequence
  Synthetic
attggataccatgccaataattcca

SEQ ID NO: 21944 - DNA, 20 bp, Artificial Sequence
  Synthetic
ttgtgttacccaggcagctt

SEQ ID NO: 21945 - DNA, 25 bp, Artificial Sequence
  Synthetic
aaatgctaataatttggggagtgca

SEQ ID NO: 21946 - DNA, 25 bp, Artificial Sequence
  Synthetic
catgaagacagaaggaacacttgag

SEQ ID NO: 21947 - DNA, 23 bp, Artificial Sequence
  Synthetic
aggaatggttgatggttggtatg

SEQ ID NO: 21948 - DNA, 25 bp, Artificial Sequence
  Synthetic
gactgatgatcacagacatgagacc

SEQ ID NO: 21949 - DNA, 25 bp, Artificial Sequence
  Synthetic
acactcaacaaagatcaacttctgt

SEQ ID NO: 21950 - DNA, 22 bp, Artificial Sequence
  Synthetic
gccaacagcttctatgaagtgt

SEQ ID NO: 21951 - DNA, 23 bp, Artificial Sequence
  Synthetic
acagaggtacaccaaggaatcaa

SEQ ID NO: 21952 - DNA, 25 bp, Artificial Sequence
  Synthetic
atcagaactgaagcattaatgacca

SEQ ID NO: 21953 - DNA, 22 bp, Artificial Sequence
  Synthetic
caactcacccatccaaccaaac

SEQ ID NO: 21954 - DNA, 23 bp, Artificial Sequence
  Synthetic
aaactcaagaagtgcagtgctag

SEQ ID NO: 21955 - DNA, 25 bp, Artificial Sequence
  Synthetic
tactgttagtcatcacagtgactga

SEQ ID NO: 21956 - DNA, 24 bp, Artificial Sequence
  Synthetic
atccacatggggcaaataatcatt

SEQ ID NO: 21957 - DNA, 25 bp, Artificial Sequence
  Synthetic
gcacaaatcacattatccattctgg

SEQ ID NO: 21958 - DNA, 22 bp, Artificial Sequence
  Synthetic
agcatatgcagcaacaatccaa

SEQ ID NO: 21959 - DNA, 20 bp, Artificial Sequence
  Synthetic
ccctccactcaacctcctcc

SEQ ID NO: 21960 - DNA, 21 bp, Artificial Sequence
  Synthetic
caatccttgctgcagtcacac

SEQ ID NO: 21961 - DNA, 23 bp, Artificial Sequence
  Synthetic
agtgtcttaaccagcaaagtgtt

SEQ ID NO: 21962 - DNA, 24 bp, Artificial Sequence
  Synthetic
tcttcccactagctgaaacatgta

SEQ ID NO: 21963 - DNA, 25 bp, Artificial Sequence
  Synthetic
gcacctaatcatgttcttacaatgg

SEQ ID NO: 21964 - DNA, 20 bp, Artificial Sequence
  Synthetic
gccatgagcaaactcctcac

SEQ ID NO: 21965 - DNA, 24 bp, Artificial Sequence
  Synthetic
tgtaggtagaatgtttgcaatgca

SEQ ID NO: 21966 - DNA, 22 bp, Artificial Sequence
  Synthetic
gaacctacatatcctcacgggc

SEQ ID NO: 21967 - DNA, 25 bp, Artificial Sequence
  Synthetic
tacagtcagtagtagaccatgtgaa

SEQ ID NO: 21968 - DNA, 20 bp, Artificial Sequence
  Synthetic
cctcccgggagagccatagt

SEQ ID NO: 21969 - DNA, 22 bp, Artificial Sequence
  Synthetic
caggggccctagattgggtgtg

SEQ ID NO: 21970 - DNA, 19 bp, Artificial Sequence
  Synthetic
cgcatggcgtccgggttct

SEQ ID NO: 21971 - DNA, 18 bp, Artificial Sequence
  Synthetic
ggtgttgggtggcggtga

SEQ ID NO: 21972 - DNA, 22 bp, Artificial Sequence
  Synthetic
tcatggacatgatcgctggtgc

SEQ ID NO: 21973 - DNA, 22 bp, Artificial Sequence
  Synthetic
tcagttatgccaacggaagcgg

SEQ ID NO: 21974 - DNA, 20 bp, Artificial Sequence
  Synthetic
gcccccttgtgtcatcggag

SEQ ID NO: 21975 - DNA, 19 bp, Artificial Sequence
  Synthetic
agcccgttgctgctgtcca

SEQ ID NO: 21976 - DNA, 22 bp, Artificial Sequence
  Synthetic
cctcgtgttcttctgctttgcg

SEQ ID NO: 21977 - DNA, 21 bp, Artificial Sequence
  Synthetic
aaagtcccctacttcgtgcgc

SEQ ID NO: 21978 - DNA, 22 bp, Artificial Sequence
  Synthetic
ggagaccaagctcatcacgtgg

SEQ ID NO: 21979 - DNA, 21 bp, Artificial Sequence
  Synthetic
ggaacgaggaccatcgcatca

SEQ ID NO: 21980 - DNA, 22 bp, Artificial Sequence
  Synthetic
tccctgtggagaacctagggac

SEQ ID NO: 21981 - DNA, 21 bp, Artificial Sequence
  Synthetic
cgggtgctcaggaggtgctta

SEQ ID NO: 21982 - DNA, 20 bp, Artificial Sequence
  Synthetic
gaagctggtcgcattgggca

SEQ ID NO: 21983 - DNA, 22 bp, Artificial Sequence
  Synthetic
tctgtgagtgctatgacgcggg

SEQ ID NO: 21984 - DNA, 21 bp, Artificial Sequence
  Synthetic
tgaagtcaccctgacgcaccc

SEQ ID NO: 21985 - DNA, 21 bp, Artificial Sequence
  Synthetic
gtcccgccatgcagaggttat

SEQ ID NO: 21986 - DNA, 19 bp, Artificial Sequence
  Synthetic
tgtgggtgctggcctagct

SEQ ID NO: 21987 - DNA, 19 bp, Artificial Sequence
  Synthetic
cgcccgcgtcactgccata

SEQ ID NO: 21988 - DNA, 22 bp, Artificial Sequence
  Synthetic
ctgcaggaacatgtggagtggg

SEQ ID NO: 21989 - DNA, 21 bp, Artificial Sequence
  Synthetic
gcaattaccttgcgagcccga

SEQ ID NO: 21990 - DNA, 21 bp, Artificial Sequence
  Synthetic
tgtggcagaggaggatgagcg

SEQ ID NO: 21991 - DNA, 22 bp, Artificial Sequence
  Synthetic
acgacaacatcctctgagcccg

SEQ ID NO: 21992 - DNA, 22 bp, Artificial Sequence
  Synthetic
agactgcaagttctggacagcc

SEQ ID NO: 21993 - DNA, 20 bp, Artificial Sequence
  Synthetic
gcgtgtgcgagaagatggcc

SEQ ID NO: 21994 - DNA, 21 bp, Artificial Sequence
  Synthetic
ttcaaggggggaaaactgcgg

SEQ ID NO: 21995 - DNA, 20 bp, Artificial Sequence
  Synthetic
cgcgtgggagacagcaagac

SEQ ID NO: 21996 - DNA, 22 bp, Artificial Sequence
  Synthetic
tgcctcagaaaacttggggtcc

SEQ ID NO: 21997 - DNA, 23 bp, Artificial Sequence
  Synthetic
agatccgaaaatcgaaacgaaca

SEQ ID NO: 21998 - DNA, 25 bp, Artificial Sequence
  Synthetic
gtatgactacaaggagaaccgattt

SEQ ID NO: 21999 - DNA, 23 bp, Artificial Sequence
  Synthetic
aagaacatgaggaaaacaagcca

SEQ ID NO: 22000 - DNA, 24 bp, Artificial Sequence
  Synthetic
atgagaaggaactatttcacagcg

SEQ ID NO: 22001 - DNA, 20 bp, Artificial Sequence
  Synthetic
tggagccacacagatgggaa

SEQ ID NO: 22002 - DNA, 23 bp, Artificial Sequence
  Synthetic
aatcagaaacatggccaattgga

SEQ ID NO: 22003 - DNA, 23 bp, Artificial Sequence
  Synthetic
tttgcatcagaatagaccaggca

SEQ ID NO: 22004 - DNA, 24 bp, Artificial Sequence
  Synthetic
agaagcagtaatgagaatgggaga

SEQ ID NO: 22005 - DNA, 20 bp, Artificial Sequence
  Synthetic
agccgcgtactctagctgat

SEQ ID NO: 22006 - DNA, 22 bp, Artificial Sequence
  Synthetic
gcagggagcaattagaagactc

SEQ ID NO: 22007 - DNA, 24 bp, Artificial Sequence
  Synthetic
aattgtagaacgtaaaacagggga

SEQ ID NO: 22008 - DNA, 22 bp, Artificial Sequence
  Synthetic
ggggctatatccctaggacggc

SEQ ID NO: 22009 - DNA, 25 bp, Artificial Sequence
  Synthetic
tgtgctttgatagaaaacatcgagc

SEQ ID NO: 22010 - DNA, 21 bp, Artificial Sequence
  Synthetic
ccaggaaaggcttctagacct

SEQ ID NO: 22011 - DNA, 22 bp, Artificial Sequence
  Synthetic
cgtggacattacaggacacatg

SEQ ID NO: 22012 - DNA, 25 bp, Artificial Sequence
  Synthetic
aaaaggaagcatctaagtatgggga

SEQ ID NO: 22013 - DNA, 24 bp, Artificial Sequence
  Synthetic
agatgttaccctacactttgagca

SEQ ID NO: 22014 - DNA, 22 bp, Artificial Sequence
  Synthetic
atttccacaaacacccattgct

SEQ ID NO: 22015 - DNA, 25 bp, Artificial Sequence
  Synthetic
atcctgattaccttaaaatggctgc

SEQ ID NO: 22016 - DNA, 23 bp, Artificial Sequence
  Synthetic
cccagggtcaaaacaatggtatt

SEQ ID NO: 22017 - DNA, 22 bp, Artificial Sequence
  Synthetic
ccccagctacaagtagtttgga

SEQ ID NO: 22018 - DNA, 20 bp, Artificial Sequence
  Synthetic
actacgtccgccgtctaggt

SEQ ID NO: 22019 - DNA, 19 bp, Artificial Sequence
  Synthetic
cgggattcgagcgcccctt

SEQ ID NO: 22020 - DNA, 19 bp, Artificial Sequence
  Synthetic
cgccgtcatcctccaccca

SEQ ID NO: 22021 - DNA, 22 bp, Artificial Sequence
  Synthetic
aagacctccaagacctcctgca

SEQ ID NO: 22022 - DNA, 22 bp, Artificial Sequence
  Synthetic
ccttcctgggcctctatcctcc

SEQ ID NO: 22023 - DNA, 20 bp, Artificial Sequence
  Synthetic
cttccggtgcgggaaagcag

SEQ ID NO: 22024 - DNA, 20 bp, Artificial Sequence
  Synthetic
tacaggcgccagctgtcctt

SEQ ID NO: 22025 - DNA, 20 bp, Artificial Sequence
  Synthetic
gacctgcgggccactaactc

SEQ ID NO: 22026 - DNA, 20 bp, Artificial Sequence
  Synthetic
ctggcccatatcctgcagcc

SEQ ID NO: 22027 - DNA, 22 bp, Artificial Sequence
  Synthetic
aggcatactgatccccgagacc

SEQ ID NO: 22028 - DNA, 20 bp, Artificial Sequence
  Synthetic
ggggcagctacttgcctcag

SEQ ID NO: 22029 - DNA, 21 bp, Artificial Sequence
  Synthetic
acctgatcccatctccaggct

SEQ ID NO: 22030 - DNA, 24 bp, Artificial Sequence
  Synthetic
gctattcgccatactacccatgtc

SEQ ID NO: 22031 - DNA, 21 bp, Artificial Sequence
  Synthetic
agttctgcccagtggatcccg

SEQ ID NO: 22032 - DNA, 21 bp, Artificial Sequence
  Synthetic
gttcatggaccctcgacctgc

SEQ ID NO: 22033 - DNA, 22 bp, Artificial Sequence
  Synthetic
cagcccctactggaaatttcag

SEQ ID NO: 22034 - DNA, 19 bp, Artificial Sequence
  Synthetic
gagcagtaccggtggcggt

SEQ ID NO: 22035 - DNA, 22 bp, Artificial Sequence
  Synthetic
atcctccttctcctgcagcaac

SEQ ID NO: 22036 - DNA, 22 bp, Artificial Sequence
  Synthetic
tcgcttcctcttctcctcagcc

SEQ ID NO: 22037 - DNA, 21 bp, Artificial Sequence
  Synthetic
tatcagcccacttcccagggt

SEQ ID NO: 22038 - DNA, 22 bp, Artificial Sequence
  Synthetic
acccttaaggtccttaccccgc

SEQ ID NO: 22039 - DNA, 20 bp, Artificial Sequence
  Synthetic
tcaaaccaaggcctaccacc

SEQ ID NO: 22040 - DNA, 22 bp, Artificial Sequence
  Synthetic
taagctcagacctccgggaagc

SEQ ID NO: 22041 - DNA, 18 bp, Artificial Sequence
  Synthetic
acgccggttgagtcgcgt

SEQ ID NO: 22042 - DNA, 23 bp, Artificial Sequence
  Synthetic
agaagtacacatcagggagacag

SEQ ID NO: 22043 - DNA, 25 bp, Artificial Sequence
  Synthetic
aagtcgaaaggttaaaacatggaac

SEQ ID NO: 22044 - DNA, 25 bp, Artificial Sequence
  Synthetic
tggttgcatacatgttagagagaga

SEQ ID NO: 22045 - DNA, 20 bp, Artificial Sequence
  Synthetic
attggagatgtgccacagca

SEQ ID NO: 22046 - DNA, 23 bp, Artificial Sequence
  Synthetic
ggaaaagggcaacagctatactc

SEQ ID NO: 22047 - DNA, 25 bp, Artificial Sequence
  Synthetic
aattggggaattgaacatatcgaca

SEQ ID NO: 22048 - DNA, 21 bp, Artificial Sequence
  Synthetic
acaggggacagagaaactgac

SEQ ID NO: 22049 - DNA, 24 bp, Artificial Sequence
  Synthetic
tgtacttgggacatttgataccac

SEQ ID NO: 22050 - DNA, 20 bp, Artificial Sequence
  Synthetic
gtggagtccgctgttctgag

SEQ ID NO: 22051 - DNA, 21 bp, Artificial Sequence
  Synthetic
tatcagaatggaccaggcgat

SEQ ID NO: 22052 - DNA, 23 bp, Artificial Sequence
  Synthetic
aacacagttcgagtctctgaaac

SEQ ID NO: 22053 - DNA, 22 bp, Artificial Sequence
  Synthetic
acaggaacaggatacaccatgg

SEQ ID NO: 22054 - DNA, 21 bp, Artificial Sequence
  Synthetic
ctaactcaaggtcgccagact

SEQ ID NO: 22055 - DNA, 25 bp, Artificial Sequence
  Synthetic
agagcactgacattaaatacgatga

SEQ ID NO: 22056 - DNA, 23 bp, Artificial Sequence
  Synthetic
ctttcacaatcactggggacaac

SEQ ID NO: 22057 - DNA, 21 bp, Artificial Sequence
  Synthetic
gctagcaagcattgacctgaa

SEQ ID NO: 22058 - DNA, 23 bp, Artificial Sequence
  Synthetic
ctcatagtgaatgcaccaaacca

SEQ ID NO: 22059 - DNA, 22 bp, Artificial Sequence
  Synthetic
cccagatggctcttcaattgtt

SEQ ID NO: 22060 - DNA, 19 bp, Artificial Sequence
  Synthetic
gacggcctcgctgactgga

SEQ ID NO: 22061 - DNA, 22 bp, Artificial Sequence
  Synthetic
tattgccacgcatccggatcac

SEQ ID NO: 22062 - DNA, 19 bp, Artificial Sequence
  Synthetic
acgccgtccaacttcacgc

SEQ ID NO: 22063 - DNA, 22 bp, Artificial Sequence
  Synthetic
tccaataaacccatcccctcgc

SEQ ID NO: 22064 - DNA, 22 bp, Artificial Sequence
  Synthetic
gggacggaggagagacgatgca

SEQ ID NO: 22065 - DNA, 25 bp, Artificial Sequence
  Synthetic
atacaccacatcgttggataatacg

SEQ ID NO: 22066 - DNA, 22 bp, Artificial Sequence
  Synthetic
cgttatcatctgctcccgctgc

SEQ ID NO: 22067 - DNA, 22 bp, Artificial Sequence
  Synthetic
cggattccaagtcagagcggcg

SEQ ID NO: 22068 - DNA, 19 bp, Artificial Sequence
  Synthetic
tcagccacgacgcgagtga

SEQ ID NO: 22069 - DNA, 21 bp, Artificial Sequence
  Synthetic
tctcatcaccgagaccgcggg

SEQ ID NO: 22070 - DNA, 19 bp, Artificial Sequence
  Synthetic
cgcccgatccctccaggtt

SEQ ID NO: 22071 - DNA, 20 bp, Artificial Sequence
  Synthetic
catcgggtagacggcgctag

SEQ ID NO: 22072 - DNA, 19 bp, Artificial Sequence
  Synthetic
ggaggaaactgccgcggga

SEQ ID NO: 22073 - DNA, 22 bp, Artificial Sequence
  Synthetic
gcacgctgcatggctaaatacc

SEQ ID NO: 22074 - DNA, 20 bp, Artificial Sequence
  Synthetic
gcatgaactgcccgtggtgg

SEQ ID NO: 22075 - DNA, 18 bp, Artificial Sequence
  Synthetic
tgaggttgcgggccaggt

SEQ ID NO: 22076 - DNA, 20 bp, Artificial Sequence
  Synthetic
tctgagcgagtcccttgcgc

SEQ ID NO: 22077 - DNA, 19 bp, Artificial Sequence
  Synthetic
cgcaagtaatgggtgcgcg

SEQ ID NO: 22078 - DNA, 22 bp, Artificial Sequence
  Synthetic
cgagagcccgtcgtgatagtcc

SEQ ID NO: 22079 - DNA, 19 bp, Artificial Sequence
  Synthetic
acatgcgccctgggtctga

SEQ ID NO: 22080 - DNA, 18 bp, Artificial Sequence
  Synthetic
cgtgcgccacgccaagat

SEQ ID NO: 22081 - DNA, 22 bp, Artificial Sequence
  Synthetic
caggcggtgcagatcggttttc

SEQ ID NO: 22082 - DNA, 22 bp, Artificial Sequence
  Synthetic
cgggtacgacctgcgatttagc

SEQ ID NO: 22083 - DNA, 20 bp, Artificial Sequence
  Synthetic
ccgctggtcggtttctgact

SEQ ID NO: 22084 - DNA, 19 bp, Artificial Sequence
  Synthetic
gcgctccacgatctcggca

SEQ ID NO: 22085 - DNA, 21 bp, Artificial Sequence
  Synthetic
accaggacaaggtggtgagct

SEQ ID NO: 22086 - DNA, 20 bp, Artificial Sequence
  Synthetic
ggccttggtggacttccagg

SEQ ID NO: 22087 - DNA, 22 bp, Artificial Sequence
  Synthetic
agagggctcatccgactctgcc

SEQ ID NO: 22088 - DNA, 20 bp, Artificial Sequence
  Synthetic
caggggcgagtccgtcgtca

SEQ ID NO: 22089 - DNA, 22 bp, Artificial Sequence
  Synthetic
tcgcgcatagtgtggaagtggt

SEQ ID NO: 22090 - DNA, 21 bp, Artificial Sequence
  Synthetic
cccctccgtattcttgtcgcg

SEQ ID NO: 22091 - DNA, 20 bp, Artificial Sequence
  Synthetic
tgctgggcgccaggaaaaac

SEQ ID NO: 22092 - DNA, 20 bp, Artificial Sequence
  Synthetic
acctgacggtgaaccaccca

SEQ ID NO: 22093 - DNA, 21 bp, Artificial Sequence
  Synthetic
cggcagcagtacacgtcgagc

SEQ ID NO: 22094 - DNA, 20 bp, Artificial Sequence
  Synthetic
cgtcgggcacagacccatgg

SEQ ID NO: 22095 - DNA, 19 bp, Artificial Sequence
  Synthetic
gcgtagttgcgcaggccct

SEQ ID NO: 22096 - DNA, 21 bp, Artificial Sequence
  Synthetic
cgtaattcaccacgggcacgc

SEQ ID NO: 22097 - DNA, 21 bp, Artificial Sequence
  Synthetic
actgacagttgcgcaatccga

SEQ ID NO: 22098 - DNA, 18 bp, Artificial Sequence
  Synthetic
gcgcgttgccccaaacca

SEQ ID NO: 22099 - DNA, 18 bp, Artificial Sequence
  Synthetic
acaagccccagcaaccgg

SEQ ID NO: 22100 - DNA, 18 bp, Artificial Sequence
  Synthetic
aagctacagcgctcgcgg

SEQ ID NO: 22101 - DNA, 19 bp, Artificial Sequence
  Synthetic
gggccacgctgacggcttt

SEQ ID NO: 22102 - DNA, 18 bp, Artificial Sequence
  Synthetic
cggcttgaacgagcgcct

SEQ ID NO: 22103 - DNA, 18 bp, Artificial Sequence
  Synthetic
gcgctacgaacccgcaca

SEQ ID NO: 22104 - DNA, 18 bp, Artificial Sequence
  Synthetic
tacgcgcacgccaaaccg

SEQ ID NO: 22105 - DNA, 19 bp, Artificial Sequence
  Synthetic
ggcttcggcgtgcagctgt

SEQ ID NO: 22106 - DNA, 20 bp, Artificial Sequence
  Synthetic
gttggacgacaacgccaagc

SEQ ID NO: 22107 - DNA, 19 bp, Artificial Sequence
  Synthetic
gtgcagcagcgcctacaga

SEQ ID NO: 22108 - DNA, 22 bp, Artificial Sequence
  Synthetic
tcaaccaggacttgctgtcggc

SEQ ID NO: 22109 - DNA, 19 bp, Artificial Sequence
  Synthetic
tgaccacccccgacgccaa

SEQ ID NO: 22110 - DNA, 21 bp, Artificial Sequence
  Synthetic
cggaagcaggacccactaccg

SEQ ID NO: 22111 - DNA, 22 bp, Artificial Sequence
  Synthetic
caaacagctgtcgcggtactcg

SEQ ID NO: 22112 - DNA, 19 bp, Artificial Sequence
  Synthetic
cgccacagcagagccagca

SEQ ID NO: 22113 - DNA, 22 bp, Artificial Sequence
  Synthetic
agctcgatgttgaacaccgacg

SEQ ID NO: 22114 - DNA, 22 bp, Artificial Sequence
  Synthetic
tcgttttcctcctctccgtcgt

SEQ ID NO: 22115 - DNA, 22 bp, Artificial Sequence
  Synthetic
accagtctcagtctcagcagca

SEQ ID NO: 22116 - DNA, 22 bp, Artificial Sequence
  Synthetic
ctgttgctctcctctaccccgc

SEQ ID NO: 22117 - DNA, 19 bp, Artificial Sequence
  Synthetic
ccactactgccggagccga

SEQ ID NO: 22118 - DNA, 21 bp, Artificial Sequence
  Synthetic
atagcggcgttaggtgacacg

SEQ ID NO: 22119 - DNA, 19 bp, Artificial Sequence
  Synthetic
gttgcgcacccgtaagccg

SEQ ID NO: 22120 - DNA, 22 bp, Artificial Sequence
  Synthetic
gctgctgttgctgctgttgttg

SEQ ID NO: 22121 - DNA, 20 bp, Artificial Sequence
  Synthetic
ggggatctcctcacgcacgc

SEQ ID NO: 22122 - DNA, 21 bp, Artificial Sequence
  Synthetic
gccacaaagtcgcttttgccg

SEQ ID NO: 22123 - DNA, 19 bp, Artificial Sequence
  Synthetic
cctcgcacagccgatgcac

SEQ ID NO: 22124 - DNA, 19 bp, Artificial Sequence
  Synthetic
gcgatcaccacgctcgagg

SEQ ID NO: 22125 - DNA, 19 bp, Artificial Sequence
  Synthetic
cagccagaccgctagccga

SEQ ID NO: 22126 - DNA, 19 bp, Artificial Sequence
  Synthetic
acccggcgtgtcgactcgt

SEQ ID NO: 22127 - DNA, 19 bp, Artificial Sequence
  Synthetic
gcggactgcaccgggatga

SEQ ID NO: 22128 - DNA, 19 bp, Artificial Sequence
  Synthetic
cgaccgcgcggctgatgat

SEQ ID NO: 22129 - DNA, 22 bp, Artificial Sequence
  Synthetic
tgaagaaatagaccgggtgccg

SEQ ID NO: 22130 - DNA, 19 bp, Artificial Sequence
  Synthetic
gaggccacggcgcagaaga

SEQ ID NO: 22131 - DNA, 19 bp, Artificial Sequence
  Synthetic
cgcgccggtactcgagcaa

SEQ ID NO: 22132 - DNA, 19 bp, Artificial Sequence
  Synthetic
agcggctgctggaagaggg

SEQ ID NO: 22133 - DNA, 22 bp, Artificial Sequence
  Synthetic
cacctggacatctaccgtcgcc

SEQ ID NO: 22134 - DNA, 19 bp, Artificial Sequence
  Synthetic
tgcctcagctgttaccgcg

SEQ ID NO: 22135 - DNA, 19 bp, Artificial Sequence
  Synthetic
gctggtgcggcttttccac

SEQ ID NO: 22136 - DNA, 19 bp, Artificial Sequence
  Synthetic
ctcggtgagcgggtagcga

SEQ ID NO: 22137 - DNA, 19 bp, Artificial Sequence
  Synthetic
cagggccagggacagcctt

SEQ ID NO: 22138 - DNA, 19 bp, Artificial Sequence
  Synthetic
cgcaccctctgagtgctgc

SEQ ID NO: 22139 - DNA, 19 bp, Artificial Sequence
  Synthetic
ccgtcttatcccgtgccgc

SEQ ID NO: 22140 - DNA, 19 bp, Artificial Sequence
  Synthetic
cgtaaggaaaccgcggcgg

SEQ ID NO: 22141 - DNA, 20 bp, Artificial Sequence
  Synthetic
acagtccggcttgggtgtcc

SEQ ID NO: 22142 - DNA, 19 bp, Artificial Sequence
  Synthetic
cgcggagggtgattcgcac

SEQ ID NO: 22143 - DNA, 22 bp, Artificial Sequence
  Synthetic
agttgttgaggtccaccagcag

SEQ ID NO: 22144 - DNA, 19 bp, Artificial Sequence
  Synthetic
agacgaccggcttccagcg

SEQ ID NO: 22145 - DNA, 18 bp, Artificial Sequence
  Synthetic
gcttgcccgacgcgtgaa

SEQ ID NO: 22146 - DNA, 21 bp, Artificial Sequence
  Synthetic
gcacgttgaccgacacgttct

SEQ ID NO: 22147 - DNA, 19 bp, Artificial Sequence
  Synthetic
gctgttgcgacggcgaatg

SEQ ID NO: 22148 - DNA, 19 bp, Artificial Sequence
  Synthetic
ccggagcgtggcggtacaa

SEQ ID NO: 22149 - DNA, 19 bp, Artificial Sequence
  Synthetic
cgtgtcgtacgcgcaccgt

SEQ ID NO: 22150 - DNA, 22 bp, Artificial Sequence
  Synthetic
tcagctccgaggctaggttagc

SEQ ID NO: 22151 - DNA, 22 bp, Artificial Sequence
  Synthetic
gaggcccatgatgagtagtcgc

SEQ ID NO: 22152 - DNA, 19 bp, Artificial Sequence
  Synthetic
gcggccggcatcaggagaa

SEQ ID NO: 22153 - DNA, 21 bp, Artificial Sequence
  Synthetic
ccgatagcggttcctcagcca

SEQ ID NO: 22154 - DNA, 19 bp, Artificial Sequence
  Synthetic
agggtggtccgcgttccgt

SEQ ID NO: 22155 - DNA, 20 bp, Artificial Sequence
  Synthetic
ccgaccagttctccatcgcg

SEQ ID NO: 22156 - DNA, 19 bp, Artificial Sequence
  Synthetic
cccgtggccgtaccctgtt

SEQ ID NO: 22157 - DNA, 21 bp, Artificial Sequence
  Synthetic
cacgcatgtgctacgcggatt

SEQ ID NO: 22158 - DNA, 19 bp, Artificial Sequence
  Synthetic
cgacgagcgcgggtcacaa

SEQ ID NO: 22159 - DNA, 19 bp, Artificial Sequence
  Synthetic
ctgacgccacgccgccatt

SEQ ID NO: 22160 - DNA, 19 bp, Artificial Sequence
  Synthetic
tgctgctctgcacgctctg

SEQ ID NO: 22161 - DNA, 19 bp, Artificial Sequence
  Synthetic
gcgtcgcccttctccgtga

SEQ ID NO: 22162 - DNA, 22 bp, Artificial Sequence
  Synthetic
cgtcgtggagacaagcaacacc

SEQ ID NO: 22163 - DNA, 20 bp, Artificial Sequence
  Synthetic
gtgctcagcggcgtgtacag

SEQ ID NO: 22164 - DNA, 18 bp, Artificial Sequence
  Synthetic
ggtagcgcttgcggcaca

SEQ ID NO: 22165 - DNA, 20 bp, Artificial Sequence
  Synthetic
gcagcggcgagaggagagga

SEQ ID NO: 22166 - DNA, 22 bp, Artificial Sequence
  Synthetic
tcctctcagtttccccgtctcc

SEQ ID NO: 22167 - DNA, 19 bp, Artificial Sequence
  Synthetic
gtggtgccgtccacgtcgt

SEQ ID NO: 22168 - DNA, 19 bp, Artificial Sequence
  Synthetic
gcacgcgcgtttccccgta

SEQ ID NO: 22169 - DNA, 19 bp, Artificial Sequence
  Synthetic
cggcaagctcacgcactgc

SEQ ID NO: 22170 - DNA, 19 bp, Artificial Sequence
  Synthetic
cggaacgtgacggttgccg

SEQ ID NO: 22171 - DNA, 20 bp, Artificial Sequence
  Synthetic
tgacgacggggaggatgacg

SEQ ID NO: 22172 - DNA, 22 bp, Artificial Sequence
  Synthetic
atcggctcgtatcccgaagtgc

SEQ ID NO: 22173 - DNA, 19 bp, Artificial Sequence
  Synthetic
ccgtcctggcacgcctctt

SEQ ID NO: 22174 - DNA, 19 bp, Artificial Sequence
  Synthetic
cccggcgtgctgttggtct

SEQ ID NO: 22175 - DNA, 20 bp, Artificial Sequence
  Synthetic
agagcctcacctgcgtgacg

SEQ ID NO: 22176 - DNA, 20 bp, Artificial Sequence
  Synthetic
gagcacttgcggctccatga

SEQ ID NO: 22177 - DNA, 19 bp, Artificial Sequence
  Synthetic
gcccgtcgtagcgcagaat

SEQ ID NO: 22178 - DNA, 20 bp, Artificial Sequence
  Synthetic
caacgccgcgtgtaacttcc

SEQ ID NO: 22179 - DNA, 20 bp, Artificial Sequence
  Synthetic
atatgtgggagcgcaaggcc

SEQ ID NO: 22180 - DNA, 20 bp, Artificial Sequence
  Synthetic
gcgactttaccgcgaacgcc

SEQ ID NO: 22181 - DNA, 21 bp, Artificial Sequence
  Synthetic
tgcctgtccaaccaccatgac

SEQ ID NO: 22182 - DNA, 20 bp, Artificial Sequence
  Synthetic
gctcatgcagcgtctcacgg

SEQ ID NO: 22183 - DNA, 20 bp, Artificial Sequence
  Synthetic
acaccagcgacaacgtgctc

SEQ ID NO: 22184 - DNA, 18 bp, Artificial Sequence
  Synthetic
cgtgtgcaccaccgtgga

SEQ ID NO: 22185 - DNA, 20 bp, Artificial Sequence
  Synthetic
cgtgcaccacggtgaacacg

SEQ ID NO: 22186 - DNA, 19 bp, Artificial Sequence
  Synthetic
ggcgctgtgtccgagctca

SEQ ID NO: 22187 - DNA, 22 bp, Artificial Sequence
  Synthetic
ccaggtgagaaagagaagccgc

SEQ ID NO: 22188 - DNA, 20 bp, Artificial Sequence
  Synthetic
cggcagcggtggtactggta

SEQ ID NO: 22189 - DNA, 19 bp, Artificial Sequence
  Synthetic
gtccagaacgcggttggga

SEQ ID NO: 22190 - DNA, 22 bp, Artificial Sequence
  Synthetic
catgttgccgtgtgacgagacg

SEQ ID NO: 22191 - DNA, 22 bp, Artificial Sequence
  Synthetic
tgggcgatgcacaactctttct

SEQ ID NO: 22192 - DNA, 19 bp, Artificial Sequence
  Synthetic
ggtggtggtgggcatcgtg

SEQ ID NO: 22193 - DNA, 22 bp, Artificial Sequence
  Synthetic
gtcgcctcggtagctcagtagt

SEQ ID NO: 22194 - DNA, 24 bp, Artificial Sequence
  Synthetic
cgataggcggctataagatagaga

SEQ ID NO: 22195 - DNA, 20 bp, Artificial Sequence
  Synthetic
tatggttcttaggcgcgcat

SEQ ID NO: 22196 - DNA, 18 bp, Artificial Sequence
  Synthetic
ccggcgtgcagcaaggtt

SEQ ID NO: 22197 - DNA, 19 bp, Artificial Sequence
  Synthetic
tccctcggcgaccaacacc

SEQ ID NO: 22198 - DNA, 21 bp, Artificial Sequence
  Synthetic
gtagcgggagatacggcgttc

SEQ ID NO: 22199 - DNA, 21 bp, Artificial Sequence
  Synthetic
gctatcgtcgccggtttcggg

SEQ ID NO: 22200 - DNA, 20 bp, Artificial Sequence
  Synthetic
tcggcgttttcgggaagggc

SEQ ID NO: 22201 - DNA, 20 bp, Artificial Sequence
  Synthetic
cgacgcgatcacggtaaccc

SEQ ID NO: 22202 - DNA, 22 bp, Artificial Sequence
  Synthetic
gcgttgtctcgcctatcagcgt

SEQ ID NO: 22203 - DNA, 20 bp, Artificial Sequence
  Synthetic
tacgagaccccgaggtacgc

SEQ ID NO: 22204 - DNA, 20 bp, Artificial Sequence
  Synthetic
cggaacggcgtttcactgcc

SEQ ID NO: 22205 - DNA, 19 bp, Artificial Sequence
  Synthetic
gcgtggcagggctggaaga

SEQ ID NO: 22206 - DNA, 19 bp, Artificial Sequence
  Synthetic
accggtgtggaagccgagg

SEQ ID NO: 22207 - DNA, 20 bp, Artificial Sequence
  Synthetic
acatgggccatgtgtggtgg

SEQ ID NO: 22208 - DNA, 22 bp, Artificial Sequence
  Synthetic
ctccgggttcctgccttttcca

SEQ ID NO: 22209 - DNA, 22 bp, Artificial Sequence
  Synthetic
aacaacgcagactgctgaaggc

SEQ ID NO: 22210 - DNA, 19 bp, Artificial Sequence
  Synthetic
agcttctccccgactccgc

SEQ ID NO: 22211 - DNA, 22 bp, Artificial Sequence
  Synthetic
cgataccaccacattcaggggc

SEQ ID NO: 22212 - DNA, 19 bp, Artificial Sequence
  Synthetic
gggactttccacacggcgg

SEQ ID NO: 22213 - DNA, 22 bp, Artificial Sequence
  Synthetic
tcgacgacaggtgcggattagt

SEQ ID NO: 22214 - DNA, 21 bp, Artificial Sequence
  Synthetic
caacaataccgccctacgttg

SEQ ID NO: 22215 - DNA, 22 bp, Artificial Sequence
  Synthetic
ggacgtaacattcggacacgga

SEQ ID NO: 22216 - DNA, 19 bp, Artificial Sequence
  Synthetic
ggcgacgacagttccgtgg

SEQ ID NO: 22217 - DNA, 19 bp, Artificial Sequence
  Synthetic
ccggcggtggtgaacgaga

SEQ ID NO: 22218 - DNA, 21 bp, Artificial Sequence
  Synthetic
gtaacccagccaaaccagcgc

SEQ ID NO: 22219 - DNA, 19 bp, Artificial Sequence
  Synthetic
ccgtgccatcggtgggtac

SEQ ID NO: 22220 - DNA, 22 bp, Artificial Sequence
  Synthetic
gcgagaaccggtcgctcatagc

SEQ ID NO: 22221 - DNA, 20 bp, Artificial Sequence
  Synthetic
ggaggctatatgaccgcgcg

SEQ ID NO: 22222 - DNA, 21 bp, Artificial Sequence
  Synthetic
ccttcatcgcgtttgccgtgc

SEQ ID NO: 22223 - DNA, 22 bp, Artificial Sequence
  Synthetic
aaacgggcgcggttttataggc

SEQ ID NO: 22224 - DNA, 22 bp, Artificial Sequence
  Synthetic
agctgatgcatttccagcgacg

SEQ ID NO: 22225 - DNA, 21 bp, Artificial Sequence
  Synthetic
ttctctgtggtcggcgagtct

SEQ ID NO: 22226 - DNA, 20 bp, Artificial Sequence
  Synthetic
gcagtgctacggtggttccc

SEQ ID NO: 22227 - DNA, 21 bp, Artificial Sequence
  Synthetic
tggtaaagtgaagacgcgccg

SEQ ID NO: 22228 - DNA, 19 bp, Artificial Sequence
  Synthetic
gtgacgcagcagcatcgct

SEQ ID NO: 22229 - DNA, 22 bp, Artificial Sequence
  Synthetic
acacctggtcgacgtggttacg

SEQ ID NO: 22230 - DNA, 20 bp, Artificial Sequence
  Synthetic
gtcagggccagaacccgcag

SEQ ID NO: 22231 - DNA, 21 bp, Artificial Sequence
  Synthetic
ccctgctgttggctacctctc

SEQ ID NO: 22232 - DNA, 20 bp, Artificial Sequence
  Synthetic
cgcatctgctcgccgtagat

SEQ ID NO: 22233 - DNA, 19 bp, Artificial Sequence
  Synthetic
acgagcacgcttccgaggg

SEQ ID NO: 22234 - DNA, 19 bp, Artificial Sequence
  Synthetic
gaccgagccagagggacct

SEQ ID NO: 22235 - DNA, 20 bp, Artificial Sequence
  Synthetic
cgtggaaaaccacccggcag

SEQ ID NO: 22236 - DNA, 21 bp, Artificial Sequence
  Synthetic
cgggggggtgaaatttggagt

SEQ ID NO: 22237 - DNA, 22 bp, Artificial Sequence
  Synthetic
aagttcgctgcaatatgcacac

SEQ ID NO: 22238 - DNA, 25 bp, Artificial Sequence
  Synthetic
aggaaaaccgattcactgaaattgg

SEQ ID NO: 22239 - DNA, 20 bp, Artificial Sequence
  Synthetic
aatcacagggaccatgcgta

SEQ ID NO: 22240 - DNA, 23 bp, Artificial Sequence
  Synthetic
ctgcaaagatattggcgatctga

SEQ ID NO: 22241 - DNA, 21 bp, Artificial Sequence
  Synthetic
cattgcagggccactgagtac

SEQ ID NO: 22242 - DNA, 21 bp, Artificial Sequence
  Synthetic
ttctcccttactgacccaagg

SEQ ID NO: 22243 - DNA, 21 bp, Artificial Sequence
  Synthetic
aaacagatcggagacatggcc

SEQ ID NO: 22244 - DNA, 21 bp, Artificial Sequence
  Synthetic
agaatggttagcggcattggg

SEQ ID NO: 22245 - DNA, 20 bp, Artificial Sequence
  Synthetic
gcgacaagcgaacaatggag

SEQ ID NO: 22246 - DNA, 25 bp, Artificial Sequence
  Synthetic
agaaggacaagaattgcatatgaga

SEQ ID NO: 22247 - DNA, 23 bp, Artificial Sequence
  Synthetic
atgagaacatggaagcaatggac

SEQ ID NO: 22248 - DNA, 22 bp, Artificial Sequence
  Synthetic
ggaagtgaaaattgatgacggc

SEQ ID NO: 22249 - DNA, 25 bp, Artificial Sequence
  Synthetic
tttggtggacaacttttttaacgag

SEQ ID NO: 22250 - DNA, 22 bp, Artificial Sequence
  Synthetic
aagacgagcaagacgagaacgg

SEQ ID NO: 22251 - DNA, 25 bp, Artificial Sequence
  Synthetic
agaggaagaaagagaacaaacagtg

SEQ ID NO: 22252 - DNA, 23 bp, Artificial Sequence
  Synthetic
aaacacttcaggtttttggaggt

SEQ ID NO: 22253 - DNA, 20 bp, Artificial Sequence
  Synthetic
ctgccgacgttgcaagagga

SEQ ID NO: 22254 - DNA, 25 bp, Artificial Sequence
  Synthetic
tataggtaacggggcaatagttgag

SEQ ID NO: 22255 - DNA, 25 bp, Artificial Sequence
  Synthetic
tgaagggaatggctattttaaagca

SEQ ID NO: 22256 - DNA, 22 bp, Artificial Sequence
  Synthetic
tgatgatactcgacatcgttgc

SEQ ID NO: 22257 - DNA, 21 bp, Artificial Sequence
  Synthetic
cgcttctacggctcgcagtat

SEQ ID NO: 22258 - DNA, 21 bp, Artificial Sequence
  Synthetic
gcattaggccatctttgggat

SEQ ID NO: 22259 - DNA, 21 bp, Artificial Sequence
  Synthetic
cgaaaacggtgtagccagtac

SEQ ID NO: 22260 - DNA, 20 bp, Artificial Sequence
  Synthetic
ttaacgaggtgcagctgccg

SEQ ID NO: 22261 - DNA, 20 bp, Artificial Sequence
  Synthetic
gggtttggctggctgttgct

SEQ ID NO: 22262 - DNA, 20 bp, Artificial Sequence
  Synthetic
ggcgtacagttttggagcca

SEQ ID NO: 22263 - DNA, 24 bp, Artificial Sequence
  Synthetic
ctctgacacaaaagctctagtcca

SEQ ID NO: 22264 - DNA, 25 bp, Artificial Sequence
  Synthetic
acgtgtcagtttctataaacgatga

SEQ ID NO: 22265 - DNA, 21 bp, Artificial Sequence
  Synthetic
tgcgctcgtcagatagcaagc

SEQ ID NO: 22266 - DNA, 21 bp, Artificial Sequence
  Synthetic
agtaggatagcacctgccgcc

SEQ ID NO: 22267 - DNA, 25 bp, Artificial Sequence
  Synthetic
agcatataaaactgatttaccgcct

SEQ ID NO: 22268 - DNA, 23 bp, Artificial Sequence
  Synthetic
aagcggttattgattacctgagc

SEQ ID NO: 22269 - DNA, 23 bp, Artificial Sequence
  Synthetic
agagtctttttcccattggtccc

SEQ ID NO: 22270 - DNA, 20 bp, Artificial Sequence
  Synthetic
gcatcgttgcacgggctgta

SEQ ID NO: 22271 - DNA, 21 bp, Artificial Sequence
  Synthetic
cggaaacgggaaatcagggcg

SEQ ID NO: 22272 - DNA, 19 bp, Artificial Sequence
  Synthetic
ggttcgggtcctgcgggaa

SEQ ID NO: 22273 - DNA, 23 bp, Artificial Sequence
  Synthetic
gctgcaaggtcattagatatccg

SEQ ID NO: 22274 - DNA, 21 bp, Artificial Sequence
  Synthetic
gctcgaccgttttcacgtggt

SEQ ID NO: 22275 - DNA, 24 bp, Artificial Sequence
  Synthetic
ttgaagtaagctgttttaagccca

SEQ ID NO: 22276 - DNA, 24 bp, Artificial Sequence
  Synthetic
taagctcctgcattaatggtgtag

SEQ ID NO: 22277 - DNA, 22 bp, Artificial Sequence
  Synthetic
tgttgctcgcataaattcgcgg

SEQ ID NO: 22278 - DNA, 22 bp, Artificial Sequence
  Synthetic
gctatgagcacaagtgaggcgc

SEQ ID NO: 22279 - DNA, 20 bp, Artificial Sequence
  Synthetic
gacaacagcggggaggaagc

SEQ ID NO: 22280 - DNA, 25 bp, Artificial Sequence
  Synthetic
tgtacataatccagcaagtaaaccc

SEQ ID NO: 22281 - DNA, 22 bp, Artificial Sequence
  Synthetic
tgctgacgtcactggcgatgac

SEQ ID NO: 22282 - DNA, 20 bp, Artificial Sequence
  Synthetic
catccgcaaagatgaggctg

SEQ ID NO: 22283 - DNA, 20 bp, Artificial Sequence
  Synthetic
caaacgtccaggcagggttt

SEQ ID NO: 22284 - DNA, 21 bp, Artificial Sequence
  Synthetic
ccccctcctggattttacact

SEQ ID NO: 22285 - DNA, 22 bp, Artificial Sequence
  Synthetic
cacatgcgggggatgaaggaag

SEQ ID NO: 22286 - DNA, 25 bp, Artificial Sequence
  Synthetic
gtttaccaccaaatttaaggccagg

SEQ ID NO: 22287 - DNA, 23 bp, Artificial Sequence
  Synthetic
aactccgggagtgtacactaatg

SEQ ID NO: 22288 - DNA, 21 bp, Artificial Sequence
  Synthetic
tatcgcagctggtatttggca

SEQ ID NO: 22289 - DNA, 21 bp, Artificial Sequence
  Synthetic
cgtacgcggacattaccgagc

SEQ ID NO: 22290 - DNA, 19 bp, Artificial Sequence
  Synthetic
gctgcggccgcaacagcta

SEQ ID NO: 22291 - DNA, 21 bp, Artificial Sequence
  Synthetic
cgcccagacgtagggtacagt

SEQ ID NO: 22292 - DNA, 22 bp, Artificial Sequence
  Synthetic
acgtactagagcacatgaaggt

SEQ ID NO: 22293 - DNA, 19 bp, Artificial Sequence
  Synthetic
cgccgtagacgtcgacgca

SEQ ID NO: 22294 - DNA, 22 bp, Artificial Sequence
  Synthetic
ccaaccaaaggagaaaagcggc

SEQ ID NO: 22295 - DNA, 20 bp, Artificial Sequence
  Synthetic
cactccctcgatgatgccgc

SEQ ID NO: 22296 - DNA, 22 bp, Artificial Sequence
  Synthetic
ttaagccctattccggaaccgc

SEQ ID NO: 22297 - DNA, 24 bp, Artificial Sequence
  Synthetic
ctgctcaagttgtgttctataccg

SEQ ID NO: 22298 - DNA, 23 bp, Artificial Sequence
  Synthetic
cgttcgcgttattgagaatcacg

SEQ ID NO: 22299 - DNA, 24 bp, Artificial Sequence
  Synthetic
aacaagaacacctacgagtacatg

SEQ ID NO: 22300 - DNA, 21 bp, Artificial Sequence
  Synthetic
gggaaatgatcttcgggtgga

SEQ ID NO: 22301 - DNA, 24 bp, Artificial Sequence
  Synthetic
gtgtcaatcatgtttgactcctcc

SEQ ID NO: 22302 - DNA, 20 bp, Artificial Sequence
  Synthetic
ggatacctgggccccactat

SEQ ID NO: 22303 - DNA, 22 bp, Artificial Sequence
  Synthetic
tttccgggttttgtgtctcgcg

SEQ ID NO: 22304 - DNA, 25 bp, Artificial Sequence
  Synthetic
atggataaaaatcccactatggacc

SEQ ID NO: 22305 - DNA, 20 bp, Artificial Sequence
  Synthetic
ccacagctggcgcacaagtt

SEQ ID NO: 22306 - DNA, 24 bp, Artificial Sequence
  Synthetic
gctatttgagccttcattccttca

SEQ ID NO: 22307 - DNA, 21 bp, Artificial Sequence
  Synthetic
accggtgggttcccaggaatt

SEQ ID NO: 22308 - DNA, 24 bp, Artificial Sequence
  Synthetic
acattcttttcattttcgtcgctg

SEQ ID NO: 22309 - DNA, 20 bp, Artificial Sequence
  Synthetic
aaaacgctgggctcgaggac

SEQ ID NO: 22310 - DNA, 20 bp, Artificial Sequence
  Synthetic
ttcttgctttaagggctggc

SEQ ID NO: 22311 - DNA, 22 bp, Artificial Sequence
  Synthetic
atggaaagccggttgtaagcga

SEQ ID NO: 22312 - DNA, 25 bp, Artificial Sequence
  Synthetic
aaccttcgagaactaaacaaactgt

SEQ ID NO: 22313 - DNA, 24 bp, Artificial Sequence
  Synthetic
ttcacgacgaacctaagacttacc

SEQ ID NO: 22314 - DNA, 22 bp, Artificial Sequence
  Synthetic
cgcagcaacgctcaaagaaaca

SEQ ID NO: 22315 - DNA, 22 bp, Artificial Sequence
  Synthetic
tgtagcctgctttcagcactgc

SEQ ID NO: 22316 - DNA, 20 bp, Artificial Sequence
  Synthetic
ccgcagctgtctctacctca

SEQ ID NO: 22317 - DNA, 22 bp, Artificial Sequence
  Synthetic
ttaaccctccctcttggccagc

SEQ ID NO: 22318 - DNA, 25 bp, Artificial Sequence
  Synthetic
tgaagatttctgctgtcatttgtgt

SEQ ID NO: 22319 - DNA, 24 bp, Artificial Sequence
  Synthetic
ttgttgctccagttattgacaaac

SEQ ID NO: 22320 - DNA, 22 bp, Artificial Sequence
  Synthetic
gtatgctcaaacagccgaaaga

SEQ ID NO: 22321 - DNA, 20 bp, Artificial Sequence
  Synthetic
atacggtaagggcagcccaa

SEQ ID NO: 22322 - DNA, 23 bp, Artificial Sequence
  Synthetic
ttctcatctttttatgcctgcca

SEQ ID NO: 22323 - DNA, 21 bp, Artificial Sequence
  Synthetic
cccccaggatgatttacccct

SEQ ID NO: 22324 - DNA, 20 bp, Artificial Sequence
  Synthetic
tcaactgtgctacacgctgc

SEQ ID NO: 22325 - DNA, 25 bp, Artificial Sequence
  Synthetic
aaatggaaggtcagattcttcttcc

SEQ ID NO: 22326 - DNA, 25 bp, Artificial Sequence
  Synthetic
tcacaaggtcttaaactttcttgga

SEQ ID NO: 22327 - DNA, 22 bp, Artificial Sequence
  Synthetic
aatggtgagctccgatgggttg

SEQ ID NO: 22328 - DNA, 22 bp, Artificial Sequence
  Synthetic
ctgtccttaagacggggattgg

SEQ ID NO: 22329 - DNA, 20 bp, Artificial Sequence
  Synthetic
ctggttccccaagcttcgtg

SEQ ID NO: 22330 - DNA, 24 bp, Artificial Sequence
  Synthetic
tacactatacgcgtggttaaactg

SEQ ID NO: 22331 - DNA, 20 bp, Artificial Sequence
  Synthetic
cgcccaaggattctctcgtt

SEQ ID NO: 22332 - DNA, 23 bp, Artificial Sequence
  Synthetic
ccagctgacatacactgtagtga

SEQ ID NO: 22333 - DNA, 20 bp, Artificial Sequence
  Synthetic
ttcctcacagggcggtagtt

SEQ ID NO: 22334 - DNA, 20 bp, Artificial Sequence
  Synthetic
ccgctgtgctggtgaaagat

SEQ ID NO: 22335 - DNA, 22 bp, Artificial Sequence
  Synthetic
gcaaagaaagttcacctccagg

SEQ ID NO: 22336 - DNA, 21 bp, Artificial Sequence
  Synthetic
ctggcaaacgggtggaaaaac

SEQ ID NO: 22337 - DNA, 20 bp, Artificial Sequence
  Synthetic
catagccccaggtcccgtaa

SEQ ID NO: 22338 - DNA, 20 bp, Artificial Sequence
  Synthetic
gcctatggctggtcgctcaa

SEQ ID NO: 22339 - DNA, 22 bp, Artificial Sequence
  Synthetic
gttgaggcttgtgggttttccg

SEQ ID NO: 22340 - DNA, 20 bp, Artificial Sequence
  Synthetic
gcctgagcaccagttggctt

SEQ ID NO: 22341 - DNA, 21 bp, Artificial Sequence
  Synthetic
gaatgcctagtggggctaacc

SEQ ID NO: 22342 - DNA, 23 bp, Artificial Sequence
  Synthetic
acagaaggtggctttatcacatt

SEQ ID NO: 22343 - DNA, 25 bp, Artificial Sequence
  Synthetic
tcaagagctggaaaataaacttcca

SEQ ID NO: 22344 - DNA, 25 bp, Artificial Sequence
  Synthetic
gtaccaattacaacaagcaaaagcc

SEQ ID NO: 22345 - DNA, 20 bp, Artificial Sequence
  Synthetic
gatggtgactgcaggtggag

SEQ ID NO: 22346 - DNA, 22 bp, Artificial Sequence
  Synthetic
atccaagttcattgactggctg

SEQ ID NO: 22347 - DNA, 23 bp, Artificial Sequence
  Synthetic
tttgtcagatggtttcaagcact

SEQ ID NO: 22348 - DNA, 25 bp, Artificial Sequence
  Synthetic
cattgtagatcttcttagtgcctcc

SEQ ID NO: 22349 - DNA, 25 bp, Artificial Sequence
  Synthetic
ataacgattttgtggctagatcgaa

SEQ ID NO: 22350 - DNA, 20 bp, Artificial Sequence
  Synthetic
cgctgtgttgacccagaaag

SEQ ID NO: 22351 - DNA, 24 bp, Artificial Sequence
  Synthetic
gtaatctctatgctggcttccatg

SEQ ID NO: 22352 - DNA, 23 bp, Artificial Sequence
  Synthetic
atggattgacaataacacctgct

SEQ ID NO: 22353 - DNA, 22 bp, Artificial Sequence
  Synthetic
ttctgcagacgattcgacattt

SEQ ID NO: 22354 - DNA, 25 bp, Artificial Sequence
  Synthetic
tcggtggttccatttagaatagaca

SEQ ID NO: 22355 - DNA, 25 bp, Artificial Sequence
  Synthetic
tgcactgacagtatagatacgttgg

SEQ ID NO: 22356 - DNA, 24 bp, Artificial Sequence
  Synthetic
tgaaagacacagcaaaaggagatt

SEQ ID NO: 22357 - DNA, 21 bp, Artificial Sequence
  Synthetic
ctgtttttggacaaacaccgg

SEQ ID NO: 22358 - DNA, 24 bp, Artificial Sequence
  Synthetic
ctcatattgagtcacaggagagca

SEQ ID NO: 22359 - DNA, 25 bp, Artificial Sequence
  Synthetic
ggactgtgcattttaaaacccaagt

SEQ ID NO: 22360 - DNA, 20 bp, Artificial Sequence
  Synthetic
gtcaggagaaaccccccgca

SEQ ID NO: 22361 - DNA, 21 bp, Artificial Sequence
  Synthetic
actgtttggaactgggttgga

SEQ ID NO: 22362 - DNA, 25 bp, Artificial Sequence
  Synthetic
gggaagtgtaatatacctaggaggc

SEQ ID NO: 22363 - DNA, 24 bp, Artificial Sequence
  Synthetic
ttctgttgtgccattagaggatct

SEQ ID NO: 22364 - DNA, 20 bp, Artificial Sequence
  Synthetic
gagcctcagcaactccacat

SEQ ID NO: 22365 - DNA, 21 bp, Artificial Sequence
  Synthetic
cccagctttactgacacagcc

SEQ ID NO: 22366 - DNA, 20 bp, Artificial Sequence
  Synthetic
aattgggcaggcggttcatt

SEQ ID NO: 22367 - DNA, 24 bp, Artificial Sequence
  Synthetic
atgattctgatcatgaacgcctag

SEQ ID NO: 22368 - DNA, 25 bp, Artificial Sequence
  Synthetic
agaagagaacaactatatgccagac

SEQ ID NO: 22369 - DNA, 23 bp, Artificial Sequence
  Synthetic
tagagctacaagatgccctacac

SEQ ID NO: 22370 - DNA, 24 bp, Artificial Sequence
  Synthetic
gtccgcaccccaataattatttgc

SEQ ID NO: 22371 - DNA, 21 bp, Artificial Sequence
  Synthetic
acagaccacgatccccacacc

SEQ ID NO: 22372 - DNA, 23 bp, Artificial Sequence
  Synthetic
gccttaaccacaaattctttggc

SEQ ID NO: 22373 - DNA, 22 bp, Artificial Sequence
  Synthetic
tgccagcctattcacatacctg

SEQ ID NO: 22374 - DNA, 20 bp, Artificial Sequence
  Synthetic
atcacatgagaacggcgcga

SEQ ID NO: 22375 - DNA, 24 bp, Artificial Sequence
  Synthetic
atgtcacatggatcatcaaccaaa

SEQ ID NO: 22376 - DNA, 23 bp, Artificial Sequence
  Synthetic
attgtgtaatggaggcagaaaca

SEQ ID NO: 22377 - DNA, 24 bp, Artificial Sequence
  Synthetic
caggatgaacagtgatcagtttgc

SEQ ID NO: 22378 - DNA, 23 bp, Artificial Sequence
  Synthetic
aacagcttatcaccttctactgc

SEQ ID NO: 22379 - DNA, 20 bp, Artificial Sequence
  Synthetic
aagcgtgtttgaatcagcgg

SEQ ID NO: 22380 - DNA, 20 bp, Artificial Sequence
  Synthetic
gaccagttgtgcaagacgtt

SEQ ID NO: 22381 - DNA, 25 bp, Artificial Sequence
  Synthetic
aacaagacatcttagacgtgctaat

SEQ ID NO: 22382 - DNA, 23 bp, Artificial Sequence
  Synthetic
cagaagatgaggtggacgaagtg

SEQ ID NO: 22383 - DNA, 24 bp, Artificial Sequence
  Synthetic
cccaacaggtacacaaatatcaga

SEQ ID NO: 22384 - DNA, 20 bp, Artificial Sequence
  Synthetic
tccacgattggacgccatta

SEQ ID NO: 22385 - DNA, 21 bp, Artificial Sequence
  Synthetic
caggcacagcaggaatattgg

SEQ ID NO: 22386 - DNA, 24 bp, Artificial Sequence
  Synthetic
gcatttgaatatgcacaaagggga

SEQ ID NO: 22387 - DNA, 21 bp, Artificial Sequence
  Synthetic
atggaagcaatagccaagcgt

SEQ ID NO: 22388 - DNA, 25 bp, Artificial Sequence
  Synthetic
aacaagttatgaaatgtggcaaaca

SEQ ID NO: 22389 - DNA, 20 bp, Artificial Sequence
  Synthetic
accagcaccaaagacggaac

SEQ ID NO: 22390 - DNA, 24 bp, Artificial Sequence
  Synthetic
ctgggatttatgtcactgcaccta

SEQ ID NO: 22391 - DNA, 25 bp, Artificial Sequence
  Synthetic
aactctacttgtgtgttactgtccc

SEQ ID NO: 22392 - DNA, 20 bp, Artificial Sequence
  Synthetic
ccaggtgcaggttacagacc

SEQ ID NO: 22393 - DNA, 21 bp, Artificial Sequence
  Synthetic
tactgcacctatgggaacacc

SEQ ID NO: 22394 - DNA, 23 bp, Artificial Sequence
  Synthetic
cagcagttctagacttcttgcag

SEQ ID NO: 22395 - DNA, 25 bp, Artificial Sequence
  Synthetic
tccagattatttacaaatggctgca

SEQ ID NO: 22396 - DNA, 25 bp, Artificial Sequence
  Synthetic
acaatggtatttgttggggtaatca

SEQ ID NO: 22397 - DNA, 24 bp, Artificial Sequence
  Synthetic
cttttatgcactgtagccaactct

SEQ ID NO: 22398 - DNA, 22 bp, Artificial Sequence
  Synthetic
tggattaacccgctcaatgccc

SEQ ID NO: 22399 - DNA, 19 bp, Artificial Sequence
  Synthetic
cccagattgggtgtgcgcg

SEQ ID NO: 22400 - DNA, 21 bp, Artificial Sequence
  Synthetic
ggctttggaggacgggatcaa

SEQ ID NO: 22401 - DNA, 19 bp, Artificial Sequence
  Synthetic
tcgcagcgccatacatcgg

SEQ ID NO: 22402 - DNA, 20 bp, Artificial Sequence
  Synthetic
cctcgtgggggtggcctatt

SEQ ID NO: 22403 - DNA, 20 bp, Artificial Sequence
  Synthetic
cccactcggggtcgctaaca

SEQ ID NO: 22404 - DNA, 21 bp, Artificial Sequence
  Synthetic
gttcaccaaaacctgtggcgc

SEQ ID NO: 22405 - DNA, 21 bp, Artificial Sequence
  Synthetic
ccactacagcgtggcagatcc

SEQ ID NO: 22406 - DNA, 22 bp, Artificial Sequence
  Synthetic
ttctgatgctgcctgagagggc

SEQ ID NO: 22407 - DNA, 22 bp, Artificial Sequence
  Synthetic
tcttgcagtcctggtctgtcca

SEQ ID NO: 22408 - DNA, 20 bp, Artificial Sequence
  Synthetic
cctgtttcggccaggttggg

SEQ ID NO: 22409 - DNA, 20 bp, Artificial Sequence
  Synthetic
taacggcgtgatgtggaccg

SEQ ID NO: 22410 - DNA, 22 bp, Artificial Sequence
  Synthetic
cactgacaactcaacaccccca

SEQ ID NO: 22411 - DNA, 21 bp, Artificial Sequence
  Synthetic
ggtgcgccaatcacgtactca

SEQ ID NO: 22412 - DNA, 22 bp, Artificial Sequence
  Synthetic
aaagtgcgatgaactggccaga

SEQ ID NO: 22413 - DNA, 21 bp, Artificial Sequence
  Synthetic
gggaggttgggcacataccgg

SEQ ID NO: 22414 - DNA, 21 bp, Artificial Sequence
  Synthetic
ccaagctgggacaccatgtgg

SEQ ID NO: 22415 - DNA, 22 bp, Artificial Sequence
  Synthetic
aacacctcccactagtcgagca

SEQ ID NO: 22416 - DNA, 22 bp, Artificial Sequence
  Synthetic
gattcgcgactccgatgcttct

SEQ ID NO: 22417 - DNA, 19 bp, Artificial Sequence
  Synthetic
gaaggggccgtgcagtgga

SEQ ID NO: 22418 - DNA, 22 bp, Artificial Sequence
  Synthetic
aggctataagggagagtggcgc

SEQ ID NO: 22419 - DNA, 21 bp, Artificial Sequence
  Synthetic
ccacgcccctaagtgcaaacc

SEQ ID NO: 22420 - DNA, 21 bp, Artificial Sequence
  Synthetic
gtaccgctccccatgactccc

SEQ ID NO: 22421 - DNA, 22 bp, Artificial Sequence
  Synthetic
tccctctcccaggaggaaacgg

SEQ ID NO: 22422 - DNA, 20 bp, Artificial Sequence
  Synthetic
gcttgtaacaccttgcgcgg

SEQ ID NO: 22423 - DNA, 22 bp, Artificial Sequence
  Synthetic
taaccacatcagctccgtgtgg

SEQ ID NO: 22424 - DNA, 22 bp, Artificial Sequence
  Synthetic
accgaaaaggacatcagggtcg

SEQ ID NO: 22425 - DNA, 19 bp, Artificial Sequence
  Synthetic
aggaggacaaccgagccct

SEQ ID NO: 22426 - DNA, 22 bp, Artificial Sequence
  Synthetic
atcgggttggtttacggtaggc

SEQ ID NO: 22427 - DNA, 24 bp, Artificial Sequence
  Synthetic
atacatatactgtgatcatgggcg

SEQ ID NO: 22428 - DNA, 23 bp, Artificial Sequence
  Synthetic
gagtacaacaaatcacactcggg

SEQ ID NO: 22429 - DNA, 20 bp, Artificial Sequence
  Synthetic
tatgggtgtgttcgggcaaa

SEQ ID NO: 22430 - DNA, 25 bp, Artificial Sequence
  Synthetic
gatggggtcttcaaaactactcttc

SEQ ID NO: 22431 - DNA, 24 bp, Artificial Sequence
  Synthetic
actgatccagatacatacaccagt

SEQ ID NO: 22432 - DNA, 23 bp, Artificial Sequence
  Synthetic
gttgagaaaacgaaacagacggt

SEQ ID NO: 22433 - DNA, 21 bp, Artificial Sequence
  Synthetic
aagtgcttcaaaccccagtgt

SEQ ID NO: 22434 - DNA, 21 bp, Artificial Sequence
  Synthetic
acatcaatagggcgcacaaat

SEQ ID NO: 22435 - DNA, 24 bp, Artificial Sequence
  Synthetic
attaccccataatttgcgaaaagc

SEQ ID NO: 22436 - DNA, 21 bp, Artificial Sequence
  Synthetic
gttggagtgtatcgcagagga

SEQ ID NO: 22437 - DNA, 25 bp, Artificial Sequence
  Synthetic
tgtacatttccaaacactttcaggt

SEQ ID NO: 22438 - DNA, 24 bp, Artificial Sequence
  Synthetic
tgcaattgcagaacacttcaattc

SEQ ID NO: 22439 - DNA, 21 bp, Artificial Sequence
  Synthetic
ctaagccccccaacaatcttg

SEQ ID NO: 22440 - DNA, 24 bp, Artificial Sequence
  Synthetic
atgattatgcaacaaaaactgggc

SEQ ID NO: 22441 - DNA, 24 bp, Artificial Sequence
  Synthetic
aacctgctgtattgagtgacaatg

SEQ ID NO: 22442 - DNA, 24 bp, Artificial Sequence
  Synthetic
acaaagcattccatcaaaatcccg

SEQ ID NO: 22443 - DNA, 25 bp, Artificial Sequence
  Synthetic
aagagatacttcaagcctgatcaac

SEQ ID NO: 22444 - DNA, 22 bp, Artificial Sequence
  Synthetic
tcattggtcgagagaaccacgc

SEQ ID NO: 22445 - DNA, 22 bp, Artificial Sequence
  Synthetic
ttgcagatgcagcaagtgtgga

SEQ ID NO: 22446 - DNA, 21 bp, Artificial Sequence
  Synthetic
agtggaacgtggacgacctca

SEQ ID NO: 22447 - DNA, 21 bp, Artificial Sequence
  Synthetic
ccggggttgagtgtgactgtt

SEQ ID NO: 22448 - DNA, 20 bp, Artificial Sequence
  Synthetic
aagtgaaaacaacgcggcgc

SEQ ID NO: 22449 - DNA, 25 bp, Artificial Sequence
  Synthetic
aagcaattgagtcttgtatggaagg

SEQ ID NO: 22450 - DNA, 22 bp, Artificial Sequence
  Synthetic
caggctttgtgtagttgcaaca

SEQ ID NO: 22451 - DNA, 24 bp, Artificial Sequence
  Synthetic
agaagatgaagctacaaatgctgc

SEQ ID NO: 22452 - DNA, 22 bp, Artificial Sequence
  Synthetic
catcagctagcttcacaggcag

SEQ ID NO: 22453 - DNA, 24 bp, Artificial Sequence
  Synthetic
agtaggatttttggatgatgccac

SEQ ID NO: 22454 - DNA, 20 bp, Artificial Sequence
  Synthetic
acctacaccaagaccccgca

SEQ ID NO: 22455 - DNA, 25 bp, Artificial Sequence
  Synthetic
tgaaagacttgaagaggaagctagg

SEQ ID NO: 22456 - DNA, 21 bp, Artificial Sequence
  Synthetic
tcgcagacgaataaaacgagc

SEQ ID NO: 22457 - DNA, 22 bp, Artificial Sequence
  Synthetic
taggccacgtcctaccataccc

SEQ ID NO: 22458 - DNA, 24 bp, Artificial Sequence
  Synthetic
gggacctttaagaagtacaccttt

SEQ ID NO: 22459 - DNA, 24 bp, Artificial Sequence
  Synthetic
tattgcatttacagaacagccacg

SEQ ID NO: 22460 - DNA, 25 bp, Artificial Sequence
  Synthetic
atcagatgttcattgttggttgtgc

SEQ ID NO: 22461 - DNA, 25 bp, Artificial Sequence
  Synthetic
agatgtttcttttatggcaagaggg

SEQ ID NO: 22462 - DNA, 23 bp, Artificial Sequence
  Synthetic
taataggccattttgggtgcaca

SEQ ID NO: 22463 - DNA, 23 bp, Artificial Sequence
  Synthetic
tgtaccaactaggaatgctcaca

SEQ ID NO: 22464 - DNA, 22 bp, Artificial Sequence
  Synthetic
cgaaatcggtcgcttgtatagc

SEQ ID NO: 22465 - DNA, 22 bp, Artificial Sequence
  Synthetic
aacctaatgcaacctcgccagc

SEQ ID NO: 22466 - DNA, 19 bp, Artificial Sequence
  Synthetic
gggccggctgctaattgcc

SEQ ID NO: 22467 - DNA, 19 bp, Artificial Sequence
  Synthetic
ccccctggcacataccgca

SEQ ID NO: 22468 - DNA, 22 bp, Artificial Sequence
  Synthetic
tgttccttacccccggtctacc

SEQ ID NO: 22469 - DNA, 22 bp, Artificial Sequence
  Synthetic
ttaccatctgccaccagcggta

SEQ ID NO: 22470 - DNA, 21 bp, Artificial Sequence
  Synthetic
ggactgcgattcgtaaggcgg

SEQ ID NO: 22471 - DNA, 21 bp, Artificial Sequence
  Synthetic
ctgccctccaaccgctttacc

SEQ ID NO: 22472 - DNA, 19 bp, Artificial Sequence
  Synthetic
ctgggctggaggtgcgcta

SEQ ID NO: 22473 - DNA, 19 bp, Artificial Sequence
  Synthetic
attcgccggctcgctgttt

SEQ ID NO: 22474 - DNA, 20 bp, Artificial Sequence
  Synthetic
gacttgctcccgcctcggta

SEQ ID NO: 22475 - DNA, 22 bp, Artificial Sequence
  Synthetic
cttgactcagccacagacgtcg

SEQ ID NO: 22476 - DNA, 20 bp, Artificial Sequence
  Synthetic
gatgaggccccgtcccttcc

SEQ ID NO: 22477 - DNA, 21 bp, Artificial Sequence
  Synthetic
ggtcgttgttctggggtgagc

SEQ ID NO: 22478 - DNA, 22 bp, Artificial Sequence
  Synthetic
tccttgctggtggcgaaattgg

SEQ ID NO: 22479 - DNA, 20 bp, Artificial Sequence
  Synthetic
gtaaccgcgacgtgtccagg

SEQ ID NO: 22480 - DNA, 19 bp, Artificial Sequence
  Synthetic
gaagcagctccgcctcgct

SEQ ID NO: 22481 - DNA, 19 bp, Artificial Sequence
  Synthetic
gccgctgcctcacgtcgta

SEQ ID NO: 22482 - DNA, 21 bp, Artificial Sequence
  Synthetic
ttactccagcactgcccgtca

SEQ ID NO: 22483 - DNA, 22 bp, Artificial Sequence
  Synthetic
ttggttaatgtagcgaccggcg

SEQ ID NO: 22484 - DNA, 20 bp, Artificial Sequence
  Synthetic
ggccccgtctctatttccgc

SEQ ID NO: 22485 - DNA, 20 bp, Artificial Sequence
  Synthetic
acttgacgttcgtaatgggc

SEQ ID NO: 22486 - DNA, 24 bp, Artificial Sequence
  Synthetic
tctcgtgtatgtctaacgatgttc

SEQ ID NO: 22487 - DNA, 23 bp, Artificial Sequence
  Synthetic
gtattaacgcattgcccagttga

SEQ ID NO: 22488 - DNA, 20 bp, Artificial Sequence
  Synthetic
acaaacaatggtagaccgcg

SEQ ID NO: 22489 - DNA, 25 bp, Artificial Sequence
  Synthetic
gttgcaaaaacaaagacagtttgaa

SEQ ID NO: 22490 - DNA, 20 bp, Artificial Sequence
  Synthetic
ccagctccggattatgtggt

SEQ ID NO: 22491 - DNA, 20 bp, Artificial Sequence
  Synthetic
cgatgaacaccgttttgcac

SEQ ID NO: 22492 - DNA, 20 bp, Artificial Sequence
  Synthetic
ggcaccactggattccgttt

SEQ ID NO: 22493 - DNA, 22 bp, Artificial Sequence
  Synthetic
ctagctcctgcaaactttctgg

SEQ ID NO: 22494 - DNA, 20 bp, Artificial Sequence
  Synthetic
gtgtgcacaccgttgcattt

SEQ ID NO: 22495 - DNA, 23 bp, Artificial Sequence
  Synthetic
ctgcttcttccggtgaatattca

SEQ ID NO: 22496 - DNA, 22 bp, Artificial Sequence
  Synthetic
caccgttgcctttactgtaagt

SEQ ID NO: 22497 - DNA, 21 bp, Artificial Sequence
  Synthetic
actctgggaatcggggggagg

SEQ ID NO: 22498 - DNA, 20 bp, Artificial Sequence
  Synthetic
ccggtattcacggggcgaca

SEQ ID NO: 22499 - DNA, 19 bp, Artificial Sequence
  Synthetic
cgatccgggccaagggctt

SEQ ID NO: 22500 - DNA, 20 bp, Artificial Sequence
  Synthetic
tgggcgggtatcatcggtct

SEQ ID NO: 22501 - DNA, 24 bp, Artificial Sequence
  Synthetic
agctagaacgattcgcagttaatc

SEQ ID NO: 22502 - DNA, 21 bp, Artificial Sequence
  Synthetic
agcaatcaggtcagccaaaat

SEQ ID NO: 22503 - DNA, 22 bp, Artificial Sequence
  Synthetic
gagagaaccaaggggaagtgac

SEQ ID NO: 22504 - DNA, 20 bp, Artificial Sequence
  Synthetic
ggaccagcggctacactaga

SEQ ID NO: 22505 - DNA, 25 bp, Artificial Sequence
  Synthetic
gtagcatgacaaaaatcttagagcc

SEQ ID NO: 22506 - DNA, 24 bp, Artificial Sequence
  Synthetic
gttagtggggaaattgaattgggc

SEQ ID NO: 22507 - DNA, 24 bp, Artificial Sequence
  Synthetic
aaactgcccatacaaaaggaaaca

SEQ ID NO: 22508 - DNA, 23 bp, Artificial Sequence
  Synthetic
ctagtgattttaacctgccacct

SEQ ID NO: 22509 - DNA, 25 bp, Artificial Sequence
  Synthetic
atacatactgacaatggcagcaatt

SEQ ID NO: 22510 - DNA, 25 bp, Artificial Sequence
  Synthetic
aggggatgctagattggtaataaca

SEQ ID NO: 22511 - DNA, 25 bp, Artificial Sequence
  Synthetic
aacaccaaaaaagataaagccacct

SEQ ID NO: 22512 - DNA, 25 bp, Artificial Sequence
  Synthetic
acaactgctgtttatccattttcag

SEQ ID NO: 22513 - DNA, 23 bp, Artificial Sequence
  Synthetic
acagaggtacataatgtttgggc

SEQ ID NO: 22514 - DNA, 23 bp, Artificial Sequence
  Synthetic
ctgctgttaaatggcagtctagc

SEQ ID NO: 22515 - DNA, 25 bp, Artificial Sequence
  Synthetic
tggtggtaatagcaacaatgagtcc

SEQ ID NO: 22516 - DNA, 22 bp, Artificial Sequence
  Synthetic
gttgcaactcacagtctggggc

SEQ ID NO: 22517 - DNA, 22 bp, Artificial Sequence
  Synthetic
agcagctaccaatgctgcttgt

SEQ ID NO: 22518 - DNA, 20 bp, Artificial Sequence
  Synthetic
agggactttccgctggggac

SEQ ID NO: 22519 - DNA, 20 bp, Artificial Sequence
  Synthetic
acgaccttcaccgcgactcc

SEQ ID NO: 22520 - DNA, 20 bp, Artificial Sequence
  Synthetic
gagcgcgtgatggtcatcgc

SEQ ID NO: 22521 - DNA, 20 bp, Artificial Sequence
  Synthetic
cgctctcaaacacctccccg

SEQ ID NO: 22522 - DNA, 22 bp, Artificial Sequence
  Synthetic
taacgtcaaggtcgtcgtcggg

SEQ ID NO: 22523 - DNA, 19 bp, Artificial Sequence
  Synthetic
ggtccgaaacgtcccgtcg

SEQ ID NO: 22524 - DNA, 22 bp, Artificial Sequence
  Synthetic
tccttgtgggacgagaacagcc

SEQ ID NO: 22525 - DNA, 19 bp, Artificial Sequence
  Synthetic
cgttgagggtctgcacgca

SEQ ID NO: 22526 - DNA, 22 bp, Artificial Sequence
  Synthetic
ggtgcgctgcttcaagattctg

SEQ ID NO: 22527 - DNA, 19 bp, Artificial Sequence
  Synthetic
ccacgccctcgctgttcgt

SEQ ID NO: 22528 - DNA, 22 bp, Artificial Sequence
  Synthetic
cactggtacatggcccactacc

SEQ ID NO: 22529 - DNA, 19 bp, Artificial Sequence
  Synthetic
gagcgcggccccagactta

SEQ ID NO: 22530 - DNA, 22 bp, Artificial Sequence
  Synthetic
ctgcatgtagcggtcgtagtgg

SEQ ID NO: 22531 - DNA, 19 bp, Artificial Sequence
  Synthetic
gctctccggcggcgttgat

SEQ ID NO: 22532 - DNA, 20 bp, Artificial Sequence
  Synthetic
gagagtccgtacccgcccca

SEQ ID NO: 22533 - DNA, 19 bp, Artificial Sequence
  Synthetic
ggggtgagcgagtggagca

SEQ ID NO: 22534 - DNA, 19 bp, Artificial Sequence
  Synthetic
cggagaacgcgaggcccat

SEQ ID NO: 22535 - DNA, 19 bp, Artificial Sequence
  Synthetic
cgtgcttcagggggcggtt

SEQ ID NO: 22536 - DNA, 19 bp, Artificial Sequence
  Synthetic
cgaagagcgcactccccca

SEQ ID NO: 22537 - DNA, 22 bp, Artificial Sequence
  Synthetic
aaaggcgccaacaaacctagga

SEQ ID NO: 22538 - DNA, 18 bp, Artificial Sequence
  Synthetic
gcgggacttcgcccagtt

SEQ ID NO: 22539 - DNA, 21 bp, Artificial Sequence
  Synthetic
gtttgcctccagccacaacac

SEQ ID NO: 22540 - DNA, 20 bp, Artificial Sequence
  Synthetic
ggacaaggccgggtcccgta

SEQ ID NO: 22541 - DNA, 22 bp, Artificial Sequence
  Synthetic
ctcccggaaggtattgctcgca

SEQ ID NO: 22542 - DNA, 20 bp, Artificial Sequence
  Synthetic
cggcgtagatgcgcttctcc

SEQ ID NO: 22543 - DNA, 19 bp, Artificial Sequence
  Synthetic
ccggcggacgcgactaaca

SEQ ID NO: 22544 - DNA, 20 bp, Artificial Sequence
  Synthetic
caagggggtgtgggtgacga

SEQ ID NO: 22545 - DNA, 19 bp, Artificial Sequence
  Synthetic
gtccgccgggatgtcggat

SEQ ID NO: 22546 - DNA, 21 bp, Artificial Sequence
  Synthetic
cgtactaccctttcgacgcgc

SEQ ID NO: 22547 - DNA, 19 bp, Artificial Sequence
  Synthetic
gtgcgccgtgctgtgtctg

SEQ ID NO: 22548 - DNA, 20 bp, Artificial Sequence
  Synthetic
gctgggcatgctgatcccgg

SEQ ID NO: 22549 - DNA, 19 bp, Artificial Sequence
  Synthetic
gtgacgtcggcgcgactca

SEQ ID NO: 22550 - DNA, 19 bp, Artificial Sequence
  Synthetic
aggagccccacgttctcga

SEQ ID NO: 22551 - DNA, 19 bp, Artificial Sequence
  Synthetic
gggcggtccagaaccactg

SEQ ID NO: 22552 - DNA, 19 bp, Artificial Sequence
  Synthetic
acaacccccacctcgctca

SEQ ID NO: 22553 - DNA, 22 bp, Artificial Sequence
  Synthetic
agcgacgtcgagtttaactgca

SEQ ID NO: 22554 - DNA, 20 bp, Artificial Sequence
  Synthetic
ggaacgcgtaatcggccacc

SEQ ID NO: 22555 - DNA, 21 bp, Artificial Sequence
  Synthetic
ttcggtgctgtttcaggggtt

SEQ ID NO: 22556 - DNA, 19 bp, Artificial Sequence
  Synthetic
gctttgtgcgcatgccccg

SEQ ID NO: 22557 - DNA, 20 bp, Artificial Sequence
  Synthetic
cttcgcccaccgattcctgt

SEQ ID NO: 22558 - DNA, 18 bp, Artificial Sequence
  Synthetic
gtatgcgacgcggctggt

SEQ ID NO: 22559 - DNA, 18 bp, Artificial Sequence
  Synthetic
tggtggcggcgcacaaca

SEQ ID NO: 22560 - DNA, 19 bp, Artificial Sequence
  Synthetic
cacacggcgtgcctgaaga

SEQ ID NO: 22561 - DNA, 20 bp, Artificial Sequence
  Synthetic
gcgagcaccgaccccctaga

SEQ ID NO: 22562 - DNA, 22 bp, Artificial Sequence
  Synthetic
aggacgtctccaagctctccga

SEQ ID NO: 22563 - DNA, 19 bp, Artificial Sequence
  Synthetic
gcgacgtccggcgacatag

SEQ ID NO: 22564 - DNA, 19 bp, Artificial Sequence
  Synthetic
cgctatcgtcggctgcggt

SEQ ID NO: 22565 - DNA, 20 bp, Artificial Sequence
  Synthetic
caggtcgaggatcgcgtcgc

SEQ ID NO: 22566 - DNA, 19 bp, Artificial Sequence
  Synthetic
gggggcggagtcgttcaac

SEQ ID NO: 22567 - DNA, 22 bp, Artificial Sequence
  Synthetic
tgcgttatcacctcctcgctcg

SEQ ID NO: 22568 - DNA, 19 bp, Artificial Sequence
  Synthetic
cggctccctgacgatgcgt

SEQ ID NO: 22569 - DNA, 22 bp, Artificial Sequence
  Synthetic
ttttcgagaagaaggcgtcgcg

SEQ ID NO: 22570 - DNA, 20 bp, Artificial Sequence
  Synthetic
cgcctatgcgcgtccctgtg

SEQ ID NO: 22571 - DNA, 20 bp, Artificial Sequence
  Synthetic
acgacgatgcatgttcggcg

SEQ ID NO: 22572 - DNA, 20 bp, Artificial Sequence
  Synthetic
gttcgaggcggatccggtca

SEQ ID NO: 22573 - DNA, 18 bp, Artificial Sequence
  Synthetic
tggcaggccgaaaacgcc

SEQ ID NO: 22574 - DNA, 20 bp, Artificial Sequence
  Synthetic
cggtcgtagtccaacgtgcc

SEQ ID NO: 22575 - DNA, 18 bp, Artificial Sequence
  Synthetic
gcatgccccgcaaaacgc

SEQ ID NO: 22576 - DNA, 20 bp, Artificial Sequence
  Synthetic
atgcagaaggggtgcaggca

SEQ ID NO: 22577 - DNA, 19 bp, Artificial Sequence
  Synthetic
ggggcggggtttgttgtga

SEQ ID NO: 22578 - DNA, 19 bp, Artificial Sequence
  Synthetic
ctccccagagcctgctggt

SEQ ID NO: 22579 - DNA, 22 bp, Artificial Sequence
  Synthetic
tttcgcgggaagaaccttccgg

SEQ ID NO: 22580 - DNA, 20 bp, Artificial Sequence
  Synthetic
ccatcggaggccccccagat

SEQ ID NO: 22581 - DNA, 19 bp, Artificial Sequence
  Synthetic
gggtggcgctctctgccaa

SEQ ID NO: 22582 - DNA, 20 bp, Artificial Sequence
  Synthetic
cgatcctgccgctcgttcga

SEQ ID NO: 22583 - DNA, 21 bp, Artificial Sequence
  Synthetic
acgaagtgtcttgtgcagcca

SEQ ID NO: 22584 - DNA, 24 bp, Artificial Sequence
  Synthetic
aatcgtgcgtaaattgctataccc

SEQ ID NO: 22585 - DNA, 22 bp, Artificial Sequence
  Synthetic
caggcactcctggtcaacagtc

SEQ ID NO: 22586 - DNA, 20 bp, Artificial Sequence
  Synthetic
tttgctgcgacaacaatgcc

SEQ ID NO: 22587 - DNA, 23 bp, Artificial Sequence
  Synthetic
gtggtgtctaatcagcagacaga

SEQ ID NO: 22588 - DNA, 20 bp, Artificial Sequence
  Synthetic
tggaccatggggaagctgat

SEQ ID NO: 22589 - DNA, 21 bp, Artificial Sequence
  Synthetic
gggcacggtgctgtctaatag

SEQ ID NO: 22590 - DNA, 25 bp, Artificial Sequence
  Synthetic
tgaatggtataaagctagaggtggc

SEQ ID NO: 22591 - DNA, 22 bp, Artificial Sequence
  Synthetic
aaggtactacgaccgcaggggt

SEQ ID NO: 22592 - DNA, 21 bp, Artificial Sequence
  Synthetic
aagggttaaacgcgctaatcc

SEQ ID NO: 22593 - DNA, 22 bp, Artificial Sequence
  Synthetic
ggtccccgggatattttgccaa

SEQ ID NO: 22594 - DNA, 20 bp, Artificial Sequence
  Synthetic
ggcgaggaggagactgcctt

SEQ ID NO: 22595 - DNA, 20 bp, Artificial Sequence
  Synthetic
gttagtcgcctggggcaacg

SEQ ID NO: 22596 - DNA, 24 bp, Artificial Sequence
  Synthetic
ttgagcaagacataggactaaccg

SEQ ID NO: 22597 - DNA, 21 bp, Artificial Sequence
  Synthetic
cactgaccgtttgcttactgt

SEQ ID NO: 22598 - DNA, 21 bp, Artificial Sequence
  Synthetic
actgaccaaggttcagactca

SEQ ID NO: 22599 - DNA, 22 bp, Artificial Sequence
  Synthetic
cataggcctgggaaacttgaat

SEQ ID NO: 22600 - DNA, 21 bp, Artificial Sequence
  Synthetic
gaggagtttcagcttgccttt

SEQ ID NO: 22601 - DNA, 24 bp, Artificial Sequence
  Synthetic
tgatctacgggatcgtatgacaga

SEQ ID NO: 22602 - DNA, 22 bp, Artificial Sequence
  Synthetic
actgaaacggtgtgtactgcca

SEQ ID NO: 22603 - DNA, 25 bp, Artificial Sequence
  Synthetic
agaatgcacctgttttaattgtggt

SEQ ID NO: 22604 - DNA, 24 bp, Artificial Sequence
  Synthetic
tcgaaaaaacatcaaaagacgctt

SEQ ID NO: 22605 - DNA, 25 bp, Artificial Sequence
  Synthetic
ttgctttctcaaattgaacattgga

SEQ ID NO: 22606 - DNA, 25 bp, Artificial Sequence
  Synthetic
acttgggaaatttgggtattggtac

SEQ ID NO: 22607 - DNA, 23 bp, Artificial Sequence
  Synthetic
tacacaaatcccgcctttgatcc

SEQ ID NO: 22608 - DNA, 23 bp, Artificial Sequence
  Synthetic
agaactacagcctttagggtctt

SEQ ID NO: 22609 - DNA, 25 bp, Artificial Sequence
  Synthetic
tgttggacatccatactttgaagtg

SEQ ID NO: 22610 - DNA, 25 bp, Artificial Sequence
  Synthetic
aatccaaatcagtatcctccagagg

SEQ ID NO: 22611 - DNA, 23 bp, Artificial Sequence
  Synthetic
ggtcttagcctggtttggagaag

SEQ ID NO: 22612 - DNA, 23 bp, Artificial Sequence
  Synthetic
ctggaaaggtttgtgtagacagt

SEQ ID NO: 22613 - DNA, 20 bp, Artificial Sequence
  Synthetic
tgctgtttgcagaacttggt

SEQ ID NO: 22614 - DNA, 21 bp, Artificial Sequence
  Synthetic
agctgattgatgatgccgatg

SEQ ID NO: 22615 - DNA, 23 bp, Artificial Sequence
  Synthetic
agaaacatctgtggtggaaaagc

SEQ ID NO: 22616 - DNA, 23 bp, Artificial Sequence
  Synthetic
acaatgggcatttgacaatgaca

SEQ ID NO: 22617 - DNA, 23 bp, Artificial Sequence
  Synthetic
agacttgagaaaagaggatggcg

SEQ ID NO: 22618 - DNA, 20 bp, Artificial Sequence
  Synthetic
cgcagagcctcagccctaga

SEQ ID NO: 22619 - DNA, 22 bp, Artificial Sequence
  Synthetic
cgcgacttcaacgacttcaagc

SEQ ID NO: 22620 - DNA, 21 bp, Artificial Sequence
  Synthetic
aaacgggacactgctgaaaat

SEQ ID NO: 22621 - DNA, 23 bp, Artificial Sequence
  Synthetic
gtggtacaacccactgttaaacc

SEQ ID NO: 22622 - DNA, 21 bp, Artificial Sequence
  Synthetic
aactctaggggctacaggagg

SEQ ID NO: 22623 - DNA, 23 bp, Artificial Sequence
  Synthetic
tctttgcaaagaactagcacacc

SEQ ID NO: 22624 - DNA, 20 bp, Artificial Sequence
  Synthetic
tgctccagatcccgccttta

SEQ ID NO: 22625 - DNA, 25 bp, Artificial Sequence
  Synthetic
ttgatgtttttggtgacttcagtga

SEQ ID NO: 22626 - DNA, 25 bp, Artificial Sequence
  Synthetic
aattaggtgacactgaaaatcctgc

SEQ ID NO: 22627 - DNA, 22 bp, Artificial Sequence
  Synthetic
ttggggctgcaaacttcaaaac

SEQ ID NO: 22628 - DNA, 25 bp, Artificial Sequence
  Synthetic
tgctttaattctactgactcatggg

SEQ ID NO: 22629 - DNA, 22 bp, Artificial Sequence
  Synthetic
agactgactcaaatctggcagc

SEQ ID NO: 22630 - DNA, 25 bp, Artificial Sequence
  Synthetic
aaatggactacatcaaggaaggaaa

SEQ ID NO: 22631 - DNA, 25 bp, Artificial Sequence
  Synthetic
tactggagtgagcaagaagaattct

SEQ ID NO: 22632 - DNA, 25 bp, Artificial Sequence
  Synthetic
ttcaggatgtaagctttcaacatcc

SEQ ID NO: 22633 - DNA, 25 bp, Artificial Sequence
  Synthetic
gaagggtttagtgtttgtgaaaacg

SEQ ID NO: 22634 - DNA, 24 bp, Artificial Sequence
  Synthetic
aagaatctagctgatgtggtatgc

SEQ ID NO: 22635 - DNA, 21 bp, Artificial Sequence
  Synthetic
atctgatgaggagacccagga

SEQ ID NO: 22636 - DNA, 23 bp, Artificial Sequence
  Synthetic
caaggcttcaagcagtttcaatt

SEQ ID NO: 22637 - DNA, 25 bp, Artificial Sequence
  Synthetic
aatacgtttttttgggggaaaagtt

SEQ ID NO: 22638 - DNA, 24 bp, Artificial Sequence
  Synthetic
attgggagctggttagaaaagagc

SEQ ID NO: 22639 - DNA, 22 bp, Artificial Sequence
  Synthetic
agaagaagaacagccaccgacg

SEQ ID NO: 22640 - DNA, 22 bp, Artificial Sequence
  Synthetic
attgctgcgcatttttggtagt

SEQ ID NO: 22641 - DNA, 24 bp, Artificial Sequence
  Synthetic
agagagctcactacctacagaatc

SEQ ID NO: 22642 - DNA, 25 bp, Artificial Sequence
  Synthetic
ctggtgatgtaagtcttgaatttgc

SEQ ID NO: 22643 - DNA, 25 bp, Artificial Sequence
  Synthetic
ctaatttaggggagtttagtgggga

SEQ ID NO: 22644 - DNA, 25 bp, Artificial Sequence
  Synthetic
ttggaactcagttacattttcatgc

SEQ ID NO: 22645 - DNA, 25 bp, Artificial Sequence
  Synthetic
aaggtattcaaattggtagaggtgg

SEQ ID NO: 22646 - DNA, 24 bp, Artificial Sequence
  Synthetic
taatgctgttattcaggacggaac

SEQ ID NO: 22647 - DNA, 23 bp, Artificial Sequence
  Synthetic
tatggctcgtgaaggtaaaatgg

SEQ ID NO: 22648 - DNA, 24 bp, Artificial Sequence
  Synthetic
ctactgaaaatcctgctccagaaa

SEQ ID NO: 22649 - DNA, 20 bp, Artificial Sequence
  Synthetic
tctctcgaacggaagcggta

SEQ ID NO: 22650 - DNA, 25 bp, Artificial Sequence
  Synthetic
gtgcagaaattgtaagtcatgaagg

SEQ ID NO: 22651 - DNA, 22 bp, Artificial Sequence
  Synthetic
aacttctgcttcaattcgcaca

SEQ ID NO: 22652 - DNA, 24 bp, Artificial Sequence
  Synthetic
ggaaattccctggcactatacaac

SEQ ID NO: 22653 - DNA, 21 bp, Artificial Sequence
  Synthetic
cccataacactgcgttgttgg

SEQ ID NO: 22654 - DNA, 23 bp, Artificial Sequence
  Synthetic
tcaagaggaagctagggatccac

SEQ ID NO: 22655 - DNA, 24 bp, Artificial Sequence
  Synthetic
gcaaaggtcctgaaataactgtga

SEQ ID NO: 22656 - DNA, 25 bp, Artificial Sequence
  Synthetic
aagaattatcaatcaagggcaacga

SEQ ID NO: 22657 - DNA, 25 bp, Artificial Sequence
  Synthetic
atagggttttcagatttcatttgcc

SEQ ID NO: 22658 - DNA, 24 bp, Artificial Sequence
  Synthetic
atggagcctaagcaaaatcaattg

SEQ ID NO: 22659 - DNA, 25 bp, Artificial Sequence
  Synthetic
tcagattggaatgttaaatgggagc

SEQ ID NO: 22660 - DNA, 25 bp, Artificial Sequence
  Synthetic
atttggccagtattaatacccacac

SEQ ID NO: 22661 - DNA, 22 bp, Artificial Sequence
  Synthetic
aaaacgtcaacaaaagccaggt

SEQ ID NO: 22662 - DNA, 25 bp, Artificial Sequence
  Synthetic
attcctaactttgatggaaacgtct

SEQ ID NO: 22663 - DNA, 24 bp, Artificial Sequence
  Synthetic
attcgttatggctaccgatgaaat

SEQ ID NO: 22664 - DNA, 20 bp, Artificial Sequence
  Synthetic
ggcggccaacccagcttatg

SEQ ID NO: 22665 - DNA, 23 bp, Artificial Sequence
  Synthetic
cgaatgttgaagcatgtggttac

SEQ ID NO: 22666 - DNA, 25 bp, Artificial Sequence
  Synthetic
ttaccattcacttggtagaacaggt

SEQ ID NO: 22667 - DNA, 20 bp, Artificial Sequence
  Synthetic
tggacggaactcttctaggc

SEQ ID NO: 22668 - DNA, 21 bp, Artificial Sequence
  Synthetic
ccacaagggttacccactact

SEQ ID NO: 22669 - DNA, 25 bp, Artificial Sequence
  Synthetic
ttgggtgaaatagctcagtactaca

SEQ ID NO: 22670 - DNA, 23 bp, Artificial Sequence
  Synthetic
cattccatggacatcaggtgtac

SEQ ID NO: 22671 - DNA, 22 bp, Artificial Sequence
  Synthetic
gctggcttggataatcacagga

SEQ ID NO: 22672 - DNA, 20 bp, Artificial Sequence
  Synthetic
tgcttctaaccccagtgtgt

SEQ ID NO: 22673 - DNA, 22 bp, Artificial Sequence
  Synthetic
tggattccaagagcacctagag

SEQ ID NO: 22674 - DNA, 25 bp, Artificial Sequence
  Synthetic
acaggaagttctatcccatcatttg

SEQ ID NO: 22675 - DNA, 25 bp, Artificial Sequence
  Synthetic
agacaattggatttcattgctgatg

SEQ ID NO: 22676 - DNA, 25 bp, Artificial Sequence
  Synthetic
aatcccactcaagagaaaagagagc

SEQ ID NO: 22677 - DNA, 20 bp, Artificial Sequence
  Synthetic
cgcgcattggcagaacattt

SEQ ID NO: 22678 - DNA, 22 bp, Artificial Sequence
  Synthetic
atcttgaacccagaagctctga

SEQ ID NO: 22679 - DNA, 22 bp, Artificial Sequence
  Synthetic
atgcccaaccaggtgataatgt

SEQ ID NO: 22680 - DNA, 23 bp, Artificial Sequence
  Synthetic
atacaccaacaaccaggatgatc

SEQ ID NO: 22681 - DNA, 25 bp, Artificial Sequence
  Synthetic
agtgtgttttacaatgtgttccctg

SEQ ID NO: 22682 - DNA, 25 bp, Artificial Sequence
  Synthetic
aaatcgaaacaaacaaatttgcagc

SEQ ID NO: 22683 - DNA, 20 bp, Artificial Sequence
  Synthetic
cctgttctcagcggtccaaa

SEQ ID NO: 22684 - DNA, 25 bp, Artificial Sequence
  Synthetic
aggaattatttcacatcagaggtgt

SEQ ID NO: 22685 - DNA, 24 bp, Artificial Sequence
  Synthetic
ccaagacttgaaccacacaaatgg

SEQ ID NO: 22686 - DNA, 25 bp, Artificial Sequence
  Synthetic
aagacatgaccaaagagttctttga

SEQ ID NO: 22687 - DNA, 22 bp, Artificial Sequence
  Synthetic
tgcccttaggatgaagtggatg

SEQ ID NO: 22688 - DNA, 20 bp, Artificial Sequence
  Synthetic
ggccccgttcacttcagaaa

SEQ ID NO: 22689 - DNA, 22 bp, Artificial Sequence
  Synthetic
acatgttggagagagaactggt

SEQ ID NO: 22690 - DNA, 20 bp, Artificial Sequence
  Synthetic
agtacacagattggcgggat

SEQ ID NO: 22691 - DNA, 22 bp, Artificial Sequence
  Synthetic
cgaagagcaacagccattctaa

SEQ ID NO: 22692 - DNA, 24 bp, Artificial Sequence
  Synthetic
gtttcaaaactggggaattgaacc

SEQ ID NO: 22693 - DNA, 22 bp, Artificial Sequence
  Synthetic
attcatcgtccatgatgtggga

SEQ ID NO: 22694 - DNA, 25 bp, Artificial Sequence
  Synthetic
ctcttctctaactgtgaatgtgagg

SEQ ID NO: 22695 - DNA, 22 bp, Artificial Sequence
  Synthetic
agtgagagggtattggagaggc

SEQ ID NO: 22696 - DNA, 25 bp, Artificial Sequence
  Synthetic
gacgatgagaattttcaagaacagg

SEQ ID NO: 22697 - DNA, 24 bp, Artificial Sequence
  Synthetic
tttctgaacaggtagaagtgcaaa

SEQ ID NO: 22698 - DNA, 20 bp, Artificial Sequence
  Synthetic
gggccctccagatccaccga

SEQ ID NO: 22699 - DNA, 20 bp, Artificial Sequence
  Synthetic
ggaggctcgggatccgtata

SEQ ID NO: 22700 - DNA, 22 bp, Artificial Sequence
  Synthetic
ggatacacaccttttggaggca

SEQ ID NO: 22701 - DNA, 22 bp, Artificial Sequence
  Synthetic
tggtgaacatccttccgttaca

SEQ ID NO: 22702 - DNA, 21 bp, Artificial Sequence
  Synthetic
aaacgcaaacactcctcctct

SEQ ID NO: 22703 - DNA, 25 bp, Artificial Sequence
  Synthetic
taaagcaatagaggttccaaaggtg

SEQ ID NO: 22704 - DNA, 23 bp, Artificial Sequence
  Synthetic
ctgcagaggtagatgacagtaga

SEQ ID NO: 22705 - DNA, 20 bp, Artificial Sequence
  Synthetic
cctcccgggagagccatagt

SEQ ID NO: 22706 - DNA, 20 bp, Artificial Sequence
  Synthetic
ggtgtgcgcgccacaagaaa

SEQ ID NO: 22707 - DNA, 22 bp, Artificial Sequence
  Synthetic
ttcacgctgctggcatcctgtt

SEQ ID NO: 22708 - DNA, 20 bp, Artificial Sequence
  Synthetic
cggtcactggggtgtcctga

SEQ ID NO: 22709 - DNA, 22 bp, Artificial Sequence
  Synthetic
tggggccctataacccacaagt

SEQ ID NO: 22710 - DNA, 21 bp, Artificial Sequence
  Synthetic
gcttcaccaagacctgcggag

SEQ ID NO: 22711 - DNA, 22 bp, Artificial Sequence
  Synthetic
cctctacggagtctcctcgagc

SEQ ID NO: 22712 - DNA, 22 bp, Artificial Sequence
  Synthetic
tggaccctcatcttcctgtgct

SEQ ID NO: 22713 - DNA, 22 bp, Artificial Sequence
  Synthetic
gtggcgacatcttgaggggtct

SEQ ID NO: 22714 - DNA, 21 bp, Artificial Sequence
  Synthetic
aagggcccgtatgccagatgt

SEQ ID NO: 22715 - DNA, 21 bp, Artificial Sequence
  Synthetic
ggccctggacttcatccctgt

SEQ ID NO: 22716 - DNA, 22 bp, Artificial Sequence
  Synthetic
cagacccaacgacggtgcttgg

SEQ ID NO: 22717 - DNA, 20 bp, Artificial Sequence
  Synthetic
gacggacgcccttatgaccg

SEQ ID NO: 22718 - DNA, 20 bp, Artificial Sequence
  Synthetic
cacggggtgcgcatggtatg

SEQ ID NO: 22719 - DNA, 22 bp, Artificial Sequence
  Synthetic
ctgggggctgtccaaaatgaga

SEQ ID NO: 22720 - DNA, 22 bp, Artificial Sequence
  Synthetic
tgcagaagaactgaaacccgct

SEQ ID NO: 22721 - DNA, 19 bp, Artificial Sequence
  Synthetic
tcgtcgtgagcggcttagc

SEQ ID NO: 22722 - DNA, 22 bp, Artificial Sequence
  Synthetic
gttacgcaggctacaccagtgg

SEQ ID NO: 22723 - DNA, 21 bp, Artificial Sequence
  Synthetic
tgtgcagcaacacttggcatg

SEQ ID NO: 22724 - DNA, 21 bp, Artificial Sequence
  Synthetic
tgttgtggggtctcagctccc

SEQ ID NO: 22725 - DNA, 20 bp, Artificial Sequence
  Synthetic
gttccctcctgctctcccga

SEQ ID NO: 22726 - DNA, 22 bp, Artificial Sequence
  Synthetic
catctcctgacccgacaacagc

SEQ ID NO: 22727 - DNA, 22 bp, Artificial Sequence
  Synthetic
tgcgagaagatggcactctacg

SEQ ID NO: 22728 - DNA, 22 bp, Artificial Sequence
  Synthetic
gtggggtgctcactaccagttt

SEQ ID NO: 22729 - DNA, 20 bp, Artificial Sequence
  Synthetic
gcgagctgcttgggagacag

SEQ ID NO: 22730 - DNA, 20 bp, Artificial Sequence
  Synthetic
ggcgccacccttaagagctt

SEQ ID NO: 22731 - DNA, 22 bp, Artificial Sequence
  Synthetic
gtaaggaagtgggccttaatgg

SEQ ID NO: 22732 - DNA, 22 bp, Artificial Sequence
  Synthetic
aagccgctcaagaattgttcaa

SEQ ID NO: 22733 - DNA, 24 bp, Artificial Sequence
  Synthetic
aattggagttcttatagctgacgc

SEQ ID NO: 22734 - DNA, 25 bp, Artificial Sequence
  Synthetic
aaagcctcagataaccaacaagatg

SEQ ID NO: 22735 - DNA, 24 bp, Artificial Sequence
  Synthetic
ccaccctcttaagttgagaaacag

SEQ ID NO: 22736 - DNA, 24 bp, Artificial Sequence
  Synthetic
tatcagcagattggaagaagaagg

SEQ ID NO: 22737 - DNA, 25 bp, Artificial Sequence
  Synthetic
tttggagagaaggaagatgttatgc

SEQ ID NO: 22738 - DNA, 24 bp, Artificial Sequence
  Synthetic
agagttacttctgatccacgaagg

SEQ ID NO: 22739 - DNA, 22 bp, Artificial Sequence
  Synthetic
ccatagcggttcagaaaatggc

SEQ ID NO: 22740 - DNA, 22 bp, Artificial Sequence
  Synthetic
ccagattgggttgctagacaaa

SEQ ID NO: 22741 - DNA, 25 bp, Artificial Sequence
  Synthetic
agggtagtatgctttaaattcccaa

SEQ ID NO: 22742 - DNA, 25 bp, Artificial Sequence
  Synthetic
aacaagcaatttccataagtctgac

SEQ ID NO: 22743 - DNA, 24 bp, Artificial Sequence
  Synthetic
aaaacctacactatctcccctccc

SEQ ID NO: 22744 - DNA, 23 bp, Artificial Sequence
  Synthetic
aaaacgcattccagcagtaaaca

SEQ ID NO: 22745 - DNA, 23 bp, Artificial Sequence
  Synthetic
taggcctactgttcctgtagagc

SEQ ID NO: 22746 - DNA, 24 bp, Artificial Sequence
  Synthetic
ttttacaacaaccaaccagaaacg

SEQ ID NO: 22747 - DNA, 25 bp, Artificial Sequence
  Synthetic
tggttttacgtactggtagtagaca

SEQ ID NO: 22748 - DNA, 24 bp, Artificial Sequence
  Synthetic
agtttcaggcaatcagtttagagt

SEQ ID NO: 22749 - DNA, 24 bp, Artificial Sequence
  Synthetic
atatgccagacatttttggacacg

SEQ ID NO: 22750 - DNA, 24 bp, Artificial Sequence
  Synthetic
atcaatgctatgaatccaggcatt

SEQ ID NO: 22751 - DNA, 23 bp, Artificial Sequence
  Synthetic
cacttgtccatttgtgtcattcg

SEQ ID NO: 22752 - DNA, 22 bp, Artificial Sequence
  Synthetic
tccatggggccaaagaaatagc

SEQ ID NO: 22753 - DNA, 22 bp, Artificial Sequence
  Synthetic
ctatcgactcttcaaacacggc

SEQ ID NO: 22754 - DNA, 25 bp, Artificial Sequence
  Synthetic
cgagaacgaaaatgacagtgataca

SEQ ID NO: 22755 - DNA, 20 bp, Artificial Sequence
  Synthetic
tacaggtagaagggcgccat

SEQ ID NO: 22756 - DNA, 24 bp, Artificial Sequence
  Synthetic
acagacctacgtgaccatatagac

SEQ ID NO: 22757 - DNA, 24 bp, Artificial Sequence
  Synthetic
tggagacatatgcaatacaatgca

SEQ ID NO: 22758 - DNA, 21 bp, Artificial Sequence
  Synthetic
aatcccactttcactgaccca

SEQ ID NO: 22759 - DNA, 21 bp, Artificial Sequence
  Synthetic
acggatgaatatgttgcacgc

SEQ ID NO: 22760 - DNA, 20 bp, Artificial Sequence
  Synthetic
gtgttgaggtaggtcgtggt

SEQ ID NO: 22761 - DNA, 23 bp, Artificial Sequence
  Synthetic
tatggttgatactggctttggtg

SEQ ID NO: 22762 - DNA, 25 bp, Artificial Sequence
  Synthetic
tttcctacacctagtggttctatgg

SEQ ID NO: 22763 - DNA, 25 bp, Artificial Sequence
  Synthetic
taggacgcaaatttttactacaagc

SEQ ID NO: 22764 - DNA, 20 bp, Artificial Sequence
  Synthetic
atgcgtgccaaatccctgtt

SEQ ID NO: 22765 - DNA, 22 bp, Artificial Sequence
  Synthetic
agaatgtgtgtactgcaagcaa

SEQ ID NO: 22766 - DNA, 24 bp, Artificial Sequence
  Synthetic
ttccataatataaggggtcggtgg

SEQ ID NO: 22767 - DNA, 25 bp, Artificial Sequence
  Synthetic
cggacagagcccattacaatattgt

SEQ ID NO: 22768 - DNA, 24 bp, Artificial Sequence
  Synthetic
atatgcacacacttagaagtctgc

SEQ ID NO: 22769 - DNA, 25 bp, Artificial Sequence
  Synthetic
aggaaaaccgtttcattgaaattgg

SEQ ID NO: 22770 - DNA, 22 bp, Artificial Sequence
  Synthetic
aacaagccaattaaagtgggca

SEQ ID NO: 22771 - DNA, 21 bp, Artificial Sequence
  Synthetic
ttttacagcagaggtgtccca

SEQ ID NO: 22772 - DNA, 25 bp, Artificial Sequence
  Synthetic
gttggaaccacataaatgggaaaag

SEQ ID NO: 22773 - DNA, 23 bp, Artificial Sequence
  Synthetic
aatcagaaacatggccaattgga

SEQ ID NO: 22774 - DNA, 25 bp, Artificial Sequence
  Synthetic
acaaagactgaacaaaaggagctac

SEQ ID NO: 22775 - DNA, 24 bp, Artificial Sequence
  Synthetic
aattggcaaatgttgtgaggaaga

SEQ ID NO: 22776 - DNA, 20 bp, Artificial Sequence
  Synthetic
agtaccagcggaaatgctcg

SEQ ID NO: 22777 - DNA, 21 bp, Artificial Sequence
  Synthetic
tgacttcgccctcatagtgaa

SEQ ID NO: 22778 - DNA, 20 bp, Artificial Sequence
  Synthetic
cccaaatggcccttcagcta

SEQ ID NO: 22779 - DNA, 22 bp, Artificial Sequence
  Synthetic
ggatgaagactaccaaggcagg

SEQ ID NO: 22780 - DNA, 25 bp, Artificial Sequence
  Synthetic
agatggacctgacatctgtacattc

SEQ ID NO: 22781 - DNA, 25 bp, Artificial Sequence
  Synthetic
attggtttaaggtgtgttacatgca

SEQ ID NO: 22782 - DNA, 25 bp, Artificial Sequence
  Synthetic
aggaggagtctgaatatccatatgc

SEQ ID NO: 22783 - DNA, 23 bp, Artificial Sequence
  Synthetic
cgggatgatgatgagagcgaatt

SEQ ID NO: 22784 - DNA, 20 bp, Artificial Sequence
  Synthetic
tgcaatagcctcagtcccag

SEQ ID NO: 22785 - DNA, 24 bp, Artificial Sequence
  Synthetic
cacagtaggtgtcagttttactga

SEQ ID NO: 22786 - DNA, 22 bp, Artificial Sequence
  Synthetic
aagtgaccaagaagacgaggag

SEQ ID NO: 22787 - DNA, 25 bp, Artificial Sequence
  Synthetic
gactcacaatatggttctgaacagt

SEQ ID NO: 22788 - DNA, 18 bp, Artificial Sequence
  Synthetic
ccggctgttcgcaagcga

SEQ ID NO: 22789 - DNA, 24 bp, Artificial Sequence
  Synthetic
agctgctccacaagatatttatcc

SEQ ID NO: 22790 - DNA, 25 bp, Artificial Sequence
  Synthetic
tcctttattcaggatcacagctagt

SEQ ID NO: 22791 - DNA, 24 bp, Artificial Sequence
  Synthetic
tagacgctattatgaacaagtgcc

SEQ ID NO: 22792 - DNA, 24 bp, Artificial Sequence
  Synthetic
ttgagttacaaacactgggtgaag

SEQ ID NO: 22793 - DNA, 20 bp, Artificial Sequence
  Synthetic
cagatggctgtttggcttcc

SEQ ID NO: 22794 - DNA, 22 bp, Artificial Sequence
  Synthetic
cctaaccgatttgcctttggag

SEQ ID NO: 22795 - DNA, 21 bp, Artificial Sequence
  Synthetic
tgtgcaggaacacagtttcag

SEQ ID NO: 22796 - DNA, 25 bp, Artificial Sequence
  Synthetic
tttcagaaaacgtagatcctccaat

SEQ ID NO: 22797 - DNA, 21 bp, Artificial Sequence
  Synthetic
tggcatgcaattggtatgtgg

SEQ ID NO: 22798 - DNA, 24 bp, Artificial Sequence
  Synthetic
tcggaagaatgattggtggaatcg

SEQ ID NO: 22799 - DNA, 22 bp, Artificial Sequence
  Synthetic
ggtgaaaatggacgaaggacaa

SEQ ID NO: 22800 - DNA, 22 bp, Artificial Sequence
  Synthetic
agggaagggtactcactggtcg

SEQ ID NO: 22801 - DNA, 25 bp, Artificial Sequence
  Synthetic
ttgcttcaaatgagaatgtggaaac

SEQ ID NO: 22802 - DNA, 24 bp, Artificial Sequence
  Synthetic
acttggaatgcaggaccttttttc

SEQ ID NO: 22803 - DNA, 24 bp, Artificial Sequence
  Synthetic
ttgaggacacaagagtctgaatgt

SEQ ID NO: 22804 - DNA, 22 bp, Artificial Sequence
  Synthetic
gacaattggcatggttcgaacc

SEQ ID NO: 22805 - DNA, 24 bp, Artificial Sequence
  Synthetic
aatggatggacagagactgatagt

SEQ ID NO: 22806 - DNA, 23 bp, Artificial Sequence
  Synthetic
gtgtcttgaaacgatggaagttg

SEQ ID NO: 22807 - DNA, 23 bp, Artificial Sequence
  Synthetic
aattggcaaatgtcgtgaggaag

SEQ ID NO: 22808 - DNA, 25 bp, Artificial Sequence
  Synthetic
atgttcgaaagtaagagcatgaagc

SEQ ID NO: 22809 - DNA, 23 bp, Artificial Sequence
  Synthetic
tccaatcctctgatgatttcgct

SEQ ID NO: 22810 - DNA, 21 bp, Artificial Sequence
  Synthetic
ggacaacgaccttggaccagc

SEQ ID NO: 22811 - DNA, 20 bp, Artificial Sequence
  Synthetic
caacacggcgaccctacaag

SEQ ID NO: 22812 - DNA, 25 bp, Artificial Sequence
  Synthetic
ttggaaaaactaactaacactgggt

SEQ ID NO: 22813 - DNA, 23 bp, Artificial Sequence
  Synthetic
aattccggttgaccttctatgtc

SEQ ID NO: 22814 - DNA, 20 bp, Artificial Sequence
  Synthetic
acgaaagtttgcaggaggca

SEQ ID NO: 22815 - DNA, 21 bp, Artificial Sequence
  Synthetic
ggcagtacggaggctatagac

SEQ ID NO: 22816 - DNA, 22 bp, Artificial Sequence
  Synthetic
agatgaagggggagattggaga

SEQ ID NO: 22817 - DNA, 23 bp, Artificial Sequence
  Synthetic
ggcatacagacattaaaccacca

SEQ ID NO: 22818 - DNA, 22 bp, Artificial Sequence
  Synthetic
gacaaaaccgctacctgtgtaa

SEQ ID NO: 22819 - DNA, 20 bp, Artificial Sequence
  Synthetic
gggcaccgcaaagacctacg

SEQ ID NO: 22820 - DNA, 20 bp, Artificial Sequence
  Synthetic
ttggacaggtgcaggcaatg

SEQ ID NO: 22821 - DNA, 23 bp, Artificial Sequence
  Synthetic
attgtggtaataacgtcccctgc

SEQ ID NO: 22822 - DNA, 21 bp, Artificial Sequence
  Synthetic
tatccgtctacataggcctgc

SEQ ID NO: 22823 - DNA, 20 bp, Artificial Sequence
  Synthetic
gcctgtaccatcgcgttcta

SEQ ID NO: 22824 - DNA, 20 bp, Artificial Sequence
  Synthetic
attggggaacactgggctaa

SEQ ID NO: 22825 - DNA, 22 bp, Artificial Sequence
  Synthetic
ggtactatgggtgacactgtgc

SEQ ID NO: 22826 - DNA, 22 bp, Artificial Sequence
  Synthetic
ctgtacctgggcaatatgatgc

SEQ ID NO: 22827 - DNA, 23 bp, Artificial Sequence
  Synthetic
tcctacaatcctccattttgctg

SEQ ID NO: 22828 - DNA, 21 bp, Artificial Sequence
  Synthetic
gagaccctccttacagccatg

SEQ ID NO: 22829 - DNA, 22 bp, Artificial Sequence
  Synthetic
tgaaacgatggaggttgttcag

SEQ ID NO: 22830 - DNA, 24 bp, Artificial Sequence
  Synthetic
gaaagcaaagttggcaaatgttgt

SEQ ID NO: 22831 - DNA, 24 bp, Artificial Sequence
  Synthetic
tcttcaatcctctgacgattttgc

SEQ ID NO: 22832 - DNA, 24 bp, Artificial Sequence
  Synthetic
cggacatgagtattggagttactg

SEQ ID NO: 22833 - DNA, 23 bp, Artificial Sequence
  Synthetic
acagaagaccagtcgggatatcc

SEQ ID NO: 22834 - DNA, 22 bp, Artificial Sequence
  Synthetic
ggtggtaaatcccagcacaggt

SEQ ID NO: 22835 - DNA, 22 bp, Artificial Sequence
  Synthetic
gagttcctctagggatggccga

SEQ ID NO: 22836 - DNA, 19 bp, Artificial Sequence
  Synthetic
ccggtggcctcagctgctt

SEQ ID NO: 22837 - DNA, 22 bp, Artificial Sequence
  Synthetic
agggtggcatcttcgacaactg

SEQ ID NO: 22838 - DNA, 19 bp, Artificial Sequence
  Synthetic
cagtggggctccgcgtact

SEQ ID NO: 22839 - DNA, 22 bp, Artificial Sequence
  Synthetic
taggaggttattggcacgccct

SEQ ID NO: 22840 - DNA, 21 bp, Artificial Sequence
  Synthetic
tcttcagtggtcagcgtcggt

SEQ ID NO: 22841 - DNA, 21 bp, Artificial Sequence
  Synthetic
tgcttcgctggttccgacttg

SEQ ID NO: 22842 - DNA, 18 bp, Artificial Sequence
  Synthetic
cgtgctggtggcgatgca

SEQ ID NO: 22843 - DNA, 20 bp, Artificial Sequence
  Synthetic
gccggcctttgtgcaaactg

SEQ ID NO: 22844 - DNA, 22 bp, Artificial Sequence
  Synthetic
aggactgtgccatagttcggga

SEQ ID NO: 22845 - DNA, 21 bp, Artificial Sequence
  Synthetic
ccattgccaatgggggctacc

SEQ ID NO: 22846 - DNA, 22 bp, Artificial Sequence
  Synthetic
ctccctagggaggctcagacca

SEQ ID NO: 22847 - DNA, 19 bp, Artificial Sequence
  Synthetic
gtgcccggttgctggcgaa

SEQ ID NO: 22848 - DNA, 20 bp, Artificial Sequence
  Synthetic
ctgggtgtgtcggcagtgac

SEQ ID NO: 22849 - DNA, 19 bp, Artificial Sequence
  Synthetic
ggcaggtaccgtgcgctct

SEQ ID NO: 22850 - DNA, 22 bp, Artificial Sequence
  Synthetic
ggaacatgtggccccccatcac

SEQ ID NO: 22851 - DNA, 20 bp, Artificial Sequence
  Synthetic
tgtgaagccggtggcggaag

SEQ ID NO: 22852 - DNA, 20 bp, Artificial Sequence
  Synthetic
cggcctctttcctgctggga

SEQ ID NO: 22853 - DNA, 21 bp, Artificial Sequence
  Synthetic
gcgctcggcgttctactctgg

SEQ ID NO: 22854 - DNA, 22 bp, Artificial Sequence
  Synthetic
gatggggtgcagcaaaggatgg

SEQ ID NO: 22855 - DNA, 21 bp, Artificial Sequence
  Synthetic
cgtctagcgcctacgacctga

SEQ ID NO: 22856 - DNA, 20 bp, Artificial Sequence
  Synthetic
ctgctgtgtccctactgccc

SEQ ID NO: 22857 - DNA, 22 bp, Artificial Sequence
  Synthetic
agctggtgtgcaggagagaaga

SEQ ID NO: 22858 - DNA, 22 bp, Artificial Sequence
  Synthetic
tcgacgaacatgacatgcaggt

SEQ ID NO: 22859 - DNA, 22 bp, Artificial Sequence
  Synthetic
cttggctgaatgtgttgctggg

SEQ ID NO: 22860 - DNA, 22 bp, Artificial Sequence
  Synthetic
gagttggtgatgtgccaggtcc

SEQ ID NO: 22861 - DNA, 24 bp, Artificial Sequence
  Synthetic
atttggaagcttgtgaattcgact

SEQ ID NO: 22862 - DNA, 25 bp, Artificial Sequence
  Synthetic
aggcagtgtaagcatttttatcatg

SEQ ID NO: 22863 - DNA, 23 bp, Artificial Sequence
  Synthetic
ggcaattccctggaactatttca

SEQ ID NO: 22864 - DNA, 22 bp, Artificial Sequence
  Synthetic
tgcgttctagcaacaaaaaagc

SEQ ID NO: 22865 - DNA, 22 bp, Artificial Sequence
  Synthetic
gtgggataggtgcaatgtcatt

SEQ ID NO: 22866 - DNA, 20 bp, Artificial Sequence
  Synthetic
caaggcttgctcccgaagac

SEQ ID NO: 22867 - DNA, 24 bp, Artificial Sequence
  Synthetic
ctaaaagtcagttttggctgcaac

SEQ ID NO: 22868 - DNA, 24 bp, Artificial Sequence
  Synthetic
tttggacacaattagacctgagtg

SEQ ID NO: 22869 - DNA, 20 bp, Artificial Sequence
  Synthetic
ccccaccacctccacaaccg

SEQ ID NO: 22870 - DNA, 19 bp, Artificial Sequence
  Synthetic
gtggaaggtcacccaggcg

SEQ ID NO: 22871 - DNA, 20 bp, Artificial Sequence
  Synthetic
gcgaccccccagtaatcatt

SEQ ID NO: 22872 - DNA, 25 bp, Artificial Sequence
  Synthetic
atgctgcttttgctactaacatact

SEQ ID NO: 22873 - DNA, 22 bp, Artificial Sequence
  Synthetic
ccactagcacaggttccagtgc

SEQ ID NO: 22874 - DNA, 25 bp, Artificial Sequence
  Synthetic
tccagacagagattttcttgatgtt

SEQ ID NO: 22875 - DNA, 25 bp, Artificial Sequence
  Synthetic
agtcattatacaccctcatgacagt

SEQ ID NO: 22876 - DNA, 25 bp, Artificial Sequence
  Synthetic
ccaaatgtttattgtaggatgcaca

SEQ ID NO: 22877 - DNA, 25 bp, Artificial Sequence
  Synthetic
atccagtgatgctcaattgtttaac

SEQ ID NO: 22878 - DNA, 25 bp, Artificial Sequence
  Synthetic
caaacgtaaaaattgaggtctgacc

SEQ ID NO: 22879 - DNA, 20 bp, Artificial Sequence
  Synthetic
tcgaacaatcaagcagtgcc

SEQ ID NO: 22880 - DNA, 22 bp, Artificial Sequence
  Synthetic
atcgtgcggtcttggtaaatgt

SEQ ID NO: 22881 - DNA, 25 bp, Artificial Sequence
  Synthetic
atgcgactgctagcatcatttatga

SEQ ID NO: 22882 - DNA, 24 bp, Artificial Sequence
  Synthetic
ccagaagttagatgtgtttgcaga

SEQ ID NO: 22883 - DNA, 24 bp, Artificial Sequence
  Synthetic
ctggttatgagactttcagggtcg

SEQ ID NO: 22884 - DNA, 21 bp, Artificial Sequence
  Synthetic
aagaactgactcccggaacca

SEQ ID NO: 22885 - DNA, 25 bp, Artificial Sequence
  Synthetic
ctaattcaaaatgcacaagctgtgg

SEQ ID NO: 22886 - DNA, 25 bp, Artificial Sequence
  Synthetic
tgagattccaattaagcagaccatc

SEQ ID NO: 22887 - DNA, 24 bp, Artificial Sequence
  Synthetic
tctctcctatcattgttggcaact

SEQ ID NO: 22888 - DNA, 25 bp, Artificial Sequence
  Synthetic
actttgtcgatttgaaaatgagagg

SEQ ID NO: 22889 - DNA, 20 bp, Artificial Sequence
  Synthetic
ccctccgtgctcgaagattt

SEQ ID NO: 22890 - DNA, 24 bp, Artificial Sequence
  Synthetic
tgaaacggaggatcataactctgc

SEQ ID NO: 22891 - DNA, 22 bp, Artificial Sequence
  Synthetic
agcattgcctacagatatgcca

SEQ ID NO: 22892 - DNA, 22 bp, Artificial Sequence
  Synthetic
cgaggcgcattagatggtaatg

SEQ ID NO: 22893 - DNA, 22 bp, Artificial Sequence
  Synthetic
agatgaatcaggccgatttgac

SEQ ID NO: 22894 - DNA, 21 bp, Artificial Sequence
  Synthetic
aaaaggcgaagagggaggagc

SEQ ID NO: 22895 - DNA, 24 bp, Artificial Sequence
  Synthetic
tctccagaaaatggggttgcaatt

SEQ ID NO: 22896 - DNA, 24 bp, Artificial Sequence
  Synthetic
cccctattgaacgtctacaatcct

SEQ ID NO: 22897 - DNA, 25 bp, Artificial Sequence
  Synthetic
tttcagatgtcttggacaaagtcag

SEQ ID NO: 22898 - DNA, 24 bp, Artificial Sequence
  Synthetic
aatttgctatcacagatgcatgtg

SEQ ID NO: 22899 - DNA, 23 bp, Artificial Sequence
  Synthetic
agacaggatatggcatttgaccc

SEQ ID NO: 22900 - DNA, 25 bp, Artificial Sequence
  Synthetic
aaatgggcaaggatatttatggtga

SEQ ID NO: 22901 - DNA, 25 bp, Artificial Sequence
  Synthetic
atggtgttttatggggtaatgactg

SEQ ID NO: 22902 - DNA, 22 bp, Artificial Sequence
  Synthetic
aacatgccctcaaactttggtt

SEQ ID NO: 22903 - DNA, 21 bp, Artificial Sequence
  Synthetic
ggagatcctccatacagccat

SEQ ID NO: 22904 - DNA, 24 bp, Artificial Sequence
  Synthetic
gaactcatgccttgaaacaatgga

SEQ ID NO: 22905 - DNA, 25 bp, Artificial Sequence
  Synthetic
aatggtcacacaaagaacaataggg

SEQ ID NO: 22906 - DNA, 22 bp, Artificial Sequence
  Synthetic
ccaaactggcaaatgttgtgag

SEQ ID NO: 22907 - DNA, 22 bp, Artificial Sequence
  Synthetic
tgaagctccgaacacaaatacc

SEQ ID NO: 22908 - DNA, 22 bp, Artificial Sequence
  Synthetic
tccaatcctccgacgattttgc

SEQ ID NO: 22909 - DNA, 21 bp, Artificial Sequence
  Synthetic
cccagatggctctccaattgt

SEQ ID NO: 22910 - DNA, 23 bp, Artificial Sequence
  Synthetic
tgaagtctgcttaaagtgggagc

SEQ ID NO: 22911 - DNA, 25 bp, Artificial Sequence
  Synthetic
ccctagtagttcatataggagaccg

SEQ ID NO: 22912 - DNA, 24 bp, Artificial Sequence
  Synthetic
tggagcctcagagagctaaaaatt

SEQ ID NO: 22913 - DNA, 25 bp, Artificial Sequence
  Synthetic
aaggtcaccattcaagattgattct

SEQ ID NO: 22914 - DNA, 25 bp, Artificial Sequence
  Synthetic
aacaccagaaagacaatccaaaagg

SEQ ID NO: 22915 - DNA, 20 bp, Artificial Sequence
  Synthetic
tcctcaaggagtgcgtttgg

SEQ ID NO: 22916 - DNA, 25 bp, Artificial Sequence
  Synthetic
gcttttaaaaatcctgaacaaaggc

SEQ ID NO: 22917 - DNA, 20 bp, Artificial Sequence
  Synthetic
caggaagaggaactgggggt

SEQ ID NO: 22918 - DNA, 22 bp, Artificial Sequence
  Synthetic
caacagatgttggtgctgttgg

SEQ ID NO: 22919 - DNA, 25 bp, Artificial Sequence
  Synthetic
tcaaacctttgacattttagagcca

SEQ ID NO: 22920 - DNA, 21 bp, Artificial Sequence
  Synthetic
cgccattgcaggaatttgctg

SEQ ID NO: 22921 - DNA, 24 bp, Artificial Sequence
  Synthetic
agtgagcgtttactaattgtggga

SEQ ID NO: 22922 - DNA, 25 bp, Artificial Sequence
  Synthetic
gttggagacacagaaaatcctagct

SEQ ID NO: 22923 - DNA, 22 bp, Artificial Sequence
  Synthetic
aactacaacaggacagagcagg

SEQ ID NO: 22924 - DNA, 21 bp, Artificial Sequence
  Synthetic
aggatttgtcacaagaggcgg

SEQ ID NO: 22925 - DNA, 24 bp, Artificial Sequence
  Synthetic
ggactaggaaatgaagctgaagat

SEQ ID NO: 22926 - DNA, 21 bp, Artificial Sequence
  Synthetic
cgtcgacgcctagaagacgac

SEQ ID NO: 22927 - DNA, 23 bp, Artificial Sequence
  Synthetic
gcaaactaaaatacaggggcatg

SEQ ID NO: 22928 - DNA, 21 bp, Artificial Sequence
  Synthetic
aattggtgccaatagacgccc

SEQ ID NO: 22929 - DNA, 20 bp, Artificial Sequence
  Synthetic
cctagacgggtagcgactag

SEQ ID NO: 22930 - DNA, 25 bp, Artificial Sequence
  Synthetic
tgtacaatagaagagtcagacaggt

SEQ ID NO: 22931 - DNA, 22 bp, Artificial Sequence
  Synthetic
tcgtccttaatactggctctcg

SEQ ID NO: 22932 - DNA, 24 bp, Artificial Sequence
  Synthetic
tgcttctggtaaggtgtatcttcc

SEQ ID NO: 22933 - DNA, 24 bp, Artificial Sequence
  Synthetic
acttctaagtcttccaaacgcaaa

SEQ ID NO: 22934 - DNA, 20 bp, Artificial Sequence
  Synthetic
gactcacagccaacctctct

SEQ ID NO: 22935 - DNA, 24 bp, Artificial Sequence
  Synthetic
ttcaggatcttgcatcgtttgaac

SEQ ID NO: 22936 - DNA, 25 bp, Artificial Sequence
  Synthetic
atcagattttatgtaagtgccagcg

SEQ ID NO: 22937 - DNA, 23 bp, Artificial Sequence
  Synthetic
cagtgcagaaaatgaagctgaag

SEQ ID NO: 22938 - DNA, 23 bp, Artificial Sequence
  Synthetic
gcataatgccagagtggataaca

SEQ ID NO: 22939 - DNA, 25 bp, Artificial Sequence
  Synthetic
tgatgttacatatgcatgttggagt

SEQ ID NO: 22940 - DNA, 25 bp, Artificial Sequence
  Synthetic
aaatgctgcaaaagacattgataca

SEQ ID NO: 22941 - DNA, 20 bp, Artificial Sequence
  Synthetic
ctctcccactgcctggaaac

SEQ ID NO: 22942 - DNA, 25 bp, Artificial Sequence
  Synthetic
gacactgtcacactaccaaaaggaa

SEQ ID NO: 22943 - DNA, 22 bp, Artificial Sequence
  Synthetic
ttttcctgatgtcaccgttgtt

SEQ ID NO: 22944 - DNA, 25 bp, Artificial Sequence
  Synthetic
tacactttttaaatcagccttcccg

SEQ ID NO: 22945 - DNA, 25 bp, Artificial Sequence
  Synthetic
cccacaaacaaatataattcctggc

SEQ ID NO: 22946 - DNA, 23 bp, Artificial Sequence
  Synthetic
aatccagaaactcaacggctagt

SEQ ID NO: 22947 - DNA, 22 bp, Artificial Sequence
  Synthetic
ctatggaaaacgagagcagctg

SEQ ID NO: 22948 - DNA, 23 bp, Artificial Sequence
  Synthetic
acaaccaacatccagtattgagg

SEQ ID NO: 22949 - DNA, 22 bp, Artificial Sequence
  Synthetic
tgtttgactcatggggtcagtc

SEQ ID NO: 22950 - DNA, 24 bp, Artificial Sequence
  Synthetic
ttcaggtacgtctttattgttgcc

SEQ ID NO: 22951 - DNA, 22 bp, Artificial Sequence
  Synthetic
gcccatcctggacatggagacg

SEQ ID NO: 22952 - DNA, 22 bp, Artificial Sequence
  Synthetic
ctcaagttttcgcacccgtcgc

SEQ ID NO: 22953 - DNA, 20 bp, Artificial Sequence
  Synthetic
gattccattcggggtgccgc

SEQ ID NO: 22954 - DNA, 19 bp, Artificial Sequence
  Synthetic
taaggccctgggagcgcgt

SEQ ID NO: 22955 - DNA, 21 bp, Artificial Sequence
  Synthetic
gcctcttccagtaactcggcc

SEQ ID NO: 22956 - DNA, 21 bp, Artificial Sequence
  Synthetic
gcgagtagttggtgatgcggc

SEQ ID NO: 22957 - DNA, 20 bp, Artificial Sequence
  Synthetic
gagcttggccatgtacgcgc

SEQ ID NO: 22958 - DNA, 19 bp, Artificial Sequence
  Synthetic
gtcggcgagcccacacaca

SEQ ID NO: 22959 - DNA, 19 bp, Artificial Sequence
  Synthetic
agaactgcccccgaagcca

SEQ ID NO: 22960 - DNA, 19 bp, Artificial Sequence
  Synthetic
gttcgtcctgccccactgg

SEQ ID NO: 22961 - DNA, 20 bp, Artificial Sequence
  Synthetic
gtggtccgtctcgctaacgg

SEQ ID NO: 22962 - DNA, 21 bp, Artificial Sequence
  Synthetic
ccgaaggtcctcccagatccc

SEQ ID NO: 22963 - DNA, 20 bp, Artificial Sequence
  Synthetic
gcagaaccgggccacgatct

SEQ ID NO: 22964 - DNA, 18 bp, Artificial Sequence
  Synthetic
attggcgcgcggaccaca

SEQ ID NO: 22965 - DNA, 21 bp, Artificial Sequence
  Synthetic
tgcactttgcgtgtctggtgt

SEQ ID NO: 22966 - DNA, 20 bp, Artificial Sequence
  Synthetic
cgtgtcgtcgaatgccaggc

SEQ ID NO: 22967 - DNA, 19 bp, Artificial Sequence
  Synthetic
ggtgcggtgcctgccgata

SEQ ID NO: 22968 - DNA, 21 bp, Artificial Sequence
  Synthetic
gaatgggagctcgggtccaca

SEQ ID NO: 22969 - DNA, 21 bp, Artificial Sequence
  Synthetic
atcgccttgtgtgtgtgctgg

SEQ ID NO: 22970 - DNA, 19 bp, Artificial Sequence
  Synthetic
ggcgaacacggggctgcat

SEQ ID NO: 22971 - DNA, 19 bp, Artificial Sequence
  Synthetic
cgccggatcgaggtaccgt

SEQ ID NO: 22972 - DNA, 20 bp, Artificial Sequence
  Synthetic
aggatcttgggtgctgacgc

SEQ ID NO: 22973 - DNA, 19 bp, Artificial Sequence
  Synthetic
tcagggggtgcgtcacgct

SEQ ID NO: 22974 - DNA, 19 bp, Artificial Sequence
  Synthetic
ggccacctgacacagaggc

SEQ ID NO: 22975 - DNA, 20 bp, Artificial Sequence
  Synthetic
tgtgggtgtgtaggcgatgc

SEQ ID NO: 22976 - DNA, 19 bp, Artificial Sequence
  Synthetic
aagtctgcgggggagcggt

SEQ ID NO: 22977 - DNA, 21 bp, Artificial Sequence
  Synthetic
atggtcgccgtcattatggcc

SEQ ID NO: 22978 - DNA, 21 bp, Artificial Sequence
  Synthetic
cgctctccatcctgcatcagg

SEQ ID NO: 22979 - DNA, 19 bp, Artificial Sequence
  Synthetic
caggggcgatggaagcgga

SEQ ID NO: 22980 - DNA, 20 bp, Artificial Sequence
  Synthetic
tccaggcagcgatgtttggc

SEQ ID NO: 22981 - DNA, 19 bp, Artificial Sequence
  Synthetic
gtcctgtcggacgacggtg

SEQ ID NO: 22982 - DNA, 19 bp, Artificial Sequence
  Synthetic
gccagggcgcagaagacgt

SEQ ID NO: 22983 - DNA, 19 bp, Artificial Sequence
  Synthetic
cgctcaaacgccccgagga

SEQ ID NO: 22984 - DNA, 22 bp, Artificial Sequence
  Synthetic
acagggtgttgcaatacgaccc

SEQ ID NO: 22985 - DNA, 18 bp, Artificial Sequence
  Synthetic
ggcggcgaacaaggcaca

SEQ ID NO: 22986 - DNA, 19 bp, Artificial Sequence
  Synthetic
gctacgccaccaccatgca

SEQ ID NO: 22987 - DNA, 19 bp, Artificial Sequence
  Synthetic
cttcgaccggggtctcgga

SEQ ID NO: 22988 - DNA, 19 bp, Artificial Sequence
  Synthetic
gccccgttaggcgccagaa

SEQ ID NO: 22989 - DNA, 22 bp, Artificial Sequence
  Synthetic
tgtgtctgtcctccggaagggc

SEQ ID NO: 22990 - DNA, 18 bp, Artificial Sequence
  Synthetic
cggcacgctgttgacgct

SEQ ID NO: 22991 - DNA, 19 bp, Artificial Sequence
  Synthetic
ccccgcgtcagacaaaccc

SEQ ID NO: 22992 - DNA, 21 bp, Artificial Sequence
  Synthetic
ccgggacttttggatgtcgcc

SEQ ID NO: 22993 - DNA, 22 bp, Artificial Sequence
  Synthetic
ccttcatgacggcgctggtact

SEQ ID NO: 22994 - DNA, 19 bp, Artificial Sequence
  Synthetic
gtcaaagtcgccgccctcc

SEQ ID NO: 22995 - DNA, 19 bp, Artificial Sequence
  Synthetic
cggctcagctggtgggagt

SEQ ID NO: 22996 - DNA, 18 bp, Artificial Sequence
  Synthetic
tcagcttgcgggcctcgt

SEQ ID NO: 22997 - DNA, 20 bp, Artificial Sequence
  Synthetic
tgtacctgcgggcgaagatg

SEQ ID NO: 22998 - DNA, 20 bp, Artificial Sequence
  Synthetic
tccacctcctgccacttggt

SEQ ID NO: 22999 - DNA, 19 bp, Artificial Sequence
  Synthetic
gatggccgcgtggaactgc

SEQ ID NO: 23000 - DNA, 18 bp, Artificial Sequence
  Synthetic
tgcgaaagttgcgcccct

SEQ ID NO: 23001 - DNA, 19 bp, Artificial Sequence
  Synthetic
gcagggtctcgagttcggc

SEQ ID NO: 23002 - DNA, 20 bp, Artificial Sequence
  Synthetic
ccgagcctcccaggtgcaga

SEQ ID NO: 23003 - DNA, 21 bp, Artificial Sequence
  Synthetic
gttgccgtcttgggctttgtc

SEQ ID NO: 23004 - DNA, 19 bp, Artificial Sequence
  Synthetic
cgtctacgtccgaagcggg

SEQ ID NO: 23005 - DNA, 20 bp, Artificial Sequence
  Synthetic
gattccccagagcagccccg

SEQ ID NO: 23006 - DNA, 18 bp, Artificial Sequence
  Synthetic
acatctcgcgcgcgctgt

SEQ ID NO: 23007 - DNA, 22 bp, Artificial Sequence
  Synthetic
ggtccgggtaaaacaacagccg

SEQ ID NO: 23008 - DNA, 21 bp, Artificial Sequence
  Synthetic
caggaggctgggatcgaaggc

SEQ ID NO: 23009 - DNA, 20 bp, Artificial Sequence
  Synthetic
ggatcagctgctttgtgcgc

SEQ ID NO: 23010 - DNA, 20 bp, Artificial Sequence
  Synthetic
cgtcaggacggagagccagg

SEQ ID NO: 23011 - DNA, 20 bp, Artificial Sequence
  Synthetic
gtgcggggcattgtgtctcc

SEQ ID NO: 23012 - DNA, 19 bp, Artificial Sequence
  Synthetic
gatcccccccgcgttccat

SEQ ID NO: 23013 - DNA, 19 bp, Artificial Sequence
  Synthetic
ggtaggccgcgctacacgt

SEQ ID NO: 23014 - DNA, 20 bp, Artificial Sequence
  Synthetic
gaggccctcttgcacgaacg

SEQ ID NO: 23015 - DNA, 19 bp, Artificial Sequence
  Synthetic
gggtggttccgccttgcgt

SEQ ID NO: 23016 - DNA, 18 bp, Artificial Sequence
  Synthetic
aaaagccagcgcgggtgg

SEQ ID NO: 23017 - DNA, 20 bp, Artificial Sequence
  Synthetic
tgcgtgcaggcgtttaacga

SEQ ID NO: 23018 - DNA, 21 bp, Artificial Sequence
  Synthetic
ctgcaccgagatcgtccatcc

SEQ ID NO: 23019 - DNA, 21 bp, Artificial Sequence
  Synthetic
atcaggggccgtgatatgccg

SEQ ID NO: 23020 - DNA, 20 bp, Artificial Sequence
  Synthetic
ctcctcgtccgtccggcact

SEQ ID NO: 23021 - DNA, 21 bp, Artificial Sequence
  Synthetic
ttcagtcggtatcgctggcgc

SEQ ID NO: 23022 - DNA, 19 bp, Artificial Sequence
  Synthetic
ccacgttcgagctcggggt

SEQ ID NO: 23023 - DNA, 20 bp, Artificial Sequence
  Synthetic
ggggacacgggctaccctca

SEQ ID NO: 23024 - DNA, 22 bp, Artificial Sequence
  Synthetic
tgtctggttcgaggacgaccac

SEQ ID NO: 23025 - DNA, 19 bp, Artificial Sequence
  Synthetic
ggccgtgaatcccccgtca

SEQ ID NO: 23026 - DNA, 20 bp, Artificial Sequence
  Synthetic
gtgtcccgcggggagaaagg

SEQ ID NO: 23027 - DNA, 18 bp, Artificial Sequence
  Synthetic
tggtcgccaccacgcatt

SEQ ID NO: 23028 - DNA, 18 bp, Artificial Sequence
  Synthetic
actcgttggcgcgctgaa

SEQ ID NO: 23029 - DNA, 20 bp, Artificial Sequence
  Synthetic
gcggcccgggagagaagaga

SEQ ID NO: 23030 - DNA, 20 bp, Artificial Sequence
  Synthetic
aggttcaccatgcaggcgtg

SEQ ID NO: 23031 - DNA, 19 bp, Artificial Sequence
  Synthetic
taacgatgcggggggtggc

SEQ ID NO: 23032 - DNA, 21 bp, Artificial Sequence
  Synthetic
cgcctgtgcgtgtccttgtgt

SEQ ID NO: 23033 - DNA, 19 bp, Artificial Sequence
  Synthetic
ccgtcttcggtgccagtcc

SEQ ID NO: 23034 - DNA, 20 bp, Artificial Sequence
  Synthetic
tgtttggcgtcgtgagtccc

SEQ ID NO: 23035 - DNA, 19 bp, Artificial Sequence
  Synthetic
ggacagcagcggggagtgt

SEQ ID NO: 23036 - DNA, 18 bp, Artificial Sequence
  Synthetic
cggccatgcacaccagca

SEQ ID NO: 23037 - DNA, 19 bp, Artificial Sequence
  Synthetic
acgaacggccacgacagtg

SEQ ID NO: 23038 - DNA, 21 bp, Artificial Sequence
  Synthetic
ataacgacaaacggcccctcg

SEQ ID NO: 23039 - DNA, 22 bp, Artificial Sequence
  Synthetic
tccaagccagccaagttaacgg

SEQ ID NO: 23040 - DNA, 22 bp, Artificial Sequence
  Synthetic
ccccggtgtcgttcaacaaaga

SEQ ID NO: 23041 - DNA, 22 bp, Artificial Sequence
  Synthetic
tctggacatgtcggcggaatcc

SEQ ID NO: 23042 - DNA, 19 bp, Artificial Sequence
  Synthetic
ttcttgcggaccacggccc

SEQ ID NO: 23043 - DNA, 19 bp, Artificial Sequence
  Synthetic
tcctccgcaaacaggcccg

SEQ ID NO: 23044 - DNA, 19 bp, Artificial Sequence
  Synthetic
gcaggaagctccacagggc

SEQ ID NO: 23045 - DNA, 20 bp, Artificial Sequence
  Synthetic
gtcgttcggggtgctcgttg

SEQ ID NO: 23046 - DNA, 20 bp, Artificial Sequence
  Synthetic
ccccggagacccccaaacct

SEQ ID NO: 23047 - DNA, 20 bp, Artificial Sequence
  Synthetic
ctggacgccatggacaggga

SEQ ID NO: 23048 - DNA, 21 bp, Artificial Sequence
  Synthetic
gtggtacacgagcacgagcca

SEQ ID NO: 23049 - DNA, 20 bp, Artificial Sequence
  Synthetic
ccgcagatcgcagcggtctc

SEQ ID NO: 23050 - DNA, 22 bp, Artificial Sequence
  Synthetic
tcagatcacccgcatcatccga

SEQ ID NO: 23051 - DNA, 19 bp, Artificial Sequence
  Synthetic
tcagccttaccacgcccga

SEQ ID NO: 23052 - DNA, 20 bp, Artificial Sequence
  Synthetic
acttccgggcctcagaaccc

SEQ ID NO: 23053 - DNA, 19 bp, Artificial Sequence
  Synthetic
gggacctgcggccaacaca

SEQ ID NO: 23054 - DNA, 22 bp, Artificial Sequence
  Synthetic
cgggctaaccaggaaatccgtg

SEQ ID NO: 23055 - DNA, 20 bp, Artificial Sequence
  Synthetic
cccgacggcgtagtggagga

SEQ ID NO: 23056 - DNA, 20 bp, Artificial Sequence
  Synthetic
cgccagcctgtttgtcctgg

SEQ ID NO: 23057 - DNA, 21 bp, Artificial Sequence
  Synthetic
gtataccctgtccgtgggcga

SEQ ID NO: 23058 - DNA, 22 bp, Artificial Sequence
  Synthetic
actcggaaagcgaagacgaggc

SEQ ID NO: 23059 - DNA, 22 bp, Artificial Sequence
  Synthetic
gctccgctaaaagaccgcatcg

SEQ ID NO: 23060 - DNA, 25 bp, Artificial Sequence
  Synthetic
ttcaattcagacagggaatcaacac

SEQ ID NO: 23061 - DNA, 20 bp, Artificial Sequence
  Synthetic
ggggctgtggctgtattgaa

SEQ ID NO: 23062 - DNA, 20 bp, Artificial Sequence
  Synthetic
gctggcgaaatcacatgtgt

SEQ ID NO: 23063 - DNA, 22 bp, Artificial Sequence
  Synthetic
agcggctttgaaatgatttggg

SEQ ID NO: 23064 - DNA, 22 bp, Artificial Sequence
  Synthetic
attcctatgggagtgggcctca

SEQ ID NO: 23065 - DNA, 21 bp, Artificial Sequence
  Synthetic
tccttgccacaagaacacatc

SEQ ID NO: 23066 - DNA, 22 bp, Artificial Sequence
  Synthetic
gaacgcccaccaaatattgccc

SEQ ID NO: 23067 - DNA, 24 bp, Artificial Sequence
  Synthetic
tttggaagatccagcgtctagaga

SEQ ID NO: 23068 - DNA, 22 bp, Artificial Sequence
  Synthetic
ctttcccgaccaccagttggat

SEQ ID NO: 23069 - DNA, 25 bp, Artificial Sequence
  Synthetic
gtggaccatatggccataattaaga

SEQ ID NO: 23070 - DNA, 24 bp, Artificial Sequence
  Synthetic
caagtacggtccattacccaaaag

SEQ ID NO: 23071 - DNA, 20 bp, Artificial Sequence
  Synthetic
attggagatgtgccacagca

SEQ ID NO: 23072 - DNA, 22 bp, Artificial Sequence
  Synthetic
atgaggagttcacaatggtggg

SEQ ID NO: 23073 - DNA, 22 bp, Artificial Sequence
  Synthetic
ttcagaaagatgcgaaagtgct

SEQ ID NO: 23074 - DNA, 22 bp, Artificial Sequence
  Synthetic
attcatcgtcgatgatgtggga

SEQ ID NO: 23075 - DNA, 20 bp, Artificial Sequence
  Synthetic
ggacatttgacaccacccag

SEQ ID NO: 23076 - DNA, 24 bp, Artificial Sequence
  Synthetic
aggtaaggaagacagaagatacgg

SEQ ID NO: 23077 - DNA, 25 bp, Artificial Sequence
  Synthetic
gaaagcgtctgagtttagtatggaa

SEQ ID NO: 23078 - DNA, 25 bp, Artificial Sequence
  Synthetic
tctggttctaaatttcaactggtgc

SEQ ID NO: 23079 - DNA, 24 bp, Artificial Sequence
  Synthetic
actgaaactggcattagagcattt

SEQ ID NO: 23080 - DNA, 21 bp, Artificial Sequence
  Synthetic
gtgatgaggtggatcagggga

SEQ ID NO: 23081 - DNA, 24 bp, Artificial Sequence
  Synthetic
gttagtacgcctgaagaaaatggc

SEQ ID NO: 23082 - DNA, 20 bp, Artificial Sequence
  Synthetic
ccgttacctgtagcagcagt

SEQ ID NO: 23083 - DNA, 22 bp, Artificial Sequence
  Synthetic
accgtatcccaatcggaaagcc

SEQ ID NO: 23084 - DNA, 20 bp, Artificial Sequence
  Synthetic
aaagggttcagggggtgcta

SEQ ID NO: 23085 - DNA, 25 bp, Artificial Sequence
  Synthetic
agatcctatatcagacgttacagca

SEQ ID NO: 23086 - DNA, 25 bp, Artificial Sequence
  Synthetic
ttgcagatgttatcacagtacacag

SEQ ID NO: 23087 - DNA, 23 bp, Artificial Sequence
  Synthetic
aactgcaattgtagatgcagtgg

SEQ ID NO: 23088 - DNA, 22 bp, Artificial Sequence
  Synthetic
aacgcttactacaagtaggcca

SEQ ID NO: 23089 - DNA, 22 bp, Artificial Sequence
  Synthetic
atcctctggctcaaacagatga

SEQ ID NO: 23090 - DNA, 25 bp, Artificial Sequence
  Synthetic
cttgcaatttcagaacatttcagca

SEQ ID NO: 23091 - DNA, 24 bp, Artificial Sequence
  Synthetic
atcaatttccactaggtagacggt

SEQ ID NO: 23092 - DNA, 25 bp, Artificial Sequence
  Synthetic
tttgtctgaataaattgctgatgcg

SEQ ID NO: 23093 - DNA, 25 bp, Artificial Sequence
  Synthetic
aacggtctcttagagtcaaacaagg

SEQ ID NO: 23094 - DNA, 23 bp, Artificial Sequence
  Synthetic
agtcattgtcaccagatgctact

SEQ ID NO: 23095 - DNA, 25 bp, Artificial Sequence
  Synthetic
tagtggagttgttgaagatgaagct

SEQ ID NO: 23096 - DNA, 22 bp, Artificial Sequence
  Synthetic
accaactccttcggaagtggga

SEQ ID NO: 23097 - DNA, 25 bp, Artificial Sequence
  Synthetic
ttggatatagaccattaggatccgc

SEQ ID NO: 23098 - DNA, 24 bp, Artificial Sequence
  Synthetic
aactgatgtaggtggtgttagtgg

SEQ ID NO: 23099 - DNA, 23 bp, Artificial Sequence
  Synthetic
ttaaatttcagttttccgcggga

SEQ ID NO: 23100 - DNA, 21 bp, Artificial Sequence
  Synthetic
ctgcgccaaatccagcttttg

SEQ ID NO: 23101 - DNA, 22 bp, Artificial Sequence
  Synthetic
aagtcagttttccttgggtcga

SEQ ID NO: 23102 - DNA, 22 bp, Artificial Sequence
  Synthetic
ggtcagtcatttggtcagcaga

SEQ ID NO: 23103 - DNA, 23 bp, Artificial Sequence
  Synthetic
gaattatactcatgggccaggag

SEQ ID NO: 23104 - DNA, 21 bp, Artificial Sequence
  Synthetic
ttcagtcgctctgcggagagg

SEQ ID NO: 23105 - DNA, 22 bp, Artificial Sequence
  Synthetic
aagaggactgagaagccctgga

SEQ ID NO: 23106 - DNA, 25 bp, Artificial Sequence
  Synthetic
acaggttaaaacatattgtgtgggc

SEQ ID NO: 23107 - DNA, 22 bp, Artificial Sequence
  Synthetic
tggcaactatgtccatgtgcca

SEQ ID NO: 23108 - DNA, 24 bp, Artificial Sequence
  Synthetic
cagaagatggatccaaatagggct

SEQ ID NO: 23109 - DNA, 22 bp, Artificial Sequence
  Synthetic
gtgccgagcacctagaagacag

SEQ ID NO: 23110 - DNA, 23 bp, Artificial Sequence
  Synthetic
ttaccagttgccaagatagagcc

SEQ ID NO: 23111 - DNA, 25 bp, Artificial Sequence
  Synthetic
agatgtaggggatgcctatttttcc

SEQ ID NO: 23112 - DNA, 24 bp, Artificial Sequence
  Synthetic
tctactccagatgagaagttccaa

SEQ ID NO: 23113 - DNA, 24 bp, Artificial Sequence
  Synthetic
tagaggcaacaatccaaaaaagcc

SEQ ID NO: 23114 - DNA, 23 bp, Artificial Sequence
  Synthetic
gcagagaccttctacacagatgg

SEQ ID NO: 23115 - DNA, 23 bp, Artificial Sequence
  Synthetic
attcctggaaaagatagagcccg

SEQ ID NO: 23116 - DNA, 20 bp, Artificial Sequence
  Synthetic
gcacacagacaatggcccca

SEQ ID NO: 23117 - DNA, 25 bp, Artificial Sequence
  Synthetic
tttccaggtctattacagagaaggc

SEQ ID NO: 23118 - DNA, 20 bp, Artificial Sequence
  Synthetic
ccagactgtgcagacatcct

SEQ ID NO: 23119 - DNA, 23 bp, Artificial Sequence
  Synthetic
ggcaaaggtcctggagatattgg

SEQ ID NO: 23120 - DNA, 20 bp, Artificial Sequence
  Synthetic
aggcgccagagagctcatta

SEQ ID NO: 23121 - DNA, 21 bp, Artificial Sequence
  Synthetic
atggagcctggtaggaatcag

SEQ ID NO: 23122 - DNA, 25 bp, Artificial Sequence
  Synthetic
acacctctatgtgtggcaatgaatt

SEQ ID NO: 23123 - DNA, 25 bp, Artificial Sequence
  Synthetic
gagtcatgtgataagcactattggg

SEQ ID NO: 23124 - DNA, 22 bp, Artificial Sequence
  Synthetic
agccaatcaacacaaggcctag

SEQ ID NO: 23125 - DNA, 20 bp, Artificial Sequence
  Synthetic
cctcctagggaaggggagtt

SEQ ID NO: 23126 - DNA, 24 bp, Artificial Sequence
  Synthetic
aatgactctttatcgcctgactgg

SEQ ID NO: 23127 - DNA, 21 bp, Artificial Sequence
  Synthetic
agacttaaggcggcccaactg

SEQ ID NO: 23128 - DNA, 25 bp, Artificial Sequence
  Synthetic
acctaataggagttcctgttacacc

SEQ ID NO: 23129 - DNA, 22 bp, Artificial Sequence
  Synthetic
gtttgggcacaagtcaggattg

SEQ ID NO: 23130 - DNA, 21 bp, Artificial Sequence
  Synthetic
cagtacttggccggtactggg

SEQ ID NO: 23131 - DNA, 23 bp, Artificial Sequence
  Synthetic
aacatcgtcaaactcacctcatg

SEQ ID NO: 23132 - DNA, 25 bp, Artificial Sequence
  Synthetic
acatctggatgctttcctataatgc

SEQ ID NO: 23133 - DNA, 24 bp, Artificial Sequence
  Synthetic
accatacatttgttcagaagggga

SEQ ID NO: 23134 - DNA, 25 bp, Artificial Sequence
  Synthetic
aggaacaattgtttatcaaagaggc

SEQ ID NO: 23135 - DNA, 23 bp, Artificial Sequence
  Synthetic
aagaggtttcttcggagctattg

SEQ ID NO: 23136 - DNA, 24 bp, Artificial Sequence
  Synthetic
taagctcacaaatagagcttgcag

SEQ ID NO: 23137 - DNA, 25 bp, Artificial Sequence
  Synthetic
tgctgcatctttaaatgatgatggc

SEQ ID NO: 23138 - DNA, 20 bp, Artificial Sequence
  Synthetic
aaggaggtcgcactcagcta

SEQ ID NO: 23139 - DNA, 20 bp, Artificial Sequence
  Synthetic
cggaagccatggaggttgct

SEQ ID NO: 23140 - DNA, 25 bp, Artificial Sequence
  Synthetic
tcttgatcgtcttttcttcaaatgc

SEQ ID NO: 23141 - DNA, 24 bp, Artificial Sequence
  Synthetic
aggccattttcatcatgggagatc

SEQ ID NO: 23142 - DNA, 25 bp, Artificial Sequence
  Synthetic
actgaggaatgtgatttagccttac

SEQ ID NO: 23143 - DNA, 20 bp, Artificial Sequence
  Synthetic
agaggaagcagatggagagc

SEQ ID NO: 23144 - DNA, 24 bp, Artificial Sequence
  Synthetic
accttttatgaggaggttacagga

SEQ ID NO: 23145 - DNA, 25 bp, Artificial Sequence
  Synthetic
aaaattgaaggagatacatgggcag

SEQ ID NO: 23146 - DNA, 24 bp, Artificial Sequence
  Synthetic
ggcagggccatctgttatagattt

SEQ ID NO: 23147 - DNA, 23 bp, Artificial Sequence
  Synthetic
tcttcaactacacatcctgaccc

SEQ ID NO: 23148 - DNA, 23 bp, Artificial Sequence
  Synthetic
ctgtttgaacaggttcctacacg

SEQ ID NO: 23149 - DNA, 25 bp, Artificial Sequence
  Synthetic
ctcgtgcatctataactaccagaag

SEQ ID NO: 23150 - DNA, 23 bp, Artificial Sequence
  Synthetic
ttttgcagatgactgtctggatg

SEQ ID NO: 23151 - DNA, 24 bp, Artificial Sequence
  Synthetic
agagacagagaacgcttagtatgg

SEQ ID NO: 23152 - DNA, 22 bp, Artificial Sequence
  Synthetic
tcctccatggggtgaatattgg

SEQ ID NO: 23153 - DNA, 20 bp, Artificial Sequence
  Synthetic
ttttgggcgtaaggagcagc

SEQ ID NO: 23154 - DNA, 22 bp, Artificial Sequence
  Synthetic
tttagcatttgtacccccacca

SEQ ID NO: 23155 - DNA, 25 bp, Artificial Sequence
  Synthetic
aagcgcaaaaggtctaagtaatttc

SEQ ID NO: 23156 - DNA, 25 bp, Artificial Sequence
  Synthetic
ttaacggcgaaatatgaatcagaga

SEQ ID NO: 23157 - DNA, 24 bp, Artificial Sequence
  Synthetic
ccttaccaggttgacactatttgt

SEQ ID NO: 23158 - DNA, 25 bp, Artificial Sequence
  Synthetic
agactttatcagatgaaactgtggc

SEQ ID NO: 23159 - DNA, 20 bp, Artificial Sequence
  Synthetic
aagtcaaatggtgcagtggg

SEQ ID NO: 23160 - DNA, 23 bp, Artificial Sequence
  Synthetic
aattgggacccaccgatttatcc

SEQ ID NO: 23161 - DNA, 20 bp, Artificial Sequence
  Synthetic
acaaccgcagacgacaagcc

SEQ ID NO: 23162 - DNA, 22 bp, Artificial Sequence
  Synthetic
aagttgaaggaacaacatgggc

SEQ ID NO: 23163 - DNA, 25 bp, Artificial Sequence
  Synthetic
agaagaaggaattccagatgttggg

SEQ ID NO: 23164 - DNA, 21 bp, Artificial Sequence
  Synthetic
actcgttctgctgaccttttc

SEQ ID NO: 23165 - DNA, 24 bp, Artificial Sequence
  Synthetic
agtgataaataacaccggcctacc

SEQ ID NO: 23166 - DNA, 25 bp, Artificial Sequence
  Synthetic
tcctgaaagagaacgtttagtttgg

SEQ ID NO: 23167 - DNA, 25 bp, Artificial Sequence
  Synthetic
atgccagacatttcttttgtaagga

SEQ ID NO: 23168 - DNA, 24 bp, Artificial Sequence
  Synthetic
tcctcctcaaggattggaggatac

SEQ ID NO: 23169 - DNA, 20 bp, Artificial Sequence
  Synthetic
aacaaccggttctggtcgtt

SEQ ID NO: 23170 - DNA, 24 bp, Artificial Sequence
  Synthetic
agaagaatcccgctcttagaatga

SEQ ID NO: 23171 - DNA, 25 bp, Artificial Sequence
  Synthetic
agtacagtccattatccaaaggtgt

SEQ ID NO: 23172 - DNA, 24 bp, Artificial Sequence
  Synthetic
aatattgctcctttaatggtggca

SEQ ID NO: 23173 - DNA, 22 bp, Artificial Sequence
  Synthetic
agagcaacagtatcagcagacc

SEQ ID NO: 23174 - DNA, 23 bp, Artificial Sequence
  Synthetic
gaagagcaacagccattctaaga

SEQ ID NO: 23175 - DNA, 23 bp, Artificial Sequence
  Synthetic
tgagacactttcaaaaggatgca

SEQ ID NO: 23176 - DNA, 23 bp, Artificial Sequence
  Synthetic
cagggaatggaaaagttgacgat

SEQ ID NO: 23177 - DNA, 25 bp, Artificial Sequence
  Synthetic
acgttcgacactgttcaaataatca

SEQ ID NO: 23178 - DNA, 23 bp, Artificial Sequence
  Synthetic
agagtctgcagtattgagaggat

SEQ ID NO: 23179 - DNA, 25 bp, Artificial Sequence
  Synthetic
aacacattaactgaaagaggagtgg

SEQ ID NO: 23180 - DNA, 25 bp, Artificial Sequence
  Synthetic
tgaggcaaattctcagagaatcagg

SEQ ID NO: 23181 - DNA, 25 bp, Artificial Sequence
  Synthetic
atcaacaatcttttgtaccgagtcc

SEQ ID NO: 23182 - DNA, 25 bp, Artificial Sequence
  Synthetic
cttgccatttcagaacatagatagc

SEQ ID NO: 23183 - DNA, 20 bp, Artificial Sequence
  Synthetic
caccagaatgcacagggaga

SEQ ID NO: 23184 - DNA, 24 bp, Artificial Sequence
  Synthetic
aactgtacgaacgagtgaaaagac

SEQ ID NO: 23185 - DNA, 20 bp, Artificial Sequence
  Synthetic
acttctgcctcatcacagcc

SEQ ID NO: 23186 - DNA, 24 bp, Artificial Sequence
  Synthetic
tatcgccaagtgagaaagatcatc

SEQ ID NO: 23187 - DNA, 22 bp, Artificial Sequence
  Synthetic
gtgtggttgtacacagtgtgga

SEQ ID NO: 23188 - DNA, 23 bp, Artificial Sequence
  Synthetic
agggtggtggaattgcttaagtg

SEQ ID NO: 23189 - DNA, 23 bp, Artificial Sequence
  Synthetic
accacagtgtctaaaggaatgtg

SEQ ID NO: 23190 - DNA, 22 bp, Artificial Sequence
  Synthetic
acacagatagtaatgcagctgc

SEQ ID NO: 23191 - DNA, 21 bp, Artificial Sequence
  Synthetic
aacatgtgcagcactggaagt

SEQ ID NO: 23192 - DNA, 23 bp, Artificial Sequence
  Synthetic
actgtggaggttgtattcgatgg

SEQ ID NO: 23193 - DNA, 20 bp, Artificial Sequence
  Synthetic
ccccgccgcgaaaacgatac

SEQ ID NO: 23194 - DNA, 23 bp, Artificial Sequence
  Synthetic
tgtgttgtgtgtgtggattagtt

SEQ ID NO: 23195 - DNA, 25 bp, Artificial Sequence
  Synthetic
ttaaactactgcagacatacgtgtg

SEQ ID NO: 23196 - DNA, 23 bp, Artificial Sequence
  Synthetic
ggacatttctcctcccaccaata

SEQ ID NO: 23197 - DNA, 25 bp, Artificial Sequence
  Synthetic
aggctatagaattgcaacctttagg

SEQ ID NO: 23198 - DNA, 21 bp, Artificial Sequence
  Synthetic
ctcctgtttccaaggtggtca

SEQ ID NO: 23199 - DNA, 23 bp, Artificial Sequence
  Synthetic
tatggcagatgtagggtttggag

SEQ ID NO: 23200 - DNA, 23 bp, Artificial Sequence
  Synthetic
attggaatgttggtgtagctcca

SEQ ID NO: 23201 - DNA, 25 bp, Artificial Sequence
  Synthetic
tgtactgccaaatggtattgctaag

SEQ ID NO: 23202 - DNA, 22 bp, Artificial Sequence
  Synthetic
aaatggttcaatgggcgtatga

SEQ ID NO: 23203 - DNA, 24 bp, Artificial Sequence
  Synthetic
aaatgttgtagggaatgtgatggt

SEQ ID NO: 23204 - DNA, 22 bp, Artificial Sequence
  Synthetic
gattcctcaagaagcggcagga

SEQ ID NO: 23205 - DNA, 24 bp, Artificial Sequence
  Synthetic
caagagttgagcgacttaaagcag

SEQ ID NO: 23206 - DNA, 21 bp, Artificial Sequence
  Synthetic
tgtaggtgagcatcccaatgt

SEQ ID NO: 23207 - DNA, 25 bp, Artificial Sequence
  Synthetic
tggggacagattgtttttttatggt

SEQ ID NO: 23208 - DNA, 23 bp, Artificial Sequence
  Synthetic
tcgttagttagcagcgaatctca

SEQ ID NO: 23209 - DNA, 22 bp, Artificial Sequence
  Synthetic
attaatgcaatggactctcgca

SEQ ID NO: 23210 - DNA, 23 bp, Artificial Sequence
  Synthetic
aagcgaccacggaatatctatga

SEQ ID NO: 23211 - DNA, 25 bp, Artificial Sequence
  Synthetic
ttaccctcctattatttgcccacaa

SEQ ID NO: 23212 - DNA, 20 bp, Artificial Sequence
  Synthetic
aagctggcaagaacaacacc

SEQ ID NO: 23213 - DNA, 22 bp, Artificial Sequence
  Synthetic
atggctggatcaagtgagcagg

SEQ ID NO: 23214 - DNA, 24 bp, Artificial Sequence
  Synthetic
tcttcaaatgcatttatcgtcgct

SEQ ID NO: 23215 - DNA, 25 bp, Artificial Sequence
  Synthetic
acctaacaacaaatggaagtaatgc

SEQ ID NO: 23216 - DNA, 25 bp, Artificial Sequence
  Synthetic
aagctatcactagtatctcagggtt

SEQ ID NO: 23217 - DNA, 23 bp, Artificial Sequence
  Synthetic
atatgttccagctaggacaagca

SEQ ID NO: 23218 - DNA, 23 bp, Artificial Sequence
  Synthetic
atcaactaatatctcctcggccc

SEQ ID NO: 23219 - DNA, 22 bp, Artificial Sequence
  Synthetic
gaggaatctccagaagcatcac

SEQ ID NO: 23220 - DNA, 24 bp, Artificial Sequence
  Synthetic
aatcctcatcatggaatctcacca

SEQ ID NO: 23221 - DNA, 25 bp, Artificial Sequence
  Synthetic
atacactagagaacgatgtgcaagt

SEQ ID NO: 23222 - DNA, 23 bp, Artificial Sequence
  Synthetic
gaacagagaaaagcagtacccca

SEQ ID NO: 23223 - DNA, 21 bp, Artificial Sequence
  Synthetic
acaaagttgctcttgctcctc

SEQ ID NO: 23224 - DNA, 24 bp, Artificial Sequence
  Synthetic
aatctctacttcaatctggacgca

SEQ ID NO: 23225 - DNA, 25 bp, Artificial Sequence
  Synthetic
tgtgatagtaaccaatcaggaatcc

SEQ ID NO: 23226 - DNA, 25 bp, Artificial Sequence
  Synthetic
agaatggtatattcctcttcccagc

SEQ ID NO: 23227 - DNA, 25 bp, Artificial Sequence
  Synthetic
agtacaataggtatcaacggaatgc

SEQ ID NO: 23228 - DNA, 22 bp, Artificial Sequence
  Synthetic
aagcataccaatcacggaaagg

SEQ ID NO: 23229 - DNA, 25 bp, Artificial Sequence
  Synthetic
acccaaaaataaggttaatgccagg

SEQ ID NO: 23230 - DNA, 25 bp, Artificial Sequence
  Synthetic
atgagaatgtaatctgcaacacaac

SEQ ID NO: 23231 - DNA, 24 bp, Artificial Sequence
  Synthetic
acttactcaacagcaactgaaaga

SEQ ID NO: 23232 - DNA, 25 bp, Artificial Sequence
  Synthetic
aaacgctgttgattattaccagagc

SEQ ID NO: 23233 - DNA, 25 bp, Artificial Sequence
  Synthetic
tagacgaaacaagatcagcatcttc

SEQ ID NO: 23234 - DNA, 23 bp, Artificial Sequence
  Synthetic
cagtgttgggggattcaattaca

SEQ ID NO: 23235 - DNA, 23 bp, Artificial Sequence
  Synthetic
aagtggacttgaaacacctgacc

SEQ ID NO: 23236 - DNA, 25 bp, Artificial Sequence
  Synthetic
gtctcaaaattttaacaccggtagc

SEQ ID NO: 23237 - DNA, 22 bp, Artificial Sequence
  Synthetic
atttgggttgcaacagtttgga

SEQ ID NO: 23238 - DNA, 21 bp, Artificial Sequence
  Synthetic
tagggcatgccgatttgtttc

SEQ ID NO: 23239 - DNA, 25 bp, Artificial Sequence
  Synthetic
cgtaagcccttagattacaaacgtc

SEQ ID NO: 23240 - DNA, 21 bp, Artificial Sequence
  Synthetic
ccaagtcttggtctgttggtg

SEQ ID NO: 23241 - DNA, 25 bp, Artificial Sequence
  Synthetic
ggatacattctgcttcaatgtacgc

SEQ ID NO: 23242 - DNA, 24 bp, Artificial Sequence
  Synthetic
tgaaacttgtactattgccggtaa

SEQ ID NO: 23243 - DNA, 25 bp, Artificial Sequence
  Synthetic
acttacaatcgccaacaattattcc

SEQ ID NO: 23244 - DNA, 25 bp, Artificial Sequence
  Synthetic
tgattacagggcttttatcagtgtt

SEQ ID NO: 23245 - DNA, 25 bp, Artificial Sequence
  Synthetic
ggtttctactgttaaaattggtggc

SEQ ID NO: 23246 - DNA, 23 bp, Artificial Sequence
  Synthetic
agatgcagagtttgtagaaccag

SEQ ID NO: 23247 - DNA, 25 bp, Artificial Sequence
  Synthetic
ttcaatcagcactttctgttgtttc

SEQ ID NO: 23248 - DNA, 25 bp, Artificial Sequence
  Synthetic
tatgcagttttttaaaatgggccga

SEQ ID NO: 23249 - DNA, 22 bp, Artificial Sequence
  Synthetic
aggcgtttccttatggtacttg

SEQ ID NO: 23250 - DNA, 24 bp, Artificial Sequence
  Synthetic
cttcctcgttcatgacaatgtagc

SEQ ID NO: 23251 - DNA, 25 bp, Artificial Sequence
  Synthetic
aaccagtgtccgtaattaaagttgc

SEQ ID NO: 23252 - DNA, 23 bp, Artificial Sequence
  Synthetic
ataccagctgactacatcttgcc

SEQ ID NO: 23253 - DNA, 24 bp, Artificial Sequence
  Synthetic
agatgctgttacttttgcaacagt

SEQ ID NO: 23254 - DNA, 25 bp, Artificial Sequence
  Synthetic
gctattatagtcagtgtcgaacagc

SEQ ID NO: 23255 - DNA, 25 bp, Artificial Sequence
  Synthetic
gttcttaaatctaagtggtggctgc

SEQ ID NO: 23256 - DNA, 21 bp, Artificial Sequence
  Synthetic
tttggatgttgtgtggaagca

SEQ ID NO: 23257 - DNA, 24 bp, Artificial Sequence
  Synthetic
acacaattgtcaatggtgtgcaac

SEQ ID NO: 23258 - DNA, 24 bp, Artificial Sequence
  Synthetic
aacaactttgtcagttcgtatgct

SEQ ID NO: 23259 - DNA, 20 bp, Artificial Sequence
  Synthetic
ctggtgatgctggccattca

SEQ ID NO: 23260 - DNA, 25 bp, Artificial Sequence
  Synthetic
ttttacactacaagctgcttttggt

SEQ ID NO: 23261 - DNA, 22 bp, Artificial Sequence
  Synthetic
gtgttgaatccaatgcaggtgt

SEQ ID NO: 23262 - DNA, 21 bp, Artificial Sequence
  Synthetic
ttttgctccatggtggttgtg

SEQ ID NO: 23263 - DNA, 20 bp, Artificial Sequence
  Synthetic
tttgcgcaaaatggcacaac

SEQ ID NO: 23264 - DNA, 25 bp, Artificial Sequence
  Synthetic
ctggtgaaggttttaacatcttagc

SEQ ID NO: 23265 - DNA, 25 bp, Artificial Sequence
  Synthetic
ttatgctgctatattgaatggttgc

SEQ ID NO: 23266 - DNA, 23 bp, Artificial Sequence
  Synthetic
taaccctggttttcttactccgt

SEQ ID NO: 23267 - DNA, 25 bp, Artificial Sequence
  Synthetic
gcacttatttgttctcactcattgc

SEQ ID NO: 23268 - DNA, 25 bp, Artificial Sequence
  Synthetic
tatggttgctaatggtttgaatgca

SEQ ID NO: 23269 - DNA, 21 bp, Artificial Sequence
  Synthetic
aacttgtgtgacgaccctgaa

SEQ ID NO: 23270 - DNA, 23 bp, Artificial Sequence
  Synthetic
tgctgcagctatgtacaaagaag

SEQ ID NO: 23271 - DNA, 25 bp, Artificial Sequence
  Synthetic
agatgttacaaaggaaaaccaggaa

SEQ ID NO: 23272 - DNA, 24 bp, Artificial Sequence
  Synthetic
tacagttgaattggaaccaccttg

SEQ ID NO: 23273 - DNA, 22 bp, Artificial Sequence
  Synthetic
gactaatggttctggtagcggt

SEQ ID NO: 23274 - DNA, 20 bp, Artificial Sequence
  Synthetic
ctagtgccgctcgactagag

SEQ ID NO: 23275 - DNA, 25 bp, Artificial Sequence
  Synthetic
ggagatattggttcttactggttgt

SEQ ID NO: 23276 - DNA, 23 bp, Artificial Sequence
  Synthetic
tgatgcctgttatgggtatgact

SEQ ID NO: 23277 - DNA, 21 bp, Artificial Sequence
  Synthetic
agttgctactgctggttacca

SEQ ID NO: 23278 - DNA, 25 bp, Artificial Sequence
  Synthetic
tttcgatgagggttcagaattaaca

SEQ ID NO: 23279 - DNA, 25 bp, Artificial Sequence
  Synthetic
tgtctgaaatccatagtagctacca

SEQ ID NO: 23280 - DNA, 25 bp, Artificial Sequence
  Synthetic
agccactttgtattatcagaatggt

SEQ ID NO: 23281 - DNA, 25 bp, Artificial Sequence
  Synthetic
ttgtctaagcatcctaaacctgagt

SEQ ID NO: 23282 - DNA, 23 bp, Artificial Sequence
  Synthetic
tttgggttccatggacattgatg

SEQ ID NO: 23283 - DNA, 25 bp, Artificial Sequence
  Synthetic
atacggttacttacaaatccactgc

SEQ ID NO: 23284 - DNA, 20 bp, Artificial Sequence
  Synthetic
cgctctgtgcaaaagctgtc

SEQ ID NO: 23285 - DNA, 21 bp, Artificial Sequence
  Synthetic
gcttccagctcctagagttct

SEQ ID NO: 23286 - DNA, 25 bp, Artificial Sequence
  Synthetic
tttaggcttacaaactcagacagtg

SEQ ID NO: 23287 - DNA, 21 bp, Artificial Sequence
  Synthetic
aagactagtggtgacttggct

SEQ ID NO: 23288 - DNA, 25 bp, Artificial Sequence
  Synthetic
tgtacctctacaagttggtttttcc

SEQ ID NO: 23289 - DNA, 23 bp, Artificial Sequence
  Synthetic
acattgccaatgtggtactgttg

SEQ ID NO: 23290 - DNA, 20 bp, Artificial Sequence
  Synthetic
gtcgcactgtgcagagtcat

SEQ ID NO: 23291 - DNA, 21 bp, Artificial Sequence
  Synthetic
tcatgcatttcacactcctgc

SEQ ID NO: 23292 - DNA, 25 bp, Artificial Sequence
  Synthetic
agagaacattgcttttaacgttgtt

SEQ ID NO: 23293 - DNA, 25 bp, Artificial Sequence
  Synthetic
ctgtttgtggttatacagactttgc

SEQ ID NO: 23294 - DNA, 20 bp, Artificial Sequence
  Synthetic
acaagactttttgcctcgca

SEQ ID NO: 23295 - DNA, 25 bp, Artificial Sequence
  Synthetic
ccaaggttcatgaggtcataattga

SEQ ID NO: 23296 - DNA, 22 bp, Artificial Sequence
  Synthetic
tggctctgattatggtgttgca

SEQ ID NO: 23297 - DNA, 25 bp, Artificial Sequence
  Synthetic
aactccactgttatgagtttgtcct

SEQ ID NO: 23298 - DNA, 25 bp, Artificial Sequence
  Synthetic
aaatgtatttgctgttgagagtggt

SEQ ID NO: 23299 - DNA, 20 bp, Artificial Sequence
  Synthetic
ctgcttttgtgggtgcacta

SEQ ID NO: 23300 - DNA, 24 bp, Artificial Sequence
  Synthetic
acgtttattgtgttgtacgttgac

SEQ ID NO: 23301 - DNA, 23 bp, Artificial Sequence
  Synthetic
ggcaccatctactctatcactcc

SEQ ID NO: 23302 - DNA, 23 bp, Artificial Sequence
  Synthetic
agtgtttcagctatcgtcacagc

SEQ ID NO: 23303 - DNA, 20 bp, Artificial Sequence
  Synthetic
agcgtcatacctagcttgcc

SEQ ID NO: 23304 - DNA, 22 bp, Artificial Sequence
  Synthetic
atgttgcattgcagactgatgt

SEQ ID NO: 23305 - DNA, 25 bp, Artificial Sequence
  Synthetic
ctgctttgaatgtattcgtttctca

SEQ ID NO: 23306 - DNA, 25 bp, Artificial Sequence
  Synthetic
tcacatctcgcataatgtttgaacc

SEQ ID NO: 23307 - DNA, 25 bp, Artificial Sequence
  Synthetic
acactgttcaaaaattgcaaactct

SEQ ID NO: 23308 - DNA, 25 bp, Artificial Sequence
  Synthetic
tacagtaatggctctaggtttgttc

SEQ ID NO: 23309 - DNA, 22 bp, Artificial Sequence
  Synthetic
ttttccatacagcttggcactg

SEQ ID NO: 23310 - DNA, 25 bp, Artificial Sequence
  Synthetic
aagctttgtttcacttgccatatgt

SEQ ID NO: 23311 - DNA, 23 bp, Artificial Sequence
  Synthetic
aattgggattctaattgggcctt

SEQ ID NO: 23312 - DNA, 25 bp, Artificial Sequence
  Synthetic
acgagtaaaacacggtgatttttct

SEQ ID NO: 23313 - DNA, 20 bp, Artificial Sequence
  Synthetic
gaaagggcaaacgggtggat

SEQ ID NO: 23314 - DNA, 23 bp, Artificial Sequence
  Synthetic
tttgacaagcctcaggaaaaaga

SEQ ID NO: 23315 - DNA, 21 bp, Artificial Sequence
  Synthetic
ccagagaccttgaccacaact

SEQ ID NO: 23316 - DNA, 21 bp, Artificial Sequence
  Synthetic
aacttcacctgcaactgctga

SEQ ID NO: 23317 - DNA, 22 bp, Artificial Sequence
  Synthetic
actgaacctaggtgaacgctag

SEQ ID NO: 23318 - DNA, 25 bp, Artificial Sequence
  Synthetic
cttttagtatttggcttccgtcctt

SEQ ID NO: 23319 - DNA, 20 bp, Artificial Sequence
  Synthetic
ggaaatccccatgcactgtt

SEQ ID NO: 23320 - DNA, 21 bp, Artificial Sequence
  Synthetic
aatggggaacaggagcagcag

SEQ ID NO: 23321 - DNA, 25 bp, Artificial Sequence
  Synthetic
agaagcaaactatgttaaaccacca

SEQ ID NO: 23322 - DNA, 25 bp, Artificial Sequence
  Synthetic
aggacaatggataaaaaagtgtggg

SEQ ID NO: 23323 - DNA, 25 bp, Artificial Sequence
  Synthetic
agtgctatatgacaacgaggaaaat

SEQ ID NO: 23324 - DNA, 21 bp, Artificial Sequence
  Synthetic
cactatccgtcgagacttgca

SEQ ID NO: 23325 - DNA, 22 bp, Artificial Sequence
  Synthetic
aaatggattgccagtgtggtgt

SEQ ID NO: 23326 - DNA, 22 bp, Artificial Sequence
  Synthetic
gcttccattgttcccctggagg

SEQ ID NO: 23327 - DNA, 22 bp, Artificial Sequence
  Synthetic
cagccgcagaggttattattgg

SEQ ID NO: 23328 - DNA, 22 bp, Artificial Sequence
  Synthetic
cgcctttgaggaggaggtaacc

SEQ ID NO: 23329 - DNA, 21 bp, Artificial Sequence
  Synthetic
atctcctgccttggaaactgt

SEQ ID NO: 23330 - DNA, 25 bp, Artificial Sequence
  Synthetic
tccggtaaattatatttgccaccct

SEQ ID NO: 23331 - DNA, 22 bp, Artificial Sequence
  Synthetic
aatcctgagtctgaacgtttgg

SEQ ID NO: 23332 - DNA, 25 bp, Artificial Sequence
  Synthetic
tggtgacaagattccagaacaaaat

SEQ ID NO: 23333 - DNA, 22 bp, Artificial Sequence
  Synthetic
ccatctattggggatgcgtaca

SEQ ID NO: 23334 - DNA, 21 bp, Artificial Sequence
  Synthetic
ggcagtttggcttcgaggtgc

SEQ ID NO: 23335 - DNA, 19 bp, Artificial Sequence
  Synthetic
tcctgtcacaccccaccgt

SEQ ID NO: 23336 - DNA, 21 bp, Artificial Sequence
  Synthetic
agcatgtgccccaatcttgga

SEQ ID NO: 23337 - DNA, 21 bp, Artificial Sequence
  Synthetic
tccgactacctcccggagatg

SEQ ID NO: 23338 - DNA, 19 bp, Artificial Sequence
  Synthetic
ccagagacggtgttgcgcc

SEQ ID NO: 23339 - DNA, 18 bp, Artificial Sequence
  Synthetic
tgggtgcaaggctcgtgc

SEQ ID NO: 23340 - DNA, 20 bp, Artificial Sequence
  Synthetic
acacccagttatgcagtgcc

SEQ ID NO: 23341 - DNA, 21 bp, Artificial Sequence
  Synthetic
gtaggtgcctccagagcccct

SEQ ID NO: 23342 - DNA, 19 bp, Artificial Sequence
  Synthetic
ccggtatcgggccagaggt

SEQ ID NO: 23343 - DNA, 21 bp, Artificial Sequence
  Synthetic
tccgtagaagggtcctcgtcc

SEQ ID NO: 23344 - DNA, 19 bp, Artificial Sequence
  Synthetic
tgggccctcaagtccagcc

SEQ ID NO: 23345 - DNA, 20 bp, Artificial Sequence
  Synthetic
gggccaagaacccagacgag

SEQ ID NO: 23346 - DNA, 22 bp, Artificial Sequence
  Synthetic
aagccagacagcagccaattgt

SEQ ID NO: 23347 - DNA, 19 bp, Artificial Sequence
  Synthetic
accggtcgcccagtcctac

SEQ ID NO: 23348 - DNA, 20 bp, Artificial Sequence
  Synthetic
cccgtcttactgcccagcct

SEQ ID NO: 23349 - DNA, 21 bp, Artificial Sequence
  Synthetic
cgagttacgctccttggaggg

SEQ ID NO: 23350 - DNA, 19 bp, Artificial Sequence
  Synthetic
tgaccctcgcgccccatct

SEQ ID NO: 23351 - DNA, 22 bp, Artificial Sequence
  Synthetic
cacaaagctgtgtgacggtccc

SEQ ID NO: 23352 - DNA, 19 bp, Artificial Sequence
  Synthetic
cggaagccctcgtttcggc

SEQ ID NO: 23353 - DNA, 20 bp, Artificial Sequence
  Synthetic
gtggattcgggggaagctgg

SEQ ID NO: 23354 - DNA, 18 bp, Artificial Sequence
  Synthetic
tcttgagctggcgcgggt

SEQ ID NO: 23355 - DNA, 20 bp, Artificial Sequence
  Synthetic
gccagagccaacctcagctc

SEQ ID NO: 23356 - DNA, 19 bp, Artificial Sequence
  Synthetic
gcaccaccatcgtccacga

SEQ ID NO: 23357 - DNA, 20 bp, Artificial Sequence
  Synthetic
gaccggacggccacgttgtg

SEQ ID NO: 23358 - DNA, 21 bp, Artificial Sequence
  Synthetic
cgtcgtccaggaccaagggga

SEQ ID NO: 23359 - DNA, 20 bp, Artificial Sequence
  Synthetic
ccgaagggaggtgatgggga

SEQ ID NO: 23360 - DNA, 22 bp, Artificial Sequence
  Synthetic
gagggggaatcgtcggttaggg

SEQ ID NO: 23361 - DNA, 22 bp, Artificial Sequence
  Synthetic
aacgctcttttccttcaccgct

SEQ ID NO: 23362 - DNA, 19 bp, Artificial Sequence
  Synthetic
gtggccaggcccaacgact

SEQ ID NO: 23363 - DNA, 22 bp, Artificial Sequence
  Synthetic
agaaggggctgtggacataggc

SEQ ID NO: 23364 - DNA, 19 bp, Artificial Sequence
  Synthetic
gacacgccctggtcggact

SEQ ID NO: 23365 - DNA, 19 bp, Artificial Sequence
  Synthetic
ccggcagccccttcatcct

SEQ ID NO: 23366 - DNA, 19 bp, Artificial Sequence
  Synthetic
cgctgcctggtgaatgcgc

SEQ ID NO: 23367 - DNA, 19 bp, Artificial Sequence
  Synthetic
gctcggtagcagcggactc

SEQ ID NO: 23368 - DNA, 21 bp, Artificial Sequence
  Synthetic
cctgccattcccagccactcc

SEQ ID NO: 23369 - DNA, 20 bp, Artificial Sequence
  Synthetic
gagggccagatgcaggagct

SEQ ID NO: 23370 - DNA, 19 bp, Artificial Sequence
  Synthetic
ttcagctgctggacacgca

SEQ ID NO: 23371 - DNA, 19 bp, Artificial Sequence
  Synthetic
ggcgaggcgttgtggcaca

SEQ ID NO: 23372 - DNA, 22 bp, Artificial Sequence
  Synthetic
gccaggtggattttgagctccg

SEQ ID NO: 23373 - DNA, 22 bp, Artificial Sequence
  Synthetic
ggcatagaggcctaggtccaca

SEQ ID NO: 23374 - DNA, 22 bp, Artificial Sequence
  Synthetic
agcccaggaccagttctactcc

SEQ ID NO: 23375 - DNA, 24 bp, Artificial Sequence
  Synthetic
agatggggatatttaaaaggggca

SEQ ID NO: 23376 - DNA, 19 bp, Artificial Sequence
  Synthetic
acctacgcccttgccccct

SEQ ID NO: 23377 - DNA, 21 bp, Artificial Sequence
  Synthetic
ctcccagtcagatgtccgtgc

SEQ ID NO: 23378 - DNA, 19 bp, Artificial Sequence
  Synthetic
gccaggatgccaccgaggt

SEQ ID NO: 23379 - DNA, 20 bp, Artificial Sequence
  Synthetic
acccggtccttgtgactgct

SEQ ID NO: 23380 - DNA, 22 bp, Artificial Sequence
  Synthetic
atgacccaacgaaacagtcccg

SEQ ID NO: 23381 - DNA, 19 bp, Artificial Sequence
  Synthetic
catggtcgggctcgggaga

SEQ ID NO: 23382 - DNA, 24 bp, Artificial Sequence
  Synthetic
ggggcattaactaagcttatgagc

SEQ ID NO: 23383 - DNA, 22 bp, Artificial Sequence
  Synthetic
ccagtttgccccatcgtttccc

SEQ ID NO: 23384 - DNA, 20 bp, Artificial Sequence
  Synthetic
cgaggatgaagcaacccccg

SEQ ID NO: 23385 - DNA, 20 bp, Artificial Sequence
  Synthetic
gctccgccacgtattccccg

SEQ ID NO: 23386 - DNA, 22 bp, Artificial Sequence
  Synthetic
tctctcaggacctcaaaggcgg

SEQ ID NO: 23387 - DNA, 20 bp, Artificial Sequence
  Synthetic
atgtggcggctcttgaaccc

SEQ ID NO: 23388 - DNA, 19 bp, Artificial Sequence
  Synthetic
cccggccatctttgccgga

SEQ ID NO: 23389 - DNA, 20 bp, Artificial Sequence
  Synthetic
ggggacacggagcctgacca

SEQ ID NO: 23390 - DNA, 22 bp, Artificial Sequence
  Synthetic
gatctcgtcccagttttgcggc

SEQ ID NO: 23391 - DNA, 19 bp, Artificial Sequence
  Synthetic
gcccccggccatactccaa

SEQ ID NO: 23392 - DNA, 19 bp, Artificial Sequence
  Synthetic
gcccatcatcccccgagca

SEQ ID NO: 23393 - DNA, 22 bp, Artificial Sequence
  Synthetic
catcgcaatcatgaagtcctcc

SEQ ID NO: 23394 - DNA, 20 bp, Artificial Sequence
  Synthetic
ggaccacgggtgtcaccagc

SEQ ID NO: 23395 - DNA, 22 bp, Artificial Sequence
  Synthetic
aatcccatgtcagggttggggt

SEQ ID NO: 23396 - DNA, 18 bp, Artificial Sequence
  Synthetic
cccgtgccgcagcgtaaa

SEQ ID NO: 23397 - DNA, 22 bp, Artificial Sequence
  Synthetic
gtgacgatgccatcaaccagct

SEQ ID NO: 23398 - DNA, 19 bp, Artificial Sequence
  Synthetic
aaacaccccccccactggc

SEQ ID NO: 23399 - DNA, 21 bp, Artificial Sequence
  Synthetic
ggggcacctaaagacccccct

SEQ ID NO: 23400 - DNA, 22 bp, Artificial Sequence
  Synthetic
tgtcttccacaccatccacagc

SEQ ID NO: 23401 - DNA, 19 bp, Artificial Sequence
  Synthetic
cggagccccaagccacctt

SEQ ID NO: 23402 - DNA, 20 bp, Artificial Sequence
  Synthetic
tcttcatacaggcccgcaat

SEQ ID NO: 23403 - DNA, 20 bp, Artificial Sequence
  Synthetic
cctggtccagcgttgcctcc

SEQ ID NO: 23404 - DNA, 22 bp, Artificial Sequence
  Synthetic
ttggtatagggcaaggttgggc

SEQ ID NO: 23405 - DNA, 19 bp, Artificial Sequence
  Synthetic
ccttggggtagccgacggt

SEQ ID NO: 23406 - DNA, 22 bp, Artificial Sequence
  Synthetic
tgggcagcatgcttggataact

SEQ ID NO: 23407 - DNA, 19 bp, Artificial Sequence
  Synthetic
ccgaaagggccaggtcgga

SEQ ID NO: 23408 - DNA, 21 bp, Artificial Sequence
  Synthetic
atttccgtcagccagggtgac

SEQ ID NO: 23409 - DNA, 20 bp, Artificial Sequence
  Synthetic
tcacctggatcccctcaccg

SEQ ID NO: 23410 - DNA, 22 bp, Artificial Sequence
  Synthetic
ggatcgattggaaaagggccca

SEQ ID NO: 23411 - DNA, 19 bp, Artificial Sequence
  Synthetic
gccagcaggtaaggcaggc

SEQ ID NO: 23412 - DNA, 22 bp, Artificial Sequence
  Synthetic
ctagattcagcgatcccccggt

SEQ ID NO: 23413 - DNA, 19 bp, Artificial Sequence
  Synthetic
gagcttgcggctgagctcc

SEQ ID NO: 23414 - DNA, 20 bp, Artificial Sequence
  Synthetic
ctccagggagatgggggcca

SEQ ID NO: 23415 - DNA, 22 bp, Artificial Sequence
  Synthetic
cagctgctgcttgtcgaggatg

SEQ ID NO: 23416 - DNA, 22 bp, Artificial Sequence
  Synthetic
acacggcgtacatgtcgatggg

SEQ ID NO: 23417 - DNA, 20 bp, Artificial Sequence
  Synthetic
cccctgtcgaccagaggacg

SEQ ID NO: 23418 - DNA, 19 bp, Artificial Sequence
  Synthetic
gcaggcacagggtctcggt

SEQ ID NO: 23419 - DNA, 20 bp, Artificial Sequence
  Synthetic
ccagcagggcacagaggtga

SEQ ID NO: 23420 - DNA, 22 bp, Artificial Sequence
  Synthetic
ttccttcagcgtctatgcccag

SEQ ID NO: 23421 - DNA, 20 bp, Artificial Sequence
  Synthetic
cgggcctctggaccctcaca

SEQ ID NO: 23422 - DNA, 20 bp, Artificial Sequence
  Synthetic
agatgtagccgcacggaccc

SEQ ID NO: 23423 - DNA, 19 bp, Artificial Sequence
  Synthetic
tgagccggcagaggaccag

SEQ ID NO: 23424 - DNA, 20 bp, Artificial Sequence
  Synthetic
cgggtgaggcggctaagagg

SEQ ID NO: 23425 - DNA, 25 bp, Artificial Sequence
  Synthetic
ttcgagtatccttctttgatgttcg

SEQ ID NO: 23426 - DNA, 24 bp, Artificial Sequence
  Synthetic
cttagtgaagagtctttgtcacca

SEQ ID NO: 23427 - DNA, 20 bp, Artificial Sequence
  Synthetic
cccgcgattggaagctgtat

SEQ ID NO: 23428 - DNA, 25 bp, Artificial Sequence
  Synthetic
ttcctttaagttcggtgattatcca

SEQ ID NO: 23429 - DNA, 21 bp, Artificial Sequence
  Synthetic
tgtcccccaaggaagagctac

SEQ ID NO: 23430 - DNA, 25 bp, Artificial Sequence
  Synthetic
ttccacttctcttagttctcaaagg

SEQ ID NO: 23431 - DNA, 20 bp, Artificial Sequence
  Synthetic
tgcaagcaggcccatagatg

SEQ ID NO: 23432 - DNA, 25 bp, Artificial Sequence
  Synthetic
acacctttagacagagttcagagag

SEQ ID NO: 23433 - DNA, 22 bp, Artificial Sequence
  Synthetic
cagaacggttgcttatggttgg

SEQ ID NO: 23434 - DNA, 25 bp, Artificial Sequence
  Synthetic
tgagtcttttcaacaagacagagct

SEQ ID NO: 23435 - DNA, 24 bp, Artificial Sequence
  Synthetic
gatgttattccagcagaaaagcct

SEQ ID NO: 23436 - DNA, 25 bp, Artificial Sequence
  Synthetic
ctgaagccatttgcacttatcttct

SEQ ID NO: 23437 - DNA, 21 bp, Artificial Sequence
  Synthetic
ttcaaccgacactgttgacac

SEQ ID NO: 23438 - DNA, 20 bp, Artificial Sequence
  Synthetic
gctgagggagcaattgagct

SEQ ID NO: 23439 - DNA, 23 bp, Artificial Sequence
  Synthetic
ccttgtactgtggggtattcatc

SEQ ID NO: 23440 - DNA, 20 bp, Artificial Sequence
  Synthetic
ttcgcactgagtagaggctt

SEQ ID NO: 23441 - DNA, 20 bp, Artificial Sequence
  Synthetic
ttgaagggggatggactgga

SEQ ID NO: 23442 - DNA, 25 bp, Artificial Sequence
  Synthetic
ctatcagattctggcgatctactca

SEQ ID NO: 23443 - DNA, 23 bp, Artificial Sequence
  Synthetic
aggtggttatttgatcgttggga

SEQ ID NO: 23444 - DNA, 22 bp, Artificial Sequence
  Synthetic
atggactctgtagtagctgtgc

SEQ ID NO: 23445 - DNA, 20 bp, Artificial Sequence
  Synthetic
attgtgcagacactgtgggt

SEQ ID NO: 23446 - DNA, 20 bp, Artificial Sequence
  Synthetic
gaggcagacttcgccatgag

SEQ ID NO: 23447 - DNA, 21 bp, Artificial Sequence
  Synthetic
aaactcccgcgaactgttttg

SEQ ID NO: 23448 - DNA, 21 bp, Artificial Sequence
  Synthetic
ctcagggaactaagggcttgg

SEQ ID NO: 23449 - DNA, 24 bp, Artificial Sequence
  Synthetic
aacgtaggcaaaagtagagaaact

SEQ ID NO: 23450 - DNA, 25 bp, Artificial Sequence
  Synthetic
ttgatgaagctaccattgcatatca

SEQ ID NO: 23451 - DNA, 23 bp, Artificial Sequence
  Synthetic
aaaaggctttggacacagttaga

SEQ ID NO: 23452 - DNA, 21 bp, Artificial Sequence
  Synthetic
taccaacctgtacctccgttg

SEQ ID NO: 23453 - DNA, 20 bp, Artificial Sequence
  Synthetic
cgccaacaacatcgcgactc

SEQ ID NO: 23454 - DNA, 21 bp, Artificial Sequence
  Synthetic
gacaggcgaaggggaagggga

SEQ ID NO: 23455 - DNA, 22 bp, Artificial Sequence
  Synthetic
agtactacgtggtcatgggtag

SEQ ID NO: 23456 - DNA, 23 bp, Artificial Sequence
  Synthetic
cgtactaaacgtgcctctgttac

SEQ ID NO: 23457 - DNA, 21 bp, Artificial Sequence
  Synthetic
agttcgccctggggtgatacc

SEQ ID NO: 23458 - DNA, 22 bp, Artificial Sequence
  Synthetic
ggctcgtctgccattttagagg

SEQ ID NO: 23459 - DNA, 23 bp, Artificial Sequence
  Synthetic
acagaaacacctcagggatatgt

SEQ ID NO: 23460 - DNA, 20 bp, Artificial Sequence
  Synthetic
acctgatggtttggaggtgg

SEQ ID NO: 23461 - DNA, 25 bp, Artificial Sequence
  Synthetic
gtgggtcatccatattatgatgtcc

SEQ ID NO: 23462 - DNA, 25 bp, Artificial Sequence
  Synthetic
ggttagagacacagaaaactctagc

SEQ ID NO: 23463 - DNA, 25 bp, Artificial Sequence
  Synthetic
gtgatcaacaacaacgaacaatagc

SEQ ID NO: 23464 - DNA, 21 bp, Artificial Sequence
  Synthetic
cttctgtatgcctcttgggga

SEQ ID NO: 23465 - DNA, 20 bp, Artificial Sequence
  Synthetic
cctgagctcacctatgtccg

SEQ ID NO: 23466 - DNA, 24 bp, Artificial Sequence
  Synthetic
ggagatcccaaaagattttcaacg

SEQ ID NO: 23467 - DNA, 21 bp, Artificial Sequence
  Synthetic
agtctgctcctaagcctgaaa

SEQ ID NO: 23468 - DNA, 24 bp, Artificial Sequence
  Synthetic
cttccctgaaggttgagacaattt

SEQ ID NO: 23469 - DNA, 23 bp, Artificial Sequence
  Synthetic
aaatccatctacgtgcatttcct

SEQ ID NO: 23470 - DNA, 24 bp, Artificial Sequence
  Synthetic
aacggtttcaataaaaagctgtgc

SEQ ID NO: 23471 - DNA, 20 bp, Artificial Sequence
  Synthetic
gtacagctcacagttggcgt

SEQ ID NO: 23472 - DNA, 23 bp, Artificial Sequence
  Synthetic
caaggcagcgtggaattatacaa

SEQ ID NO: 23473 - DNA, 22 bp, Artificial Sequence
  Synthetic
gatctttatgctctgggggttg

SEQ ID NO: 23474 - DNA, 25 bp, Artificial Sequence
  Synthetic
tctgtttctgtctataaccgaagtc

SEQ ID NO: 23475 - DNA, 20 bp, Artificial Sequence
  Synthetic
gctgttgccgagggaagaaa

SEQ ID NO: 23476 - DNA, 21 bp, Artificial Sequence
  Synthetic
ttgcctgaatgagagtggact

SEQ ID NO: 23477 - DNA, 23 bp, Artificial Sequence
  Synthetic
tcaaacagcatgatgtccgatag

SEQ ID NO: 23478 - DNA, 24 bp, Artificial Sequence
  Synthetic
ataccctgtcagaaatacacgagc

SEQ ID NO: 23479 - DNA, 20 bp, Artificial Sequence
  Synthetic
gcagactttctgggggagga

SEQ ID NO: 23480 - DNA, 23 bp, Artificial Sequence
  Synthetic
tgatgagttgcgtaattggatgc

SEQ ID NO: 23481 - DNA, 20 bp, Artificial Sequence
  Synthetic
tgcttgcgaaaggtgtgtac

SEQ ID NO: 23482 - DNA, 20 bp, Artificial Sequence
  Synthetic
aaaggagaacctcgagcctt

SEQ ID NO: 23483 - DNA, 21 bp, Artificial Sequence
  Synthetic
ttagctcccaggttacgtcat

SEQ ID NO: 23484 - DNA, 25 bp, Artificial Sequence
  Synthetic
tatcgatgtttctcgcttaacagaa

SEQ ID NO: 23485 - DNA, 22 bp, Artificial Sequence
  Synthetic
ccgctttcctgtgtgtaatcat

SEQ ID NO: 23486 - DNA, 25 bp, Artificial Sequence
  Synthetic
gatcttcagttacaacttgacagct

SEQ ID NO: 23487 - DNA, 22 bp, Artificial Sequence
  Synthetic
aacgacctcggtacaaaaaccc

SEQ ID NO: 23488 - DNA, 21 bp, Artificial Sequence
  Synthetic
gcaaaacatctccttcctgca

SEQ ID NO: 23489 - DNA, 20 bp, Artificial Sequence
  Synthetic
gaagctgacttcgccgatct

SEQ ID NO: 23490 - DNA, 21 bp, Artificial Sequence
  Synthetic
cgtatccttgccggtattcac

SEQ ID NO: 23491 - DNA, 22 bp, Artificial Sequence
  Synthetic
tgcacaagctttactgaacact

SEQ ID NO: 23492 - DNA, 21 bp, Artificial Sequence
  Synthetic
cactgttcgcggttacaaacc

SEQ ID NO: 23493 - DNA, 20 bp, Artificial Sequence
  Synthetic
tctagggatttggcctccac

SEQ ID NO: 23494 - DNA, 21 bp, Artificial Sequence
  Synthetic
aggtttagggcttcttcctgc

SEQ ID NO: 23495 - DNA, 23 bp, Artificial Sequence
  Synthetic
caagtagcgaaaaatccaacagc

SEQ ID NO: 23496 - DNA, 20 bp, Artificial Sequence
  Synthetic
ctgctcagctcttgcggtta

SEQ ID NO: 23497 - DNA, 24 bp, Artificial Sequence
  Synthetic
tttgtcacgaatatagccactgat

SEQ ID NO: 23498 - DNA, 24 bp, Artificial Sequence
  Synthetic
agatcctctaaatttgaacctccg

SEQ ID NO: 23499 - DNA, 23 bp, Artificial Sequence
  Synthetic
tccagacatagcaacaatgacag

SEQ ID NO: 23500 - DNA, 25 bp, Artificial Sequence
  Synthetic
tgatggttacttcctcaaaacaaga

SEQ ID NO: 23501 - DNA, 20 bp, Artificial Sequence
  Synthetic
tcagaaccctgacggattgt

SEQ ID NO: 23502 - DNA, 20 bp, Artificial Sequence
  Synthetic
ggctgcatcgtctcgagaac

SEQ ID NO: 23503 - DNA, 25 bp, Artificial Sequence
  Synthetic
tctccagcagcaaaaactaaaattc

SEQ ID NO: 23504 - DNA, 24 bp, Artificial Sequence
  Synthetic
tgtacggaagaagaattgaggtct

SEQ ID NO: 23505 - DNA, 20 bp, Artificial Sequence
  Synthetic
caacgttctctcctgcacga

SEQ ID NO: 23506 - DNA, 23 bp, Artificial Sequence
  Synthetic
caagtagtcattgctatgctcga

SEQ ID NO: 23507 - DNA, 20 bp, Artificial Sequence
  Synthetic
agccgataatgctcgctcac

SEQ ID NO: 23508 - DNA, 23 bp, Artificial Sequence
  Synthetic
gtccttcctgtttagggaaacga

SEQ ID NO: 23509 - DNA, 23 bp, Artificial Sequence
  Synthetic
cattctgtggcttctgcattaga

SEQ ID NO: 23510 - DNA, 24 bp, Artificial Sequence
  Synthetic
tacgatccaaattgagaaccttgc

SEQ ID NO: 23511 - DNA, 24 bp, Artificial Sequence
  Synthetic
tcttactagctccttgtcgagaac

SEQ ID NO: 23512 - DNA, 20 bp, Artificial Sequence
  Synthetic
aatgccgctcgagtcaatgt

SEQ ID NO: 23513 - DNA, 20 bp, Artificial Sequence
  Synthetic
cgacaacccacgatcttgct

SEQ ID NO: 23514 - DNA, 20 bp, Artificial Sequence
  Synthetic
tcgctcccactaatgcaact

SEQ ID NO: 23515 - DNA, 24 bp, Artificial Sequence
  Synthetic
aaacagtgaggacgacaaagtaaa

SEQ ID NO: 23516 - DNA, 24 bp, Artificial Sequence
  Synthetic
gcaatcgctaaaacaatcgattgc

SEQ ID NO: 23517 - DNA, 25 bp, Artificial Sequence
  Synthetic
gtaggtaaaacctcgtttggtcaac

SEQ ID NO: 23518 - DNA, 20 bp, Artificial Sequence
  Synthetic
caggctgcacaccatcacta

SEQ ID NO: 23519 - DNA, 23 bp, Artificial Sequence
  Synthetic
ggaactgaccctataaggaatgc

SEQ ID NO: 23520 - DNA, 23 bp, Artificial Sequence
  Synthetic
gacaaccatttttgctttgctgt

SEQ ID NO: 23521 - DNA, 24 bp, Artificial Sequence
  Synthetic
cgatcaaatcgcaaacaaacactt

SEQ ID NO: 23522 - DNA, 22 bp, Artificial Sequence
  Synthetic
gcgaacgtttacaaatggctcc

SEQ ID NO: 23523 - DNA, 25 bp, Artificial Sequence
  Synthetic
atctgtgcagcttaaaacctaatgt

SEQ ID NO: 23524 - DNA, 20 bp, Artificial Sequence
  Synthetic
ggcttctgtcaccttgctca

SEQ ID NO: 23525 - DNA, 20 bp, Artificial Sequence
  Synthetic
ccgcacaagaaagccctctt

SEQ ID NO: 23526 - DNA, 25 bp, Artificial Sequence
  Synthetic
ctgtcaattctacattatgtgcagc

SEQ ID NO: 23527 - DNA, 24 bp, Artificial Sequence
  Synthetic
gaagctggttctacaacagaaact

SEQ ID NO: 23528 - DNA, 22 bp, Artificial Sequence
  Synthetic
gctcaaagtccaaaaaaacgca

SEQ ID NO: 23529 - DNA, 20 bp, Artificial Sequence
  Synthetic
gcctgaccccagaaaccatt

SEQ ID NO: 23530 - DNA, 23 bp, Artificial Sequence
  Synthetic
tcgtttccttttccaggttcatt

SEQ ID NO: 23531 - DNA, 25 bp, Artificial Sequence
  Synthetic
ttaggtcctgtagctttagactcat

SEQ ID NO: 23532 - DNA, 20 bp, Artificial Sequence
  Synthetic
aaggcactattcgttgcacc

SEQ ID NO: 23533 - DNA, 21 bp, Artificial Sequence
  Synthetic
aatcacaatgcgctcccattt

SEQ ID NO: 23534 - DNA, 24 bp, Artificial Sequence
  Synthetic
agaagcaaggatgaggttttctgt

SEQ ID NO: 23535 - DNA, 20 bp, Artificial Sequence
  Synthetic
gcccctaaaacccgacaaag

SEQ ID NO: 23536 - DNA, 22 bp, Artificial Sequence
  Synthetic
aaaagcatctaggagctcccca

SEQ ID NO: 23537 - DNA, 20 bp, Artificial Sequence
  Synthetic
cacaggagcaaccacgaaga

SEQ ID NO: 23538 - DNA, 25 bp, Artificial Sequence
  Synthetic
acctctctgtaagcaaatactgaca

SEQ ID NO: 23539 - DNA, 20 bp, Artificial Sequence
  Synthetic
cgaagcggtgaatgcatgaa

SEQ ID NO: 23540 - DNA, 25 bp, Artificial Sequence
  Synthetic
actggaaaagctacaatggattgta

SEQ ID NO: 23541 - DNA, 21 bp, Artificial Sequence
  Synthetic
tctgccatcaaagcatttcga

SEQ ID NO: 23542 - DNA, 20 bp, Artificial Sequence
  Synthetic
aatttggcggctggtaatcc

SEQ ID NO: 23543 - DNA, 20 bp, Artificial Sequence
  Synthetic
ttccgaccgagcaatctcag

SEQ ID NO: 23544 - DNA, 25 bp, Artificial Sequence
  Synthetic
caacacttttttaaggcatcttcca

SEQ ID NO: 23545 - DNA, 22 bp, Artificial Sequence
  Synthetic
ccaaagcgttcatatctcggac

SEQ ID NO: 23546 - DNA, 20 bp, Artificial Sequence
  Synthetic
aagcaaccttgacgggcatt

SEQ ID NO: 23547 - DNA, 21 bp, Artificial Sequence
  Synthetic
aaaccggcgtatttcttcctg

SEQ ID NO: 23548 - DNA, 21 bp, Artificial Sequence
  Synthetic
agaccctcttacgctggttaa

SEQ ID NO: 23549 - DNA, 23 bp, Artificial Sequence
  Synthetic
tctttgtcatcgatttggtcacg

SEQ ID NO: 23550 - DNA, 22 bp, Artificial Sequence
  Synthetic
cgtccactaccaagacctagat

SEQ ID NO: 23551 - DNA, 23 bp, Artificial Sequence
  Synthetic
tagctctgcagattttgtagcac

SEQ ID NO: 23552 - DNA, 22 bp, Artificial Sequence
  Synthetic
agctaaaccaacccgaagaatc

SEQ ID NO: 23553 - DNA, 25 bp, Artificial Sequence
  Synthetic
tctcaaaatccctttaaagcagagc

SEQ ID NO: 23554 - DNA, 25 bp, Artificial Sequence
  Synthetic
atctggaaattcaagaaagtcgtgg

SEQ ID NO: 23555 - DNA, 21 bp, Artificial Sequence
  Synthetic
ctgaaggaatcgctcaaggac

SEQ ID NO: 23556 - DNA, 20 bp, Artificial Sequence
  Synthetic
tggaggggccattccgtaat

SEQ ID NO: 23557 - DNA, 20 bp, Artificial Sequence
  Synthetic
aacctgggagacaagatgca

SEQ ID NO: 23558 - DNA, 22 bp, Artificial Sequence
  Synthetic
caccctaatatagttccgctgc

SEQ ID NO: 23559 - DNA, 23 bp, Artificial Sequence
  Synthetic
cagatgcttttacgacttgcaac

SEQ ID NO: 23560 - DNA, 20 bp, Artificial Sequence
  Synthetic
aagttcccatgatcgcctca

SEQ ID NO: 23561 - DNA, 20 bp, Artificial Sequence
  Synthetic
gagcttgtcccaattgctcc

SEQ ID NO: 23562 - DNA, 24 bp, Artificial Sequence
  Synthetic
tatcagcgatgcagtttctacagc

SEQ ID NO: 23563 - DNA, 20 bp, Artificial Sequence
  Synthetic
tgttccccgtacaagcaagt

SEQ ID NO: 23564 - DNA, 24 bp, Artificial Sequence
  Synthetic
ctgctcagctgttaaaaagtcaaa

SEQ ID NO: 23565 - DNA, 20 bp, Artificial Sequence
  Synthetic
ccccaggcaaagcaaaaagc

SEQ ID NO: 23566 - DNA, 22 bp, Artificial Sequence
  Synthetic
ggtaactgttgtattcgcacgg

SEQ ID NO: 23567 - DNA, 23 bp, Artificial Sequence
  Synthetic
gatcctaacgtgtctcctattgc

SEQ ID NO: 23568 - DNA, 24 bp, Artificial Sequence
  Synthetic
ttttcctgtgttttttcgatcagc

SEQ ID NO: 23569 - DNA, 22 bp, Artificial Sequence
  Synthetic
gggagttggagaaatcatggga

SEQ ID NO: 23570 - DNA, 22 bp, Artificial Sequence
  Synthetic
ttcgagcccttttgaagagtga

SEQ ID NO: 23571 - DNA, 22 bp, Artificial Sequence
  Synthetic
tcagagcctgtggatagtcttg

SEQ ID NO: 23572 - DNA, 21 bp, Artificial Sequence
  Synthetic
agggaaatcagaaaatcccgc

SEQ ID NO: 23573 - DNA, 25 bp, Artificial Sequence
  Synthetic
agcgtacatccatgatttattgtgt

SEQ ID NO: 23574 - DNA, 20 bp, Artificial Sequence
  Synthetic
cgcgctccgttaagatgatt

SEQ ID NO: 23575 - DNA, 22 bp, Artificial Sequence
  Synthetic
ccttcggcaacaaaaatcgttg

SEQ ID NO: 23576 - DNA, 21 bp, Artificial Sequence
  Synthetic
ttaacttcaacaagcgctgca

SEQ ID NO: 23577 - DNA, 23 bp, Artificial Sequence
  Synthetic
caggacgcaccggagataaaatt

SEQ ID NO: 23578 - DNA, 20 bp, Artificial Sequence
  Synthetic
gtagtgccagctcgggataa

SEQ ID NO: 23579 - DNA, 20 bp, Artificial Sequence
  Synthetic
tcctgcagccagaccatgta

SEQ ID NO: 23580 - DNA, 23 bp, Artificial Sequence
  Synthetic
cttaatctttctgaatggggcgt

SEQ ID NO: 23581 - DNA, 22 bp, Artificial Sequence
  Synthetic
ttacgaaggccatacggtatct

SEQ ID NO: 23582 - DNA, 20 bp, Artificial Sequence
  Synthetic
gtgcggggagaactcttgtt

SEQ ID NO: 23583 - DNA, 23 bp, Artificial Sequence
  Synthetic
caacgaaatacgcttgataccca

SEQ ID NO: 23584 - DNA, 24 bp, Artificial Sequence
  Synthetic
aatgtcgaggctttaaacgttttc

SEQ ID NO: 23585 - DNA, 21 bp, Artificial Sequence
  Synthetic
cgtctgcgtaagatgcatctt

SEQ ID NO: 23586 - DNA, 20 bp, Artificial Sequence
  Synthetic
gcgtaatggtgtgatgcctg

SEQ ID NO: 23587 - DNA, 25 bp, Artificial Sequence
  Synthetic
tccgtaacttctgattcagaattga

SEQ ID NO: 23588 - DNA, 20 bp, Artificial Sequence
  Synthetic
catggcaaaggttcgcctca

SEQ ID NO: 23589 - DNA, 21 bp, Artificial Sequence
  Synthetic
aggcgattctggaccaaaatc

SEQ ID NO: 23590 - DNA, 23 bp, Artificial Sequence
  Synthetic
ttgccttaggagaaaagggaagg

SEQ ID NO: 23591 - DNA, 20 bp, Artificial Sequence
  Synthetic
agcttcggaaggagacaagt

SEQ ID NO: 23592 - DNA, 23 bp, Artificial Sequence
  Synthetic
agcaattacgggatgaacatctg

SEQ ID NO: 23593 - DNA, 25 bp, Artificial Sequence
  Synthetic
gttcacctctttcaacggtatatga

SEQ ID NO: 23594 - DNA, 20 bp, Artificial Sequence
  Synthetic
ctccacaaatcagccgatcc

SEQ ID NO: 23595 - DNA, 20 bp, Artificial Sequence
  Synthetic
tgctcgctgcaaattccgaa

SEQ ID NO: 23596 - DNA, 23 bp, Artificial Sequence
  Synthetic
aacagctcaccaatcgagaatca

SEQ ID NO: 23597 - DNA, 20 bp, Artificial Sequence
  Synthetic
catgtgcggcaagccttttg

SEQ ID NO: 23598 - DNA, 22 bp, Artificial Sequence
  Synthetic
caagagcacaatggtatccgag

SEQ ID NO: 23599 - DNA, 25 bp, Artificial Sequence
  Synthetic
tggaagaggttcttttatgaatcgt

SEQ ID NO: 23600 - DNA, 22 bp, Artificial Sequence
  Synthetic
tatagggagcgaatgttgctgt

SEQ ID NO: 23601 - DNA, 20 bp, Artificial Sequence
  Synthetic
ttggcgagatagcgttgttc

SEQ ID NO: 23602 - DNA, 20 bp, Artificial Sequence
  Synthetic
ggtgctttgtgccaactctt

SEQ ID NO: 23603 - DNA, 25 bp, Artificial Sequence
  Synthetic
ctaagggaacagaaggcttgataat

SEQ ID NO: 23604 - DNA, 20 bp, Artificial Sequence
  Synthetic
tgctaaaaggtcgcgctaga

SEQ ID NO: 23605 - DNA, 20 bp, Artificial Sequence
  Synthetic
gtggaaattcgggggagtct

SEQ ID NO: 23606 - DNA, 25 bp, Artificial Sequence
  Synthetic
aaggacaatatagccttggagaaac

SEQ ID NO: 23607 - DNA, 25 bp, Artificial Sequence
  Synthetic
tcctggttttcctctcttaatagct

SEQ ID NO: 23608 - DNA, 22 bp, Artificial Sequence
  Synthetic
ccggaagacttattagcagcag

SEQ ID NO: 23609 - DNA, 22 bp, Artificial Sequence
  Synthetic
actagctaagcagttaggcctt

SEQ ID NO: 23610 - DNA, 22 bp, Artificial Sequence
  Synthetic
ttcacactacacaatgtgtcgc

SEQ ID NO: 23611 - DNA, 24 bp, Artificial Sequence
  Synthetic
tgacggatgttgttaaaggttctc

SEQ ID NO: 23612 - DNA, 23 bp, Artificial Sequence
  Synthetic
ttctcagaagaggatgtgcatga

SEQ ID NO: 23613 - DNA, 24 bp, Artificial Sequence
  Synthetic
tcgcagaattgatgatcatatgcc

SEQ ID NO: 23614 - DNA, 25 bp, Artificial Sequence
  Synthetic
atatgctgaggatttagaacaagca

SEQ ID NO: 23615 - DNA, 20 bp, Artificial Sequence
  Synthetic
gtcgcatcgagcaaagcatc

SEQ ID NO: 23616 - DNA, 21 bp, Artificial Sequence
  Synthetic
tagcagggatagaggaagcca

SEQ ID NO: 23617 - DNA, 24 bp, Artificial Sequence
  Synthetic
ctccttctttgacaaagtcagaga

SEQ ID NO: 23618 - DNA, 25 bp, Artificial Sequence
  Synthetic
ggagcatatttagaaacagttccct

SEQ ID NO: 23619 - DNA, 23 bp, Artificial Sequence
  Synthetic
gcgattcagttagcacgtattcc

SEQ ID NO: 23620 - DNA, 20 bp, Artificial Sequence
  Synthetic
tccgaagaaagcttgggtgc

SEQ ID NO: 23621 - DNA, 20 bp, Artificial Sequence
  Synthetic
cgttgcgtgatctcaaggct

SEQ ID NO: 23622 - DNA, 25 bp, Artificial Sequence
  Synthetic
ggaaattttctttccggagaacgag

SEQ ID NO: 23623 - DNA, 23 bp, Artificial Sequence
  Synthetic
gatcccagccatcaatgtgatag

SEQ ID NO: 23624 - DNA, 21 bp, Artificial Sequence
  Synthetic
ctagtcagcgagtgggatgac

SEQ ID NO: 23625 - DNA, 23 bp, Artificial Sequence
  Synthetic
tatgccgcatattttaacgcgta

SEQ ID NO: 23626 - DNA, 24 bp, Artificial Sequence
  Synthetic
tccacagttacagaaatcgatgag

SEQ ID NO: 23627 - DNA, 20 bp, Artificial Sequence
  Synthetic
gcgctatgatggttacagcg

SEQ ID NO: 23628 - DNA, 25 bp, Artificial Sequence
  Synthetic
accagtattttgggtcatatcttgt

SEQ ID NO: 23629 - DNA, 22 bp, Artificial Sequence
  Synthetic
gaaagggggagctatttatgcc

SEQ ID NO: 23630 - DNA, 22 bp, Artificial Sequence
  Synthetic
gcaattcaagcaagtgtggatg

SEQ ID NO: 23631 - DNA, 22 bp, Artificial Sequence
  Synthetic
atacacatttgcagaggagagc

SEQ ID NO: 23632 - DNA, 21 bp, Artificial Sequence
  Synthetic
gcatcgacaccatcaccatct

SEQ ID NO: 23633 - DNA, 24 bp, Artificial Sequence
  Synthetic
tttacgcagttgctgtactactca

SEQ ID NO: 23634 - DNA, 22 bp, Artificial Sequence
  Synthetic
ttgctctgaaacacttctgtcg

SEQ ID NO: 23635 - DNA, 25 bp, Artificial Sequence
  Synthetic
ttgatggaattggacgattctacat

SEQ ID NO: 23636 - DNA, 23 bp, Artificial Sequence
  Synthetic
gccaagccaataatggtgatgat

SEQ ID NO: 23637 - DNA, 22 bp, Artificial Sequence
  Synthetic
ggtgagaatggacggaaaacaa

SEQ ID NO: 23638 - DNA, 21 bp, Artificial Sequence
  Synthetic
aaggaccagaagtggaggaaa

SEQ ID NO: 23639 - DNA, 24 bp, Artificial Sequence
  Synthetic
gggatgtgtttgtcataagggaac

SEQ ID NO: 23640 - DNA, 25 bp, Artificial Sequence
  Synthetic
aacagacactatcaagagttggaga

SEQ ID NO: 23641 - DNA, 22 bp, Artificial Sequence
  Synthetic
cacatgtgtgtgcagggataac

SEQ ID NO: 23642 - DNA, 23 bp, Artificial Sequence
  Synthetic
tgagatgatttgggatccgaacg

SEQ ID NO: 23643 - DNA, 22 bp, Artificial Sequence
  Synthetic
tctacggaaggagtacctgagt

SEQ ID NO: 23644 - DNA, 23 bp, Artificial Sequence
  Synthetic
tggcttcggaggaaatttgtatg

SEQ ID NO: 23645 - DNA, 23 bp, Artificial Sequence
  Synthetic
tgaaggagttaactggagtccac

SEQ ID NO: 23646 - DNA, 24 bp, Artificial Sequence
  Synthetic
aaatccagcattgtacacacaaga

SEQ ID NO: 23647 - DNA, 24 bp, Artificial Sequence
  Synthetic
atcaccttacacagggaattctgg

SEQ ID NO: 23648 - DNA, 23 bp, Artificial Sequence
  Synthetic
actggactatgaagctagatgca

SEQ ID NO: 23649 - DNA, 25 bp, Artificial Sequence
  Synthetic
agagcagaatttttggaatcgatga

SEQ ID NO: 23650 - DNA, 25 bp, Artificial Sequence
  Synthetic
aggagaattgggaataataagagcc

SEQ ID NO: 23651 - DNA, 24 bp, Artificial Sequence
  Synthetic
caatcagatcctttttactgggga

SEQ ID NO: 23652 - DNA, 20 bp, Artificial Sequence
  Synthetic
ccagttgcatgggcctcata

SEQ ID NO: 23653 - DNA, 22 bp, Artificial Sequence
  Synthetic
tcatcctagctccagtgctggt

SEQ ID NO: 23654 - DNA, 22 bp, Artificial Sequence
  Synthetic
catcacaatggcaaaacctcct

SEQ ID NO: 23655 - DNA, 21 bp, Artificial Sequence
  Synthetic
cctgcattgtgacgaagactt

SEQ ID NO: 23656 - DNA, 24 bp, Artificial Sequence
  Synthetic
tttgacaaagacacagactcagat

SEQ ID NO: 23657 - DNA, 20 bp, Artificial Sequence
  Synthetic
aagaggcgactgttcgagga

SEQ ID NO: 23658 - DNA, 23 bp, Artificial Sequence
  Synthetic
atacccatggagaatacccagag

SEQ ID NO: 23659 - DNA, 25 bp, Artificial Sequence
  Synthetic
cactgcaagacaagttaatgacaat

SEQ ID NO: 23660 - DNA, 23 bp, Artificial Sequence
  Synthetic
agtgaaactggagaatgggaagt

SEQ ID NO: 23661 - DNA, 20 bp, Artificial Sequence
  Synthetic
gacgaccgaaagcgtcaccg

SEQ ID NO: 23662 - DNA, 20 bp, Artificial Sequence
  Synthetic
cctccagaggccgtagaggg

SEQ ID NO: 23663 - DNA, 23 bp, Artificial Sequence
  Synthetic
gcaggtagcaacgatagaatagg

SEQ ID NO: 23664 - DNA, 23 bp, Artificial Sequence
  Synthetic
tgaggctataggaccaagtgaac

SEQ ID NO: 23665 - DNA, 24 bp, Artificial Sequence
  Synthetic
caaacgagctactataaggaccag

SEQ ID NO: 23666 - DNA, 23 bp, Artificial Sequence
  Synthetic
ttttgcagatgtcctattggctt

SEQ ID NO: 23667 - DNA, 25 bp, Artificial Sequence
  Synthetic
atcagtttagagcttttcgactgaa

SEQ ID NO: 23668 - DNA, 22 bp, Artificial Sequence
  Synthetic
taggtgaacattgggacacagc

SEQ ID NO: 23669 - DNA, 25 bp, Artificial Sequence
  Synthetic
acgacgagaacaatgttatgttagg

SEQ ID NO: 23670 - DNA, 23 bp, Artificial Sequence
  Synthetic
attggttacaaagagcacaaggc

SEQ ID NO: 23671 - DNA, 21 bp, Artificial Sequence
  Synthetic
gttaacagctttcagccaggg

SEQ ID NO: 23672 - DNA, 25 bp, Artificial Sequence
  Synthetic
tgaatgcaagtccatatgatttgga

SEQ ID NO: 23673 - DNA, 24 bp, Artificial Sequence
  Synthetic
ttgttccatgggttatgtacttgc

SEQ ID NO: 23674 - DNA, 24 bp, Artificial Sequence
  Synthetic
gagtgctgctactatacgtagtgt

SEQ ID NO: 23675 - DNA, 25 bp, Artificial Sequence
  Synthetic
tggtaacatgatagatggttttgct

SEQ ID NO: 23676 - DNA, 20 bp, Artificial Sequence
  Synthetic
acgggagttgctaggtgttt

SEQ ID NO: 23677 - DNA, 25 bp, Artificial Sequence
  Synthetic
acgtagaagaatttgtctttcaggc

SEQ ID NO: 23678 - DNA, 24 bp, Artificial Sequence
  Synthetic
tgacaaatattaccctgttgtggt

SEQ ID NO: 23679 - DNA, 23 bp, Artificial Sequence
  Synthetic
ttaactgtcacaagtgctggaca

SEQ ID NO: 23680 - DNA, 25 bp, Artificial Sequence
  Synthetic
acctgctaatattgtacttccacaa

SEQ ID NO: 23681 - DNA, 24 bp, Artificial Sequence
  Synthetic
aaactgtgcttaatgttgttggac

SEQ ID NO: 23682 - DNA, 24 bp, Artificial Sequence
  Synthetic
atcaatgacgttgcatttgtttcg

SEQ ID NO: 23683 - DNA, 24 bp, Artificial Sequence
  Synthetic
aggaaatgtgttttgtgatggagt

SEQ ID NO: 23684 - DNA, 23 bp, Artificial Sequence
  Synthetic
aaaattgttcaatggcaagaggc

SEQ ID NO: 23685 - DNA, 25 bp, Artificial Sequence
  Synthetic
ttgagtcgtgaagatcttgagattg

SEQ ID NO: 23686 - DNA, 25 bp, Artificial Sequence
  Synthetic
ttaaattgataggacacaccgtctg

SEQ ID NO: 23687 - DNA, 20 bp, Artificial Sequence
  Synthetic
ggtgacagctcagagagtgg

SEQ ID NO: 23688 - DNA, 25 bp, Artificial Sequence
  Synthetic
tggctttagctaatatgttaccagc

SEQ ID NO: 23689 - DNA, 23 bp, Artificial Sequence
  Synthetic
ctaaggaattgaaacggcccatt

SEQ ID NO: 23690 - DNA, 25 bp, Artificial Sequence
  Synthetic
aactggtttgaaactgaagcttact

SEQ ID NO: 23691 - DNA, 25 bp, Artificial Sequence
  Synthetic
tgtgttgcactttattacacatgca

SEQ ID NO: 23692 - DNA, 23 bp, Artificial Sequence
  Synthetic
actcgttctatgtcgtattgcag

SEQ ID NO: 23693 - DNA, 22 bp, Artificial Sequence
  Synthetic
aagcttaaacgtgcttttggtg

SEQ ID NO: 23694 - DNA, 20 bp, Artificial Sequence
  Synthetic
gcctactgcttccgtctcaa

SEQ ID NO: 23695 - DNA, 25 bp, Artificial Sequence
  Synthetic
gatcttgtggatctgttggttatgt

SEQ ID NO: 23696 - DNA, 25 bp, Artificial Sequence
  Synthetic
agatgctttagcttctatgactggt

SEQ ID NO: 23697 - DNA, 25 bp, Artificial Sequence
  Synthetic
tgtgtacaagcatacatttagaggc

SEQ ID NO: 23698 - DNA, 23 bp, Artificial Sequence
  Synthetic
gcaaaggttattgctaagtgggt

SEQ ID NO: 23699 - DNA, 25 bp, Artificial Sequence
  Synthetic
tgactgatgtcaaatgtgctaatgt

SEQ ID NO: 23700 - DNA, 25 bp, Artificial Sequence
  Synthetic
tgctaagaaaaatcttgatgaggcg

SEQ ID NO: 23701 - DNA, 25 bp, Artificial Sequence
  Synthetic
gtatggcagattcaaactatccagg

SEQ ID NO: 23702 - DNA, 24 bp, Artificial Sequence
  Synthetic
gaactgctactgaatatgcttcca

SEQ ID NO: 23703 - DNA, 21 bp, Artificial Sequence
  Synthetic
cggcaagtttgtacaagtgcc

SEQ ID NO: 23704 - DNA, 25 bp, Artificial Sequence
  Synthetic
tcagttctttgttgttaagaggaca

SEQ ID NO: 23705 - DNA, 25 bp, Artificial Sequence
  Synthetic
ttttggtgactatgttattgcagcc

SEQ ID NO: 23706 - DNA, 22 bp, Artificial Sequence
  Synthetic
atccagctttgcatgtagcttc

SEQ ID NO: 23707 - DNA, 25 bp, Artificial Sequence
  Synthetic
ttggaaaagccaggctctattatga

SEQ ID NO: 23708 - DNA, 21 bp, Artificial Sequence
  Synthetic
ctgggatgatatgttacgccg

SEQ ID NO: 23709 - DNA, 25 bp, Artificial Sequence
  Synthetic
gttgattcaacctttgtcacagaat

SEQ ID NO: 23710 - DNA, 21 bp, Artificial Sequence
  Synthetic
agatggatggtgacgatgtct

SEQ ID NO: 23711 - DNA, 22 bp, Artificial Sequence
  Synthetic
ttatgcagagtgttggagcttg

SEQ ID NO: 23712 - DNA, 24 bp, Artificial Sequence
  Synthetic
cttgaaattgtttgctgcagaaac

SEQ ID NO: 23713 - DNA, 25 bp, Artificial Sequence
  Synthetic
acacattggtatgaaacgttactgc

SEQ ID NO: 23714 - DNA, 25 bp, Artificial Sequence
  Synthetic
accataaatgcattacctgagatgg

SEQ ID NO: 23715 - DNA, 21 bp, Artificial Sequence
  Synthetic
caaaccgtggattctgctcaa

SEQ ID NO: 23716 - DNA, 20 bp, Artificial Sequence
  Synthetic
atcacccagctcatgctcct

SEQ ID NO: 23717 - DNA, 21 bp, Artificial Sequence
  Synthetic
gaagccactggtttgtttgct

SEQ ID NO: 23718 - DNA, 25 bp, Artificial Sequence
  Synthetic
taaacgtgccacagtttacaattct

SEQ ID NO: 23719 - DNA, 25 bp, Artificial Sequence
  Synthetic
tttgaggcacataaggactctttta

SEQ ID NO: 23720 - DNA, 21 bp, Artificial Sequence
  Synthetic
gcatggatgctaagcaggttg

SEQ ID NO: 23721 - DNA, 24 bp, Artificial Sequence
  Synthetic
acaacataccctactaatgtggcc

SEQ ID NO: 23722 - DNA, 25 bp, Artificial Sequence
  Synthetic
agagtctttcgatgataagaggtcc

SEQ ID NO: 23723 - DNA, 25 bp, Artificial Sequence
  Synthetic
tgcatttgttaataggcttgtaccg

SEQ ID NO: 23724 - DNA, 25 bp, Artificial Sequence
  Synthetic
ttctccaatggaaagagttagtctc

SEQ ID NO: 23725 - DNA, 24 bp, Artificial Sequence
  Synthetic
aatggggtattttgcattttggac

SEQ ID NO: 23726 - DNA, 22 bp, Artificial Sequence
  Synthetic
ctggacatacagcctgaagact

SEQ ID NO: 23727 - DNA, 25 bp, Artificial Sequence
  Synthetic
ccggctagacttgaaatagttaagc

SEQ ID NO: 23728 - DNA, 22 bp, Artificial Sequence
  Synthetic
tcatgcctttaaatgcaaccgt

SEQ ID NO: 23729 - DNA, 24 bp, Artificial Sequence
  Synthetic
gtaaggattttacgcctgtacagg

SEQ ID NO: 23730 - DNA, 24 bp, Artificial Sequence
  Synthetic
acaaggtcttttagaggtctctgt

SEQ ID NO: 23731 - DNA, 25 bp, Artificial Sequence
  Synthetic
attgggttacacctctcacttctag

SEQ ID NO: 23732 - DNA, 25 bp, Artificial Sequence
  Synthetic
tgagcagcctgatgtcttttattca

SEQ ID NO: 23733 - DNA, 24 bp, Artificial Sequence
  Synthetic
cctgcaggtgttcttactaatcat

SEQ ID NO: 23734 - DNA, 25 bp, Artificial Sequence
  Synthetic
aagtgattattgtggaggcaattct

SEQ ID NO: 23735 - DNA, 22 bp, Artificial Sequence
  Synthetic
ccgaaccagcattgctatttcg

SEQ ID NO: 23736 - DNA, 23 bp, Artificial Sequence
  Synthetic
tgtggtgattatgcagcatgtaa

SEQ ID NO: 23737 - DNA, 20 bp, Artificial Sequence
  Synthetic
gcatcaaagtgttgcctcca

SEQ ID NO: 23738 - DNA, 25 bp, Artificial Sequence
  Synthetic
tgcttatgtttctcaacagcttagt

SEQ ID NO: 23739 - DNA, 25 bp, Artificial Sequence
  Synthetic
gtagtggttactactaccctgaacc

SEQ ID NO: 23740 - DNA, 25 bp, Artificial Sequence
  Synthetic
gtaaaatggccttggtatgtatggc

SEQ ID NO: 23741 - DNA, 22 bp, Artificial Sequence
  Synthetic
agagttcctagtcatgcttggt

SEQ ID NO: 23742 - DNA, 24 bp, Artificial Sequence
  Synthetic
ttgaggactatcatactctgacgg

SEQ ID NO: 23743 - DNA, 22 bp, Artificial Sequence
  Synthetic
aatccagtagtagagcgtcctc

SEQ ID NO: 23744 - DNA, 22 bp, Artificial Sequence
  Synthetic
ccaggctgatgtcaataccccg

SEQ ID NO: 23745 - DNA, 24 bp, Artificial Sequence
  Synthetic
ttgctagtcttgttctggcaaaac

SEQ ID NO: 23746 - DNA, 25 bp, Artificial Sequence
  Synthetic
tgacagtacactttcaggttttgag

SEQ ID NO: 23747 - DNA, 23 bp, Artificial Sequence
  Synthetic
gcagaaaagtcgagataaggcac

SEQ ID NO: 23748 - DNA, 22 bp, Artificial Sequence
  Synthetic
ggaaggacctctttgcatcaga

SEQ ID NO: 23749 - DNA, 24 bp, Artificial Sequence
  Synthetic
ctacagagattcgcttggagaagc

SEQ ID NO: 23750 - DNA, 21 bp, Artificial Sequence
  Synthetic
ggcttcgccgagatcagaagt

SEQ ID NO: 23751 - DNA, 20 bp, Artificial Sequence
  Synthetic
gaaagtgacagggccccttt

SEQ ID NO: 23752 - DNA, 23 bp, Artificial Sequence
  Synthetic
aacacagttcgagtctctgaaac

SEQ ID NO: 23753 - DNA, 22 bp, Artificial Sequence
  Synthetic
ccctcccgggagagccatagtg

SEQ ID NO: 23754 - DNA, 21 bp, Artificial Sequence
  Synthetic
tggagtatacgtgttgccgcg

SEQ ID NO: 23755 - DNA, 19 bp, Artificial Sequence
  Synthetic
gctcgtcggcgctcctgta

SEQ ID NO: 23756 - DNA, 22 bp, Artificial Sequence
  Synthetic
acacctacagtggcagtcaggt

SEQ ID NO: 23757 - DNA, 21 bp, Artificial Sequence
  Synthetic
gcatgtcctgcgtttacccca

SEQ ID NO: 23758 - DNA, 20 bp, Artificial Sequence
  Synthetic
tactgctggcactacgcacc

SEQ ID NO: 23759 - DNA, 21 bp, Artificial Sequence
  Synthetic
ctcccagtggtcggtggtttg

SEQ ID NO: 23760 - DNA, 21 bp, Artificial Sequence
  Synthetic
tgaccgcagtgagcaacatcc

SEQ ID NO: 23761 - DNA, 20 bp, Artificial Sequence
  Synthetic
cgctgctgctgggacacatg

SEQ ID NO: 23762 - DNA, 20 bp, Artificial Sequence
  Synthetic
aggtcatcacctggggtgcg

SEQ ID NO: 23763 - DNA, 22 bp, Artificial Sequence
  Synthetic
atggagcaggttcgagaacgct

SEQ ID NO: 23764 - DNA, 22 bp, Artificial Sequence
  Synthetic
tgttgcggggatctttagggct

SEQ ID NO: 23765 - DNA, 21 bp, Artificial Sequence
  Synthetic
gggaaccgcaccgttacaact

SEQ ID NO: 23766 - DNA, 22 bp, Artificial Sequence
  Synthetic
acgtaccgatatgtcgcctccg

SEQ ID NO: 23767 - DNA, 20 bp, Artificial Sequence
  Synthetic
gcaggctcctcccccaagtt

SEQ ID NO: 23768 - DNA, 22 bp, Artificial Sequence
  Synthetic
atggaggagtgctcacaagctg

SEQ ID NO: 23769 - DNA, 19 bp, Artificial Sequence
  Synthetic
tactcggggggtgggttgc

SEQ ID NO: 23770 - DNA, 20 bp, Artificial Sequence
  Synthetic
cgtaggacctggggagggag

SEQ ID NO: 23771 - DNA, 22 bp, Artificial Sequence
  Synthetic
aaagggatacaagggcgtgtgg

SEQ ID NO: 23772 - DNA, 20 bp, Artificial Sequence
  Synthetic
tgccggctgctgagttcttt

SEQ ID NO: 23773 - DNA, 21 bp, Artificial Sequence
  Synthetic
cagacgctgagctagtggacg

SEQ ID NO: 23774 - DNA, 22 bp, Artificial Sequence
  Synthetic
tcagctggacggctctaatgtg

SEQ ID NO: 23775 - DNA, 22 bp, Artificial Sequence
  Synthetic
aagagaaactgcccatcagccc

SEQ ID NO: 23776 - DNA, 22 bp, Artificial Sequence
  Synthetic
ttccaaccaccatcatggcgaa

SEQ ID NO: 23777 - DNA, 21 bp, Artificial Sequence
  Synthetic
ctccctcacggagcggcttta

SEQ ID NO: 23778 - DNA, 21 bp, Artificial Sequence
  Synthetic
tagagcagccctgagagcctt

SEQ ID NO: 23779 - DNA, 25 bp, Artificial Sequence
  Synthetic
tcaagaagtacacatcaggaagaca

SEQ ID NO: 23780 - DNA, 23 bp, Artificial Sequence
  Synthetic
agtcgaaaggctaaagcatggaa

SEQ ID NO: 23781 - DNA, 25 bp, Artificial Sequence
  Synthetic
agagaagaaagaagaactccaggat

SEQ ID NO: 23782 - DNA, 25 bp, Artificial Sequence
  Synthetic
tagcatctttattggagatgtgcca

SEQ ID NO: 23783 - DNA, 23 bp, Artificial Sequence
  Synthetic
tgaagagttcacaatggttggga

SEQ ID NO: 23784 - DNA, 24 bp, Artificial Sequence
  Synthetic
aaagtgctttttcaaaattgggga

SEQ ID NO: 23785 - DNA, 22 bp, Artificial Sequence
  Synthetic
acacagggaacagagaaactga

SEQ ID NO: 23786 - DNA, 24 bp, Artificial Sequence
  Synthetic
gatgtgcttgggacatttgatacc

SEQ ID NO: 23787 - DNA, 22 bp, Artificial Sequence
  Synthetic
agacaggagatatgggccagca

SEQ ID NO: 23788 - DNA, 20 bp, Artificial Sequence
  Synthetic
ctgccgacgccttaccgatt

SEQ ID NO: 23789 - DNA, 20 bp, Artificial Sequence
  Synthetic
gcccccttgtgtcatcggag

SEQ ID NO: 23790 - DNA, 20 bp, Artificial Sequence
  Synthetic
gcccattgctgctgtccacc

SEQ ID NO: 23791 - DNA, 22 bp, Artificial Sequence
  Synthetic
atctgaagggtaggtgggtgcc

SEQ ID NO: 23792 - DNA, 21 bp, Artificial Sequence
  Synthetic
aaagtcccctacttcgtgcgc

SEQ ID NO: 23793 - DNA, 18 bp, Artificial Sequence
  Synthetic
ccgcgtgcggtgacatca

SEQ ID NO: 23794 - DNA, 19 bp, Artificial Sequence
  Synthetic
agaccttgtgggctggccc

SEQ ID NO: 23795 - DNA, 22 bp, Artificial Sequence
  Synthetic
tcacggacaactcctctccacc

SEQ ID NO: 23796 - DNA, 22 bp, Artificial Sequence
  Synthetic
tttgtgacgagtgccactccac

SEQ ID NO: 23797 - DNA, 20 bp, Artificial Sequence
  Synthetic
accgcggtcttgacgtgtct

SEQ ID NO: 23798 - DNA, 20 bp, Artificial Sequence
  Synthetic
gagtgctatgacgcgggctg

SEQ ID NO: 23799 - DNA, 20 bp, Artificial Sequence
  Synthetic
acctggaggtcgtcacgagc

SEQ ID NO: 23800 - DNA, 22 bp, Artificial Sequence
  Synthetic
accaactggcagaaactcgagg

SEQ ID NO: 23801 - DNA, 22 bp, Artificial Sequence
  Synthetic
agatcatgagcggtgaggtccc

SEQ ID NO: 23802 - DNA, 22 bp, Artificial Sequence
  Synthetic
ctcagcagcctcactgtaaccc

SEQ ID NO: 23803 - DNA, 21 bp, Artificial Sequence
  Synthetic
gggacgttccccattaacgcc

SEQ ID NO: 23804 - DNA, 19 bp, Artificial Sequence
  Synthetic
cgagcccgaaccggacgta

SEQ ID NO: 23805 - DNA, 20 bp, Artificial Sequence
  Synthetic
ccggactacaaccccccgct

SEQ ID NO: 23806 - DNA, 19 bp, Artificial Sequence
  Synthetic
tcttccatgccccccctgg

SEQ ID NO: 23807 - DNA, 20 bp, Artificial Sequence
  Synthetic
ctgacgcccccacattcagc

SEQ ID NO: 23808 - DNA, 22 bp, Artificial Sequence
  Synthetic
acgacgtggttagcaagctccc

SEQ ID NO: 23809 - DNA, 22 bp, Artificial Sequence
  Synthetic
tcacttgctacatcaaggcccg

SEQ ID NO: 23810 - DNA, 22 bp, Artificial Sequence
  Synthetic
ccagtcaattcctggctaggca

SEQ ID NO: 23811 - DNA, 20 bp, Artificial Sequence
  Synthetic
gtccgcgctaggcttctgtc

SEQ ID NO: 23812 - DNA, 25 bp, Artificial Sequence
  Synthetic
acccagaaacatattgcttttgtgt

SEQ ID NO: 23813 - DNA, 20 bp, Artificial Sequence
  Synthetic
tgtgtcacaaaccgctggta

SEQ ID NO: 23814 - DNA, 21 bp, Artificial Sequence
  Synthetic
gcacaacaagcgtatagggtg

SEQ ID NO: 23815 - DNA, 22 bp, Artificial Sequence
  Synthetic
gacagtcagcaaaggccaaacg

SEQ ID NO: 23816 - DNA, 22 bp, Artificial Sequence
  Synthetic
gggaatgacagtgcttatgctg

SEQ ID NO: 23817 - DNA, 20 bp, Artificial Sequence
  Synthetic
tggggggggctgttatatcc

SEQ ID NO: 23818 - DNA, 23 bp, Artificial Sequence
  Synthetic
tatgggcacgtttaagccttacc

SEQ ID NO: 23819 - DNA, 23 bp, Artificial Sequence
  Synthetic
atgtgaatttcaaggatgacgct

SEQ ID NO: 23820 - DNA, 19 bp, Artificial Sequence
  Synthetic
ttccacccagaaggccgcg

SEQ ID NO: 23821 - DNA, 20 bp, Artificial Sequence
  Synthetic
gctgacgtgctatctggcat

SEQ ID NO: 23822 - DNA, 22 bp, Artificial Sequence
  Synthetic
tggcagatcgcattttgcagtg

SEQ ID NO: 23823 - DNA, 20 bp, Artificial Sequence
  Synthetic
ccccagctgtgttggacatc

SEQ ID NO: 23824 - DNA, 20 bp, Artificial Sequence
  Synthetic
tacttgctccagctgcctct

SEQ ID NO: 23825 - DNA, 20 bp, Artificial Sequence
  Synthetic
cgactatgtgacacgcacca

SEQ ID NO: 23826 - DNA, 23 bp, Artificial Sequence
  Synthetic
atccagattatttgggaatggcc

SEQ ID NO: 23827 - DNA, 23 bp, Artificial Sequence
  Synthetic
attggaggattggaactttgggt

SEQ ID NO: 23828 - DNA, 24 bp, Artificial Sequence
  Synthetic
gtaaggttgttctaggtcaggaga

SEQ ID NO: 23829 - DNA, 21 bp, Artificial Sequence
  Synthetic
tgtgcgacacaagctgcaata

SEQ ID NO: 23830 - DNA, 21 bp, Artificial Sequence
  Synthetic
gaatcggagcagggaaattcc

SEQ ID NO: 23831 - DNA, 25 bp, Artificial Sequence
  Synthetic
tatcaggattcacatgaacagtggc

SEQ ID NO: 23832 - DNA, 20 bp, Artificial Sequence
  Synthetic
accgcaaatcgcagctggag

SEQ ID NO: 23833 - DNA, 22 bp, Artificial Sequence
  Synthetic
agacttcaagaggaggctcggg

SEQ ID NO: 23834 - DNA, 23 bp, Artificial Sequence
  Synthetic
ctccatctattacacgccctttg

SEQ ID NO: 23835 - DNA, 21 bp, Artificial Sequence
  Synthetic
acatcattaggtggtggggag

SEQ ID NO: 23836 - DNA, 22 bp, Artificial Sequence
  Synthetic
catcagtttgcagtttcagcag

SEQ ID NO: 23837 - DNA, 24 bp, Artificial Sequence
  Synthetic
atcacctacttacccttacacacc

SEQ ID NO: 23838 - DNA, 23 bp, Artificial Sequence
  Synthetic
ttatgctggatctgaaaggcttc

SEQ ID NO: 23839 - DNA, 25 bp, Artificial Sequence
  Synthetic
acagaaaatcctaacacgtatcctg

SEQ ID NO: 23840 - DNA, 22 bp, Artificial Sequence
  Synthetic
gtgatgtaggatttggagctgc

SEQ ID NO: 23841 - DNA, 25 bp, Artificial Sequence
  Synthetic
acaaacctcaaaacaatttaggacc

SEQ ID NO: 23842 - DNA, 23 bp, Artificial Sequence
  Synthetic
gaggcaaacttagaaaccgtttc

SEQ ID NO: 23843 - DNA, 21 bp, Artificial Sequence
  Synthetic
aagaatgaagtgggccatgtg

SEQ ID NO: 23844 - DNA, 25 bp, Artificial Sequence
  Synthetic
tcagaaagatgagacttgacaatgc

SEQ ID NO: 23845 - DNA, 23 bp, Artificial Sequence
  Synthetic
aactcccattgtactggcataca

SEQ ID NO: 23846 - DNA, 25 bp, Artificial Sequence
  Synthetic
agctgtagagattgcaaataagact

SEQ ID NO: 23847 - DNA, 22 bp, Artificial Sequence
  Synthetic
ttcagccaaaaaggaggacatg

SEQ ID NO: 23848 - DNA, 25 bp, Artificial Sequence
  Synthetic
tgaggaatcacctaaagcaagtgag

SEQ ID NO: 23849 - DNA, 22 bp, Artificial Sequence
  Synthetic
ccaagatgtgggaaatgggaac

SEQ ID NO: 23850 - DNA, 24 bp, Artificial Sequence
  Synthetic
aattgttgcctttctgtttttcgc

SEQ ID NO: 23851 - DNA, 25 bp, Artificial Sequence
  Synthetic
tgaggaacttgaaagactaaaaccg

SEQ ID NO: 23852 - DNA, 25 bp, Artificial Sequence
  Synthetic
actttccacacttttcatctctctg

SEQ ID NO: 23853 - DNA, 22 bp, Artificial Sequence
  Synthetic
tcttggacaagaatggcatgtg

SEQ ID NO: 23854 - DNA, 25 bp, Artificial Sequence
  Synthetic
ctagcgaagttaaagcccaatcatc

SEQ ID NO: 23855 - DNA, 23 bp, Artificial Sequence
  Synthetic
attgacttgtttgttaagcgtcg

SEQ ID NO: 23856 - DNA, 24 bp, Artificial Sequence
  Synthetic
tttgtcttttagatcaggcttggc

SEQ ID NO: 23857 - DNA, 24 bp, Artificial Sequence
  Synthetic
ttaatcctgctaatgggcatatgc

SEQ ID NO: 23858 - DNA, 20 bp, Artificial Sequence
  Synthetic
cagtggcaggaagcatggta

SEQ ID NO: 23859 - DNA, 25 bp, Artificial Sequence
  Synthetic
ctcctctgagtaaggatttacctga

SEQ ID NO: 23860 - DNA, 25 bp, Artificial Sequence
  Synthetic
tgttgagtacaaagtaacagtctgg

SEQ ID NO: 23861 - DNA, 25 bp, Artificial Sequence
  Synthetic
acgaaattgtagtgttcgtgttaag

SEQ ID NO: 23862 - DNA, 21 bp, Artificial Sequence
  Synthetic
cagtagctgctggtttggaat

SEQ ID NO: 23863 - DNA, 25 bp, Artificial Sequence
  Synthetic
atacatctttggttccacatacacg

SEQ ID NO: 23864 - DNA, 25 bp, Artificial Sequence
  Synthetic
tggtaatgttaaacctggtgaaact

SEQ ID NO: 23865 - DNA, 25 bp, Artificial Sequence
  Synthetic
attgtgcttggtttgtacaaaatga

SEQ ID NO: 23866 - DNA, 25 bp, Artificial Sequence
  Synthetic
agaggctcggattaatgataagaag

SEQ ID NO: 23867 - DNA, 24 bp, Artificial Sequence
  Synthetic
ctcagtttgtatttattgccgtgc

SEQ ID NO: 23868 - DNA, 25 bp, Artificial Sequence
  Synthetic
tttggtgattttatacaaacagccc

SEQ ID NO: 23869 - DNA, 21 bp, Artificial Sequence
  Synthetic
cagatcctgctatgcacgttg

SEQ ID NO: 23870 - DNA, 25 bp, Artificial Sequence
  Synthetic
tgctatcagtgctaagaatagagct

SEQ ID NO: 23871 - DNA, 25 bp, Artificial Sequence
  Synthetic
acatgaattttgttgttcacatggt

SEQ ID NO: 23872 - DNA, 25 bp, Artificial Sequence
  Synthetic
aagtctagctatagatgcttaccct

SEQ ID NO: 23873 - DNA, 25 bp, Artificial Sequence
  Synthetic
tgaacgtttaaagttatttgctgca

SEQ ID NO: 23874 - DNA, 25 bp, Artificial Sequence
  Synthetic
atgttgctaattatcagcacattgg

SEQ ID NO: 23875 - DNA, 25 bp, Artificial Sequence
  Synthetic
ctttccactgcaaataggtttttca

SEQ ID NO: 23876 - DNA, 22 bp, Artificial Sequence
  Synthetic
tgatgcttttcctgtagccaag

SEQ ID NO: 23877 - DNA, 23 bp, Artificial Sequence
  Synthetic
atcacacggtgtaatctaggtgg

SEQ ID NO: 23878 - DNA, 23 bp, Artificial Sequence
  Synthetic
ctcaaagttgagttttggttcgc

SEQ ID NO: 23879 - DNA, 24 bp, Artificial Sequence
  Synthetic
ttttacatttaggtgcagggtctg

SEQ ID NO: 23880 - DNA, 25 bp, Artificial Sequence
  Synthetic
atcgttcttgtgagagtactactgt

SEQ ID NO: 23881 - DNA, 25 bp, Artificial Sequence
  Synthetic
tcgtaaacgtagaagtatttctgct

SEQ ID NO: 23882 - DNA, 24 bp, Artificial Sequence
  Synthetic
aaatgcttatgtctctcaacagct

SEQ ID NO: 23883 - DNA, 21 bp, Artificial Sequence
  Synthetic
tacagggtgtcaaacttggca

SEQ ID NO: 23884 - DNA, 23 bp, Artificial Sequence
  Synthetic
atctgagcgaaattaccaaacct

SEQ ID NO: 23885 - DNA, 25 bp, Artificial Sequence
  Synthetic
tcaacagtgttttggtaaaagagga

SEQ ID NO: 23886 - DNA, 24 bp, Artificial Sequence
  Synthetic
ctggtactcagcacatttcaaatg

SEQ ID NO: 23887 - DNA, 20 bp, Artificial Sequence
  Synthetic
tgcagcaatatgcacccact

SEQ ID NO: 23888 - DNA, 24 bp, Artificial Sequence
  Synthetic
cgaaagaggcgaagaaacaattga

SEQ ID NO: 23889 - DNA, 24 bp, Artificial Sequence
  Synthetic
cctaatggacctccttgttatcag

SEQ ID NO: 23890 - DNA, 23 bp, Artificial Sequence
  Synthetic
aaaacgagtcaactaaagtgggc

SEQ ID NO: 23891 - DNA, 25 bp, Artificial Sequence
  Synthetic
gaattatttcacagcagaggtgtcc

SEQ ID NO: 23892 - DNA, 25 bp, Artificial Sequence
  Synthetic
aaatgggagaaatactgtgtccttg

SEQ ID NO: 23893 - DNA, 20 bp, Artificial Sequence
  Synthetic
ccccaagggagtggaagaag

SEQ ID NO: 23894 - DNA, 25 bp, Artificial Sequence
  Synthetic
aattgggaggttttacgtacagatg

SEQ ID NO: 23895 - DNA, 21 bp, Artificial Sequence
  Synthetic
ggcgataatggacgaagaaca

SEQ ID NO: 23896 - DNA, 21 bp, Artificial Sequence
  Synthetic
tcctgagaggatccgtagccc

SEQ ID NO: 23897 - DNA, 25 bp, Artificial Sequence
  Synthetic
aagaggacaactatccactagagga

SEQ ID NO: 23898 - DNA, 25 bp, Artificial Sequence
  Synthetic
aagctttcagcatctattactgaca

SEQ ID NO: 23899 - DNA, 22 bp, Artificial Sequence
  Synthetic
aagagacggagagagaccgagg

SEQ ID NO: 23900 - DNA, 24 bp, Artificial Sequence
  Synthetic
aaatgttggaggtggagatgtaaa

SEQ ID NO: 23901 - DNA, 23 bp, Artificial Sequence
  Synthetic
cggaggacttatatagggcttgt

SEQ ID NO: 23902 - DNA, 25 bp, Artificial Sequence
  Synthetic
acacctgttaaaccaaatacagctg

SEQ ID NO: 23903 - DNA, 21 bp, Artificial Sequence
  Synthetic
tgcagcctatacctgaaaggc

SEQ ID NO: 23904 - DNA, 23 bp, Artificial Sequence
  Synthetic
cactttagttagagccagggaac

SEQ ID NO: 23905 - DNA, 20 bp, Artificial Sequence
  Synthetic
ggtggttcgagtgagcagat

SEQ ID NO: 23906 - DNA, 25 bp, Artificial Sequence
  Synthetic
tacaggtgaatattgggatgtagca

SEQ ID NO: 23907 - DNA, 21 bp, Artificial Sequence
  Synthetic
ctttcatggaagacgggagca

SEQ ID NO: 23908 - DNA, 20 bp, Artificial Sequence
  Synthetic
gtacctccccctcagactgc

SEQ ID NO: 23909 - DNA, 21 bp, Artificial Sequence
  Synthetic
tcgcactgtttatgcagagca

SEQ ID NO: 23910 - DNA, 23 bp, Artificial Sequence
  Synthetic
ttttggtaagtgacaaatgcccg

SEQ ID NO: 23911 - DNA, 24 bp, Artificial Sequence
  Synthetic
attcggatttccatttcatcgacg

SEQ ID NO: 23912 - DNA, 24 bp, Artificial Sequence
  Synthetic
tcattgaaattggagtaacacgga

SEQ ID NO: 23913 - DNA, 23 bp, Artificial Sequence
  Synthetic
aagaggcgaagagacaattgaag

SEQ ID NO: 23914 - DNA, 25 bp, Artificial Sequence
  Synthetic
agactttgatgactgcaaagatgtt

SEQ ID NO: 23915 - DNA, 25 bp, Artificial Sequence
  Synthetic
gggctactgaatacataatgaaggg

SEQ ID NO: 23916 - DNA, 25 bp, Artificial Sequence
  Synthetic
tgtgttcttgaaataggagacatgc

SEQ ID NO: 23917 - DNA, 20 bp, Artificial Sequence
  Synthetic
gggagtggaggaaggctcta

SEQ ID NO: 23918 - DNA, 21 bp, Artificial Sequence
  Synthetic
gtgatgccccctttgatgaca

SEQ ID NO: 23919 - DNA, 25 bp, Artificial Sequence
  Synthetic
cagaaaataactggaggccttatgg

SEQ ID NO: 23920 - DNA, 20 bp, Artificial Sequence
  Synthetic
acagagattcgcttggggaa

SEQ ID NO: 23921 - DNA, 23 bp, Artificial Sequence
  Synthetic
agggacaacatgaccaagaaaat

SEQ ID NO: 23922 - DNA, 21 bp, Artificial Sequence
  Synthetic
ccgttggagggaatgagaaga

SEQ ID NO: 23923 - DNA, 23 bp, Artificial Sequence
  Synthetic
tccaatcctctgatgatttcgct

SEQ ID NO: 23924 - DNA, 20 bp, Artificial Sequence
  Synthetic
aacaacgaccttggaccagc

SEQ ID NO: 23925 - DNA, 23 bp, Artificial Sequence
  Synthetic
tcttccctagcagttcatatcgg

SEQ ID NO: 23926 - DNA, 20 bp, Artificial Sequence
  Synthetic
ccagctacccgaccctacaa

SEQ ID NO: 23927 - DNA, 25 bp, Artificial Sequence
  Synthetic
tggaaccatataatgaagtgcaaga

SEQ ID NO: 23928 - DNA, 25 bp, Artificial Sequence
  Synthetic
acatgccttaaaacgaaagtatgga

SEQ ID NO: 23929 - DNA, 24 bp, Artificial Sequence
  Synthetic
tgacagtgtatttgacctgtcaga

SEQ ID NO: 23930 - DNA, 23 bp, Artificial Sequence
  Synthetic
gacgtggtccagattagatttgc

SEQ ID NO: 23931 - DNA, 23 bp, Artificial Sequence
  Synthetic
aaaagcaaagcacatgaagcaat

SEQ ID NO: 23932 - DNA, 22 bp, Artificial Sequence
  Synthetic
agagaattacaacaccccacca

SEQ ID NO: 23933 - DNA, 25 bp, Artificial Sequence
  Synthetic
ggccttcagatccatctattgttac

SEQ ID NO: 23934 - DNA, 23 bp, Artificial Sequence
  Synthetic
cacatggatacgaggaaattcca

SEQ ID NO: 23935 - DNA, 21 bp, Artificial Sequence
  Synthetic
tgccttaacatccagacgtgg

SEQ ID NO: 23936 - DNA, 25 bp, Artificial Sequence
  Synthetic
tcctgaaacacaacgtttagtatgg

SEQ ID NO: 23937 - DNA, 23 bp, Artificial Sequence
  Synthetic
attggttgtgttcctgctattgg

SEQ ID NO: 23938 - DNA, 24 bp, Artificial Sequence
  Synthetic
tttacgacgcgaacagttatttgc

SEQ ID NO: 23939 - DNA, 22 bp, Artificial Sequence
  Synthetic
gaaccctatgtttcatgcgacc

SEQ ID NO: 23940 - DNA, 24 bp, Artificial Sequence
  Synthetic
tctgcagtagtatggtacaacaga

SEQ ID NO: 23941 - DNA, 23 bp, Artificial Sequence
  Synthetic
ggctcaaatagaccagtgattca

SEQ ID NO: 23942 - DNA, 22 bp, Artificial Sequence
  Synthetic
ctcgaggtctggatacgagatg

SEQ ID NO: 23943 - DNA, 23 bp, Artificial Sequence
  Synthetic
aaaagtacacatcaggaaggcaa

SEQ ID NO: 23944 - DNA, 24 bp, Artificial Sequence
  Synthetic
aaaaggtcgaaaggttgaaacatg

SEQ ID NO: 23945 - DNA, 24 bp, Artificial Sequence
  Synthetic
atgctagaaagagaattggtccgt

SEQ ID NO: 23946 - DNA, 22 bp, Artificial Sequence
  Synthetic
tctctcttggaaatgtgccaca

SEQ ID NO: 23947 - DNA, 25 bp, Artificial Sequence
  Synthetic
gaagagcaacagctattctcagaaa

SEQ ID NO: 23948 - DNA, 20 bp, Artificial Sequence
  Synthetic
agatcaatggccctgagtca

SEQ ID NO: 23949 - DNA, 20 bp, Artificial Sequence
  Synthetic
tgccccaccagaacagagta

SEQ ID NO: 23950 - DNA, 24 bp, Artificial Sequence
  Synthetic
aagagatatggcccagcattaagc

SEQ ID NO: 23951 - DNA, 25 bp, Artificial Sequence
  Synthetic
tggaggagtattgcaaacattatgg

SEQ ID NO: 23952 - DNA, 25 bp, Artificial Sequence
  Synthetic
ggttagattaagggtttgtgtacgt

SEQ ID NO: 23953 - DNA, 25 bp, Artificial Sequence
  Synthetic
aaaaggagattgtttttggacagtg

SEQ ID NO: 23954 - DNA, 23 bp, Artificial Sequence
  Synthetic
gggaagtggatctagaacggttc

SEQ ID NO: 23955 - DNA, 22 bp, Artificial Sequence
  Synthetic
gtggatcacgttctggtagacc

SEQ ID NO: 23956 - DNA, 20 bp, Artificial Sequence
  Synthetic
actggcggtgtcactcaatc

SEQ ID NO: 23957 - DNA, 21 bp, Artificial Sequence
  Synthetic
agcagcaccagacaatgcatt

SEQ ID NO: 23958 - DNA, 25 bp, Artificial Sequence
  Synthetic
agaccctataaatgcaacagatgtt

SEQ ID NO: 23959 - DNA, 23 bp, Artificial Sequence
  Synthetic
taggtgatacagagaatccagca

SEQ ID NO: 23960 - DNA, 25 bp, Artificial Sequence
  Synthetic
gtgtgccattagaattagtggacac

SEQ ID NO: 23961 - DNA, 21 bp, Artificial Sequence
  Synthetic
ctagtggacagcagtgacctt

SEQ ID NO: 23962 - DNA, 25 bp, Artificial Sequence
  Synthetic
ctgtgtggaaacctggatattgtgt

SEQ ID NO: 23963 - DNA, 24 bp, Artificial Sequence
  Synthetic
gtgcctggatattttacacagcag

SEQ ID NO: 23964 - DNA, 24 bp, Artificial Sequence
  Synthetic
agaagtgtaccagtagcattgttt

SEQ ID NO: 23965 - DNA, 21 bp, Artificial Sequence
  Synthetic
agatggaaacgaggtgtctgt

SEQ ID NO: 23966 - DNA, 21 bp, Artificial Sequence
  Synthetic
cattggcagcatctgaaagca

SEQ ID NO: 23967 - DNA, 23 bp, Artificial Sequence
  Synthetic
atgtgcattttaccaaggaagca

SEQ ID NO: 23968 - DNA, 20 bp, Artificial Sequence
  Synthetic
ttttacatgggtggcggatg

SEQ ID NO: 23969 - DNA, 20 bp, Artificial Sequence
  Synthetic
caggtgggggtcgggtaaca

SEQ ID NO: 23970 - DNA, 23 bp, Artificial Sequence
  Synthetic
acagaccctgttacacaatctgc

SEQ ID NO: 23971 - DNA, 24 bp, Artificial Sequence
  Synthetic
gtatccaccctgactcatttgaat

SEQ ID NO: 23972 - DNA, 25 bp, Artificial Sequence
  Synthetic
ccacagtccggtaaactttatctac

SEQ ID NO: 23973 - DNA, 20 bp, Artificial Sequence
  Synthetic
cattgggatgctgcaaagcc

SEQ ID NO: 23974 - DNA, 25 bp, Artificial Sequence
  Synthetic
tgccaccagctataaacattatctg

SEQ ID NO: 23975 - DNA, 23 bp, Artificial Sequence
  Synthetic
tctacctcctctagaaagcggtc

SEQ ID NO: 23976 - DNA, 25 bp, Artificial Sequence
  Synthetic
cttgatcctatgattgttgttggca

SEQ ID NO: 23977 - DNA, 25 bp, Artificial Sequence
  Synthetic
gcactatccctatacaatagacacc

SEQ ID NO: 23978 - DNA, 23 bp, Artificial Sequence
  Synthetic
tagcgaatggtatgttgtgacag

SEQ ID NO: 23979 - DNA, 25 bp, Artificial Sequence
  Synthetic
tttcacctcagagacaaagcaaaag

SEQ ID NO: 23980 - DNA, 21 bp, Artificial Sequence
  Synthetic
gtgccgctgcagaagaagtaa

SEQ ID NO: 23981 - DNA, 25 bp, Artificial Sequence
  Synthetic
ccaaattatttctgctcctgttacc

SEQ ID NO: 23982 - DNA, 20 bp, Artificial Sequence
  Synthetic
ctccagagagtcgccccgta

SEQ ID NO: 23983 - DNA, 25 bp, Artificial Sequence
  Synthetic
agaccctataagttcaggttctgaa

SEQ ID NO: 23984 - DNA, 22 bp, Artificial Sequence
  Synthetic
ggggagggatttcaacgtgtta

SEQ ID NO: 23985 - DNA, 25 bp, Artificial Sequence
  Synthetic
gaacaatacgagtcagcagattagg

SEQ ID NO: 23986 - DNA, 25 bp, Artificial Sequence
  Synthetic
tgaaggagaatctatgatcatgccc

SEQ ID NO: 23987 - DNA, 25 bp, Artificial Sequence
  Synthetic
aatgttttacagatggctctttggt

SEQ ID NO: 23988 - DNA, 25 bp, Artificial Sequence
  Synthetic
tgtctttaacccagaaagagagaga

SEQ ID NO: 23989 - DNA, 20 bp, Artificial Sequence
  Synthetic
ccagccactggtgaacactg

SEQ ID NO: 23990 - DNA, 23 bp, Artificial Sequence
  Synthetic
ctcggatttaacaagcattgctg

SEQ ID NO: 23991 - DNA, 20 bp, Artificial Sequence
  Synthetic
gcagtttggcttcgaggtgc

SEQ ID NO: 23992 - DNA, 19 bp, Artificial Sequence
  Synthetic
ccagagacggtgttgcgcc

SEQ ID NO: 23993 - DNA, 22 bp, Artificial Sequence
  Synthetic
gtagacacccagttatgcagtg

SEQ ID NO: 23994 - DNA, 20 bp, Artificial Sequence
  Synthetic
agtaggtgcctccagagccc

SEQ ID NO: 23995 - DNA, 19 bp, Artificial Sequence
  Synthetic
ccggtatcgggccagaggt

SEQ ID NO: 23996 - DNA, 20 bp, Artificial Sequence
  Synthetic
cctggggccaccttcatcac

SEQ ID NO: 23997 - DNA, 20 bp, Artificial Sequence
  Synthetic
gtggctgcctttgggatgca

SEQ ID NO: 23998 - DNA, 21 bp, Artificial Sequence
  Synthetic
agttgatgatctgtaggcgca

SEQ ID NO: 23999 - DNA, 19 bp, Artificial Sequence
  Synthetic
atgcgggatctgccggtcg

SEQ ID NO: 24000 - DNA, 20 bp, Artificial Sequence
  Synthetic
actcgtgaggcaccccatcc

SEQ ID NO: 24001 - DNA, 20 bp, Artificial Sequence
  Synthetic
tccccgggagattcgcgaca

SEQ ID NO: 24002 - DNA, 21 bp, Artificial Sequence
  Synthetic
gtttcagatcccacgcctcca

SEQ ID NO: 24003 - DNA, 21 bp, Artificial Sequence
  Synthetic
agctatgcctcccgtcgactg

SEQ ID NO: 24004 - DNA, 20 bp, Artificial Sequence
  Synthetic
cggccaatcccggggtaact

SEQ ID NO: 24005 - DNA, 21 bp, Artificial Sequence
  Synthetic
cctgcgtagaacgatggggcg

SEQ ID NO: 24006 - DNA, 22 bp, Artificial Sequence
  Synthetic
gactctgtttccagccagaggg

SEQ ID NO: 24007 - DNA, 19 bp, Artificial Sequence
  Synthetic
ccgccatctcgtgggcctt

SEQ ID NO: 24008 - DNA, 19 bp, Artificial Sequence
  Synthetic
ggcctcattcgcctctcgc

SEQ ID NO: 24009 - DNA, 19 bp, Artificial Sequence
  Synthetic
gcaggcaggcctccagctt

SEQ ID NO: 24010 - DNA, 19 bp, Artificial Sequence
  Synthetic
gccgtgcctaggatgcgga

SEQ ID NO: 24011 - DNA, 18 bp, Artificial Sequence
  Synthetic
tgcgagcaaaggcggcga

SEQ ID NO: 24012 - DNA, 20 bp, Artificial Sequence
  Synthetic
tcgccagagggatctgcacc

SEQ ID NO: 24013 - DNA, 20 bp, Artificial Sequence
  Synthetic
cgacctcagctccgagtggg

SEQ ID NO: 24014 - DNA, 19 bp, Artificial Sequence
  Synthetic
cccacttttggcgcgacct

SEQ ID NO: 24015 - DNA, 19 bp, Artificial Sequence
  Synthetic
actcctgctggccctccct

SEQ ID NO: 24016 - DNA, 19 bp, Artificial Sequence
  Synthetic
catgagcaagggcccaggg

SEQ ID NO: 24017 - DNA, 18 bp, Artificial Sequence
  Synthetic
ttccggccgttagcgtgc

SEQ ID NO: 24018 - DNA, 20 bp, Artificial Sequence
  Synthetic
gcctctggctgttcagctcg

SEQ ID NO: 24019 - DNA, 18 bp, Artificial Sequence
  Synthetic
aggggtcagcggctgtca

SEQ ID NO: 24020 - DNA, 19 bp, Artificial Sequence
  Synthetic
cggccaggctctgaccaga

SEQ ID NO: 24021 - DNA, 19 bp, Artificial Sequence
  Synthetic
agatgcggcgcagacagcc

SEQ ID NO: 24022 - DNA, 20 bp, Artificial Sequence
  Synthetic
ctcgtcaggccgcgagagga

SEQ ID NO: 24023 - DNA, 19 bp, Artificial Sequence
  Synthetic
cctttgagcccgaggtgcc

SEQ ID NO: 24024 - DNA, 20 bp, Artificial Sequence
  Synthetic
gtagcgccgctgattctgga

SEQ ID NO: 24025 - DNA, 22 bp, Artificial Sequence
  Synthetic
tctgttccttctgctccagtgc

SEQ ID NO: 24026 - DNA, 19 bp, Artificial Sequence
  Synthetic
gatgcgcctgacgttgtgc

SEQ ID NO: 24027 - DNA, 25 bp, Artificial Sequence
  Synthetic
tcgaagagtttatatggatgtgcat

SEQ ID NO: 24028 - DNA, 22 bp, Artificial Sequence
  Synthetic
ttggcttctgacatctcccagc

SEQ ID NO: 24029 - DNA, 18 bp, Artificial Sequence
  Synthetic
agtagcgggcctcggtgt

SEQ ID NO: 24030 - DNA, 21 bp, Artificial Sequence
  Synthetic
gcagtggctatgcctccatgc

SEQ ID NO: 24031 - DNA, 22 bp, Artificial Sequence
  Synthetic
gagatggtgtccggagacccca

SEQ ID NO: 24032 - DNA, 21 bp, Artificial Sequence
  Synthetic
aagagccagggggggaagtcg

SEQ ID NO: 24033 - DNA, 21 bp, Artificial Sequence
  Synthetic
aagcctgcctcatccttgacc

SEQ ID NO: 24034 - DNA, 19 bp, Artificial Sequence
  Synthetic
ccctgggcttggttcgcct

SEQ ID NO: 24035 - DNA, 20 bp, Artificial Sequence
  Synthetic
tgggcagtaggctcggagtg

SEQ ID NO: 24036 - DNA, 19 bp, Artificial Sequence
  Synthetic
cccgcctggtgctggaagt

SEQ ID NO: 24037 - DNA, 22 bp, Artificial Sequence
  Synthetic
agatggccatcagtaggcaccc

SEQ ID NO: 24038 - DNA, 20 bp, Artificial Sequence
  Synthetic
cagtcctaggtcagcggccg

SEQ ID NO: 24039 - DNA, 22 bp, Artificial Sequence
  Synthetic
tgtgctggaaagagaggctgga

SEQ ID NO: 24040 - DNA, 19 bp, Artificial Sequence
  Synthetic
tgggacctggggccgtaga

SEQ ID NO: 24041 - DNA, 19 bp, Artificial Sequence
  Synthetic
tgctgtatgcctcgcagcg

SEQ ID NO: 24042 - DNA, 20 bp, Artificial Sequence
  Synthetic
ggggggcctggagtcgatca

SEQ ID NO: 24043 - DNA, 18 bp, Artificial Sequence
  Synthetic
tggcacgcgattggggca

SEQ ID NO: 24044 - DNA, 18 bp, Artificial Sequence
  Synthetic
aagggcgcacaccactcc

SEQ ID NO: 24045 - DNA, 19 bp, Artificial Sequence
  Synthetic
acaccctcaacccccgagt

SEQ ID NO: 24046 - DNA, 19 bp, Artificial Sequence
  Synthetic
gccctccagatcgccacct

SEQ ID NO: 24047 - DNA, 22 bp, Artificial Sequence
  Synthetic
tgacggatgtctttaacggcgc

SEQ ID NO: 24048 - DNA, 22 bp, Artificial Sequence
  Synthetic
gcgtaacgtcattgtccaccga

SEQ ID NO: 24049 - DNA, 20 bp, Artificial Sequence
  Synthetic
actgacccccttgagcacgc

SEQ ID NO: 24050 - DNA, 21 bp, Artificial Sequence
  Synthetic
gtgtcctggtttaaggccgca

SEQ ID NO: 24051 - DNA, 19 bp, Artificial Sequence
  Synthetic
tgtacccatcccggccctc

SEQ ID NO: 24052 - DNA, 21 bp, Artificial Sequence
  Synthetic
tcgatgagggagcaaacaccc

SEQ ID NO: 24053 - DNA, 21 bp, Artificial Sequence
  Synthetic
gtggtcagcagcagatagtga

SEQ ID NO: 24054 - DNA, 19 bp, Artificial Sequence
  Synthetic
cgtagcaccacgtggctgc

SEQ ID NO: 24055 - DNA, 19 bp, Artificial Sequence
  Synthetic
cgctctccgggcacgtctt

SEQ ID NO: 24056 - DNA, 21 bp, Artificial Sequence
  Synthetic
cccgtgcctccttactacgga

SEQ ID NO: 24057 - DNA, 19 bp, Artificial Sequence
  Synthetic
aggcctctgcgtccggagt

SEQ ID NO: 24058 - DNA, 21 bp, Artificial Sequence
  Synthetic
ctggatgagggagcgccaatt

SEQ ID NO: 24059 - DNA, 19 bp, Artificial Sequence
  Synthetic
ccagggtccccacagtgga

SEQ ID NO: 24060 - DNA, 19 bp, Artificial Sequence
  Synthetic
gggcagttcctcgttgcgc

SEQ ID NO: 24061 - DNA, 19 bp, Artificial Sequence
  Synthetic
cagacgcccccagccctaa

SEQ ID NO: 24062 - DNA, 20 bp, Artificial Sequence
  Synthetic
ccaccaccgtcagggagtct

SEQ ID NO: 24063 - DNA, 19 bp, Artificial Sequence
  Synthetic
cacgttgctgggtggggga

SEQ ID NO: 24064 - DNA, 20 bp, Artificial Sequence
  Synthetic
ctgtcctcccagggacccga

SEQ ID NO: 24065 - DNA, 22 bp, Artificial Sequence
  Synthetic
ggtggttacaggagacgtgggt

SEQ ID NO: 24066 - DNA, 19 bp, Artificial Sequence
  Synthetic
cgtagctcaccgccagctc

SEQ ID NO: 24067 - DNA, 22 bp, Artificial Sequence
  Synthetic
aacgatggaatggccaccaggt

SEQ ID NO: 24068 - DNA, 19 bp, Artificial Sequence
  Synthetic
gcaccgtcaggcacctgtg

SEQ ID NO: 24069 - DNA, 22 bp, Artificial Sequence
  Synthetic
gagtctgcgatagagggccagg

SEQ ID NO: 24070 - DNA, 21 bp, Artificial Sequence
  Synthetic
cgtacgtgcgtgtctttgccc

SEQ ID NO: 24071 - DNA, 21 bp, Artificial Sequence
  Synthetic
tggactcagccaccttgtcgt

SEQ ID NO: 24072 - DNA, 19 bp, Artificial Sequence
  Synthetic
gccgctgggtgacacagac

SEQ ID NO: 24073 - DNA, 22 bp, Artificial Sequence
  Synthetic
tttcaggctttgcaaacacagt

SEQ ID NO: 24074 - DNA, 22 bp, Artificial Sequence
  Synthetic
atagggtggacggtgagcaacc

SEQ ID NO: 24075 - DNA, 23 bp, Artificial Sequence
  Synthetic
aacaacatgtttggactgggtag

SEQ ID NO: 24076 - DNA, 20 bp, Artificial Sequence
  Synthetic
agaagtacgcctgctgcatt

SEQ ID NO: 24077 - DNA, 25 bp, Artificial Sequence
  Synthetic
gtagacattataaacgagcagagca

SEQ ID NO: 24078 - DNA, 21 bp, Artificial Sequence
  Synthetic
tttgggtggggttgtcatttc

SEQ ID NO: 24079 - DNA, 25 bp, Artificial Sequence
  Synthetic
atgtgttgttatttaaggcaaggga

SEQ ID NO: 24080 - DNA, 24 bp, Artificial Sequence
  Synthetic
gctggaaaaaaaaaggctacactg

SEQ ID NO: 24081 - DNA, 22 bp, Artificial Sequence
  Synthetic
aaacctactgaccacggacccg

SEQ ID NO: 24082 - DNA, 25 bp, Artificial Sequence
  Synthetic
accaggatatatgtcattgtttgca

SEQ ID NO: 24083 - DNA, 25 bp, Artificial Sequence
  Synthetic
tactgctactacgtgtacataacct

SEQ ID NO: 24084 - DNA, 20 bp, Artificial Sequence
  Synthetic
ctcctactcctgtagtgccg

SEQ ID NO: 24085 - DNA, 25 bp, Artificial Sequence
  Synthetic
aaatcgtatagttgtccccaaagtg

SEQ ID NO: 24086 - DNA, 24 bp, Artificial Sequence
  Synthetic
gctgtttgatgttaatcctggtga

SEQ ID NO: 24087 - DNA, 25 bp, Artificial Sequence
  Synthetic
tatcagattatttcgaatggctgca

SEQ ID NO: 24088 - DNA, 20 bp, Artificial Sequence
  Synthetic
actggctacaacgtgcacag

SEQ ID NO: 24089 - DNA, 23 bp, Artificial Sequence
  Synthetic
ggtgatacctaccgctttttaca

SEQ ID NO: 24090 - DNA, 20 bp, Artificial Sequence
  Synthetic
cagtgaccatgccctgcctt

SEQ ID NO: 24091 - DNA, 24 bp, Artificial Sequence
  Synthetic
ccattgtttggggcatatagttgt

SEQ ID NO: 24092 - DNA, 22 bp, Artificial Sequence
  Synthetic
ataccacttctgtcactggctg

SEQ ID NO: 24093 - DNA, 20 bp, Artificial Sequence
  Synthetic
tcctgaagaggaggagcgac

SEQ ID NO: 24094 - DNA, 24 bp, Artificial Sequence
  Synthetic
aaaacgaaagtatctgacaagccc

SEQ ID NO: 24095 - DNA, 21 bp, Artificial Sequence
  Synthetic
tgaagttatgtgccagcctcc

SEQ ID NO: 24096 - DNA, 25 bp, Artificial Sequence
  Synthetic
ggcagcatggataaataaatgttgc

SEQ ID NO: 24097 - DNA, 23 bp, Artificial Sequence
  Synthetic
aaaagctggctattccgttgatg

SEQ ID NO: 24098 - DNA, 22 bp, Artificial Sequence
  Synthetic
agaagaaccaggtcccctcagc

SEQ ID NO: 24099 - DNA, 24 bp, Artificial Sequence
  Synthetic
attcctttggaaactttacctcca

SEQ ID NO: 24100 - DNA, 20 bp, Artificial Sequence
  Synthetic
ctgacccgattcctcccaga

SEQ ID NO: 24101 - DNA, 24 bp, Artificial Sequence
  Synthetic
agcccaatttcgactattgttgaa

SEQ ID NO: 24102 - DNA, 23 bp, Artificial Sequence
  Synthetic
aattgcctttcagatgacactgt

SEQ ID NO: 24103 - DNA, 21 bp, Artificial Sequence
  Synthetic
ggttgtgaaccagcgttaggt

SEQ ID NO: 24104 - DNA, 22 bp, Artificial Sequence
  Synthetic
tttcagctgaattgtcccagtt

SEQ ID NO: 24105 - DNA, 21 bp, Artificial Sequence
  Synthetic
ttgcggaacagcattaacaga

SEQ ID NO: 24106 - DNA, 22 bp, Artificial Sequence
  Synthetic
gcttgcctgcagtgttggaaac

SEQ ID NO: 24107 - DNA, 21 bp, Artificial Sequence
  Synthetic
ctccaggagcttctgttgggc

SEQ ID NO: 24108 - DNA, 21 bp, Artificial Sequence
  Synthetic
acagacagcaggaggcacaag

SEQ ID NO: 24109 - DNA, 20 bp, Artificial Sequence
  Synthetic
gcacagggggggtacaggaa

SEQ ID NO: 24110 - DNA, 23 bp, Artificial Sequence
  Synthetic
cagcaacactgtcaatatgcaca

SEQ ID NO: 24111 - DNA, 25 bp, Artificial Sequence
  Synthetic
agaaacaccagaatggattgtaaga

SEQ ID NO: 24112 - DNA, 24 bp, Artificial Sequence
  Synthetic
ggcacaaatgacaatgtcagaatg

SEQ ID NO: 24113 - DNA, 21 bp, Artificial Sequence
  Synthetic
gctgcagccattatgtgatgc

SEQ ID NO: 24114 - DNA, 23 bp, Artificial Sequence
  Synthetic
tgatgcaaactggaaatgcttct

SEQ ID NO: 24115 - DNA, 20 bp, Artificial Sequence
  Synthetic
acatggaccaaggtgtctgg

SEQ ID NO: 24116 - DNA, 22 bp, Artificial Sequence
  Synthetic
acagaagacaggatccagcggc

SEQ ID NO: 24117 - DNA, 21 bp, Artificial Sequence
  Synthetic
gatggtcaacgtgcagtaaca

SEQ ID NO: 24118 - DNA, 24 bp, Artificial Sequence
  Synthetic
tggcgttactgcttttcttattgt

SEQ ID NO: 24119 - DNA, 23 bp, Artificial Sequence
  Synthetic
atcctgtagtactgtggacacct

SEQ ID NO: 24120 - DNA, 19 bp, Artificial Sequence
  Synthetic
attgggacccgacccccca

SEQ ID NO: 24121 - DNA, 25 bp, Artificial Sequence
  Synthetic
acagaggaaaccatactatttgagc

SEQ ID NO: 24122 - DNA, 23 bp, Artificial Sequence
  Synthetic
gttcccaaggtgtctggatatca

SEQ ID NO: 24123 - DNA, 25 bp, Artificial Sequence
  Synthetic
acccagctatttattatagggtgca

SEQ ID NO: 24124 - DNA, 24 bp, Artificial Sequence
  Synthetic
tctgtttacgtagggaacagatgt

SEQ ID NO: 24125 - DNA, 24 bp, Artificial Sequence
  Synthetic
actacacgtagcaccaatatgact

SEQ ID NO: 24126 - DNA, 24 bp, Artificial Sequence
  Synthetic
gtactgttgtgtatgtatgggtgg

SEQ ID NO: 24127 - DNA, 20 bp, Artificial Sequence
  Synthetic
ccggtttcggtcgtgcacaa

SEQ ID NO: 24128 - DNA, 22 bp, Artificial Sequence
  Synthetic
tgagtgtcgtacagcctccagg

SEQ ID NO: 24129 - DNA, 20 bp, Artificial Sequence
  Synthetic
gcgcgcgacaaggaagactt

SEQ ID NO: 24130 - DNA, 19 bp, Artificial Sequence
  Synthetic
cgccagagctctcgcgcat

SEQ ID NO: 24131 - DNA, 21 bp, Artificial Sequence
  Synthetic
tctcaccgaatgtggccgtgc

SEQ ID NO: 24132 - DNA, 20 bp, Artificial Sequence
  Synthetic
cgtcatgttcggcttggcct

SEQ ID NO: 24133 - DNA, 20 bp, Artificial Sequence
  Synthetic
ggatggggcgccttgcaata

SEQ ID NO: 24134 - DNA, 20 bp, Artificial Sequence
  Synthetic
tgacttcaacgccagcacgg

SEQ ID NO: 24135 - DNA, 22 bp, Artificial Sequence
  Synthetic
ccttgctcttactcggacctgc

SEQ ID NO: 24136 - DNA, 21 bp, Artificial Sequence
  Synthetic
attccctcactggcctgtggt

SEQ ID NO: 24137 - DNA, 22 bp, Artificial Sequence
  Synthetic
ctaaaaggtgctttgacgcgcg

SEQ ID NO: 24138 - DNA, 22 bp, Artificial Sequence
  Synthetic
tggcccagctgatggctatacc

SEQ ID NO: 24139 - DNA, 22 bp, Artificial Sequence
  Synthetic
tcacgcagatgtactccagtgc

SEQ ID NO: 24140 - DNA, 21 bp, Artificial Sequence
  Synthetic
caggtcgggtacttgcatgcc

SEQ ID NO: 24141 - DNA, 22 bp, Artificial Sequence
  Synthetic
ctaccaccatccttggcatcgg

SEQ ID NO: 24142 - DNA, 20 bp, Artificial Sequence
  Synthetic
caccgacgccctcatgacag

SEQ ID NO: 24143 - DNA, 20 bp, Artificial Sequence
  Synthetic
ccgtcaggctcagggcgtat

SEQ ID NO: 24144 - DNA, 22 bp, Artificial Sequence
  Synthetic
atacatcgccacctgcatgcaa

SEQ ID NO: 24145 - DNA, 22 bp, Artificial Sequence
  Synthetic
ttctgggccaaacacatgtgga

SEQ ID NO: 24146 - DNA, 22 bp, Artificial Sequence
  Synthetic
tgtcgtcaacttgctgcctgga

SEQ ID NO: 24147 - DNA, 20 bp, Artificial Sequence
  Synthetic
cgaaacccgcgccaaacttt

SEQ ID NO: 24148 - DNA, 18 bp, Artificial Sequence
  Synthetic
cgtttagcgcgggggtca

SEQ ID NO: 24149 - DNA, 20 bp, Artificial Sequence
  Synthetic
cctgggcacggcctgattac

SEQ ID NO: 24150 - DNA, 22 bp, Artificial Sequence
  Synthetic
acctggagcctgagcaggtaga

SEQ ID NO: 24151 - DNA, 20 bp, Artificial Sequence
  Synthetic
cgcaaggctcctcaccatgg

SEQ ID NO: 24152 - DNA, 22 bp, Artificial Sequence
  Synthetic
tggattccagtattcccccgct

SEQ ID NO: 24153 - DNA, 20 bp, Artificial Sequence
  Synthetic
aatcgcgcccacaatgctgg

SEQ ID NO: 24154 - DNA, 20 bp, Artificial Sequence
  Synthetic
gggctgcctgggaaacagtt

SEQ ID NO: 24155 - DNA, 19 bp, Artificial Sequence
  Synthetic
ccacccctcagagcgtgga

SEQ ID NO: 24156 - DNA, 21 bp, Artificial Sequence
  Synthetic
cgcgattgatgcggatttgcc

SEQ ID NO: 24157 - DNA, 20 bp, Artificial Sequence
  Synthetic
cgaggtgggcgtaacgcttg

SEQ ID NO: 24158 - DNA, 21 bp, Artificial Sequence
  Synthetic
tcatgcccgggaagagtttgc

SEQ ID NO: 24159 - DNA, 19 bp, Artificial Sequence
  Synthetic
gggcggacaatgccgtctg

SEQ ID NO: 24160 - DNA, 20 bp, Artificial Sequence
  Synthetic
cagcgtcagtccgaacgtcc

SEQ ID NO: 24161 - DNA, 22 bp, Artificial Sequence
  Synthetic
gcgaaccgaaaacccaataccg

SEQ ID NO: 24162 - DNA, 22 bp, Artificial Sequence
  Synthetic
gaccaatacatcggcggcatcg

SEQ ID NO: 24163 - DNA, 20 bp, Artificial Sequence
  Synthetic
gcaaaatcaccgtcgccgcc

SEQ ID NO: 24164 - DNA, 20 bp, Artificial Sequence
  Synthetic
gctcccaagccgaaacgtga

SEQ ID NO: 24165 - DNA, 19 bp, Artificial Sequence
  Synthetic
gtgatgcggccgccgactt

SEQ ID NO: 24166 - DNA, 21 bp, Artificial Sequence
  Synthetic
aaccgggaatcaggtcggtgg

SEQ ID NO: 24167 - DNA, 19 bp, Artificial Sequence
  Synthetic
ggggtgtgcgtgccggaaa

SEQ ID NO: 24168 - DNA, 20 bp, Artificial Sequence
  Synthetic
ccgcccgcgacaatgtagtt

SEQ ID NO: 24169 - DNA, 20 bp, Artificial Sequence
  Synthetic
gcgcttttgggcgaacagcg

SEQ ID NO: 24170 - DNA, 19 bp, Artificial Sequence
  Synthetic
ggcagggaataccgcccgt

SEQ ID NO: 24171 - DNA, 19 bp, Artificial Sequence
  Synthetic
ccgccctgcaagccgatgt

SEQ ID NO: 24172 - DNA, 22 bp, Artificial Sequence
  Synthetic
gcttcctgccatttgctgtcgg

SEQ ID NO: 24173 - DNA, 20 bp, Artificial Sequence
  Synthetic
agtttcaccgccaccaacgc

SEQ ID NO: 24174 - DNA, 19 bp, Artificial Sequence
  Synthetic
ttcgtcccaagccggacac

SEQ ID NO: 24175 - DNA, 19 bp, Artificial Sequence
  Synthetic
ccgcgtttcgggcaactcg

SEQ ID NO: 24176 - DNA, 18 bp, Artificial Sequence
  Synthetic
ggtacgcgccgtggatga

SEQ ID NO: 24177 - DNA, 20 bp, Artificial Sequence
  Synthetic
ccgctttgccgtggaacagt

SEQ ID NO: 24178 - DNA, 19 bp, Artificial Sequence
  Synthetic
tgcaggtggaggtagcgcg

SEQ ID NO: 24179 - DNA, 20 bp, Artificial Sequence
  Synthetic
tagagcagttcggcgtgtgc

SEQ ID NO: 24180 - DNA, 22 bp, Artificial Sequence
  Synthetic
gccgccctaccgacttgataat

SEQ ID NO: 24181 - DNA, 20 bp, Artificial Sequence
  Synthetic
cgcgtgtcgcccaaaatgac

SEQ ID NO: 24182 - DNA, 22 bp, Artificial Sequence
  Synthetic
ccaaaaacgcctcgaatcgtgg

SEQ ID NO: 24183 - DNA, 21 bp, Artificial Sequence
  Synthetic
ttatgccgtctgtcgaacggc

SEQ ID NO: 24184 - DNA, 19 bp, Artificial Sequence
  Synthetic
ggcggagagtgcaccgtgt

SEQ ID NO: 24185 - DNA, 22 bp, Artificial Sequence
  Synthetic
ttcgggccgatgaaggtaaagc

SEQ ID NO: 24186 - DNA, 22 bp, Artificial Sequence
  Synthetic
gattcgtcggcgagtttgacgt

SEQ ID NO: 24187 - DNA, 18 bp, Artificial Sequence
  Synthetic
cgccggtggctttggaga

SEQ ID NO: 24188 - DNA, 21 bp, Artificial Sequence
  Synthetic
acgtcttccaatgtcagcggc

SEQ ID NO: 24189 - DNA, 19 bp, Artificial Sequence
  Synthetic
cgggtgtcgatgtcggcga

SEQ ID NO: 24190 - DNA, 18 bp, Artificial Sequence
  Synthetic
cgatgtgcgcgacaggga

SEQ ID NO: 24191 - DNA, 19 bp, Artificial Sequence
  Synthetic
ggcgttgcccagttgcagg

SEQ ID NO: 24192 - DNA, 20 bp, Artificial Sequence
  Synthetic
cctgcgaaatgctggtcgga

SEQ ID NO: 24193 - DNA, 20 bp, Artificial Sequence
  Synthetic
cgctcccttgcctacgatgc

SEQ ID NO: 24194 - DNA, 20 bp, Artificial Sequence
  Synthetic
gaccccagcttcaaagccgc

SEQ ID NO: 24195 - DNA, 20 bp, Artificial Sequence
  Synthetic
gttccgaccagtggggcaac

SEQ ID NO: 24196 - DNA, 21 bp, Artificial Sequence
  Synthetic
atcagccccctgcgtaccaaa

SEQ ID NO: 24197 - DNA, 22 bp, Artificial Sequence
  Synthetic
tcagtggtttgtcggcatggac

SEQ ID NO: 24198 - DNA, 19 bp, Artificial Sequence
  Synthetic
ccgccgccatcgagccttt

SEQ ID NO: 24199 - DNA, 19 bp, Artificial Sequence
  Synthetic
catggcagggcaggccgaa

SEQ ID NO: 24200 - DNA, 22 bp, Artificial Sequence
  Synthetic
tcttcgaggctgacgaaggcga

SEQ ID NO: 24201 - DNA, 20 bp, Artificial Sequence
  Synthetic
tcgatgctgtcgaacgcgcc

SEQ ID NO: 24202 - DNA, 22 bp, Artificial Sequence
  Synthetic
gattcgtccgcctgatacacgg

SEQ ID NO: 24203 - DNA, 18 bp, Artificial Sequence
  Synthetic
tgcggcgaggcgtgcatt

SEQ ID NO: 24204 - DNA, 21 bp, Artificial Sequence
  Synthetic
cgtccaaacgcgccatttcgc

SEQ ID NO: 24205 - DNA, 18 bp, Artificial Sequence
  Synthetic
tcgtgccacggcagcatg

SEQ ID NO: 24206 - DNA, 19 bp, Artificial Sequence
  Synthetic
cgccacggcgtgttgtcga

SEQ ID NO: 24207 - DNA, 21 bp, Artificial Sequence
  Synthetic
tgtttggtccgtcgggttcgg

SEQ ID NO: 24208 - DNA, 21 bp, Artificial Sequence
  Synthetic
aacaaccagaatgaggcggca

SEQ ID NO: 24209 - DNA, 21 bp, Artificial Sequence
  Synthetic
gcggcaacatgcacgatacga

SEQ ID NO: 24210 - DNA, 18 bp, Artificial Sequence
  Synthetic
ccgtcagcggcaacagca

SEQ ID NO: 24211 - DNA, 19 bp, Artificial Sequence
  Synthetic
gccgccgtctgcatcagca

SEQ ID NO: 24212 - DNA, 20 bp, Artificial Sequence
  Synthetic
cggcacgcaaaacctgtacg

SEQ ID NO: 24213 - DNA, 22 bp, Artificial Sequence
  Synthetic
cgttgtgcattgaagggcgaac

SEQ ID NO: 24214 - DNA, 19 bp, Artificial Sequence
  Synthetic
cggcgacgggggaatttgc

SEQ ID NO: 24215 - DNA, 22 bp, Artificial Sequence
  Synthetic
cgccgtaacccatttccgcttc

SEQ ID NO: 24216 - DNA, 22 bp, Artificial Sequence
  Synthetic
caacacgctgttgggtatggga

SEQ ID NO: 24217 - DNA, 19 bp, Artificial Sequence
  Synthetic
tttgccgtatccgggcggt

SEQ ID NO: 24218 - DNA, 20 bp, Artificial Sequence
  Synthetic
ggtggaacggaagctgctgg

SEQ ID NO: 24219 - DNA, 22 bp, Artificial Sequence
  Synthetic
ccgctgtcggcttcaaaatggt

SEQ ID NO: 24220 - DNA, 19 bp, Artificial Sequence
  Synthetic
gtttgcgcgtcagctcgac

SEQ ID NO: 24221 - DNA, 21 bp, Artificial Sequence
  Synthetic
ttttccggcaggagcttgtcg

SEQ ID NO: 24222 - DNA, 21 bp, Artificial Sequence
  Synthetic
gcgtgccgcagattttcatcg

SEQ ID NO: 24223 - DNA, 22 bp, Artificial Sequence
  Synthetic
aagcctgcgccttttgcattcg

SEQ ID NO: 24224 - DNA, 21 bp, Artificial Sequence
  Synthetic
aagtcggcgtagatgtgccca

SEQ ID NO: 24225 - DNA, 22 bp, Artificial Sequence
  Synthetic
aaccctgaaatcgtcgaagcgc

SEQ ID NO: 24226 - DNA, 19 bp, Artificial Sequence
  Synthetic
gaaccggcgggcaggatgt

SEQ ID NO: 24227 - DNA, 19 bp, Artificial Sequence
  Synthetic
ccggcgatggtctgcctga

SEQ ID NO: 24228 - DNA, 20 bp, Artificial Sequence
  Synthetic
aaaggtcgatgacgcgcacg

SEQ ID NO: 24229 - DNA, 20 bp, Artificial Sequence
  Synthetic
aatcggcaactgcggttccc

SEQ ID NO: 24230 - DNA, 20 bp, Artificial Sequence
  Synthetic
gctttcagacgacgtcaggt

SEQ ID NO: 24231 - DNA, 20 bp, Artificial Sequence
  Synthetic
gcaaggtcggcggcgcttta

SEQ ID NO: 24232 - DNA, 21 bp, Artificial Sequence
  Synthetic
catgttgcgcgggatttctgg

SEQ ID NO: 24233 - DNA, 19 bp, Artificial Sequence
  Synthetic
gggcatgaccgccgccata

SEQ ID NO: 24234 - DNA, 22 bp, Artificial Sequence
  Synthetic
aacgtggtcgatgtggttgcag

SEQ ID NO: 24235 - DNA, 19 bp, Artificial Sequence
  Synthetic
atgccgaacgtcccccagc

SEQ ID NO: 24236 - DNA, 21 bp, Artificial Sequence
  Synthetic
aggcagtggagtcgaggatgt

SEQ ID NO: 24237 - DNA, 18 bp, Artificial Sequence
  Synthetic
gggttgccgccgaccaaa

SEQ ID NO: 24238 - DNA, 20 bp, Artificial Sequence
  Synthetic
ttgatgccgacgacctgtcc

SEQ ID NO: 24239 - DNA, 21 bp, Artificial Sequence
  Synthetic
gcttcgccgtcgccttgttta

SEQ ID NO: 24240 - DNA, 22 bp, Artificial Sequence
  Synthetic
ttcgcgcccaaccgttatttgg

SEQ ID NO: 24241 - DNA, 21 bp, Artificial Sequence
  Synthetic
aaaaccctgcaccgcagtgat

SEQ ID NO: 24242 - DNA, 19 bp, Artificial Sequence
  Synthetic
gtagcgcgctgatgcagga

SEQ ID NO: 24243 - DNA, 19 bp, Artificial Sequence
  Synthetic
cgcaaggcaggccgtggtt

SEQ ID NO: 24244 - DNA, 20 bp, Artificial Sequence
  Synthetic
gggttcggacggcatctgtc

SEQ ID NO: 24245 - DNA, 22 bp, Artificial Sequence
  Synthetic
agccataagctgcccgtttcgg

SEQ ID NO: 24246 - DNA, 20 bp, Artificial Sequence
  Synthetic
gggtatggacggcagcaagg

SEQ ID NO: 24247 - DNA, 19 bp, Artificial Sequence
  Synthetic
tgctcctgctcgcccacga

SEQ ID NO: 24248 - DNA, 18 bp, Artificial Sequence
  Synthetic
agacggatgcgagggcgt

SEQ ID NO: 24249 - DNA, 21 bp, Artificial Sequence
  Synthetic
gggtaccttccacgacgcgta

SEQ ID NO: 24250 - DNA, 19 bp, Artificial Sequence
  Synthetic
ctgcgggcagttcgttggt

SEQ ID NO: 24251 - DNA, 21 bp, Artificial Sequence
  Synthetic
tttgggcgtgtcgtgtgttcc

SEQ ID NO: 24252 - DNA, 19 bp, Artificial Sequence
  Synthetic
gcaaggtggcggctgtcga

SEQ ID NO: 24253 - DNA, 21 bp, Artificial Sequence
  Synthetic
gccgctgcaagggcttttttg

SEQ ID NO: 24254 - DNA, 20 bp, Artificial Sequence
  Synthetic
tccgttgcggatgtggtggg

SEQ ID NO: 24255 - DNA, 22 bp, Artificial Sequence
  Synthetic
atgaggaagttgcagtgtcggg

SEQ ID NO: 24256 - DNA, 21 bp, Artificial Sequence
  Synthetic
tgtgcaggctgtgtccgaagc

SEQ ID NO: 24257 - DNA, 20 bp, Artificial Sequence
  Synthetic
ggtgcgttgttctgttcgcc

SEQ ID NO: 24258 - DNA, 20 bp, Artificial Sequence
  Synthetic
ggaggcggtcagtatgccga

SEQ ID NO: 24259 - DNA, 22 bp, Artificial Sequence
  Synthetic
tttccgcaggttcggctgtact

SEQ ID NO: 24260 - DNA, 20 bp, Artificial Sequence
  Synthetic
aggctgtgttcgagttcggg

SEQ ID NO: 24261 - DNA, 20 bp, Artificial Sequence
  Synthetic
gggaagcggccgatgtgttt

SEQ ID NO: 24262 - DNA, 20 bp, Artificial Sequence
  Synthetic
gcttttcgcgtgatgccccg

SEQ ID NO: 24263 - DNA, 19 bp, Artificial Sequence
  Synthetic
ggtgcaggcggggtggaaa

SEQ ID NO: 24264 - DNA, 24 bp, Artificial Sequence
  Synthetic
ttgatggctttaggttttgtcgtt

SEQ ID NO: 24265 - DNA, 19 bp, Artificial Sequence
  Synthetic
caggttgcggctgccttct

SEQ ID NO: 24266 - DNA, 19 bp, Artificial Sequence
  Synthetic
caggtgtcgccgctgacga

SEQ ID NO: 24267 - DNA, 21 bp, Artificial Sequence
  Synthetic
agcgtgtgttttcggggttga

SEQ ID NO: 24268 - DNA, 19 bp, Artificial Sequence
  Synthetic
ccgacggtcagcgggatga

SEQ ID NO: 24269 - DNA, 20 bp, Artificial Sequence
  Synthetic
acgccatgtttttcggcggc

SEQ ID NO: 24270 - DNA, 18 bp, Artificial Sequence
  Synthetic
tggcactgcgttggacgg

SEQ ID NO: 24271 - DNA, 18 bp, Artificial Sequence
  Synthetic
agcgcgtcggcatcggta

SEQ ID NO: 24272 - DNA, 21 bp, Artificial Sequence
  Synthetic
aaccagtcgtcgcttttgcct

SEQ ID NO: 24273 - DNA, 19 bp, Artificial Sequence
  Synthetic
ctcttgcgccgtcctgcct

SEQ ID NO: 24274 - DNA, 18 bp, Artificial Sequence
  Synthetic
agcagggtggcggtcaac

SEQ ID NO: 24275 - DNA, 18 bp, Artificial Sequence
  Synthetic
cgcctttgccgcgtgttt

SEQ ID NO: 24276 - DNA, 20 bp, Artificial Sequence
  Synthetic
gtttgcgacagtcggccatg

SEQ ID NO: 24277 - DNA, 22 bp, Artificial Sequence
  Synthetic
ttcgacaatgccggtaatgcgt

SEQ ID NO: 24278 - DNA, 21 bp, Artificial Sequence
  Synthetic
gacgtgttcctcgggttgcag

SEQ ID NO: 24279 - DNA, 19 bp, Artificial Sequence
  Synthetic
agccttcaacggcactgca

SEQ ID NO: 24280 - DNA, 20 bp, Artificial Sequence
  Synthetic
ccggcaaaatgcaggcaggc

SEQ ID NO: 24281 - DNA, 19 bp, Artificial Sequence
  Synthetic
acgatgatgcccatcccgc

SEQ ID NO: 24282 - DNA, 20 bp, Artificial Sequence
  Synthetic
ggagagggcggcgggtatca

SEQ ID NO: 24283 - DNA, 22 bp, Artificial Sequence
  Synthetic
tcgaaacagccttggatgtcgc

SEQ ID NO: 24284 - DNA, 19 bp, Artificial Sequence
  Synthetic
ttttggacacgctgccgga

SEQ ID NO: 24285 - DNA, 22 bp, Artificial Sequence
  Synthetic
gaacggattcggtttgcttggc

SEQ ID NO: 24286 - DNA, 19 bp, Artificial Sequence
  Synthetic
ggtatgctgggcgcgtcga

SEQ ID NO: 24287 - DNA, 22 bp, Artificial Sequence
  Synthetic
aagccacttcgataaaggcggc

SEQ ID NO: 24288 - DNA, 22 bp, Artificial Sequence
  Synthetic
tcggcaatctggaaatggtcgt

SEQ ID NO: 24289 - DNA, 19 bp, Artificial Sequence
  Synthetic
cacttctcccgcccccgaa

SEQ ID NO: 24290 - DNA, 20 bp, Artificial Sequence
  Synthetic
accgcatccgtgccgtattc

SEQ ID NO: 24291 - DNA, 19 bp, Artificial Sequence
  Synthetic
acaggcgcgcgagaaagac

SEQ ID NO: 24292 - DNA, 18 bp, Artificial Sequence
  Synthetic
aaacaggtgcgccgacgg

SEQ ID NO: 24293 - DNA, 19 bp, Artificial Sequence
  Synthetic
tcctgtggcacggctaccc

SEQ ID NO: 24294 - DNA, 19 bp, Artificial Sequence
  Synthetic
cgccgtgcggttgccgata

SEQ ID NO: 24295 - DNA, 18 bp, Artificial Sequence
  Synthetic
cccgaaggcagcgcgttt

SEQ ID NO: 24296 - DNA, 19 bp, Artificial Sequence
  Synthetic
agccgcccgcctcgttttg

SEQ ID NO: 24297 - DNA, 22 bp, Artificial Sequence
  Synthetic
aggcgcacaaattcttcctcgg

SEQ ID NO: 24298 - DNA, 18 bp, Artificial Sequence
  Synthetic
gcgatgtttgccgccgtc

SEQ ID NO: 24299 - DNA, 21 bp, Artificial Sequence
  Synthetic
ggtggttttcgtcgtggaggc

SEQ ID NO: 24300 - DNA, 19 bp, Artificial Sequence
  Synthetic
ccggtgatgcggacggctt

SEQ ID NO: 24301 - DNA, 20 bp, Artificial Sequence
  Synthetic
tcgctgtcggtttgcgaacc

SEQ ID NO: 24302 - DNA, 20 bp, Artificial Sequence
  Synthetic
cgttttcggcggcggatttc

SEQ ID NO: 24303 - DNA, 21 bp, Artificial Sequence
  Synthetic
gtctgtcgtcgaggcattcca

SEQ ID NO: 24304 - DNA, 22 bp, Artificial Sequence
  Synthetic
acgaaaacggccaagtcttggg

SEQ ID NO: 24305 - DNA, 24 bp, Artificial Sequence
  Synthetic
cctgttaacaagaaacggttttgc

SEQ ID NO: 24306 - DNA, 20 bp, Artificial Sequence
  Synthetic
cgactaccgttgctatgcgt

SEQ ID NO: 24307 - DNA, 18 bp, Artificial Sequence
  Synthetic
aattccgcgcgcgggcat

SEQ ID NO: 24308 - DNA, 19 bp, Artificial Sequence
  Synthetic
gccaaccatccgcttgccg

SEQ ID NO: 24309 - DNA, 19 bp, Artificial Sequence
  Synthetic
gcactgtttgccgagcgcg

SEQ ID NO: 24310 - DNA, 19 bp, Artificial Sequence
  Synthetic
tgaagggcgatgtcccgcg

SEQ ID NO: 24311 - DNA, 22 bp, Artificial Sequence
  Synthetic
ggctttggggcgacaaacagac

SEQ ID NO: 24312 - DNA, 20 bp, Artificial Sequence
  Synthetic
gccagcggctttccacaatg

SEQ ID NO: 24313 - DNA, 19 bp, Artificial Sequence
  Synthetic
aacgacgacgcgcaggtgg

SEQ ID NO: 24314 - DNA, 19 bp, Artificial Sequence
  Synthetic
gtttgcccgaacgtgcggt

SEQ ID NO: 24315 - DNA, 21 bp, Artificial Sequence
  Synthetic
gcagggcagtgtgtatccagt

SEQ ID NO: 24316 - DNA, 21 bp, Artificial Sequence
  Synthetic
aaacagtcatgccgatgccga

SEQ ID NO: 24317 - DNA, 22 bp, Artificial Sequence
  Synthetic
acgcatgatatttggctggcgg

SEQ ID NO: 24318 - DNA, 21 bp, Artificial Sequence
  Synthetic
cgccgtacacgaggtcttccg

SEQ ID NO: 24319 - DNA, 22 bp, Artificial Sequence
  Synthetic
aaccgtttacaccggaagatgt

SEQ ID NO: 24320 - DNA, 20 bp, Artificial Sequence
  Synthetic
atggtgatgatgattgcgcc

SEQ ID NO: 24321 - DNA, 22 bp, Artificial Sequence
  Synthetic
agaagtaacaggccgtctgaaa

SEQ ID NO: 24322 - DNA, 21 bp, Artificial Sequence
  Synthetic
tcatcgtcgaagaaagcggct

SEQ ID NO: 24323 - DNA, 19 bp, Artificial Sequence
  Synthetic
gtagggcggcgaggttggt

SEQ ID NO: 24324 - DNA, 22 bp, Artificial Sequence
  Synthetic
tccgagtccgaagcatcttgtg

SEQ ID NO: 24325 - DNA, 22 bp, Artificial Sequence
  Synthetic
tcgctgctcatcaggctaaggt

SEQ ID NO: 24326 - DNA, 22 bp, Artificial Sequence
  Synthetic
gttctttacgtttttgtggggc

SEQ ID NO: 24327 - DNA, 22 bp, Artificial Sequence
  Synthetic
aggcgtggatttccgttaccgt

SEQ ID NO: 24328 - DNA, 24 bp, Artificial Sequence
  Synthetic
gcatttttcggtatcggtgtaacg

SEQ ID NO: 24329 - DNA, 19 bp, Artificial Sequence
  Synthetic
ggcgtggcgatgattgccg

SEQ ID NO: 24330 - DNA, 21 bp, Artificial Sequence
  Synthetic
taagccaagccgttgcaaccg

SEQ ID NO: 24331 - DNA, 21 bp, Artificial Sequence
  Synthetic
acgtctggctttccattcggg

SEQ ID NO: 24332 - DNA, 21 bp, Artificial Sequence
  Synthetic
cctaccgtttttctgcttgcg

SEQ ID NO: 24333 - DNA, 20 bp, Artificial Sequence
  Synthetic
gcgtattgtctgtgcgcgga

SEQ ID NO: 24334 - DNA, 22 bp, Artificial Sequence
  Synthetic
cgaaaacacagcttccgaaccg

SEQ ID NO: 24335 - DNA, 21 bp, Artificial Sequence
  Synthetic
gcggcgaagatgaatgccaac

SEQ ID NO: 24336 - DNA, 22 bp, Artificial Sequence
  Synthetic
tgcactgaagccgagtattccg

SEQ ID NO: 24337 - DNA, 22 bp, Artificial Sequence
  Synthetic
gaccccgaacacgccaaaatct

SEQ ID NO: 24338 - DNA, 21 bp, Artificial Sequence
  Synthetic
aagcccaatgggagaaatcgt

SEQ ID NO: 24339 - DNA, 21 bp, Artificial Sequence
  Synthetic
acgcttcgaccgtccaatccc

SEQ ID NO: 24340 - DNA, 22 bp, Artificial Sequence
  Synthetic
ggcaacggcgtaaatcagtgcc

SEQ ID NO: 24341 - DNA, 19 bp, Artificial Sequence
  Synthetic
gacggtttcgcggctgtct

SEQ ID NO: 24342 - DNA, 21 bp, Artificial Sequence
  Synthetic
ccagcccgcgatcctgataca

SEQ ID NO: 24343 - DNA, 22 bp, Artificial Sequence
  Synthetic
aggagtggtaaccatgccgaca

SEQ ID NO: 24344 - DNA, 20 bp, Artificial Sequence
  Synthetic
gacttgttcgggcagcccca

SEQ ID NO: 24345 - DNA, 22 bp, Artificial Sequence
  Synthetic
ggcggttttgattttggagccg

SEQ ID NO: 24346 - DNA, 20 bp, Artificial Sequence
  Synthetic
acggtttatctgcccgccga

SEQ ID NO: 24347 - DNA, 19 bp, Artificial Sequence
  Synthetic
gaacgcaggctgccgagca

SEQ ID NO: 24348 - DNA, 20 bp, Artificial Sequence
  Synthetic
ggtgttgttcggcggcaagg

SEQ ID NO: 24349 - DNA, 18 bp, Artificial Sequence
  Synthetic
cggctgccgtgtcggtaa

SEQ ID NO: 24350 - DNA, 20 bp, Artificial Sequence
  Synthetic
agagcggcatatcgggatgc

SEQ ID NO: 24351 - DNA, 20 bp, Artificial Sequence
  Synthetic
tcgtcggcgtgtttaagcgc

SEQ ID NO: 24352 - DNA, 18 bp, Artificial Sequence
  Synthetic
tttgcccgccgtcgaacg

SEQ ID NO: 24353 - DNA, 21 bp, Artificial Sequence
  Synthetic
gttgtcgtttcccccgaagcc

SEQ ID NO: 24354 - DNA, 19 bp, Artificial Sequence
  Synthetic
gcatcggccctgcctacga

SEQ ID NO: 24355 - DNA, 20 bp, Artificial Sequence
  Synthetic
cgcgcgtcatatggtcgagc

SEQ ID NO: 24356 - DNA, 19 bp, Artificial Sequence
  Synthetic
atctggtgatgggccgccc

SEQ ID NO: 24357 - DNA, 20 bp, Artificial Sequence
  Synthetic
gcgcgaactcgaaaaaccgc

SEQ ID NO: 24358 - DNA, 22 bp, Artificial Sequence
  Synthetic
tggtggaaggcttcgaacatcg

SEQ ID NO: 24359 - DNA, 19 bp, Artificial Sequence
  Synthetic
ggccgggtttcgaccgtgt

SEQ ID NO: 24360 - DNA, 21 bp, Artificial Sequence
  Synthetic
gcccaattggaaaagggcagc

SEQ ID NO: 24361 - DNA, 19 bp, Artificial Sequence
  Synthetic
ccggcatccgcgccttgtt

SEQ ID NO: 24362 - DNA, 22 bp, Artificial Sequence
  Synthetic
accgtccgaccatcgtgtttgc

SEQ ID NO: 24363 - DNA, 21 bp, Artificial Sequence
  Synthetic
gacgagttccacgtcgttcgc

SEQ ID NO: 24364 - DNA, 19 bp, Artificial Sequence
  Synthetic
ggatgttgggcgcgggcat

SEQ ID NO: 24365 - DNA, 19 bp, Artificial Sequence
  Synthetic
gcgtgtcgggcaggtaggt

SEQ ID NO: 24366 - DNA, 22 bp, Artificial Sequence
  Synthetic
gtctgtgcccacatcggtctga

SEQ ID NO: 24367 - DNA, 20 bp, Artificial Sequence
  Synthetic
cgggaacggctctggcaacc

SEQ ID NO: 24368 - DNA, 19 bp, Artificial Sequence
  Synthetic
gacaaaggcgtgctggcgg

SEQ ID NO: 24369 - DNA, 22 bp, Artificial Sequence
  Synthetic
atacgcttagggtgtctgatcg

SEQ ID NO: 24370 - DNA, 22 bp, Artificial Sequence
  Synthetic
aagggttcgtccaaaagcagga

SEQ ID NO: 24371 - DNA, 22 bp, Artificial Sequence
  Synthetic
aacgttgtgaaacggtttgcgc

SEQ ID NO: 24372 - DNA, 20 bp, Artificial Sequence
  Synthetic
ggagttgccgcgttggaagt

SEQ ID NO: 24373 - DNA, 21 bp, Artificial Sequence
  Synthetic
ttctgcggatgtttttctccg

SEQ ID NO: 24374 - DNA, 19 bp, Artificial Sequence
  Synthetic
ggacagccggttccggtca

SEQ ID NO: 24375 - DNA, 22 bp, Artificial Sequence
  Synthetic
tcatcttgttgctgatggcgga

SEQ ID NO: 24376 - DNA, 21 bp, Artificial Sequence
  Synthetic
cggcaaccggcttcttcttcc

SEQ ID NO: 24377 - DNA, 19 bp, Artificial Sequence
  Synthetic
ctgacggcgcggcattcct

SEQ ID NO: 24378 - DNA, 19 bp, Artificial Sequence
  Synthetic
tgcgagatgctgggaacgg

SEQ ID NO: 24379 - DNA, 22 bp, Artificial Sequence
  Synthetic
gcgtgaaaccaagacattcggc

SEQ ID NO: 24380 - DNA, 22 bp, Artificial Sequence
  Synthetic
accgttattggcggatttggcg

SEQ ID NO: 24381 - DNA, 22 bp, Artificial Sequence
  Synthetic
ttggacaacgccctgaaggttg

SEQ ID NO: 24382 - DNA, 19 bp, Artificial Sequence
  Synthetic
ggctgaaatcaggcggcgc

SEQ ID NO: 24383 - DNA, 19 bp, Artificial Sequence
  Synthetic
tcgccgtcgccgtcagcta

SEQ ID NO: 24384 - DNA, 20 bp, Artificial Sequence
  Synthetic
agggcaattcgacgatgttg

SEQ ID NO: 24385 - DNA, 19 bp, Artificial Sequence
  Synthetic
gaagcgaggtcaggcggca

SEQ ID NO: 24386 - DNA, 22 bp, Artificial Sequence
  Synthetic
agccgataatcaggcgtgttgc

SEQ ID NO: 24387 - DNA, 19 bp, Artificial Sequence
  Synthetic
ggcgatggcggacggtatg

SEQ ID NO: 24388 - DNA, 20 bp, Artificial Sequence
  Synthetic
gcacatttttcggggcgcat

SEQ ID NO: 24389 - DNA, 20 bp, Artificial Sequence
  Synthetic
gtgattccggctgttcgcgg

SEQ ID NO: 24390 - DNA, 19 bp, Artificial Sequence
  Synthetic
tgccgaagcagaagccgaa

SEQ ID NO: 24391 - DNA, 19 bp, Artificial Sequence
  Synthetic
gcctcctggccgccgatta

SEQ ID NO: 24392 - DNA, 19 bp, Artificial Sequence
  Synthetic
taaggcttcgctgcgccag

SEQ ID NO: 24393 - DNA, 19 bp, Artificial Sequence
  Synthetic
agcaggaagccgcacaagc

SEQ ID NO: 24394 - DNA, 18 bp, Artificial Sequence
  Synthetic
cggcgcgcgggtcaaaat

SEQ ID NO: 24395 - DNA, 22 bp, Artificial Sequence
  Synthetic
gctgcatgaggacgctctatga

SEQ ID NO: 24396 - DNA, 20 bp, Artificial Sequence
  Synthetic
gcaggacggtcaaggcacac

SEQ ID NO: 24397 - DNA, 22 bp, Artificial Sequence
  Synthetic
tgctgacattgtgctacgtcga

SEQ ID NO: 24398 - DNA, 21 bp, Artificial Sequence
  Synthetic
aagcatcaacggcttggaggc

SEQ ID NO: 24399 - DNA, 22 bp, Artificial Sequence
  Synthetic
tggtggacacgcagaaaaaccg

SEQ ID NO: 24400 - DNA, 19 bp, Artificial Sequence
  Synthetic
cgccgccctgccttgtgaa

SEQ ID NO: 24401 - DNA, 22 bp, Artificial Sequence
  Synthetic
acatcgggcatttcttcccagc

SEQ ID NO: 24402 - DNA, 19 bp, Artificial Sequence
  Synthetic
atacggctgcatcgcggtc

SEQ ID NO: 24403 - DNA, 19 bp, Artificial Sequence
  Synthetic
cggaacgcctcaaagccgc

SEQ ID NO: 24404 - DNA, 22 bp, Artificial Sequence
  Synthetic
gtcaaatcgtggtttgacgggc

SEQ ID NO: 24405 - DNA, 20 bp, Artificial Sequence
  Synthetic
aaaagccgggcgcaaatcag

SEQ ID NO: 24406 - DNA, 21 bp, Artificial Sequence
  Synthetic
ccaaatgggcgaattggggcg

SEQ ID NO: 24407 - DNA, 18 bp, Artificial Sequence
  Synthetic
gcggcggcggttctcaaa

SEQ ID NO: 24408 - DNA, 18 bp, Artificial Sequence
  Synthetic
gcgcggcacttcgaccaa

SEQ ID NO: 24409 - DNA, 19 bp, Artificial Sequence
  Synthetic
atgcgcgcggatgtttggc

SEQ ID NO: 24410 - DNA, 20 bp, Artificial Sequence
  Synthetic
attgtccgaccatacgcccg

SEQ ID NO: 24411 - DNA, 23 bp, Artificial Sequence
  Synthetic
gagttcctgttgtcgctatttgc

SEQ ID NO: 24412 - DNA, 21 bp, Artificial Sequence
  Synthetic
gcgaagagcggaaaatcaaac

SEQ ID NO: 24413 - DNA, 22 bp, Artificial Sequence
  Synthetic
tcccgggtagcagccttttttg

SEQ ID NO: 24414 - DNA, 20 bp, Artificial Sequence
  Synthetic
aaatgccccgatggtgcagg

SEQ ID NO: 24415 - DNA, 21 bp, Artificial Sequence
  Synthetic
ctgttcggcagccgtttcacc

SEQ ID NO: 24416 - DNA, 18 bp, Artificial Sequence
  Synthetic
gcgcgatgtccatccgca

SEQ ID NO: 24417 - DNA, 19 bp, Artificial Sequence
  Synthetic
cccgccccgatcccttcta

SEQ ID NO: 24418 - DNA, 19 bp, Artificial Sequence
  Synthetic
atttggccgatgcgctgca

SEQ ID NO: 24419 - DNA, 22 bp, Artificial Sequence
  Synthetic
gttggcgatgacttcgttggtg

SEQ ID NO: 24420 - DNA, 22 bp, Artificial Sequence
  Synthetic
cgcattaatgccgtttatgcca

SEQ ID NO: 24421 - DNA, 21 bp, Artificial Sequence
  Synthetic
tggttttgccgatgtctgccg

SEQ ID NO: 24422 - DNA, 19 bp, Artificial Sequence
  Synthetic
gcagtaccgcccagcagga

SEQ ID NO: 24423 - DNA, 19 bp, Artificial Sequence
  Synthetic
ggtggtgcagcctgccgaa

SEQ ID NO: 24424 - DNA, 20 bp, Artificial Sequence
  Synthetic
tgtggacgacgtaaccgcgc

SEQ ID NO: 24425 - DNA, 22 bp, Artificial Sequence
  Synthetic
tccgccaccaaaaacctgatga

SEQ ID NO: 24426 - DNA, 22 bp, Artificial Sequence
  Synthetic
atttggacttcaaacgcggcag

SEQ ID NO: 24427 - DNA, 19 bp, Artificial Sequence
  Synthetic
tcaaaccataggccgcgcc

SEQ ID NO: 24428 - DNA, 19 bp, Artificial Sequence
  Synthetic
cgaagctgacgttggcggc

SEQ ID NO: 24429 - DNA, 22 bp, Artificial Sequence
  Synthetic
ttgcccatgccgaccataatcg

SEQ ID NO: 24430 - DNA, 22 bp, Artificial Sequence
  Synthetic
tcttcgggattggattcgccgg

SEQ ID NO: 24431 - DNA, 20 bp, Artificial Sequence
  Synthetic
aatcgttgctgccggcatcg

SEQ ID NO: 24432 - DNA, 22 bp, Artificial Sequence
  Synthetic
agccgcagtggattaagaaggg

SEQ ID NO: 24433 - DNA, 18 bp, Artificial Sequence
  Synthetic
tgctccccgaacgcgctt

SEQ ID NO: 24434 - DNA, 21 bp, Artificial Sequence
  Synthetic
acataaagccggcggcaaaca

SEQ ID NO: 24435 - DNA, 20 bp, Artificial Sequence
  Synthetic
gagcaggcggtatggtcggc

SEQ ID NO: 24436 - DNA, 23 bp, Artificial Sequence
  Synthetic
tccagcatcacatactcgaaagt

SEQ ID NO: 24437 - DNA, 21 bp, Artificial Sequence
  Synthetic
acgaagttttggtcgattgcc

SEQ ID NO: 24438 - DNA, 19 bp, Artificial Sequence
  Synthetic
gcaagggcgggttcggtaa

SEQ ID NO: 24439 - DNA, 20 bp, Artificial Sequence
  Synthetic
ggttttggcggcaggcgtat

SEQ ID NO: 24440 - DNA, 22 bp, Artificial Sequence
  Synthetic
tttggcggctttggatatcgga

SEQ ID NO: 24441 - DNA, 20 bp, Artificial Sequence
  Synthetic
aatcctgcatggcgagggtg

SEQ ID NO: 24442 - DNA, 19 bp, Artificial Sequence
  Synthetic
ggcgagtacggcgacctgt

SEQ ID NO: 24443 - DNA, 20 bp, Artificial Sequence
  Synthetic
cgctttcatgcgcctgaccg

SEQ ID NO: 24444 - DNA, 18 bp, Artificial Sequence
  Synthetic
tccgccgcgccgctttta

SEQ ID NO: 24445 - DNA, 19 bp, Artificial Sequence
  Synthetic
ggcccggggcgcatgattt

SEQ ID NO: 24446 - DNA, 17 bp, Artificial Sequence
  Synthetic
ttgttcgaccgccgcgt

SEQ ID NO: 24447 - DNA, 21 bp, Artificial Sequence
  Synthetic
ggttcgatggcttcggatgcc

SEQ ID NO: 24448 - DNA, 19 bp, Artificial Sequence
  Synthetic
ggacgagccgttgacgagc

SEQ ID NO: 24449 - DNA, 19 bp, Artificial Sequence
  Synthetic
caagcgcgcgcaggacgta

SEQ ID NO: 24450 - DNA, 20 bp, Artificial Sequence
  Synthetic
gcttcgccgaagcagacggg

SEQ ID NO: 24451 - DNA, 25 bp, Artificial Sequence
  Synthetic
aatttgcaggttatcactatgtgca

SEQ ID NO: 24452 - DNA, 19 bp, Artificial Sequence
  Synthetic
ggcgaaaaaggcgctggcg

SEQ ID NO: 24453 - DNA, 21 bp, Artificial Sequence
  Synthetic
gacgttgtgcaaggtttccgg

SEQ ID NO: 24454 - DNA, 18 bp, Artificial Sequence
  Synthetic
cagtccgcacgccccaat

SEQ ID NO: 24455 - DNA, 21 bp, Artificial Sequence
  Synthetic
actttggtggcgacgacttcg

SEQ ID NO: 24456 - DNA, 19 bp, Artificial Sequence
  Synthetic
gcgcccgaaatccccgtca

SEQ ID NO: 24457 - DNA, 19 bp, Artificial Sequence
  Synthetic
cgccatcgaagcctgcacg

SEQ ID NO: 24458 - DNA, 22 bp, Artificial Sequence
  Synthetic
acctgaaagacctgttcggcac

SEQ ID NO: 24459 - DNA, 20 bp, Artificial Sequence
  Synthetic
gcattggccgtcataccgct

SEQ ID NO: 24460 - DNA, 21 bp, Artificial Sequence
  Synthetic
aaaaccgtgttggagctcggc

SEQ ID NO: 24461 - DNA, 22 bp, Artificial Sequence
  Synthetic
ccctgcgacggttttagacagg

SEQ ID NO: 24462 - DNA, 22 bp, Artificial Sequence
  Synthetic
cgatacgttcggggtggatgtt

SEQ ID NO: 24463 - DNA, 20 bp, Artificial Sequence
  Synthetic
ttgcgacgtatgcaccagct

SEQ ID NO: 24464 - DNA, 19 bp, Artificial Sequence
  Synthetic
gcgcaggcgatggtggtgt

SEQ ID NO: 24465 - DNA, 22 bp, Artificial Sequence
  Synthetic
ttgctggaatctaaatcggctg

SEQ ID NO: 24466 - DNA, 20 bp, Artificial Sequence
  Synthetic
tgtgaatgtttcgccgcccg

SEQ ID NO: 24467 - DNA, 20 bp, Artificial Sequence
  Synthetic
gggcgataatggcgcggaag

SEQ ID NO: 24468 - DNA, 20 bp, Artificial Sequence
  Synthetic
gcactttgccgccgatgttt

SEQ ID NO: 24469 - DNA, 18 bp, Artificial Sequence
  Synthetic
gcgaatcgccgcagacga

SEQ ID NO: 24470 - DNA, 22 bp, Artificial Sequence
  Synthetic
tattgcaggagttcggcagctt

SEQ ID NO: 24471 - DNA, 19 bp, Artificial Sequence
  Synthetic
tccgcaccgcaaatcaggg

SEQ ID NO: 24472 - DNA, 21 bp, Artificial Sequence
  Synthetic
acgaagcagtgctgatgctca

SEQ ID NO: 24473 - DNA, 19 bp, Artificial Sequence
  Synthetic
acagcctcgccaccaacgc

SEQ ID NO: 24474 - DNA, 20 bp, Artificial Sequence
  Synthetic
cgttggcgcggattttggcg

SEQ ID NO: 24475 - DNA, 20 bp, Artificial Sequence
  Synthetic
gccgtttcgacaaaggcggc

SEQ ID NO: 24476 - DNA, 20 bp, Artificial Sequence
  Synthetic
aaacgccagcgacgaagtgc

SEQ ID NO: 24477 - DNA, 19 bp, Artificial Sequence
  Synthetic
gcagcgaccaggaatggcg

SEQ ID NO: 24478 - DNA, 19 bp, Artificial Sequence
  Synthetic
agcccgttcatttgcgcca

SEQ ID NO: 24479 - DNA, 22 bp, Artificial Sequence
  Synthetic
gcctgaacaatcaaaatggcga

SEQ ID NO: 24480 - DNA, 22 bp, Artificial Sequence
  Synthetic
tatcggcttcactattggcagc

SEQ ID NO: 24481 - DNA, 20 bp, Artificial Sequence
  Synthetic
tgtacggcaaaggagacggc

SEQ ID NO: 24482 - DNA, 18 bp, Artificial Sequence
  Synthetic
cggcggcaagcgtctgaa

SEQ ID NO: 24483 - DNA, 22 bp, Artificial Sequence
  Synthetic
accgtattcattgcaggtgccg

SEQ ID NO: 24484 - DNA, 21 bp, Artificial Sequence
  Synthetic
aaagccagttggacttcgccc

SEQ ID NO: 24485 - DNA, 22 bp, Artificial Sequence
  Synthetic
acttctcggacgttccattcgg

SEQ ID NO: 24486 - DNA, 19 bp, Artificial Sequence
  Synthetic
gtcggtcagcagcgccact

SEQ ID NO: 24487 - DNA, 20 bp, Artificial Sequence
  Synthetic
acacgatggcgggtgcttcg

SEQ ID NO: 24488 - DNA, 22 bp, Artificial Sequence
  Synthetic
acagtaatgcgcttcagacggc

SEQ ID NO: 24489 - DNA, 21 bp, Artificial Sequence
  Synthetic
gcaactgcgcgacgtattgtc

SEQ ID NO: 24490 - DNA, 21 bp, Artificial Sequence
  Synthetic
cctgcttgccaacgtctttgc

SEQ ID NO: 24491 - DNA, 18 bp, Artificial Sequence
  Synthetic
gcaggattggcggggcat

SEQ ID NO: 24492 - DNA, 22 bp, Artificial Sequence
  Synthetic
ttcgccgtgggactttatccgg

SEQ ID NO: 24493 - DNA, 22 bp, Artificial Sequence
  Synthetic
tttctgcgtcggtcattggggt

SEQ ID NO: 24494 - DNA, 22 bp, Artificial Sequence
  Synthetic
ccccaaagccgaaatcgaaggc

SEQ ID NO: 24495 - DNA, 19 bp, Artificial Sequence
  Synthetic
ttcgcgggaatgacggtcg

SEQ ID NO: 24496 - DNA, 18 bp, Artificial Sequence
  Synthetic
ggtgcagcctgccttcgt

SEQ ID NO: 24497 - DNA, 21 bp, Artificial Sequence
  Synthetic
acgagttggtgtacttgccgg

SEQ ID NO: 24498 - DNA, 21 bp, Artificial Sequence
  Synthetic
tgtcgcggacaaaacgatggt

SEQ ID NO: 24499 - DNA, 20 bp, Artificial Sequence
  Synthetic
acgatttgcagttggcggcg

SEQ ID NO: 24500 - DNA, 18 bp, Artificial Sequence
  Synthetic
cggctgcgtttggcgact

SEQ ID NO: 24501 - DNA, 20 bp, Artificial Sequence
  Synthetic
ttttccccgagcgcggcatt

SEQ ID NO: 24502 - DNA, 22 bp, Artificial Sequence
  Synthetic
tcttcggcgatttcaaagccgt

SEQ ID NO: 24503 - DNA, 22 bp, Artificial Sequence
  Synthetic
gggcattgtttgaccggtttcc

SEQ ID NO: 24504 - DNA, 21 bp, Artificial Sequence
  Synthetic
gcttaagcccgcaacaaaaag

SEQ ID NO: 24505 - DNA, 20 bp, Artificial Sequence
  Synthetic
gaagtcggcggcgaattgct

SEQ ID NO: 24506 - DNA, 20 bp, Artificial Sequence
  Synthetic
ccaaatgcggatggtgcgga

SEQ ID NO: 24507 - DNA, 21 bp, Artificial Sequence
  Synthetic
agtgactgggttatcttcggc

SEQ ID NO: 24508 - DNA, 20 bp, Artificial Sequence
  Synthetic
gttgagaagcgttgacggct

SEQ ID NO: 24509 - DNA, 22 bp, Artificial Sequence
  Synthetic
tgaaagaatgtccaggcgattt

SEQ ID NO: 24510 - DNA, 21 bp, Artificial Sequence
  Synthetic
cccgatgttcgtgattacgga

SEQ ID NO: 24511 - DNA, 25 bp, Artificial Sequence
  Synthetic
aatatttcacgggcaataacttccc

SEQ ID NO: 24512 - DNA, 25 bp, Artificial Sequence
  Synthetic
cgattgaggcttcatcgtttttagg

SEQ ID NO: 24513 - DNA, 25 bp, Artificial Sequence
  Synthetic
tggaattctaggcagaatctcttgc

SEQ ID NO: 24514 - DNA, 22 bp, Artificial Sequence
  Synthetic
tggcacaaattccatatccgaa

SEQ ID NO: 24515 - DNA, 19 bp, Artificial Sequence
  Synthetic
ctgcgcgacatccacaccc

SEQ ID NO: 24516 - DNA, 19 bp, Artificial Sequence
  Synthetic
acatcgccaaaggacgcgg

SEQ ID NO: 24517 - DNA, 21 bp, Artificial Sequence
  Synthetic
ccgctttggatttggttgccg

SEQ ID NO: 24518 - DNA, 19 bp, Artificial Sequence
  Synthetic
gcatccgcttctccggcga

SEQ ID NO: 24519 - DNA, 21 bp, Artificial Sequence
  Synthetic
gttctgccgaccgctacttcc

SEQ ID NO: 24520 - DNA, 19 bp, Artificial Sequence
  Synthetic
gttcggtcaccgtcgggca

SEQ ID NO: 24521 - DNA, 18 bp, Artificial Sequence
  Synthetic
gttggatgcgcccgtcga

SEQ ID NO: 24522 - DNA, 21 bp, Artificial Sequence
  Synthetic
cgtggcaaacatccaacccga

SEQ ID NO: 24523 - DNA, 19 bp, Artificial Sequence
  Synthetic
gtctgtccctgcccggcaa

SEQ ID NO: 24524 - DNA, 22 bp, Artificial Sequence
  Synthetic
agcatcctcaaattcaccggcc

SEQ ID NO: 24525 - DNA, 18 bp, Artificial Sequence
  Synthetic
gccgacacgttggcgcaa

SEQ ID NO: 24526 - DNA, 19 bp, Artificial Sequence
  Synthetic
tccaagacccaggcgagca

SEQ ID NO: 24527 - DNA, 22 bp, Artificial Sequence
  Synthetic
atcgccaactcctgcgtcttcc

SEQ ID NO: 24528 - DNA, 19 bp, Artificial Sequence
  Synthetic
cccctgcccaaaacgaccg

SEQ ID NO: 24529 - DNA, 22 bp, Artificial Sequence
  Synthetic
gatcgccgaaatcgattcccca

SEQ ID NO: 24530 - DNA, 20 bp, Artificial Sequence
  Synthetic
cgcgtgccgccatatcttcg

SEQ ID NO: 24531 - DNA, 22 bp, Artificial Sequence
  Synthetic
gcgggatgattttttccgccaa

SEQ ID NO: 24532 - DNA, 21 bp, Artificial Sequence
  Synthetic
tcgttgagcaggcgcaatacg

SEQ ID NO: 24533 - DNA, 22 bp, Artificial Sequence
  Synthetic
aagcccaaaaagtcggactggt

SEQ ID NO: 24534 - DNA, 18 bp, Artificial Sequence
  Synthetic
tacttgccaccgcgccct

SEQ ID NO: 24535 - DNA, 22 bp, Artificial Sequence
  Synthetic
ctcgaggttgcaaaagtcgcct

SEQ ID NO: 24536 - DNA, 22 bp, Artificial Sequence
  Synthetic
ttgatgaccgcctgccagtagc

SEQ ID NO: 24537 - DNA, 21 bp, Artificial Sequence
  Synthetic
gatggatgcccgattcgtgcg

SEQ ID NO: 24538 - DNA, 22 bp, Artificial Sequence
  Synthetic
ttttcgcaatcgcattgaccgc

SEQ ID NO: 24539 - DNA, 19 bp, Artificial Sequence
  Synthetic
gccatcgttgccgccctga

SEQ ID NO: 24540 - DNA, 21 bp, Artificial Sequence
  Synthetic
gcaccggtctcttccgattgg

SEQ ID NO: 24541 - DNA, 22 bp, Artificial Sequence
  Synthetic
tgctttccaacatcctccccct

SEQ ID NO: 24542 - DNA, 20 bp, Artificial Sequence
  Synthetic
cgcacacgctgccatatcct

SEQ ID NO: 24543 - DNA, 20 bp, Artificial Sequence
  Synthetic
tgcccttcattgccgttggg

SEQ ID NO: 24544 - DNA, 22 bp, Artificial Sequence
  Synthetic
gcagaaagtcggcgaataccgg

SEQ ID NO: 24545 - DNA, 22 bp, Artificial Sequence
  Synthetic
tccgcctgtaccgaaatcaacg

SEQ ID NO: 24546 - DNA, 20 bp, Artificial Sequence
  Synthetic
cgaaaccgacgctcgcgtat

SEQ ID NO: 24547 - DNA, 24 bp, Artificial Sequence
  Synthetic
ttttccagacggcattttttgttt

SEQ ID NO: 24548 - DNA, 19 bp, Artificial Sequence
  Synthetic
catccgcacccagttgcgc

SEQ ID NO: 24549 - DNA, 22 bp, Artificial Sequence
  Synthetic
gtcagacatcgggaaatgcttt

SEQ ID NO: 24550 - DNA, 20 bp, Artificial Sequence
  Synthetic
tgcaaaccgcgccgtatcag

SEQ ID NO: 24551 - DNA, 19 bp, Artificial Sequence
  Synthetic
gcgaaccggcgcaagaact

SEQ ID NO: 24552 - DNA, 22 bp, Artificial Sequence
  Synthetic
gttgccaagcctaagccgttgc

SEQ ID NO: 24553 - DNA, 20 bp, Artificial Sequence
  Synthetic
tggcggcttcgactgtttcg

SEQ ID NO: 24554 - DNA, 22 bp, Artificial Sequence
  Synthetic
agcatccccatcatccacaacc

SEQ ID NO: 24555 - DNA, 21 bp, Artificial Sequence
  Synthetic
tcgcttcgatcacttcgggac

SEQ ID NO: 24556 - DNA, 19 bp, Artificial Sequence
  Synthetic
ggattgccggcgccgatgt

SEQ ID NO: 24557 - DNA, 18 bp, Artificial Sequence
  Synthetic
cgcgccgtccaagccttt

SEQ ID NO: 24558 - DNA, 21 bp, Artificial Sequence
  Synthetic
ggcttggatttgccggactgt

SEQ ID NO: 24559 - DNA, 19 bp, Artificial Sequence
  Synthetic
cgagggtgcgctccatctg

SEQ ID NO: 24560 - DNA, 20 bp, Artificial Sequence
  Synthetic
gtagcggtcgaagtcgtgcg

SEQ ID NO: 24561 - DNA, 21 bp, Artificial Sequence
  Synthetic
cgggggaagtcggtcaggtag

SEQ ID NO: 24562 - DNA, 22 bp, Artificial Sequence
  Synthetic
tttgaccagcagcgaagacagg

SEQ ID NO: 24563 - DNA, 20 bp, Artificial Sequence
  Synthetic
cacggtccgcgtgatttggt

SEQ ID NO: 24564 - DNA, 25 bp, Artificial Sequence
  Synthetic
acaggctggttactttgtttttttg

SEQ ID NO: 24565 - DNA, 21 bp, Artificial Sequence
  Synthetic
ggtcggtatgcaatgcgtggt

SEQ ID NO: 24566 - DNA, 21 bp, Artificial Sequence
  Synthetic
ccccgatagccgaaaagcagc

SEQ ID NO: 24567 - DNA, 19 bp, Artificial Sequence
  Synthetic
ggacagcccgaacacaccc

SEQ ID NO: 24568 - DNA, 19 bp, Artificial Sequence
  Synthetic
ttgccggaacatggctgct

SEQ ID NO: 24569 - DNA, 18 bp, Artificial Sequence
  Synthetic
tgggcaacgaaggcgacg

SEQ ID NO: 24570 - DNA, 21 bp, Artificial Sequence
  Synthetic
ctacaccctctccgtcgtccc

SEQ ID NO: 24571 - DNA, 19 bp, Artificial Sequence
  Synthetic
atatgtgccgtgccgcgct

SEQ ID NO: 24572 - DNA, 21 bp, Artificial Sequence
  Synthetic
aaaggggcgaagtttacaggc

SEQ ID NO: 24573 - DNA, 20 bp, Artificial Sequence
  Synthetic
ttggtttcgccgctcatggc

SEQ ID NO: 24574 - DNA, 18 bp, Artificial Sequence
  Synthetic
cgctcggcggcatccaaa

SEQ ID NO: 24575 - DNA, 19 bp, Artificial Sequence
  Synthetic
tcacaggcacacgtctgcg

SEQ ID NO: 24576 - DNA, 19 bp, Artificial Sequence
  Synthetic
cgtgggcttacctgccgct

SEQ ID NO: 24577 - DNA, 22 bp, Artificial Sequence
  Synthetic
ttcagacggcattttcggcaca

SEQ ID NO: 24578 - DNA, 22 bp, Artificial Sequence
  Synthetic
tacctcgccaaaaaactcggca

SEQ ID NO: 24579 - DNA, 22 bp, Artificial Sequence
  Synthetic
ggtcggtatggatgccttcctg

SEQ ID NO: 24580 - DNA, 22 bp, Artificial Sequence
  Synthetic
accaacaacagcaccttcctcg

SEQ ID NO: 24581 - DNA, 22 bp, Artificial Sequence
  Synthetic
atctggcgaaggaaatgcacgt

SEQ ID NO: 24582 - DNA, 22 bp, Artificial Sequence
  Synthetic
gcttgcccgattttgaaagccg

SEQ ID NO: 24583 - DNA, 19 bp, Artificial Sequence
  Synthetic
ccgcccgcccgattgtcaa

SEQ ID NO: 24584 - DNA, 22 bp, Artificial Sequence
  Synthetic
tcgagtacgccggtgattttgt

SEQ ID NO: 24585 - DNA, 21 bp, Artificial Sequence
  Synthetic
aattcgactgctttttcggcg

SEQ ID NO: 24586 - DNA, 22 bp, Artificial Sequence
  Synthetic
tccaacagttttgccacaccgt

SEQ ID NO: 24587 - DNA, 22 bp, Artificial Sequence
  Synthetic
agcccagtatgacaatttgctg

SEQ ID NO: 24588 - DNA, 20 bp, Artificial Sequence
  Synthetic
tgcccaagcacccaaatcat

SEQ ID NO: 24589 - DNA, 20 bp, Artificial Sequence
  Synthetic
cacgccaatgacgcgcaatc

SEQ ID NO: 24590 - DNA, 21 bp, Artificial Sequence
  Synthetic
gcaaaattccgcgcattaagc

SEQ ID NO: 24591 - DNA, 22 bp, Artificial Sequence
  Synthetic
gcctataccgaaaaatggcgcg

SEQ ID NO: 24592 - DNA, 20 bp, Artificial Sequence
  Synthetic
gtttgatgccgttttgtgcg

SEQ ID NO: 24593 - DNA, 20 bp, Artificial Sequence
  Synthetic
gcaaacaacaacactcgggc

SEQ ID NO: 24594 - DNA, 25 bp, Artificial Sequence
  Synthetic
cgaaatttttcatggtaaacgagcg

SEQ ID NO: 24595 - DNA, 21 bp, Artificial Sequence
  Synthetic
gtccgaagacggcggcttcac

SEQ ID NO: 24596 - DNA, 21 bp, Artificial Sequence
  Synthetic
ggtacgcaaccgaacagctct

SEQ ID NO: 24597 - DNA, 25 bp, Artificial Sequence
  Synthetic
accgttcaaataaatcgctctacat

SEQ ID NO: 24598 - DNA, 21 bp, Artificial Sequence
  Synthetic
ctgggcaaactggaaaaacgg

SEQ ID NO: 24599 - DNA, 18 bp, Artificial Sequence
  Synthetic
cggcaaaggcgtgcacgt

SEQ ID NO: 24600 - DNA, 19 bp, Artificial Sequence
  Synthetic
cgcctgcgcgttgtgaatc

SEQ ID NO: 24601 - DNA, 23 bp, Artificial Sequence
  Synthetic
aaacggtttttctttggcttcgg

SEQ ID NO: 24602 - DNA, 22 bp, Artificial Sequence
  Synthetic
gcggctgccgtacaatcaaaat

SEQ ID NO: 24603 - DNA, 19 bp, Artificial Sequence
  Synthetic
gcatcagccttgccacgct

SEQ ID NO: 24604 - DNA, 22 bp, Artificial Sequence
  Synthetic
caggcagtgtcggtcatcctca

SEQ ID NO: 24605 - DNA, 19 bp, Artificial Sequence
  Synthetic
tccaggcgtccccagttgt

SEQ ID NO: 24606 - DNA, 18 bp, Artificial Sequence
  Synthetic
acgttcgacggcggcttg

SEQ ID NO: 24607 - DNA, 21 bp, Artificial Sequence
  Synthetic
ttcagcttcggatggaaaagg

SEQ ID NO: 24608 - DNA, 20 bp, Artificial Sequence
  Synthetic
catacggcgcatcgttggcg

SEQ ID NO: 24609 - DNA, 20 bp, Artificial Sequence
  Synthetic
cccgcctttccgacaacgag

SEQ ID NO: 24610 - DNA, 21 bp, Artificial Sequence
  Synthetic
tgtggcgaaaagctccatcgg

SEQ ID NO: 24611 - DNA, 19 bp, Artificial Sequence
  Synthetic
gggctgctggatgcgggta

SEQ ID NO: 24612 - DNA, 19 bp, Artificial Sequence
  Synthetic
cgcccgccggtctgaaaca

SEQ ID NO: 24613 - DNA, 21 bp, Artificial Sequence
  Synthetic
acggtggaacgtgggaacagg

SEQ ID NO: 24614 - DNA, 19 bp, Artificial Sequence
  Synthetic
aagcaacagcatccgccgc

SEQ ID NO: 24615 - DNA, 20 bp, Artificial Sequence
  Synthetic
tccccgataccgatgccgtc

SEQ ID NO: 24616 - DNA, 20 bp, Artificial Sequence
  Synthetic
aaacggttgcccaaaccccg

SEQ ID NO: 24617 - DNA, 22 bp, Artificial Sequence
  Synthetic
tctgctcgccaaagtcaaagcc

SEQ ID NO: 24618 - DNA, 22 bp, Artificial Sequence
  Synthetic
aacatctggcgcaaaaaaccgg

SEQ ID NO: 24619 - DNA, 20 bp, Artificial Sequence
  Synthetic
cgaagtgttggacgcaccgc

SEQ ID NO: 24620 - DNA, 20 bp, Artificial Sequence
  Synthetic
ttttccacgcgtttgcccgg

SEQ ID NO: 24621 - DNA, 20 bp, Artificial Sequence
  Synthetic
cgacatccacggcaaagcgc

SEQ ID NO: 24622 - DNA, 20 bp, Artificial Sequence
  Synthetic
attcacacgcaaacccgcct

SEQ ID NO: 24623 - DNA, 22 bp, Artificial Sequence
  Synthetic
agtgtccgccaacatattgcgc

SEQ ID NO: 24624 - DNA, 19 bp, Artificial Sequence
  Synthetic
ccccgcccgtttcgccaaa

SEQ ID NO: 24625 - DNA, 19 bp, Artificial Sequence
  Synthetic
accattgccgtctgcgaca

SEQ ID NO: 24626 - DNA, 21 bp, Artificial Sequence
  Synthetic
cgaaaccttaaaccccggccc

SEQ ID NO: 24627 - DNA, 22 bp, Artificial Sequence
  Synthetic
tgtcaaaacgctccttcaggcg

SEQ ID NO: 24628 - DNA, 18 bp, Artificial Sequence
  Synthetic
gcatccgcgccgaagagt

SEQ ID NO: 24629 - DNA, 19 bp, Artificial Sequence
  Synthetic
catctgcgccttgtccggc

SEQ ID NO: 24630 - DNA, 21 bp, Artificial Sequence
  Synthetic
cctgcggattcaataccggca

SEQ ID NO: 24631 - DNA, 19 bp, Artificial Sequence
  Synthetic
cggccgattccgccaaacc

SEQ ID NO: 24632 - DNA, 20 bp, Artificial Sequence
  Synthetic
cccattccccgtttgccagc

SEQ ID NO: 24633 - DNA, 21 bp, Artificial Sequence
  Synthetic
gctgggcacgtcttccaaagc

SEQ ID NO: 24634 - DNA, 18 bp, Artificial Sequence
  Synthetic
gccagttcgcgcgtggtt

SEQ ID NO: 24635 - DNA, 18 bp, Artificial Sequence
  Synthetic
gcctttggcggctttgcg

SEQ ID NO: 24636 - DNA, 18 bp, Artificial Sequence
  Synthetic
gtgtgcggcgcggatgta

SEQ ID NO: 24637 - DNA, 19 bp, Artificial Sequence
  Synthetic
gcgtttttccagcgcgtcg

SEQ ID NO: 24638 - DNA, 21 bp, Artificial Sequence
  Synthetic
gatcctacacgccgcgaacct

SEQ ID NO: 24639 - DNA, 22 bp, Artificial Sequence
  Synthetic
gactcggaagacgtcatccggc

SEQ ID NO: 24640 - DNA, 22 bp, Artificial Sequence
  Synthetic
aacttgaagcggcaatgagggc

SEQ ID NO: 24641 - DNA, 19 bp, Artificial Sequence
  Synthetic
cggctgtgcgtgaggtgct

SEQ ID NO: 24642 - DNA, 20 bp, Artificial Sequence
  Synthetic
tcaacgcctttcaccagctc

SEQ ID NO: 24643 - DNA, 19 bp, Artificial Sequence
  Synthetic
gtccaccaccaagagcgcg

SEQ ID NO: 24644 - DNA, 20 bp, Artificial Sequence
  Synthetic
ggcgagcgtttgcggatgaa

SEQ ID NO: 24645 - DNA, 21 bp, Artificial Sequence
  Synthetic
atgtgtgccgaaaacaaccgc

SEQ ID NO: 24646 - DNA, 19 bp, Artificial Sequence
  Synthetic
cttccgtcctcgccgatcc

SEQ ID NO: 24647 - DNA, 19 bp, Artificial Sequence
  Synthetic
cgaagccctgcgcctcgaa

SEQ ID NO: 24648 - DNA, 19 bp, Artificial Sequence
  Synthetic
tttgcagacgaccgcgtgc

SEQ ID NO: 24649 - DNA, 20 bp, Artificial Sequence
  Synthetic
aaatcctgtttgccgccgcc

SEQ ID NO: 24650 - DNA, 18 bp, Artificial Sequence
  Synthetic
tttggccttggctgccga

SEQ ID NO: 24651 - DNA, 19 bp, Artificial Sequence
  Synthetic
cgctacggcagccgcgaaa

SEQ ID NO: 24652 - DNA, 21 bp, Artificial Sequence
  Synthetic
tgccggtatggtttcaagacg

SEQ ID NO: 24653 - DNA, 22 bp, Artificial Sequence
  Synthetic
cctctcgtactaggagcagccc

SEQ ID NO: 24654 - DNA, 19 bp, Artificial Sequence
  Synthetic
gcggggccctcgaaaacct

SEQ ID NO: 24655 - DNA, 22 bp, Artificial Sequence
  Synthetic
agcacaaaaatcttgccgtcgc

SEQ ID NO: 24656 - DNA, 19 bp, Artificial Sequence
  Synthetic
gacgggcaaaggttcgcgt

SEQ ID NO: 24657 - DNA, 21 bp, Artificial Sequence
  Synthetic
atctccatccacgacgtgggc

SEQ ID NO: 24658 - DNA, 21 bp, Artificial Sequence
  Synthetic
cggcaaataccaaacccccgt

SEQ ID NO: 24659 - DNA, 19 bp, Artificial Sequence
  Synthetic
aatggccgccgccttcacc

SEQ ID NO: 24660 - DNA, 19 bp, Artificial Sequence
  Synthetic
ccctgccttgcgcgaccaa

SEQ ID NO: 24661 - DNA, 21 bp, Artificial Sequence
  Synthetic
tctcgctcgcgtccaaatctg

SEQ ID NO: 24662 - DNA, 20 bp, Artificial Sequence
  Synthetic
ccgtgggtatgtcgctcggc

SEQ ID NO: 24663 - DNA, 20 bp, Artificial Sequence
  Synthetic
caccgtcggtgcagtcttca

SEQ ID NO: 24664 - DNA, 19 bp, Artificial Sequence
  Synthetic
ctacgaagcccccgtcgga

SEQ ID NO: 24665 - DNA, 19 bp, Artificial Sequence
  Synthetic
cgttcaggctgcccgaaca

SEQ ID NO: 24666 - DNA, 22 bp, Artificial Sequence
  Synthetic
agaacaaatcaaacgcgcccgc

SEQ ID NO: 24667 - DNA, 19 bp, Artificial Sequence
  Synthetic
cgcaccccgtgggcacaat

SEQ ID NO: 24668 - DNA, 24 bp, Artificial Sequence
  Synthetic
catgcagatatgcagattctgaca

SEQ ID NO: 24669 - DNA, 21 bp, Artificial Sequence
  Synthetic
tatcgagttgcgccaccaacc

SEQ ID NO: 24670 - DNA, 22 bp, Artificial Sequence
  Synthetic
tcaaccaatccgtttacgccca

SEQ ID NO: 24671 - DNA, 22 bp, Artificial Sequence
  Synthetic
ttttggacgaaccctccatcgg

SEQ ID NO: 24672 - DNA, 22 bp, Artificial Sequence
  Synthetic
gcgacggcgtgattaaagtcga

SEQ ID NO: 24673 - DNA, 19 bp, Artificial Sequence
  Synthetic
acgccgtacgccgaaacag

SEQ ID NO: 24674 - DNA, 18 bp, Artificial Sequence
  Synthetic
aacgcatcgtgccgccca

SEQ ID NO: 24675 - DNA, 22 bp, Artificial Sequence
  Synthetic
agctgcaactgctcggtaatga

SEQ ID NO: 24676 - DNA, 19 bp, Artificial Sequence
  Synthetic
ccgccagattgccgcgtgt

SEQ ID NO: 24677 - DNA, 21 bp, Artificial Sequence
  Synthetic
tggggtctttttcggtcaggc

SEQ ID NO: 24678 - DNA, 22 bp, Artificial Sequence
  Synthetic
tgtccgtcgggattttggtgtc

SEQ ID NO: 24679 - DNA, 20 bp, Artificial Sequence
  Synthetic
atgaccccgcttttgctggt

SEQ ID NO: 24680 - DNA, 20 bp, Artificial Sequence
  Synthetic
cttggtcgagctgcttgccc

SEQ ID NO: 24681 - DNA, 20 bp, Artificial Sequence
  Synthetic
caggttcaggcttggtcgct

SEQ ID NO: 24682 - DNA, 22 bp, Artificial Sequence
  Synthetic
cgcgaaagagttgtccgacgaa

SEQ ID NO: 24683 - DNA, 21 bp, Artificial Sequence
  Synthetic
ctgcggaaaatgcggcaaagc

SEQ ID NO: 24684 - DNA, 19 bp, Artificial Sequence
  Synthetic
ggcacgacacccgccgatt

SEQ ID NO: 24685 - DNA, 22 bp, Artificial Sequence
  Synthetic
ctcgatgcgatggaaagccccg

SEQ ID NO: 24686 - DNA, 20 bp, Artificial Sequence
  Synthetic
ccgtcctcgaagccgtcagg

SEQ ID NO: 24687 - DNA, 22 bp, Artificial Sequence
  Synthetic
cactcggcgacaaaaaaggcat

SEQ ID NO: 24688 - DNA, 20 bp, Artificial Sequence
  Synthetic
gcgtatacaaccgctcgccc

SEQ ID NO: 24689 - DNA, 20 bp, Artificial Sequence
  Synthetic
tcggttttctctgtgcggac

SEQ ID NO: 24690 - DNA, 18 bp, Artificial Sequence
  Synthetic
caaccggcgtggcgatgt

SEQ ID NO: 24691 - DNA, 18 bp, Artificial Sequence
  Synthetic
cgcggccaaactcgttgc

SEQ ID NO: 24692 - DNA, 21 bp, Artificial Sequence
  Synthetic
atgagcgtggtcaaaggtcgc

SEQ ID NO: 24693 - DNA, 21 bp, Artificial Sequence
  Synthetic
tggcaatggcaggctttgaga

SEQ ID NO: 24694 - DNA, 22 bp, Artificial Sequence
  Synthetic
cttgcccatgaaaaccacgtcg

SEQ ID NO: 24695 - DNA, 19 bp, Artificial Sequence
  Synthetic
gacaagcccccgcctacca

SEQ ID NO: 24696 - DNA, 21 bp, Artificial Sequence
  Synthetic
aaccgtctgcaccgtaaatgt

SEQ ID NO: 24697 - DNA, 20 bp, Artificial Sequence
  Synthetic
tttccagtgcggcgagatac

SEQ ID NO: 24698 - DNA, 19 bp, Artificial Sequence
  Synthetic
acatccgccgtggtgttgc

SEQ ID NO: 24699 - DNA, 20 bp, Artificial Sequence
  Synthetic
ttcatgcagtggcgttagct

SEQ ID NO: 24700 - DNA, 20 bp, Artificial Sequence
  Synthetic
gtgcctctccaaacgccacg

SEQ ID NO: 24701 - DNA, 20 bp, Artificial Sequence
  Synthetic
gtttgtcgtcaaaccgcgcg

SEQ ID NO: 24702 - DNA, 20 bp, Artificial Sequence
  Synthetic
gaggcggaggtagagccgga

SEQ ID NO: 24703 - DNA, 18 bp, Artificial Sequence
  Synthetic
ttgccgccagttgcagcg

SEQ ID NO: 24704 - DNA, 22 bp, Artificial Sequence
  Synthetic
cgcatcgacgttgtcctttggt

SEQ ID NO: 24705 - DNA, 16 bp, Artificial Sequence
  Synthetic
tgccgcacgcgcagaa

SEQ ID NO: 24706 - DNA, 22 bp, Artificial Sequence
  Synthetic
caagccgaaacacgagcgaaac

SEQ ID NO: 24707 - DNA, 18 bp, Artificial Sequence
  Synthetic
cgtgtccgcgcgtttgca

SEQ ID NO: 24708 - DNA, 21 bp, Artificial Sequence
  Synthetic
acggtgcgtttctgacttcgc

SEQ ID NO: 24709 - DNA, 20 bp, Artificial Sequence
  Synthetic
ccgtcctgccactcggtctc

SEQ ID NO: 24710 - DNA, 19 bp, Artificial Sequence
  Synthetic
ctggtccgcatacagccgc

SEQ ID NO: 24711 - DNA, 20 bp, Artificial Sequence
  Synthetic
cgcgggcttggcgttatacg

SEQ ID NO: 24712 - DNA, 22 bp, Artificial Sequence
  Synthetic
accgcaaaagacgacaaggtgt

SEQ ID NO: 24713 - DNA, 16 bp, Artificial Sequence
  Synthetic
aaggcagccgcgcgat

SEQ ID NO: 24714 - DNA, 20 bp, Artificial Sequence
  Synthetic
cgggcctataccgttgccgc

SEQ ID NO: 24715 - DNA, 21 bp, Artificial Sequence
  Synthetic
gcccactgcagatagggacca

SEQ ID NO: 24716 - DNA, 21 bp, Artificial Sequence
  Synthetic
aaaccataaaacgggttgcct

SEQ ID NO: 24717 - DNA, 21 bp, Artificial Sequence
  Synthetic
cagatcgaccgcttcctcgtg

SEQ ID NO: 24718 - DNA, 22 bp, Artificial Sequence
  Synthetic
acaggcgaacaccaccaactac

SEQ ID NO: 24719 - DNA, 21 bp, Artificial Sequence
  Synthetic
cggtagattgcccggaatgcg

SEQ ID NO: 24720 - DNA, 19 bp, Artificial Sequence
  Synthetic
ccgccgacggccgaaaagt

SEQ ID NO: 24721 - DNA, 20 bp, Artificial Sequence
  Synthetic
cgtatcgaccaaagcggcgt

SEQ ID NO: 24722 - DNA, 22 bp, Artificial Sequence
  Synthetic
gcattcaaccgtttggacagca

SEQ ID NO: 24723 - DNA, 22 bp, Artificial Sequence
  Synthetic
cgactttgtcggcaacaccttg

SEQ ID NO: 24724 - DNA, 19 bp, Artificial Sequence
  Synthetic
gccgaagcgatggcgatgg

SEQ ID NO: 24725 - DNA, 20 bp, Artificial Sequence
  Synthetic
caagtgccgggcaaacctcc

SEQ ID NO: 24726 - DNA, 22 bp, Artificial Sequence
  Synthetic
cgaaagcaaagccgaactcgac

SEQ ID NO: 24727 - DNA, 20 bp, Artificial Sequence
  Synthetic
agaagccgtcttcccgctgc

SEQ ID NO: 24728 - DNA, 19 bp, Artificial Sequence
  Synthetic
tctgccttcgcttctgccg

SEQ ID NO: 24729 - DNA, 18 bp, Artificial Sequence
  Synthetic
gagcgcggggttgccttt

SEQ ID NO: 24730 - DNA, 20 bp, Artificial Sequence
  Synthetic
ctttgtcgcgggcgagtttg

SEQ ID NO: 24731 - DNA, 20 bp, Artificial Sequence
  Synthetic
tcgtcttcgcctttgaccgg

SEQ ID NO: 24732 - DNA, 22 bp, Artificial Sequence
  Synthetic
cttggcagatatgtgtcgggct

SEQ ID NO: 24733 - DNA, 22 bp, Artificial Sequence
  Synthetic
tcttcagccgccttcaaatcca

SEQ ID NO: 24734 - DNA, 19 bp, Artificial Sequence
  Synthetic
ggaggtgtggatgcggcct

SEQ ID NO: 24735 - DNA, 19 bp, Artificial Sequence
  Synthetic
ggaagctgtccgagcccgt

SEQ ID NO: 24736 - DNA, 19 bp, Artificial Sequence
  Synthetic
ggcaagtgcgccgaaatgg

SEQ ID NO: 24737 - DNA, 21 bp, Artificial Sequence
  Synthetic
gtcgccttcacatcgtgcacg

SEQ ID NO: 24738 - DNA, 19 bp, Artificial Sequence
  Synthetic
ggcaacgcggctgtcttcc

SEQ ID NO: 24739 - DNA, 20 bp, Artificial Sequence
  Synthetic
tttcaggcaggtcgggctgt

SEQ ID NO: 24740 - DNA, 21 bp, Artificial Sequence
  Synthetic
cgattgcgatatacccggcgg

SEQ ID NO: 24741 - DNA, 19 bp, Artificial Sequence
  Synthetic
cgtcgcataccaaacgcgc

SEQ ID NO: 24742 - DNA, 20 bp, Artificial Sequence
  Synthetic
gaagcctgccgcgagattct

SEQ ID NO: 24743 - DNA, 22 bp, Artificial Sequence
  Synthetic
acgcaccacaacgacagtatgg

SEQ ID NO: 24744 - DNA, 20 bp, Artificial Sequence
  Synthetic
ttgggacgggcagaacgacc

SEQ ID NO: 24745 - DNA, 21 bp, Artificial Sequence
  Synthetic
ccgaaatgcctgcccataccg

SEQ ID NO: 24746 - DNA, 20 bp, Artificial Sequence
  Synthetic
gtttgcctgtttgagcgcgt

SEQ ID NO: 24747 - DNA, 20 bp, Artificial Sequence
  Synthetic
gacattgccgccgctcaagc

SEQ ID NO: 24748 - DNA, 21 bp, Artificial Sequence
  Synthetic
gtaaccgccgcccaattcgtc

SEQ ID NO: 24749 - DNA, 21 bp, Artificial Sequence
  Synthetic
gcaaacgaaatgccttgcgcc

SEQ ID NO: 24750 - DNA, 20 bp, Artificial Sequence
  Synthetic
ggcaggaacgaagtcggcag

SEQ ID NO: 24751 - DNA, 20 bp, Artificial Sequence
  Synthetic
cgatttgctccgcgtgttgc

SEQ ID NO: 24752 - DNA, 21 bp, Artificial Sequence
  Synthetic
caaccaggtcgaatacggcgg

SEQ ID NO: 24753 - DNA, 19 bp, Artificial Sequence
  Synthetic
cggatgtggcggatgacgg

SEQ ID NO: 24754 - DNA, 19 bp, Artificial Sequence
  Synthetic
ctgccgccatatccgggca

SEQ ID NO: 24755 - DNA, 20 bp, Artificial Sequence
  Synthetic
aaacagctgatccgtgccgc

SEQ ID NO: 24756 - DNA, 22 bp, Artificial Sequence
  Synthetic
caatgcatcccgctcggattga

SEQ ID NO: 24757 - DNA, 21 bp, Artificial Sequence
  Synthetic
tacctgcccaagcaatacccg

SEQ ID NO: 24758 - DNA, 20 bp, Artificial Sequence
  Synthetic
cgcccacacgtgccaaatca

SEQ ID NO: 24759 - DNA, 20 bp, Artificial Sequence
  Synthetic
tcgccccttatgacctcgac

SEQ ID NO: 24760 - DNA, 20 bp, Artificial Sequence
  Synthetic
gacaccgtgcgcgaagaagg

SEQ ID NO: 24761 - DNA, 19 bp, Artificial Sequence
  Synthetic
cgctcgcccgccacaaact

SEQ ID NO: 24762 - DNA, 20 bp, Artificial Sequence
  Synthetic
ggtacgacttcgatgccgcg

SEQ ID NO: 24763 - DNA, 22 bp, Artificial Sequence
  Synthetic
aaccttggtcgcccataacgga

SEQ ID NO: 24764 - DNA, 20 bp, Artificial Sequence
  Synthetic
ggccgaccgacagtttccag

SEQ ID NO: 24765 - DNA, 21 bp, Artificial Sequence
  Synthetic
ggcaagggcgaggatgatgag

SEQ ID NO: 24766 - DNA, 19 bp, Artificial Sequence
  Synthetic
ctctgcctgccctgctgct

SEQ ID NO: 24767 - DNA, 22 bp, Artificial Sequence
  Synthetic
cgttaacaccgagcttgtcgca

SEQ ID NO: 24768 - DNA, 20 bp, Artificial Sequence
  Synthetic
cgaggttcgcaccgacttcg

SEQ ID NO: 24769 - DNA, 20 bp, Artificial Sequence
  Synthetic
aagccgcacaagcctttccc

SEQ ID NO: 24770 - DNA, 21 bp, Artificial Sequence
  Synthetic
tgccgcgttgtcgtgaaaagc

SEQ ID NO: 24771 - DNA, 22 bp, Artificial Sequence
  Synthetic
tcgtctttcaactgcgcttcca

SEQ ID NO: 24772 - DNA, 21 bp, Artificial Sequence
  Synthetic
gcgtcgtggtttcagacgtgc

SEQ ID NO: 24773 - DNA, 19 bp, Artificial Sequence
  Synthetic
ggacaggcgcggcgaaact

SEQ ID NO: 24774 - DNA, 19 bp, Artificial Sequence
  Synthetic
gcaccatcagcatcggggc

SEQ ID NO: 24775 - DNA, 19 bp, Artificial Sequence
  Synthetic
cggcacgtcggcaaaacgg

SEQ ID NO: 24776 - DNA, 19 bp, Artificial Sequence
  Synthetic
gctgtccgcccgagagttc

SEQ ID NO: 24777 - DNA, 20 bp, Artificial Sequence
  Synthetic
cgcgacacgcctttttcctg

SEQ ID NO: 24778 - DNA, 19 bp, Artificial Sequence
  Synthetic
ggcggggttgaggctgaac

SEQ ID NO: 24779 - DNA, 20 bp, Artificial Sequence
  Synthetic
cctcctgctgctgcaacagg

SEQ ID NO: 24780 - DNA, 19 bp, Artificial Sequence
  Synthetic
actgtgccagttcgcgctc

SEQ ID NO: 24781 - DNA, 19 bp, Artificial Sequence
  Synthetic
ggcaaaggtgcgggcggta

SEQ ID NO: 24782 - DNA, 22 bp, Artificial Sequence
  Synthetic
tgcgacaggatttgcgacaacg

SEQ ID NO: 24783 - DNA, 20 bp, Artificial Sequence
  Synthetic
tcctgctgggtttggaaggc

SEQ ID NO: 24784 - DNA, 19 bp, Artificial Sequence
  Synthetic
ctttcggcgcgggggtttc

SEQ ID NO: 24785 - DNA, 21 bp, Artificial Sequence
  Synthetic
ataccggcctgtccgtgaccc

SEQ ID NO: 24786 - DNA, 22 bp, Artificial Sequence
  Synthetic
ggcttcgtacagcttatcgcct

SEQ ID NO: 24787 - DNA, 20 bp, Artificial Sequence
  Synthetic
ccgacaatggcaagggcgtt

SEQ ID NO: 24788 - DNA, 21 bp, Artificial Sequence
  Synthetic
ccgccgtacaacgaatggctc

SEQ ID NO: 24789 - DNA, 19 bp, Artificial Sequence
  Synthetic
ccctcgccgctgattgacg

SEQ ID NO: 24790 - DNA, 22 bp, Artificial Sequence
  Synthetic
acggcgaaatcgaatgggtcaa

SEQ ID NO: 24791 - DNA, 18 bp, Artificial Sequence
  Synthetic
gcggcggatgctgttgct

SEQ ID NO: 24792 - DNA, 19 bp, Artificial Sequence
  Synthetic
cgccgtcgcggaatgggaa

SEQ ID NO: 24793 - DNA, 20 bp, Artificial Sequence
  Synthetic
agcggcacttccaatacgcg

SEQ ID NO: 24794 - DNA, 20 bp, Artificial Sequence
  Synthetic
aggcgagtttgtaggcggtc

SEQ ID NO: 24795 - DNA, 18 bp, Artificial Sequence
  Synthetic
aacgcaccatggtcgggc

SEQ ID NO: 24796 - DNA, 18 bp, Artificial Sequence
  Synthetic
agaaacaccgccgctccg

SEQ ID NO: 24797 - DNA, 20 bp, Artificial Sequence
  Synthetic
cgtccacacgcccaacatcg

SEQ ID NO: 24798 - DNA, 19 bp, Artificial Sequence
  Synthetic
gcgcggtaagccacgccta

SEQ ID NO: 24799 - DNA, 21 bp, Artificial Sequence
  Synthetic
tgttgtcggtttagcagcaag

SEQ ID NO: 24800 - DNA, 21 bp, Artificial Sequence
  Synthetic
gtttgaacacgattgaccgct

SEQ ID NO: 24801 - DNA, 22 bp, Artificial Sequence
  Synthetic
ccacctacttacattttgcggt

SEQ ID NO: 24802 - DNA, 20 bp, Artificial Sequence
  Synthetic
ggtcgcgccattcagaaaac

SEQ ID NO: 24803 - DNA, 20 bp, Artificial Sequence
  Synthetic
aaacagcccgaatcacaacc

SEQ ID NO: 24804 - DNA, 20 bp, Artificial Sequence
  Synthetic
acacaaagcgagatgcccga

SEQ ID NO: 24805 - DNA, 24 bp, Artificial Sequence
  Synthetic
acgtgatgatgctaaatttttgca

SEQ ID NO: 24806 - DNA, 24 bp, Artificial Sequence
  Synthetic
ggtcgtcatgaagttttaatgcgg

SEQ ID NO: 24807 - DNA, 20 bp, Artificial Sequence
  Synthetic
cggaagcgatgcacaatctg

SEQ ID NO: 24808 - DNA, 24 bp, Artificial Sequence
  Synthetic
tctgaaagatgatgatgagccaag

SEQ ID NO: 24809 - DNA, 22 bp, Artificial Sequence
  Synthetic
tgcaactgacctgcaaattttc

SEQ ID NO: 24810 - DNA, 24 bp, Artificial Sequence
  Synthetic
gtgcctgtcataatcgcttaatgc

SEQ ID NO: 24811 - DNA, 20 bp, Artificial Sequence
  Synthetic
cgttggaaacgttgtgcgac

SEQ ID NO: 24812 - DNA, 21 bp, Artificial Sequence
  Synthetic
catagccagcagcgtccaagc

SEQ ID NO: 24813 - DNA, 19 bp, Artificial Sequence
  Synthetic
cggttggtcaggcgcacgt

SEQ ID NO: 24814 - DNA, 20 bp, Artificial Sequence
  Synthetic
tcgcccaggtaagtctttgg

SEQ ID NO: 24815 - DNA, 19 bp, Artificial Sequence
  Synthetic
acattgacacacggcggcg

SEQ ID NO: 24816 - DNA, 18 bp, Artificial Sequence
  Synthetic
ccgcagtttaccgccgca

SEQ ID NO: 24817 - DNA, 19 bp, Artificial Sequence
  Synthetic
tttcaccagcccctccgcg

SEQ ID NO: 24818 - DNA, 20 bp, Artificial Sequence
  Synthetic
gctgggcagcgaatccttcc

SEQ ID NO: 24819 - DNA, 18 bp, Artificial Sequence
  Synthetic
gccgccggcaaattccca

SEQ ID NO: 24820 - DNA, 19 bp, Artificial Sequence
  Synthetic
gcccgatgccgatgttgcg

SEQ ID NO: 24821 - DNA, 18 bp, Artificial Sequence
  Synthetic
ggctgtgtgcgtcggcat

SEQ ID NO: 24822 - DNA, 19 bp, Artificial Sequence
  Synthetic
ggcgcggtgcagggttttg

SEQ ID NO: 24823 - DNA, 22 bp, Artificial Sequence
  Synthetic
ctgttgggtaaacgtgccctgc

SEQ ID NO: 24824 - DNA, 20 bp, Artificial Sequence
  Synthetic
acccgaaaaacagcacggcg

SEQ ID NO: 24825 - DNA, 20 bp, Artificial Sequence
  Synthetic
gcaatcagcctttgcgtcgg

SEQ ID NO: 24826 - DNA, 18 bp, Artificial Sequence
  Synthetic
aagcgacagcatccgccg

SEQ ID NO: 24827 - DNA, 21 bp, Artificial Sequence
  Synthetic
acaccgatgccgtctgaacct

SEQ ID NO: 24828 - DNA, 22 bp, Artificial Sequence
  Synthetic
ccacttccgtgggaatgacggt

SEQ ID NO: 24829 - DNA, 22 bp, Artificial Sequence
  Synthetic
cggcggataaatcgaattgccc

SEQ ID NO: 24830 - DNA, 22 bp, Artificial Sequence
  Synthetic
tccaaacgctcgcggatttcat

SEQ ID NO: 24831 - DNA, 19 bp, Artificial Sequence
  Synthetic
gttcctgcgcggcgaggat

SEQ ID NO: 24832 - DNA, 18 bp, Artificial Sequence
  Synthetic
tttacgcgttccgccgcc

SEQ ID NO: 24833 - DNA, 18 bp, Artificial Sequence
  Synthetic
cgcgacgaaggcgggttt

SEQ ID NO: 24834 - DNA, 21 bp, Artificial Sequence
  Synthetic
tgtacgttcccctgccagtgc

SEQ ID NO: 24835 - DNA, 22 bp, Artificial Sequence
  Synthetic
aggctcttcgtaaggcttcgcc

SEQ ID NO: 24836 - DNA, 19 bp, Artificial Sequence
  Synthetic
ccccgaccacgcgctcttt

SEQ ID NO: 24837 - DNA, 20 bp, Artificial Sequence
  Synthetic
ccacgccacggaaatcacgc

SEQ ID NO: 24838 - DNA, 17 bp, Artificial Sequence
  Synthetic
aaaacggcggcgcacca

SEQ ID NO: 24839 - DNA, 21 bp, Artificial Sequence
  Synthetic
cgtatttttggaagcggcggc

SEQ ID NO: 24840 - DNA, 22 bp, Artificial Sequence
  Synthetic
agagtgggtaagctggtagccg

SEQ ID NO: 24841 - DNA, 20 bp, Artificial Sequence
  Synthetic
gacgccgatcaggaacacgc

SEQ ID NO: 24842 - DNA, 22 bp, Artificial Sequence
  Synthetic
gcttgaacgcctcgatatccgg

SEQ ID NO: 24843 - DNA, 18 bp, Artificial Sequence
  Synthetic
gcactgcctgcccgcatt

SEQ ID NO: 24844 - DNA, 18 bp, Artificial Sequence
  Synthetic
aaccggcagccaaagcca

SEQ ID NO: 24845 - DNA, 18 bp, Artificial Sequence
  Synthetic
gctgccgcgcccatcaat

SEQ ID NO: 24846 - DNA, 22 bp, Artificial Sequence
  Synthetic
aacggtagagcagggtttggac

SEQ ID NO: 24847 - DNA, 19 bp, Artificial Sequence
  Synthetic
cggccgggtctgttgggat

SEQ ID NO: 24848 - DNA, 20 bp, Artificial Sequence
  Synthetic
caggttgcccatcgggtaat

SEQ ID NO: 24849 - DNA, 21 bp, Artificial Sequence
  Synthetic
cgccgaacatgacatgtccca

SEQ ID NO: 24850 - DNA, 20 bp, Artificial Sequence
  Synthetic
acctcgtcggctttgtcggc

SEQ ID NO: 24851 - DNA, 20 bp, Artificial Sequence
  Synthetic
cgtttgcttacgggcggata

SEQ ID NO: 24852 - DNA, 18 bp, Artificial Sequence
  Synthetic
acgcactgctttcgcccg

SEQ ID NO: 24853 - DNA, 22 bp, Artificial Sequence
  Synthetic
caaactctccgccatccatccg

SEQ ID NO: 24854 - DNA, 20 bp, Artificial Sequence
  Synthetic
agccgtcgatttctgccgct

SEQ ID NO: 24855 - DNA, 21 bp, Artificial Sequence
  Synthetic
agcctgattgccggttatgcc

SEQ ID NO: 24856 - DNA, 19 bp, Artificial Sequence
  Synthetic
aaagcccttgccaaacgcg

SEQ ID NO: 24857 - DNA, 21 bp, Artificial Sequence
  Synthetic
ccgacttggacggtttgctgc

SEQ ID NO: 24858 - DNA, 21 bp, Artificial Sequence
  Synthetic
cgcttggaaaacacccgcttc

SEQ ID NO: 24859 - DNA, 19 bp, Artificial Sequence
  Synthetic
aaggcgcacgcaattccgc

SEQ ID NO: 24860 - DNA, 18 bp, Artificial Sequence
  Synthetic
tgggcggcagtgcgcaat

SEQ ID NO: 24861 - DNA, 19 bp, Artificial Sequence
  Synthetic
cgcgccaagtccataccgg

SEQ ID NO: 24862 - DNA, 20 bp, Artificial Sequence
  Synthetic
gtccgcaccatcctgtcgca

SEQ ID NO: 24863 - DNA, 21 bp, Artificial Sequence
  Synthetic
tttcccgtccatccatcggca

SEQ ID NO: 24864 - DNA, 19 bp, Artificial Sequence
  Synthetic
ctgcgcctgcggcaatttg

SEQ ID NO: 24865 - DNA, 21 bp, Artificial Sequence
  Synthetic
gtgttgctgctggacgaaccg

SEQ ID NO: 24866 - DNA, 21 bp, Artificial Sequence
  Synthetic
gcatggcgacaatctcgtccc

SEQ ID NO: 24867 - DNA, 22 bp, Artificial Sequence
  Synthetic
attcggcgaacacatcatccgg

SEQ ID NO: 24868 - DNA, 24 bp, Artificial Sequence
  Synthetic
atcttgatgtgtttgtgttcgacg

SEQ ID NO: 24869 - DNA, 20 bp, Artificial Sequence
  Synthetic
ctgcaccgcagcaggatgtt

SEQ ID NO: 24870 - DNA, 22 bp, Artificial Sequence
  Synthetic
aacatcagcgtactcccccccg

SEQ ID NO: 24871 - DNA, 22 bp, Artificial Sequence
  Synthetic
gcgtaaccacttccacatcggt

SEQ ID NO: 24872 - DNA, 21 bp, Artificial Sequence
  Synthetic
gatgacggtccgttgcagtcg

SEQ ID NO: 24873 - DNA, 21 bp, Artificial Sequence
  Synthetic
ctggtgtggttggaagacggc

SEQ ID NO: 24874 - DNA, 18 bp, Artificial Sequence
  Synthetic
gcgggcgcgttcgtgtat

SEQ ID NO: 24875 - DNA, 22 bp, Artificial Sequence
  Synthetic
cgccattttgcgcccgatatgt

SEQ ID NO: 24876 - DNA, 19 bp, Artificial Sequence
  Synthetic
accgacgcaggcatcgatg

SEQ ID NO: 24877 - DNA, 21 bp, Artificial Sequence
  Synthetic
agcttcttcatctcgcgcgtg

SEQ ID NO: 24878 - DNA, 20 bp, Artificial Sequence
  Synthetic
atgggcatctaccggcgtga

SEQ ID NO: 24879 - DNA, 22 bp, Artificial Sequence
  Synthetic
cgacatcggcgatttcgtcctg

SEQ ID NO: 24880 - DNA, 21 bp, Artificial Sequence
  Synthetic
ttccgacaccgcaatatgccc

SEQ ID NO: 24881 - DNA, 21 bp, Artificial Sequence
  Synthetic
atcggcgtattcgatcggggc

SEQ ID NO: 24882 - DNA, 19 bp, Artificial Sequence
  Synthetic
tcttcggcggctttggcgg

SEQ ID NO: 24883 - DNA, 19 bp, Artificial Sequence
  Synthetic
cgcacgggattcagcggct

SEQ ID NO: 24884 - DNA, 20 bp, Artificial Sequence
  Synthetic
atgcgggcggaggattatgc

SEQ ID NO: 24885 - DNA, 19 bp, Artificial Sequence
  Synthetic
agtgctgaacgacacgcgc

SEQ ID NO: 24886 - DNA, 21 bp, Artificial Sequence
  Synthetic
cgcgattgagcaagacgcaaa

SEQ ID NO: 24887 - DNA, 20 bp, Artificial Sequence
  Synthetic
ggaggcggcggcgtataagg

SEQ ID NO: 24888 - DNA, 18 bp, Artificial Sequence
  Synthetic
atccgccgtggtgttgcc

SEQ ID NO: 24889 - DNA, 19 bp, Artificial Sequence
  Synthetic
acactgcctgggcaaagcg

SEQ ID NO: 24890 - DNA, 19 bp, Artificial Sequence
  Synthetic
gcccgaaactgccgcacct

SEQ ID NO: 24891 - DNA, 23 bp, Artificial Sequence
  Synthetic
aactgacgggcattttgaatttg

SEQ ID NO: 24892 - DNA, 20 bp, Artificial Sequence
  Synthetic
ccagtccgacccactgcatc

SEQ ID NO: 24893 - DNA, 21 bp, Artificial Sequence
  Synthetic
gggcggactgaatatccggtc

SEQ ID NO: 24894 - DNA, 20 bp, Artificial Sequence
  Synthetic
gcacaggcagtccgcgatcc

SEQ ID NO: 24895 - DNA, 22 bp, Artificial Sequence
  Synthetic
ttcaaccgcgatgtgtccgtag

SEQ ID NO: 24896 - DNA, 20 bp, Artificial Sequence
  Synthetic
cggtacatcacgctgcgctg

SEQ ID NO: 24897 - DNA, 20 bp, Artificial Sequence
  Synthetic
cggtacgcggccttggtaga

SEQ ID NO: 24898 - DNA, 20 bp, Artificial Sequence
  Synthetic
ctgcaggggctcgagtacgc

SEQ ID NO: 24899 - DNA, 22 bp, Artificial Sequence
  Synthetic
cagtcgtacatcgcaaacacgc

SEQ ID NO: 24900 - DNA, 19 bp, Artificial Sequence
  Synthetic
cccctcgctgccgttgact

SEQ ID NO: 24901 - DNA, 18 bp, Artificial Sequence
  Synthetic
cagcggcaaatcggcagc

SEQ ID NO: 24902 - DNA, 20 bp, Artificial Sequence
  Synthetic
cgtaaaaaccggcggcaaac

SEQ ID NO: 24903 - DNA, 22 bp, Artificial Sequence
  Synthetic
tttccagcgcggatattctggc

SEQ ID NO: 24904 - DNA, 22 bp, Artificial Sequence
  Synthetic
aggatggggtgcatacggtagc

SEQ ID NO: 24905 - DNA, 22 bp, Artificial Sequence
  Synthetic
ccgatacggtttggagccgttt

SEQ ID NO: 24906 - DNA, 21 bp, Artificial Sequence
  Synthetic
tggttcgcaccgctttacgaa

SEQ ID NO: 24907 - DNA, 20 bp, Artificial Sequence
  Synthetic
gcgaccataccaaacaccca

SEQ ID NO: 24908 - DNA, 20 bp, Artificial Sequence
  Synthetic
ggcaaagcaaaaacccccgg

SEQ ID NO: 24909 - DNA, 20 bp, Artificial Sequence
  Synthetic
tttgcctgacccactgcctg

SEQ ID NO: 24910 - DNA, 22 bp, Artificial Sequence
  Synthetic
cgaaatgattaaggcgggcgcg

SEQ ID NO: 24911 - DNA, 21 bp, Artificial Sequence
  Synthetic
acgttttaaacctcccccgcc

SEQ ID NO: 24912 - DNA, 19 bp, Artificial Sequence
  Synthetic
gccaccctgcaatcgctcg

SEQ ID NO: 24913 - DNA, 20 bp, Artificial Sequence
  Synthetic
tgcccaagctgatttcgccc

SEQ ID NO: 24914 - DNA, 22 bp, Artificial Sequence
  Synthetic
tcatcgaaatcaccgtccccga

SEQ ID NO: 24915 - DNA, 22 bp, Artificial Sequence
  Synthetic
tcgaaataccccaatcggaacc

SEQ ID NO: 24916 - DNA, 19 bp, Artificial Sequence
  Synthetic
gcggcagggttgggttcga

SEQ ID NO: 24917 - DNA, 19 bp, Artificial Sequence
  Synthetic
gtttcgcgcgcctcttgca

SEQ ID NO: 24918 - DNA, 20 bp, Artificial Sequence
  Synthetic
aaccgacttcccggcaaacg

SEQ ID NO: 24919 - DNA, 22 bp, Artificial Sequence
  Synthetic
gcgtggacggcttcttcaaagg

SEQ ID NO: 24920 - DNA, 18 bp, Artificial Sequence
  Synthetic
acggcggcgtttttgctg

SEQ ID NO: 24921 - DNA, 20 bp, Artificial Sequence
  Synthetic
atgttgtcggcaagctcgcg

SEQ ID NO: 24922 - DNA, 18 bp, Artificial Sequence
  Synthetic
ctttggcgggcgcggttt

SEQ ID NO: 24923 - DNA, 21 bp, Artificial Sequence
  Synthetic
ttccatacggacgttgtgcgc

SEQ ID NO: 24924 - DNA, 22 bp, Artificial Sequence
  Synthetic
atcggaagcttgtgcggattcg

SEQ ID NO: 24925 - DNA, 21 bp, Artificial Sequence
  Synthetic
acactgggcgagtttgacgac

SEQ ID NO: 24926 - DNA, 19 bp, Artificial Sequence
  Synthetic
aaacctgcccgccgtcatt

SEQ ID NO: 24927 - DNA, 20 bp, Artificial Sequence
  Synthetic
cttgccgatatgcttgccgc

SEQ ID NO: 24928 - DNA, 18 bp, Artificial Sequence
  Synthetic
gctgctgcaacgcgggtt

SEQ ID NO: 24929 - DNA, 19 bp, Artificial Sequence
  Synthetic
ggctgcctgccgacatcct

SEQ ID NO: 24930 - DNA, 21 bp, Artificial Sequence
  Synthetic
aaaaccctgcccatccccagc

SEQ ID NO: 24931 - DNA, 22 bp, Artificial Sequence
  Synthetic
atgtcaaacgcctctcctccgc

SEQ ID NO: 24932 - DNA, 21 bp, Artificial Sequence
  Synthetic
cggcgatgatggtgttttcgg

SEQ ID NO: 24933 - DNA, 19 bp, Artificial Sequence
  Synthetic
ggctggcgactctgctgca

SEQ ID NO: 24934 - DNA, 20 bp, Artificial Sequence
  Synthetic
cacgactgaaccgatgccgt

SEQ ID NO: 24935 - DNA, 19 bp, Artificial Sequence
  Synthetic
cgtcgatttcgcctgcggc

SEQ ID NO: 24936 - DNA, 22 bp, Artificial Sequence
  Synthetic
ggtggtgtccgaaatgtttgcg

SEQ ID NO: 24937 - DNA, 21 bp, Artificial Sequence
  Synthetic
taatagaggcccgccgcaaag

SEQ ID NO: 24938 - DNA, 22 bp, Artificial Sequence
  Synthetic
acggcatttgtcatcactggcc

SEQ ID NO: 24939 - DNA, 22 bp, Artificial Sequence
  Synthetic
ttacccatcgcaccgacaaaca

SEQ ID NO: 24940 - DNA, 22 bp, Artificial Sequence
  Synthetic
ttgaggccgtctgaaacttcgc

SEQ ID NO: 24941 - DNA, 20 bp, Artificial Sequence
  Synthetic
cacgcagaaggtcagcacca

SEQ ID NO: 24942 - DNA, 19 bp, Artificial Sequence
  Synthetic
gcccatgtgctgcggttgt

SEQ ID NO: 24943 - DNA, 21 bp, Artificial Sequence
  Synthetic
ggcggcggtatttatgtccgt

SEQ ID NO: 24944 - DNA, 20 bp, Artificial Sequence
  Synthetic
aaaaccgctcaaaccgccct

SEQ ID NO: 24945 - DNA, 19 bp, Artificial Sequence
  Synthetic
ggtcaacgcaggcggttcg

SEQ ID NO: 24946 - DNA, 21 bp, Artificial Sequence
  Synthetic
ccaacacacccaagccacaca

SEQ ID NO: 24947 - DNA, 22 bp, Artificial Sequence
  Synthetic
attcggtgactacggctggatg

SEQ ID NO: 24948 - DNA, 20 bp, Artificial Sequence
  Synthetic
caccaacctcaccggctcaa

SEQ ID NO: 24949 - DNA, 21 bp, Artificial Sequence
  Synthetic
gttccgccacaaacaactggg

SEQ ID NO: 24950 - DNA, 21 bp, Artificial Sequence
  Synthetic
ggcttcccaagtacaggcctc

SEQ ID NO: 24951 - DNA, 18 bp, Artificial Sequence
  Synthetic
ggacgtgccgccgatgtt

SEQ ID NO: 24952 - DNA, 21 bp, Artificial Sequence
  Synthetic
ccagaagcgtttgcctgtggc

SEQ ID NO: 24953 - DNA, 22 bp, Artificial Sequence
  Synthetic
gagggtgaggatttcgtcgtgg

SEQ ID NO: 24954 - DNA, 20 bp, Artificial Sequence
  Synthetic
ggtcagacgctcgacggtgt

SEQ ID NO: 24955 - DNA, 19 bp, Artificial Sequence
  Synthetic
gcgtgggcgtatccgtcgt

SEQ ID NO: 24956 - DNA, 18 bp, Artificial Sequence
  Synthetic
gcgcggcaggcatcattc

SEQ ID NO: 24957 - DNA, 19 bp, Artificial Sequence
  Synthetic
agcgtgttcaatggcggcg

SEQ ID NO: 24958 - DNA, 19 bp, Artificial Sequence
  Synthetic
gcacgctcgcgctcttgga

SEQ ID NO: 24959 - DNA, 21 bp, Artificial Sequence
  Synthetic
gtgccgactgttttgccgacg

SEQ ID NO: 24960 - DNA, 22 bp, Artificial Sequence
  Synthetic
ttccgacaaaatccggctcaca

SEQ ID NO: 24961 - DNA, 20 bp, Artificial Sequence
  Synthetic
cgaagccgacgaacgcaagg

SEQ ID NO: 24962 - DNA, 21 bp, Artificial Sequence
  Synthetic
aaacagccgttgaccgcaacc

SEQ ID NO: 24963 - DNA, 20 bp, Artificial Sequence
  Synthetic
gacaaactccgcacgtccgc

SEQ ID NO: 24964 - DNA, 19 bp, Artificial Sequence
  Synthetic
cggcacgcctttcagacgg

SEQ ID NO: 24965 - DNA, 19 bp, Artificial Sequence
  Synthetic
cgaaagcagccacgtcgcc

SEQ ID NO: 24966 - DNA, 21 bp, Artificial Sequence
  Synthetic
ctgaacgaaaaacgcgccgag

SEQ ID NO: 24967 - DNA, 18 bp, Artificial Sequence
  Synthetic
acgtggccaaaccgcacc

SEQ ID NO: 24968 - DNA, 20 bp, Artificial Sequence
  Synthetic
catcgccacacccgttcaga

SEQ ID NO: 24969 - DNA, 18 bp, Artificial Sequence
  Synthetic
accgcacaaaccggcgga

SEQ ID NO: 24970 - DNA, 19 bp, Artificial Sequence
  Synthetic
cgtgatcgacggaggtgcg

SEQ ID NO: 24971 - DNA, 22 bp, Artificial Sequence
  Synthetic
ttggaaaactacgaaggcggcc

SEQ ID NO: 24972 - DNA, 20 bp, Artificial Sequence
  Synthetic
cccgaacctcgattacgccg

SEQ ID NO: 24973 - DNA, 19 bp, Artificial Sequence
  Synthetic
atccgccctctttgctgcg

SEQ ID NO: 24974 - DNA, 21 bp, Artificial Sequence
  Synthetic
gtcgtcgttttgcccacaccg

SEQ ID NO: 24975 - DNA, 18 bp, Artificial Sequence
  Synthetic
gccattgccgccgccaaa

SEQ ID NO: 24976 - DNA, 19 bp, Artificial Sequence
  Synthetic
aaaagccgcagccacctcg

SEQ ID NO: 24977 - DNA, 19 bp, Artificial Sequence
  Synthetic
tgctcgaccgccacttcac

SEQ ID NO: 24978 - DNA, 22 bp, Artificial Sequence
  Synthetic
caggaaatttccgccctcgtca

SEQ ID NO: 24979 - DNA, 22 bp, Artificial Sequence
  Synthetic
caaacttgggactgaacccggc

SEQ ID NO: 24980 - DNA, 19 bp, Artificial Sequence
  Synthetic
aggcgctcggcaaacacaa

SEQ ID NO: 24981 - DNA, 22 bp, Artificial Sequence
  Synthetic
gcgacacctacaacgacacaca

SEQ ID NO: 24982 - DNA, 22 bp, Artificial Sequence
  Synthetic
atcgccgacaaaaccaccatcg

SEQ ID NO: 24983 - DNA, 19 bp, Artificial Sequence
  Synthetic
ccgggcgcggtattctgga

SEQ ID NO: 24984 - DNA, 19 bp, Artificial Sequence
  Synthetic
ggacgacgtacgcgccgaa

SEQ ID NO: 24985 - DNA, 18 bp, Artificial Sequence
  Synthetic
cgacggcggcgagattgt

SEQ ID NO: 24986 - DNA, 24 bp, Artificial Sequence
  Synthetic
accaataccgtaaatagcctgaag

SEQ ID NO: 24987 - DNA, 22 bp, Artificial Sequence
  Synthetic
aaatgtcttccactgtcaagcc

SEQ ID NO: 24988 - DNA, 22 bp, Artificial Sequence
  Synthetic
cgacagcagctttgatttcagg

SEQ ID NO: 24989 - DNA, 20 bp, Artificial Sequence
  Synthetic
cgccgcatattttcagacgg

SEQ ID NO: 24990 - DNA, 19 bp, Artificial Sequence
  Synthetic
ccccttcagacggcatcgc

SEQ ID NO: 24991 - DNA, 21 bp, Artificial Sequence
  Synthetic
gagttcgcggttttcaacgcg

SEQ ID NO: 24992 - DNA, 21 bp, Artificial Sequence
  Synthetic
gtaaccagactgtacgggccg

SEQ ID NO: 24993 - DNA, 21 bp, Artificial Sequence
  Synthetic
gggaatcagaagcggtagcgc

SEQ ID NO: 24994 - DNA, 19 bp, Artificial Sequence
  Synthetic
gccaggccggcggtaatca

SEQ ID NO: 24995 - DNA, 20 bp, Artificial Sequence
  Synthetic
atatgccccgttccgtcggc

SEQ ID NO: 24996 - DNA, 19 bp, Artificial Sequence
  Synthetic
gcgcgtatcagcacggtga

SEQ ID NO: 24997 - DNA, 21 bp, Artificial Sequence
  Synthetic
tggtcgaaaccgccatttccg

SEQ ID NO: 24998 - DNA, 20 bp, Artificial Sequence
  Synthetic
cgctgaacgccaataccgcc

SEQ ID NO: 24999 - DNA, 22 bp, Artificial Sequence
  Synthetic
cggcgcgtatccgtttgaaacc

SEQ ID NO: 25000 - DNA, 20 bp, Artificial Sequence
  Synthetic
acggcgttgaacgaagtcga

SEQ ID NO: 25001 - DNA, 19 bp, Artificial Sequence
  Synthetic
gcgtgggcgtgaactaccg

SEQ ID NO: 25002 - DNA, 22 bp, Artificial Sequence
  Synthetic
aattgttggaatccggcttgtt

SEQ ID NO: 25003 - DNA, 19 bp, Artificial Sequence
  Synthetic
cgcgcgggtcttggacgaa

SEQ ID NO: 25004 - DNA, 21 bp, Artificial Sequence
  Synthetic
tttgaccaactcggcaagcgg

SEQ ID NO: 25005 - DNA, 19 bp, Artificial Sequence
  Synthetic
gcaccagttcgcccgcgat

SEQ ID NO: 25006 - DNA, 20 bp, Artificial Sequence
  Synthetic
cgcccgtggcttctttacgg

SEQ ID NO: 25007 - DNA, 22 bp, Artificial Sequence
  Synthetic
aacgccgccatttccatatcgg

SEQ ID NO: 25008 - DNA, 20 bp, Artificial Sequence
  Synthetic
gcacttctaactccccgccc

SEQ ID NO: 25009 - DNA, 22 bp, Artificial Sequence
  Synthetic
tttgcaaaggtctcagaatgcc

SEQ ID NO: 25010 - DNA, 21 bp, Artificial Sequence
  Synthetic
agcgtaccgaccgacaatccg

SEQ ID NO: 25011 - DNA, 20 bp, Artificial Sequence
  Synthetic
cgtattccccgccggagaga

SEQ ID NO: 25012 - DNA, 20 bp, Artificial Sequence
  Synthetic
aatacgcgatgcagctcgcc

SEQ ID NO: 25013 - DNA, 19 bp, Artificial Sequence
  Synthetic
aagctcgccatgcccttcg

SEQ ID NO: 25014 - DNA, 22 bp, Artificial Sequence
  Synthetic
ttccaaatcatcctgccccacc

SEQ ID NO: 25015 - DNA, 21 bp, Artificial Sequence
  Synthetic
tgagccgccttctcgacaacc

SEQ ID NO: 25016 - DNA, 18 bp, Artificial Sequence
  Synthetic
attccgccatgccgtccg

SEQ ID NO: 25017 - DNA, 20 bp, Artificial Sequence
  Synthetic
cggcgtaatcgtcggctcgc

SEQ ID NO: 25018 - DNA, 20 bp, Artificial Sequence
  Synthetic
cgcataccgcagcgaaatgc

SEQ ID NO: 25019 - DNA, 20 bp, Artificial Sequence
  Synthetic
gcagcagcggaacacaaagc

SEQ ID NO: 25020 - DNA, 19 bp, Artificial Sequence
  Synthetic
cggttccctaaggcgccca

SEQ ID NO: 25021 - DNA, 19 bp, Artificial Sequence
  Synthetic
tgcagaccggcaagctgtt

SEQ ID NO: 25022 - DNA, 19 bp, Artificial Sequence
  Synthetic
gcgggcgaactcgacgctt

SEQ ID NO: 25023 - DNA, 22 bp, Artificial Sequence
  Synthetic
atgattttggacatcggcccga

SEQ ID NO: 25024 - DNA, 21 bp, Artificial Sequence
  Synthetic
ggttggcgcagaagctgtttg

SEQ ID NO: 25025 - DNA, 22 bp, Artificial Sequence
  Synthetic
agacgacctgattattgcccgc

SEQ ID NO: 25026 - DNA, 21 bp, Artificial Sequence
  Synthetic
aagggtttccaacaggctgct

SEQ ID NO: 25027 - DNA, 21 bp, Artificial Sequence
  Synthetic
cgccgacctgttcgcaaatcg

SEQ ID NO: 25028 - DNA, 22 bp, Artificial Sequence
  Synthetic
aaatgccgtctgaacacattgc

SEQ ID NO: 25029 - DNA, 20 bp, Artificial Sequence
  Synthetic
cgggctgccgtttaccatag

SEQ ID NO: 25030 - DNA, 23 bp, Artificial Sequence
  Synthetic
gttcaagtttcggctattgcaaa

SEQ ID NO: 25031 - DNA, 21 bp, Artificial Sequence
  Synthetic
ccgcaacacaagggtatgatt

SEQ ID NO: 25032 - DNA, 20 bp, Artificial Sequence
  Synthetic
ccgcagttttgccctgtcct

SEQ ID NO: 25033 - DNA, 20 bp, Artificial Sequence
  Synthetic
tatcgacatcgggcacgctg

SEQ ID NO: 25034 - DNA, 19 bp, Artificial Sequence
  Synthetic
gtaatcctgccgccgagcg

SEQ ID NO: 25035 - DNA, 19 bp, Artificial Sequence
  Synthetic
ccgggcaatacggcatcgc

SEQ ID NO: 25036 - DNA, 18 bp, Artificial Sequence
  Synthetic
gcatcgggcggcttgtgt

SEQ ID NO: 25037 - DNA, 20 bp, Artificial Sequence
  Synthetic
cgagatagccttgcgcggtc

SEQ ID NO: 25038 - DNA, 20 bp, Artificial Sequence
  Synthetic
ggtacagcccgaagcgcaaa

SEQ ID NO: 25039 - DNA, 20 bp, Artificial Sequence
  Synthetic
ggcagaggtgcggattagcg

SEQ ID NO: 25040 - DNA, 22 bp, Artificial Sequence
  Synthetic
ttttccggccttctgcgagaaa

SEQ ID NO: 25041 - DNA, 19 bp, Artificial Sequence
  Synthetic
agatgaggaggcagcgggc

SEQ ID NO: 25042 - DNA, 24 bp, Artificial Sequence
  Synthetic
ggcatattaacaacatcaaccctg

SEQ ID NO: 25043 - DNA, 21 bp, Artificial Sequence
  Synthetic
cgatggggaggtttggaagct

SEQ ID NO: 25044 - DNA, 19 bp, Artificial Sequence
  Synthetic
cgtaacctacgccgcccag

SEQ ID NO: 25045 - DNA, 19 bp, Artificial Sequence
  Synthetic
cggcatcttgtccgacggc

SEQ ID NO: 25046 - DNA, 19 bp, Artificial Sequence
  Synthetic
ggtaggaacgggcggtggt

SEQ ID NO: 25047 - DNA, 19 bp, Artificial Sequence
  Synthetic
gcggatgggggacgttgag

SEQ ID NO: 25048 - DNA, 19 bp, Artificial Sequence
  Synthetic
gcaaaggcggcttgggcaa

SEQ ID NO: 25049 - DNA, 20 bp, Artificial Sequence
  Synthetic
tgattaccgccgtctccgcc

SEQ ID NO: 25050 - DNA, 21 bp, Artificial Sequence
  Synthetic
ctatcacgcaccggtctgctg

SEQ ID NO: 25051 - DNA, 22 bp, Artificial Sequence
  Synthetic
ggcaggcgtatgcgaaagatgt

SEQ ID NO: 25052 - DNA, 21 bp, Artificial Sequence
  Synthetic
ccatgcccagtttgcggatgc

SEQ ID NO: 25053 - DNA, 18 bp, Artificial Sequence
  Synthetic
gccggaagcggcttggta

SEQ ID NO: 25054 - DNA, 22 bp, Artificial Sequence
  Synthetic
catcggcaagattttcggtcgc

SEQ ID NO: 25055 - DNA, 20 bp, Artificial Sequence
  Synthetic
gcagcagatgccggcgcata

SEQ ID NO: 25056 - DNA, 18 bp, Artificial Sequence
  Synthetic
gcctgttgcggcacttgc

SEQ ID NO: 25057 - DNA, 19 bp, Artificial Sequence
  Synthetic
cgaagcggcgggattcgga

SEQ ID NO: 25058 - DNA, 22 bp, Artificial Sequence
  Synthetic
ttgtcgaacactttgccgaagc

SEQ ID NO: 25059 - DNA, 22 bp, Artificial Sequence
  Synthetic
aacaaccgtccgatttggtgcg

SEQ ID NO: 25060 - DNA, 22 bp, Artificial Sequence
  Synthetic
gcaatacgccgtcaaaacccca

SEQ ID NO: 25061 - DNA, 19 bp, Artificial Sequence
  Synthetic
gacagggcgcggtcgagtt

SEQ ID NO: 25062 - DNA, 19 bp, Artificial Sequence
  Synthetic
gcggttttcgcgccgtagc

SEQ ID NO: 25063 - DNA, 22 bp, Artificial Sequence
  Synthetic
tcatcgtgagcgtgttcagacg

SEQ ID NO: 25064 - DNA, 19 bp, Artificial Sequence
  Synthetic
ggcatgacggcggacagtt

SEQ ID NO: 25065 - DNA, 22 bp, Artificial Sequence
  Synthetic
atttcggcaatcgataccgccg

SEQ ID NO: 25066 - DNA, 18 bp, Artificial Sequence
  Synthetic
gcaaacacgccgccgaca

SEQ ID NO: 25067 - DNA, 21 bp, Artificial Sequence
  Synthetic
cgaactttccggcggtcagaa

SEQ ID NO: 25068 - DNA, 22 bp, Artificial Sequence
  Synthetic
gtcgaattcgtcctgaccgagg

SEQ ID NO: 25069 - DNA, 20 bp, Artificial Sequence
  Synthetic
gttggcgatgctggtggtgg

SEQ ID NO: 25070 - DNA, 19 bp, Artificial Sequence
  Synthetic
ccgcgtccgattccacgct

SEQ ID NO: 25071 - DNA, 19 bp, Artificial Sequence
  Synthetic
ggttcgcccgcttccagca

SEQ ID NO: 25072 - DNA, 19 bp, Artificial Sequence
  Synthetic
tggcagccctctcgcctga

SEQ ID NO: 25073 - DNA, 20 bp, Artificial Sequence
  Synthetic
accttggttgccgcgacttt

SEQ ID NO: 25074 - DNA, 18 bp, Artificial Sequence
  Synthetic
aacggcgtggcgcaaggt

SEQ ID NO: 25075 - DNA, 21 bp, Artificial Sequence
  Synthetic
tttggcagaggcgctcaaaga

SEQ ID NO: 25076 - DNA, 21 bp, Artificial Sequence
  Synthetic
ccggcatcggcgatctcatct

SEQ ID NO: 25077 - DNA, 22 bp, Artificial Sequence
  Synthetic
gtgccgtagtggttttcgagca

SEQ ID NO: 25078 - DNA, 20 bp, Artificial Sequence
  Synthetic
ggaagggcggcttcttctgc

SEQ ID NO: 25079 - DNA, 20 bp, Artificial Sequence
  Synthetic
atgcgctgaaaacacccccg

SEQ ID NO: 25080 - DNA, 22 bp, Artificial Sequence
  Synthetic
ggcatcgggaacttaatcaggg

SEQ ID NO: 25081 - DNA, 21 bp, Artificial Sequence
  Synthetic
gcccgaagatttggtgtgccg

SEQ ID NO: 25082 - DNA, 22 bp, Artificial Sequence
  Synthetic
atgagtatcgtgctgcacggcg

SEQ ID NO: 25083 - DNA, 19 bp, Artificial Sequence
  Synthetic
ggccagccgtccgcattca

SEQ ID NO: 25084 - DNA, 20 bp, Artificial Sequence
  Synthetic
cgacaacgccctgagcaagg

SEQ ID NO: 25085 - DNA, 18 bp, Artificial Sequence
  Synthetic
tcgtctttggcggcgtcg

SEQ ID NO: 25086 - DNA, 19 bp, Artificial Sequence
  Synthetic
gcgaggtaggcggtcagca

SEQ ID NO: 25087 - DNA, 21 bp, Artificial Sequence
  Synthetic
cgtcggtgttgacggcaatgc

SEQ ID NO: 25088 - DNA, 18 bp, Artificial Sequence
  Synthetic
gccgccggcattgtcgat

SEQ ID NO: 25089 - DNA, 22 bp, Artificial Sequence
  Synthetic
cggaaggattgcaggcttttgg

SEQ ID NO: 25090 - DNA, 20 bp, Artificial Sequence
  Synthetic
tcaaacagagcccgacgtgg

SEQ ID NO: 25091 - DNA, 20 bp, Artificial Sequence
  Synthetic
gcgtgaaggtcgccaaaggc

SEQ ID NO: 25092 - DNA, 22 bp, Artificial Sequence
  Synthetic
cgttttcctgatgttccgtctt

SEQ ID NO: 25093 - DNA, 20 bp, Artificial Sequence
  Synthetic
cgggctgtccgtccgtatcg

SEQ ID NO: 25094 - DNA, 22 bp, Artificial Sequence
  Synthetic
attcatcgcggcaggttgacgg

SEQ ID NO: 25095 - DNA, 20 bp, Artificial Sequence
  Synthetic
caggcctcaacccatcctgc

SEQ ID NO: 25096 - DNA, 22 bp, Artificial Sequence
  Synthetic
aagctccctgccgtggattttg

SEQ ID NO: 25097 - DNA, 20 bp, Artificial Sequence
  Synthetic
cggggacgcggatttcagac

SEQ ID NO: 25098 - DNA, 19 bp, Artificial Sequence
  Synthetic
gttccgcgccgatgatgcg

SEQ ID NO: 25099 - DNA, 20 bp, Artificial Sequence
  Synthetic
tgatgttgacggcgcagtgg

SEQ ID NO: 25100 - DNA, 19 bp, Artificial Sequence
  Synthetic
gatgacgggcgcgacgtgt

SEQ ID NO: 25101 - DNA, 21 bp, Artificial Sequence
  Synthetic
aaagacggcttcatgcgtgcg

SEQ ID NO: 25102 - DNA, 20 bp, Artificial Sequence
  Synthetic
gaagcccagtccgacgacgt

SEQ ID NO: 25103 - DNA, 19 bp, Artificial Sequence
  Synthetic
cgtatggcgaggcggtcga

SEQ ID NO: 25104 - DNA, 22 bp, Artificial Sequence
  Synthetic
gcgaaattttgccgcctactgc

SEQ ID NO: 25105 - DNA, 20 bp, Artificial Sequence
  Synthetic
gcctgcctgaaaggttcgga

SEQ ID NO: 25106 - DNA, 19 bp, Artificial Sequence
  Synthetic
gacgatgccgcgctgctgt

SEQ ID NO: 25107 - DNA, 19 bp, Artificial Sequence
  Synthetic
gtagccgcgtttgagggcg

SEQ ID NO: 25108 - DNA, 20 bp, Artificial Sequence
  Synthetic
tcgccttcggcatagggaca

SEQ ID NO: 25109 - DNA, 21 bp, Artificial Sequence
  Synthetic
cccgcgccggtaatcagaatc

SEQ ID NO: 25110 - DNA, 22 bp, Artificial Sequence
  Synthetic
actttgccgagcatatagccgc

SEQ ID NO: 25111 - DNA, 19 bp, Artificial Sequence
  Synthetic
cgcgaagggcagtacgtcc

SEQ ID NO: 25112 - DNA, 21 bp, Artificial Sequence
  Synthetic
atgccgtatcacgttccccct

SEQ ID NO: 25113 - DNA, 19 bp, Artificial Sequence
  Synthetic
gacgccgcctacgcactca

SEQ ID NO: 25114 - DNA, 20 bp, Artificial Sequence
  Synthetic
acaccttggctcgttccaaa

SEQ ID NO: 25115 - DNA, 22 bp, Artificial Sequence
  Synthetic
atcaggtaggcaaacaccgcca

SEQ ID NO: 25116 - DNA, 19 bp, Artificial Sequence
  Synthetic
ccaaggcgaggacggtgca

SEQ ID NO: 25117 - DNA, 19 bp, Artificial Sequence
  Synthetic
cgtcatacaggcgcgggct

SEQ ID NO: 25118 - DNA, 18 bp, Artificial Sequence
  Synthetic
ttccgcgctgcaacacgc

SEQ ID NO: 25119 - DNA, 19 bp, Artificial Sequence
  Synthetic
ccgttaccggggttctgcg

SEQ ID NO: 25120 - DNA, 21 bp, Artificial Sequence
  Synthetic
acctgaacgccttgtcctcca

SEQ ID NO: 25121 - DNA, 19 bp, Artificial Sequence
  Synthetic
gttggcgggttggatgggc

SEQ ID NO: 25122 - DNA, 19 bp, Artificial Sequence
  Synthetic
gccgcatttcaaagcggcg

SEQ ID NO: 25123 - DNA, 22 bp, Artificial Sequence
  Synthetic
cgaacctgccgatgccgtattg

SEQ ID NO: 25124 - DNA, 19 bp, Artificial Sequence
  Synthetic
gtttgttggcggtaggcgc

SEQ ID NO: 25125 - DNA, 18 bp, Artificial Sequence
  Synthetic
cgcgcgttccgaacccaa

SEQ ID NO: 25126 - DNA, 19 bp, Artificial Sequence
  Synthetic
gatgccggaaccgacaccg

SEQ ID NO: 25127 - DNA, 20 bp, Artificial Sequence
  Synthetic
cgccttcaaaccccaagccg

SEQ ID NO: 25128 - DNA, 18 bp, Artificial Sequence
  Synthetic
gcgcggcgttcgtcttgt

SEQ ID NO: 25129 - DNA, 19 bp, Artificial Sequence
  Synthetic
gcggggaggccgtctgaat

SEQ ID NO: 25130 - DNA, 21 bp, Artificial Sequence
  Synthetic
cgctcttcaatcagcgtgccc

SEQ ID NO: 25131 - DNA, 18 bp, Artificial Sequence
  Synthetic
ggcatgcgccgcattgtg

SEQ ID NO: 25132 - DNA, 18 bp, Artificial Sequence
  Synthetic
tggcccggcgtgttttcc

SEQ ID NO: 25133 - DNA, 21 bp, Artificial Sequence
  Synthetic
cctgggctttgctgatgacgc

SEQ ID NO: 25134 - DNA, 19 bp, Artificial Sequence
  Synthetic
ggcggccagcagcttgtct

SEQ ID NO: 25135 - DNA, 18 bp, Artificial Sequence
  Synthetic
gttgcgcgcgtctgtggt

SEQ ID NO: 25136 - DNA, 22 bp, Artificial Sequence
  Synthetic
agtcatcgtcttcatcgtcgcc

SEQ ID NO: 25137 - DNA, 19 bp, Artificial Sequence
  Synthetic
ccagccgccgcctttcctt

SEQ ID NO: 25138 - DNA, 19 bp, Artificial Sequence
  Synthetic
gccgtctgaacgcgaccgt

SEQ ID NO: 25139 - DNA, 22 bp, Artificial Sequence
  Synthetic
tcggtttgattcctaccggcga

SEQ ID NO: 25140 - DNA, 22 bp, Artificial Sequence
  Synthetic
cctgctgaaaaaagccgatgcc

SEQ ID NO: 25141 - DNA, 21 bp, Artificial Sequence
  Synthetic
gtcgccgtcagccattattgc

SEQ ID NO: 25142 - DNA, 22 bp, Artificial Sequence
  Synthetic
ttgccgcttctgatcgattgcc

SEQ ID NO: 25143 - DNA, 20 bp, Artificial Sequence
  Synthetic
taccgcgaacgcatgagggc

SEQ ID NO: 25144 - DNA, 19 bp, Artificial Sequence
  Synthetic
agggcgcgggtcatatcgg

SEQ ID NO: 25145 - DNA, 18 bp, Artificial Sequence
  Synthetic
ggcaatggcgacgcgttg

SEQ ID NO: 25146 - DNA, 20 bp, Artificial Sequence
  Synthetic
ggcgaggaacatcgtctgca

SEQ ID NO: 25147 - DNA, 19 bp, Artificial Sequence
  Synthetic
ggcgatgaaggcggcaaga

SEQ ID NO: 25148 - DNA, 19 bp, Artificial Sequence
  Synthetic
gcagccatggtgcgtccga

SEQ ID NO: 25149 - DNA, 22 bp, Artificial Sequence
  Synthetic
catgagttgtgccagttccgcc

SEQ ID NO: 25150 - DNA, 20 bp, Artificial Sequence
  Synthetic
tggagacaacatgtagcgca

SEQ ID NO: 25151 - DNA, 25 bp, Artificial Sequence
  Synthetic
gacagttggtgtcctaattgtaaca

SEQ ID NO: 25152 - DNA, 24 bp, Artificial Sequence
  Synthetic
aaaggaggttattgtttgaggaca

SEQ ID NO: 25153 - DNA, 23 bp, Artificial Sequence
  Synthetic
acagctgacgttaattagccacc

SEQ ID NO: 25154 - DNA, 25 bp, Artificial Sequence
  Synthetic
atcccttgcgaaatctaaatatgca

SEQ ID NO: 25155 - DNA, 25 bp, Artificial Sequence
  Synthetic
tttggagtgtgcattacaaaaatga

SEQ ID NO: 25156 - DNA, 21 bp, Artificial Sequence
  Synthetic
aacctaaacttgggtcccctg

SEQ ID NO: 25157 - DNA, 24 bp, Artificial Sequence
  Synthetic
tattgcagtgattgatacaccagg

SEQ ID NO: 25158 - DNA, 25 bp, Artificial Sequence
  Synthetic
acaagacaggttttaaatgtcaccg

SEQ ID NO: 25159 - DNA, 25 bp, Artificial Sequence
  Synthetic
accaccagcatttaatgtaaaagtg

SEQ ID NO: 25160 - DNA, 25 bp, Artificial Sequence
  Synthetic
agtaggggttcaaattgatagaggt

SEQ ID NO: 25161 - DNA, 25 bp, Artificial Sequence
  Synthetic
aaggagatagtttacctacagaccc

SEQ ID NO: 25162 - DNA, 25 bp, Artificial Sequence
  Synthetic
acttgatgagtgggaattagcattt

SEQ ID NO: 25163 - DNA, 25 bp, Artificial Sequence
  Synthetic
gacctatgtgtaagtgaccaatagc

SEQ ID NO: 25164 - DNA, 25 bp, Artificial Sequence
  Synthetic
aaatcgaaacaaacaaatttgcagc

SEQ ID NO: 25165 - DNA, 23 bp, Artificial Sequence
  Synthetic
cgagattggagtgacaaggagag

SEQ ID NO: 25166 - DNA, 21 bp, Artificial Sequence
  Synthetic
cggtccaaattcctgctgatg

SEQ ID NO: 25167 - DNA, 21 bp, Artificial Sequence
  Synthetic
aaagtgggcacttggtgagaa

SEQ ID NO: 25168 - DNA, 23 bp, Artificial Sequence
  Synthetic
aggaattacttcacagcagaggt

SEQ ID NO: 25169 - DNA, 23 bp, Artificial Sequence
  Synthetic
gcatggagttttctctcactgac

SEQ ID NO: 25170 - DNA, 25 bp, Artificial Sequence
  Synthetic
tgagaataaatcagaaacatggccc

SEQ ID NO: 25171 - DNA, 22 bp, Artificial Sequence
  Synthetic
agcgataggaggggatgctagg

SEQ ID NO: 25172 - DNA, 21 bp, Artificial Sequence
  Synthetic
tgggatgctcctcccgattcc

SEQ ID NO: 25173 - DNA, 20 bp, Artificial Sequence
  Synthetic
tccttcggatgcccaggtcg

SEQ ID NO: 25174 - DNA, 19 bp, Artificial Sequence
  Synthetic
cgctcccctcgttccacct

SEQ ID NO: 25175 - DNA, 21 bp, Artificial Sequence
  Synthetic
aaggcctcttcctaggtccgg

SEQ ID NO: 25176 - DNA, 20 bp, Artificial Sequence
  Synthetic
agagaacgacccagaacgct

SEQ ID NO: 25177 - DNA, 23 bp, Artificial Sequence
  Synthetic
attggggccagaagaaaaacaaa

SEQ ID NO: 25178 - DNA, 25 bp, Artificial Sequence
  Synthetic
ttggactatgaacaatttgacagct

SEQ ID NO: 25179 - DNA, 21 bp, Artificial Sequence
  Synthetic
ggggtgtacagggtggttttc

SEQ ID NO: 25180 - DNA, 21 bp, Artificial Sequence
  Synthetic
actaggtagtcagaacagccc

SEQ ID NO: 25181 - DNA, 20 bp, Artificial Sequence
  Synthetic
ggaggacgcggacaaagaaa

SEQ ID NO: 25182 - DNA, 20 bp, Artificial Sequence
  Synthetic
acagaagcttggacaatgcg

SEQ ID NO: 25183 - DNA, 21 bp, Artificial Sequence
  Synthetic
tggactttaaacaagaggcgg

SEQ ID NO: 25184 - DNA, 20 bp, Artificial Sequence
  Synthetic
ccactgtcaccacagctgcc

SEQ ID NO: 25185 - DNA, 23 bp, Artificial Sequence
  Synthetic
acctacatttagtggtggcaatg

SEQ ID NO: 25186 - DNA, 23 bp, Artificial Sequence
  Synthetic
cgcaaaggtactgtacgctatag

SEQ ID NO: 25187 - DNA, 23 bp, Artificial Sequence
  Synthetic
taccagttccaagatatgcctcc

SEQ ID NO: 25188 - DNA, 20 bp, Artificial Sequence
  Synthetic
tttcagatggctttgtggcg

SEQ ID NO: 25189 - DNA, 20 bp, Artificial Sequence
  Synthetic
tggattgcctgatccacagt

SEQ ID NO: 25190 - DNA, 20 bp, Artificial Sequence
  Synthetic
gggattgcccccccttagaa

SEQ ID NO: 25191 - DNA, 20 bp, Artificial Sequence
  Synthetic
gggatgctatacccaccact

SEQ ID NO: 25192 - DNA, 25 bp, Artificial Sequence
  Synthetic
acaactgtatgtaatgtaaaggcgt

SEQ ID NO: 25193 - DNA, 22 bp, Artificial Sequence
  Synthetic
ccaccttagtatgtaggcggcg

SEQ ID NO: 25194 - DNA, 20 bp, Artificial Sequence
  Synthetic
ttgcgaggggatctgggagt

SEQ ID NO: 25195 - DNA, 22 bp, Artificial Sequence
  Synthetic
tggagtcaactgggctactggt

SEQ ID NO: 25196 - DNA, 22 bp, Artificial Sequence
  Synthetic
acacccttccaattggactggc

SEQ ID NO: 25197 - DNA, 25 bp, Artificial Sequence
  Synthetic
cgaggggatgtatggttaaattcaa

SEQ ID NO: 25198 - DNA, 20 bp, Artificial Sequence
  Synthetic
gtaccccacctgtggtacgt

SEQ ID NO: 25199 - DNA, 22 bp, Artificial Sequence
  Synthetic
tggagggctgacaataccacct

SEQ ID NO: 25200 - DNA, 23 bp, Artificial Sequence
  Synthetic
gttagggcccatagaatgttggt

SEQ ID NO: 25201 - DNA, 19 bp, Artificial Sequence
  Synthetic
cgccagatgggtgggccat

SEQ ID NO: 25202 - DNA, 22 bp, Artificial Sequence
  Synthetic
gtcccttactcggtgctcttgc

SEQ ID NO: 25203 - DNA, 25 bp, Artificial Sequence
  Synthetic
tcttacatgcaggagaagtatgagg

SEQ ID NO: 25204 - DNA, 25 bp, Artificial Sequence
  Synthetic
acatgccaacataactgagattcaa

SEQ ID NO: 25205 - DNA, 20 bp, Artificial Sequence
  Synthetic
caacctgggttacctgcgat

SEQ ID NO: 25206 - DNA, 22 bp, Artificial Sequence
  Synthetic
cctcatgcagctacaatccttg

SEQ ID NO: 25207 - DNA, 22 bp, Artificial Sequence
  Synthetic
gtctactccgcgttcaatccgg

SEQ ID NO: 25208 - DNA, 25 bp, Artificial Sequence
  Synthetic
ggactagtcttgtcgtcaattatgg

SEQ ID NO: 25209 - DNA, 20 bp, Artificial Sequence
  Synthetic
ccatgccgatgcccctgttg

SEQ ID NO: 25210 - DNA, 21 bp, Artificial Sequence
  Synthetic
caactcgggccatcactagtg

SEQ ID NO: 25211 - DNA, 21 bp, Artificial Sequence
  Synthetic
ttgcagaagtgtgtcgaggca

SEQ ID NO: 25212 - DNA, 22 bp, Artificial Sequence
  Synthetic
aactcagtgaccaacaccgagc

SEQ ID NO: 25213 - DNA, 22 bp, Artificial Sequence
  Synthetic
tgcagacaaacaagcaatgcgt

SEQ ID NO: 25214 - DNA, 21 bp, Artificial Sequence
  Synthetic
gcatcattgctggtgtgcacg

SEQ ID NO: 25215 - DNA, 22 bp, Artificial Sequence
  Synthetic
attgtgatgtttactccccgga

SEQ ID NO: 25216 - DNA, 22 bp, Artificial Sequence
  Synthetic
tggtctgaaggggatgacgtcc

SEQ ID NO: 25217 - DNA, 21 bp, Artificial Sequence
  Synthetic
gaattcaactcccccccaaac

SEQ ID NO: 25218 - DNA, 20 bp, Artificial Sequence
  Synthetic
tggggacatctgggtgacaa

SEQ ID NO: 25219 - DNA, 22 bp, Artificial Sequence
  Synthetic
aacgggggatgataaaaatgca

SEQ ID NO: 25220 - DNA, 21 bp, Artificial Sequence
  Synthetic
atcctggtgtcagatgtgtct

SEQ ID NO: 25221 - DNA, 21 bp, Artificial Sequence
  Synthetic
aatgacgtgtggatgggaaga

SEQ ID NO: 25222 - DNA, 20 bp, Artificial Sequence
  Synthetic
agaagtcagtggcgaggttt

SEQ ID NO: 25223 - DNA, 21 bp, Artificial Sequence
  Synthetic
ggacagctttcctttgtgtgc

SEQ ID NO: 25224 - DNA, 21 bp, Artificial Sequence
  Synthetic
ggaattccctggcgttttaca

SEQ ID NO: 25225 - DNA, 25 bp, Artificial Sequence
  Synthetic
agctgatactcagataagtgtaccc

SEQ ID NO: 25226 - DNA, 25 bp, Artificial Sequence
  Synthetic
ttgcttgttggcaatatatggatgt

SEQ ID NO: 25227 - DNA, 20 bp, Artificial Sequence
  Synthetic
gaagcgtcgacgagctgcag

SEQ ID NO: 25228 - DNA, 22 bp, Artificial Sequence
  Synthetic
ctcttggaagagttcagcgact

SEQ ID NO: 25229 - DNA, 20 bp, Artificial Sequence
  Synthetic
ccggaaggtgcaccaacaaa

SEQ ID NO: 25230 - DNA, 25 bp, Artificial Sequence
  Synthetic
ttcaactacagaaacctcagtttgc

SEQ ID NO: 25231 - DNA, 22 bp, Artificial Sequence
  Synthetic
atcctccagaacaaacagacga

SEQ ID NO: 25232 - DNA, 25 bp, Artificial Sequence
  Synthetic
tggcctgatcttataaaaatggagc

SEQ ID NO: 25233 - DNA, 22 bp, Artificial Sequence
  Synthetic
acaacatgtgcagacaaactga

SEQ ID NO: 25234 - DNA, 21 bp, Artificial Sequence
  Synthetic
aaatggaacgtgttaccctgg

SEQ ID NO: 25235 - DNA, 20 bp, Artificial Sequence
  Synthetic
tgtggggcatacatcaccca

SEQ ID NO: 25236 - DNA, 20 bp, Artificial Sequence
  Synthetic
ggagggagccatggaagaat

SEQ ID NO: 25237 - DNA, 25 bp, Artificial Sequence
  Synthetic
tggtttccagcattcaaatgatcaa

SEQ ID NO: 25238 - DNA, 25 bp, Artificial Sequence
  Synthetic
ctatataacaaggtgaagagggcac

SEQ ID NO: 25239 - DNA, 19 bp, Artificial Sequence
  Synthetic
aaacccgctcaatgcccgg

SEQ ID NO: 25240 - DNA, 20 bp, Artificial Sequence
  Synthetic
gcaggggccctaaattgggt

SEQ ID NO: 25241 - DNA, 20 bp, Artificial Sequence
  Synthetic
cgagcttcggagcagtcacg

SEQ ID NO: 25242 - DNA, 21 bp, Artificial Sequence
  Synthetic
gggcggtactgttggtcaagg

SEQ ID NO: 25243 - DNA, 22 bp, Artificial Sequence
  Synthetic
gatgacaagccgtattgctggc

SEQ ID NO: 25244 - DNA, 20 bp, Artificial Sequence
  Synthetic
ggccaacaggcaacaacagc

SEQ ID NO: 25245 - DNA, 20 bp, Artificial Sequence
  Synthetic
cttcacacctacgcccgctc

SEQ ID NO: 25246 - DNA, 22 bp, Artificial Sequence
  Synthetic
gcttggcttggcatgtcaaggg

SEQ ID NO: 25247 - DNA, 22 bp, Artificial Sequence
  Synthetic
cgtgacgctgtcatcatgctca

SEQ ID NO: 25248 - DNA, 22 bp, Artificial Sequence
  Synthetic
ggagacgaaggtcatcacgtgg

SEQ ID NO: 25249 - DNA, 22 bp, Artificial Sequence
  Synthetic
cggttctaagacccttgctggc

SEQ ID NO: 25250 - DNA, 18 bp, Artificial Sequence
  Synthetic
gtgtgcacgcggggtgtt

SEQ ID NO: 25251 - DNA, 21 bp, Artificial Sequence
  Synthetic
taggactgtcaccaccggagc

SEQ ID NO: 25252 - DNA, 20 bp, Artificial Sequence
  Synthetic
agaggtctagacgtcgccgt

SEQ ID NO: 25253 - DNA, 22 bp, Artificial Sequence
  Synthetic
accggtatgtttcgtctgggga

SEQ ID NO: 25254 - DNA, 20 bp, Artificial Sequence
  Synthetic
gctgggggccgttcagaatg

SEQ ID NO: 25255 - DNA, 19 bp, Artificial Sequence
  Synthetic
tctaggagggtgggtggcc

SEQ ID NO: 25256 - DNA, 21 bp, Artificial Sequence
  Synthetic
caggcgagggggctgtacagt

SEQ ID NO: 25257 - DNA, 22 bp, Artificial Sequence
  Synthetic
catgccagaaggggtacaaggg

SEQ ID NO: 25258 - DNA, 20 bp, Artificial Sequence
  Synthetic
gaggattcaccgcttcgcgc

SEQ ID NO: 25259 - DNA, 20 bp, Artificial Sequence
  Synthetic
acaaggccaccacccagatg

SEQ ID NO: 25260 - DNA, 22 bp, Artificial Sequence
  Synthetic
ttccgcggaggaaaaggaagcc

SEQ ID NO: 25261 - DNA, 21 bp, Artificial Sequence
  Synthetic
gctcatcaccccttgctctgc

SEQ ID NO: 25262 - DNA, 22 bp, Artificial Sequence
  Synthetic
tcgctctctcgacaagaaagcc

SEQ ID NO: 25263 - DNA, 20 bp, Artificial Sequence
  Synthetic
gagagccaggggacacacga

SEQ ID NO: 25264 - DNA, 22 bp, Artificial Sequence
  Synthetic
ctacagagccaggaacagctgg

SEQ ID NO: 25265 - DNA, 22 bp, Artificial Sequence
  Synthetic
actgggcggtgaagacaaaacg

SEQ ID NO: 25266 - DNA, 22 bp, Artificial Sequence
  Synthetic
cgagtaactcgtccctcttctg

SEQ ID NO: 25267 - DNA, 20 bp, Artificial Sequence
  Synthetic
gcgtactgccccagcttgaa

SEQ ID NO: 25268 - DNA, 25 bp, Artificial Sequence
  Synthetic
gtgttgaaaagaaaaagactgaggg

SEQ ID NO: 25269 - DNA, 23 bp, Artificial Sequence
  Synthetic
ccatactggcattactggtgaca

SEQ ID NO: 25270 - DNA, 21 bp, Artificial Sequence
  Synthetic
ccactgtgtggttttccctca

SEQ ID NO: 25271 - DNA, 23 bp, Artificial Sequence
  Synthetic
tgtacaacagacttctcagtggt

SEQ ID NO: 25272 - DNA, 22 bp, Artificial Sequence
  Synthetic
gaagtcttcatcgctcaaagca

SEQ ID NO: 25273 - DNA, 25 bp, Artificial Sequence
  Synthetic
tactggctacaaacaatgtctttcg

SEQ ID NO: 25274 - DNA, 25 bp, Artificial Sequence
  Synthetic
tgatgaaacctgtgaacatgagtac

SEQ ID NO: 25275 - DNA, 21 bp, Artificial Sequence
  Synthetic
gaaacatggtggtggtgtagc

SEQ ID NO: 25276 - DNA, 20 bp, Artificial Sequence
  Synthetic
gtgcagacggttcgtacaca

SEQ ID NO: 25277 - DNA, 25 bp, Artificial Sequence
  Synthetic
ctagtggtgatatcacttgtgttgt

SEQ ID NO: 25278 - DNA, 22 bp, Artificial Sequence
  Synthetic
cataatggcaaccatccaacgt

SEQ ID NO: 25279 - DNA, 23 bp, Artificial Sequence
  Synthetic
aagacatctgaggagcactttgt

SEQ ID NO: 25280 - DNA, 25 bp, Artificial Sequence
  Synthetic
cttgatgagagttttcttggtaggt

SEQ ID NO: 25281 - DNA, 22 bp, Artificial Sequence
  Synthetic
ttaacgggtgtagaagctgtga

SEQ ID NO: 25282 - DNA, 25 bp, Artificial Sequence
  Synthetic
aaggaaacatcttacactacaacca

SEQ ID NO: 25283 - DNA, 25 bp, Artificial Sequence
  Synthetic
agacactattcagcgagtttcaaga

SEQ ID NO: 25284 - DNA, 24 bp, Artificial Sequence
  Synthetic
aacacaagagttaggtcatgagga

SEQ ID NO: 25285 - DNA, 25 bp, Artificial Sequence
  Synthetic
tgcagcatttgtttaagtggattag

SEQ ID NO: 25286 - DNA, 25 bp, Artificial Sequence
  Synthetic
tggaagagctatgttcatatcatgg

SEQ ID NO: 25287 - DNA, 22 bp, Artificial Sequence
  Synthetic
agtgttgctgtgaaaaatggcg

SEQ ID NO: 25288 - DNA, 21 bp, Artificial Sequence
  Synthetic
tacagctcacagcgagttagc

SEQ ID NO: 25289 - DNA, 22 bp, Artificial Sequence
  Synthetic
aattcgtagtgctgccaagaag

SEQ ID NO: 25290 - DNA, 20 bp, Artificial Sequence
  Synthetic
tttagccagcgtggtggttc

SEQ ID NO: 25291 - DNA, 24 bp, Artificial Sequence
  Synthetic
cactcgttatgtgcttatggatgg

SEQ ID NO: 25292 - DNA, 24 bp, Artificial Sequence
  Synthetic
tattgccatattggtgacttgtgc

SEQ ID NO: 25293 - DNA, 22 bp, Artificial Sequence
  Synthetic
agacactgttgccacttacaca

SEQ ID NO: 25294 - DNA, 21 bp, Artificial Sequence
  Synthetic
aggaaaatggcattcccgtca

SEQ ID NO: 25295 - DNA, 24 bp, Artificial Sequence
  Synthetic
atccaacctggtcaaacattttca

SEQ ID NO: 25296 - DNA, 24 bp, Artificial Sequence
  Synthetic
tgacatattgggacctctttctgc

SEQ ID NO: 25297 - DNA, 23 bp, Artificial Sequence
  Synthetic
gtttacgagaatgctttcttgcc

SEQ ID NO: 25298 - DNA, 24 bp, Artificial Sequence
  Synthetic
gctagagctatagtgtttgtgtgt

SEQ ID NO: 25299 - DNA, 25 bp, Artificial Sequence
  Synthetic
aaaccatgtatcaaggttgctactg

SEQ ID NO: 25300 - DNA, 21 bp, Artificial Sequence
  Synthetic
gcgaggaaatgctcgataacc

SEQ ID NO: 25301 - DNA, 24 bp, Artificial Sequence
  Synthetic
acaatgctcttcactatgcttagg

SEQ ID NO: 25302 - DNA, 20 bp, Artificial Sequence
  Synthetic
cggctggtaccacacaaaca

SEQ ID NO: 25303 - DNA, 23 bp, Artificial Sequence
  Synthetic
ttcaactgtgctttccttctgtg

SEQ ID NO: 25304 - DNA, 22 bp, Artificial Sequence
  Synthetic
agaaacacagtctgtaccgtct

SEQ ID NO: 25305 - DNA, 24 bp, Artificial Sequence
  Synthetic
cgtcagcgtctaactaaatacaca

SEQ ID NO: 25306 - DNA, 25 bp, Artificial Sequence
  Synthetic
aatcaggatcttaatgggaactggt

SEQ ID NO: 25307 - DNA, 24 bp, Artificial Sequence
  Synthetic
tctactgtgtttccacctacaagt

SEQ ID NO: 25308 - DNA, 25 bp, Artificial Sequence
  Synthetic
agacttttatgactttgctgtgtct

SEQ ID NO: 25309 - DNA, 21 bp, Artificial Sequence
  Synthetic
ttgaagtcaatagccgccact

SEQ ID NO: 25310 - DNA, 23 bp, Artificial Sequence
  Synthetic
agtgtgcgcaagtattaagtgag

SEQ ID NO: 25311 - DNA, 25 bp, Artificial Sequence
  Synthetic
tgtgtgctataacagtaactatgcg

SEQ ID NO: 25312 - DNA, 22 bp, Artificial Sequence
  Synthetic
acatgatgagcttactggccac

SEQ ID NO: 25313 - DNA, 20 bp, Artificial Sequence
  Synthetic
aatgccccaggttgtgatgt

SEQ ID NO: 25314 - DNA, 20 bp, Artificial Sequence
  Synthetic
tggtattgccactgtacgcg

SEQ ID NO: 25315 - DNA, 25 bp, Artificial Sequence
  Synthetic
atgttgcaaattatcaaaaggtcgg

SEQ ID NO: 25316 - DNA, 22 bp, Artificial Sequence
  Synthetic
agacttcgtgcaaaacactacg

SEQ ID NO: 25317 - DNA, 25 bp, Artificial Sequence
  Synthetic
acagacctcaaataggcgttgtaag

SEQ ID NO: 25318 - DNA, 23 bp, Artificial Sequence
  Synthetic
atgtggctacattacaagcagaa

SEQ ID NO: 25319 - DNA, 20 bp, Artificial Sequence
  Synthetic
tagagggctgtcatgcaact

SEQ ID NO: 25320 - DNA, 25 bp, Artificial Sequence
  Synthetic
tgaagtactttgtcaagattggacc

SEQ ID NO: 25321 - DNA, 25 bp, Artificial Sequence
  Synthetic
ttgctgataagtttccagttcttca

SEQ ID NO: 25322 - DNA, 24 bp, Artificial Sequence
  Synthetic
atgtgaataagcatgcattccaca

SEQ ID NO: 25323 - DNA, 22 bp, Artificial Sequence
  Synthetic
aaaggacactttgatggacacg

SEQ ID NO: 25324 - DNA, 23 bp, Artificial Sequence
  Synthetic
ttgatggtagagtggaaggacag

SEQ ID NO: 25325 - DNA, 22 bp, Artificial Sequence
  Synthetic
gctatgccttcgaacacatcgt

SEQ ID NO: 25326 - DNA, 25 bp, Artificial Sequence
  Synthetic
gtaaggatggacatgttgaaacctt

SEQ ID NO: 25327 - DNA, 21 bp, Artificial Sequence
  Synthetic
ctgtgcaacagtacatacggc

SEQ ID NO: 25328 - DNA, 23 bp, Artificial Sequence
  Synthetic
tggctataccatgcatgctaact

SEQ ID NO: 25329 - DNA, 25 bp, Artificial Sequence
  Synthetic
tgcactttcgagtacatatctgatg

SEQ ID NO: 25330 - DNA, 24 bp, Artificial Sequence
  Synthetic
aaatggtacaatcacagatgctgt

SEQ ID NO: 25331 - DNA, 25 bp, Artificial Sequence
  Synthetic
atgcagattcttttgtagtcaaggg

SEQ ID NO: 25332 - DNA, 25 bp, Artificial Sequence
  Synthetic
tatggtttttacaccactactggca

SEQ ID NO: 25333 - DNA, 24 bp, Artificial Sequence
  Synthetic
tcaagatgttaactgcactgatgt

SEQ ID NO: 25334 - DNA, 25 bp, Artificial Sequence
  Synthetic
acagaagtaatgcctgtttctatgg

SEQ ID NO: 25335 - DNA, 25 bp, Artificial Sequence
  Synthetic
taatgctagagatctcatttgtgcg

SEQ ID NO: 25336 - DNA, 20 bp, Artificial Sequence
  Synthetic
gcaagctgcaagacgttgtt

SEQ ID NO: 25337 - DNA, 22 bp, Artificial Sequence
  Synthetic
acatgtcacgtatgtgccatcc

SEQ ID NO: 25338 - DNA, 23 bp, Artificial Sequence
  Synthetic
catcaccagatgttgatcttggc

SEQ ID NO: 25339 - DNA, 21 bp, Artificial Sequence
  Synthetic
gtggttcttgctgcaagtttg

SEQ ID NO: 25340 - DNA, 23 bp, Artificial Sequence
  Synthetic
attcacatcttttgcttgtcgct

SEQ ID NO: 25341 - DNA, 23 bp, Artificial Sequence
  Synthetic
cgaagtttactaccagcttgagt

SEQ ID NO: 25342 - DNA, 23 bp, Artificial Sequence
  Synthetic
agtcacactagccatccttactg

SEQ ID NO: 25343 - DNA, 23 bp, Artificial Sequence
  Synthetic
taaagcttgttttcctctggctc

SEQ ID NO: 25344 - DNA, 22 bp, Artificial Sequence
  Synthetic
actgtggctacatcacgaacgc

SEQ ID NO: 25345 - DNA, 22 bp, Artificial Sequence
  Synthetic
agtgtgttagaggtacgactgt

SEQ ID NO: 25346 - DNA, 24 bp, Artificial Sequence
  Synthetic
gcttgaagatccttgtaaggtaca

SEQ ID NO: 25347 - DNA, 20 bp, Artificial Sequence
  Synthetic
agcgccgaccccaaggttta

SEQ ID NO: 25348 - DNA, 20 bp, Artificial Sequence
  Synthetic
acaatgctgccaccgtgcta

SEQ ID NO: 25349 - DNA, 21 bp, Artificial Sequence
  Synthetic
gctgaggcatctaaaaagcct

SEQ ID NO: 25350 - DNA, 23 bp, Artificial Sequence
  Synthetic
aagcacattgacgcatacaaaac

SEQ ID NO: 25351 - DNA, 25 bp, Artificial Sequence
  Synthetic
tcaatgtgtaacattagggaggact

SEQ ID NO: 25352 - DNA, 24 bp, Artificial Sequence
  Synthetic
accaataggtgacaatcatccaga

SEQ ID NO: 25353 - DNA, 22 bp, Artificial Sequence
  Synthetic
ttgacaaggtgtgaagagccgc

SEQ ID NO: 25354 - DNA, 22 bp, Artificial Sequence
  Synthetic
gttgggacacactccacacaaa

SEQ ID NO: 25355 - DNA, 25 bp, Artificial Sequence
  Synthetic
cagacagactaatacagataacccg

SEQ ID NO: 25356 - DNA, 25 bp, Artificial Sequence
  Synthetic
ttaccattttctagggagatctgga

SEQ ID NO: 25357 - DNA, 25 bp, Artificial Sequence
  Synthetic
ggtaacttacctatttatccccacc

SEQ ID NO: 25358 - DNA, 25 bp, Artificial Sequence
  Synthetic
taccagttatgttaacacctggatc

SEQ ID NO: 25359 - DNA, 25 bp, Artificial Sequence
  Synthetic
ttagccactactctcataggagaac

SEQ ID NO: 25360 - DNA, 20 bp, Artificial Sequence
  Synthetic
agtccaccgcctcactagtt

SEQ ID NO: 25361 - DNA, 24 bp, Artificial Sequence
  Synthetic
ttaaatgaagttcttgtggtgcca

SEQ ID NO: 25362 - DNA, 21 bp, Artificial Sequence
  Synthetic
aaatgcatctgtgttctggca

SEQ ID NO: 25363 - DNA, 23 bp, Artificial Sequence
  Synthetic
ttgcctatcaacacacacactca

SEQ ID NO: 25364 - DNA, 25 bp, Artificial Sequence
  Synthetic
tccctaattgtgattgcactgaatg

SEQ ID NO: 25365 - DNA, 22 bp, Artificial Sequence
  Synthetic
ctgaggagcaagggttatctga

SEQ ID NO: 25366 - DNA, 23 bp, Artificial Sequence
  Synthetic
ggctccagcttagctatgtacat

SEQ ID NO: 25367 - DNA, 25 bp, Artificial Sequence
  Synthetic
ttgatgggtatgatcaacagagtgt

SEQ ID NO: 25368 - DNA, 22 bp, Artificial Sequence
  Synthetic
ttaccagcaatggcaagaaggt

SEQ ID NO: 25369 - DNA, 23 bp, Artificial Sequence
  Synthetic
gggaacctaaacccaaaagcaga

SEQ ID NO: 25370 - DNA, 23 bp, Artificial Sequence
  Synthetic
ccatgagggtgttaagctagaga

SEQ ID NO: 25371 - DNA, 23 bp, Artificial Sequence
  Synthetic
ttcttggtatacatgttggtggc

SEQ ID NO: 25372 - DNA, 20 bp, Artificial Sequence
  Synthetic
tggttcagcagtagggtgtg

SEQ ID NO: 25373 - DNA, 22 bp, Artificial Sequence
  Synthetic
cgccactctttccttatacacc

SEQ ID NO: 25374 - DNA, 20 bp, Artificial Sequence
  Synthetic
tctgccattcgcattttgca

SEQ ID NO: 25375 - DNA, 25 bp, Artificial Sequence
  Synthetic
agactctctaaattcaaatgtggcg

SEQ ID NO: 25376 - DNA, 25 bp, Artificial Sequence
  Synthetic
gtatgcaacaaatcatattgccacc

SEQ ID NO: 25377 - DNA, 24 bp, Artificial Sequence
  Synthetic
actgggatgcagttagaaaagaaa

SEQ ID NO: 25378 - DNA, 23 bp, Artificial Sequence
  Synthetic
ctagctcctcacggacttttttc

SEQ ID NO: 25379 - DNA, 25 bp, Artificial Sequence
  Synthetic
aaacagaaacatcaaaggtgctagt

SEQ ID NO: 25380 - DNA, 24 bp, Artificial Sequence
  Synthetic
gttccattagttgaaggtacccct

SEQ ID NO: 25381 - DNA, 24 bp, Artificial Sequence
  Synthetic
cctgaatttttggtacagccttcc

SEQ ID NO: 25382 - DNA, 25 bp, Artificial Sequence
  Synthetic
tgtaggtgatggactttttgtagca

SEQ ID NO: 25383 - DNA, 23 bp, Artificial Sequence
  Synthetic
tggtctggagattaatagggctg

SEQ ID NO: 25384 - DNA, 25 bp, Artificial Sequence
  Synthetic
ttactcatgcaggaactataggtga

SEQ ID NO: 25385 - DNA, 22 bp, Artificial Sequence
  Synthetic
agttggcttttattcctcctgc

SEQ ID NO: 25386 - DNA, 25 bp, Artificial Sequence
  Synthetic
cccatggggttggtataaatacaga

SEQ ID NO: 25387 - DNA, 23 bp, Artificial Sequence
  Synthetic
aatttgctggcttcagaagagtc

SEQ ID NO: 25388 - DNA, 23 bp, Artificial Sequence
  Synthetic
attgtggaagaagcagattgtgt

SEQ ID NO: 25389 - DNA, 21 bp, Artificial Sequence
  Synthetic
ggcagcagtacacatttctcc

SEQ ID NO: 25390 - DNA, 25 bp, Artificial Sequence
  Synthetic
tcctagcactttatgaaaaaggagc

SEQ ID NO: 25391 - DNA, 21 bp, Artificial Sequence
  Synthetic
agaagtccttctccgctgaaa

SEQ ID NO: 25392 - DNA, 20 bp, Artificial Sequence
  Synthetic
gcccactgcaccaactcctg

SEQ ID NO: 25393 - DNA, 20 bp, Artificial Sequence
  Synthetic
tccctcagttgtgcctttgc

SEQ ID NO: 25394 - DNA, 23 bp, Artificial Sequence
  Synthetic
cccagacttcattagacagcctt

SEQ ID NO: 25395 - DNA, 20 bp, Artificial Sequence
  Synthetic
tggtacaatttgcgcgggaa

SEQ ID NO: 25396 - DNA, 25 bp, Artificial Sequence
  Synthetic
gctgaaaaattacactgttggttcg

SEQ ID NO: 25397 - DNA, 25 bp, Artificial Sequence
  Synthetic
tgaagcatttgaaatagcagaaggc

SEQ ID NO: 25398 - DNA, 22 bp, Artificial Sequence
  Synthetic
tgaatggaatgggaaagggaga

SEQ ID NO: 25399 - DNA, 20 bp, Artificial Sequence
  Synthetic
gtggagaacgccagaatgct

SEQ ID NO: 25400 - DNA, 22 bp, Artificial Sequence
  Synthetic
gatcaggagaatttggcgtcaa

SEQ ID NO: 25401 - DNA, 21 bp, Artificial Sequence
  Synthetic
tcctgagaggatcagtggccc

SEQ ID NO: 25402 - DNA, 24 bp, Artificial Sequence
  Synthetic
cccaaggggacaactatctactag

SEQ ID NO: 25403 - DNA, 25 bp, Artificial Sequence
  Synthetic
ctgctggttttgaagtttataacgc

SEQ ID NO: 25404 - DNA, 20 bp, Artificial Sequence
  Synthetic
cctgggcttggaaaaaccca

SEQ ID NO: 25405 - DNA, 25 bp, Artificial Sequence
  Synthetic
aatgacagttattcccatcgaagaa

SEQ ID NO: 25406 - DNA, 23 bp, Artificial Sequence
  Synthetic
ggaaattatcccgatacagaccg

SEQ ID NO: 25407 - DNA, 25 bp, Artificial Sequence
  Synthetic
cagtgtactaactgtcagcatgtga

SEQ ID NO: 25408 - DNA, 24 bp, Artificial Sequence
  Synthetic
tgatcccaatgttggtatggtaga

SEQ ID NO: 25409 - DNA, 24 bp, Artificial Sequence
  Synthetic
ttaaacctgttttggaagatggga

SEQ ID NO: 25410 - DNA, 25 bp, Artificial Sequence
  Synthetic
tcaggcgttgataaattaaccagag

SEQ ID NO: 25411 - DNA, 25 bp, Artificial Sequence
  Synthetic
tcaagaaccttgacgttacctttac

SEQ ID NO: 25412 - DNA, 20 bp, Artificial Sequence
  Synthetic
ccatgtgatgggccaattca

SEQ ID NO: 25413 - DNA, 25 bp, Artificial Sequence
  Synthetic
atggttccttattcaaagatggggt

SEQ ID NO: 25414 - DNA, 24 bp, Artificial Sequence
  Synthetic
atcaattaggagatgccacaacaa

SEQ ID NO: 25415 - DNA, 23 bp, Artificial Sequence
  Synthetic
tgagagaggctagaacaacttcc

SEQ ID NO: 25416 - DNA, 25 bp, Artificial Sequence
  Synthetic
aaggcagagttgatctcttaggaga

SEQ ID NO: 25417 - DNA, 21 bp, Artificial Sequence
  Synthetic
tcatgtgatgcgataaccacc

SEQ ID NO: 25418 - DNA, 25 bp, Artificial Sequence
  Synthetic
tttagctgataccggtcttaaaagt

SEQ ID NO: 25419 - DNA, 25 bp, Artificial Sequence
  Synthetic
gataccatgcttaaagatgggttga

SEQ ID NO: 25420 - DNA, 23 bp, Artificial Sequence
  Synthetic
tcaaagatgaggggacagtaact

SEQ ID NO: 25421 - DNA, 20 bp, Artificial Sequence
  Synthetic
tttgggtcacccgattggag

SEQ ID NO: 25422 - DNA, 24 bp, Artificial Sequence
  Synthetic
tgacaaaggcacaaaagacttaac

SEQ ID NO: 25423 - DNA, 21 bp, Artificial Sequence
  Synthetic
ctaactgtgtagcctgcttgc

SEQ ID NO: 25424 - DNA, 24 bp, Artificial Sequence
  Synthetic
gacttgtccctttgatagaggtgc

SEQ ID NO: 25425 - DNA, 25 bp, Artificial Sequence
  Synthetic
accggcttttttagaataaccaaca

SEQ ID NO: 25426 - DNA, 23 bp, Artificial Sequence
  Synthetic
tttgtcaacaaatttgggttcgg

SEQ ID NO: 25427 - DNA, 20 bp, Artificial Sequence
  Synthetic
aacggcaatcgcatgcttag

SEQ ID NO: 25428 - DNA, 22 bp, Artificial Sequence
  Synthetic
tggctcagaagctacaaaaacc

SEQ ID NO: 25429 - DNA, 25 bp, Artificial Sequence
  Synthetic
aatcagatgctctttacgttgttga

SEQ ID NO: 25430 - DNA, 25 bp, Artificial Sequence
  Synthetic
attgacttactcagatggttcagac

SEQ ID NO: 25431 - DNA, 25 bp, Artificial Sequence
  Synthetic
caagctattcagtttgcttttgacc

SEQ ID NO: 25432 - DNA, 23 bp, Artificial Sequence
  Synthetic
attaccctgttgaccaagcaaac

SEQ ID NO: 25433 - DNA, 25 bp, Artificial Sequence
  Synthetic
acgtaaccctaaatcaaatgaacct

SEQ ID NO: 25434 - DNA, 24 bp, Artificial Sequence
  Synthetic
acgatcggttacagaaatcaagtc

SEQ ID NO: 25435 - DNA, 21 bp, Artificial Sequence
  Synthetic
tctgccacctctcaaccgact

SEQ ID NO: 25436 - DNA, 21 bp, Artificial Sequence
  Synthetic
ggcttcaaccacaaacagcag

SEQ ID NO: 25437 - DNA, 25 bp, Artificial Sequence
  Synthetic
tcatgttcatgtctcctttaatgct

SEQ ID NO: 25438 - DNA, 23 bp, Artificial Sequence
  Synthetic
aaggggtagatcagaaatcagct

SEQ ID NO: 25439 - DNA, 24 bp, Artificial Sequence
  Synthetic
tcgtttgattcacaagagaggaaa

SEQ ID NO: 25440 - DNA, 25 bp, Artificial Sequence
  Synthetic
tattgcttacctagaatcacacgac

SEQ ID NO: 25441 - DNA, 25 bp, Artificial Sequence
  Synthetic
tcatcctaaagtgttttaccaggac

SEQ ID NO: 25442 - DNA, 25 bp, Artificial Sequence
  Synthetic
acaagaaaattgaggagtgtacagg

SEQ ID NO: 25443 - DNA, 21 bp, Artificial Sequence
  Synthetic
ttgggggacaacagaagactt

SEQ ID NO: 25444 - DNA, 23 bp, Artificial Sequence
  Synthetic
gtgaaagccagttgacctatgtt

SEQ ID NO: 25445 - DNA, 21 bp, Artificial Sequence
  Synthetic
gaacagcggaatgcacgtatt

SEQ ID NO: 25446 - DNA, 22 bp, Artificial Sequence
  Synthetic
ttttcggcggttcagaagttaa

SEQ ID NO: 25447 - DNA, 25 bp, Artificial Sequence
  Synthetic
agtcactttcattttagtgggatca

SEQ ID NO: 25448 - DNA, 23 bp, Artificial Sequence
  Synthetic
gcccaaggcagtaatcatttcaa

SEQ ID NO: 25449 - DNA, 23 bp, Artificial Sequence
  Synthetic
ttgtcctagttgtacgaggagag

SEQ ID NO: 25450 - DNA, 25 bp, Artificial Sequence
  Synthetic
tgaagtggttacagcattagaatca

SEQ ID NO: 25451 - DNA, 25 bp, Artificial Sequence
  Synthetic
acagaagtgaactcttgtcttgaac

SEQ ID NO: 25452 - DNA, 23 bp, Artificial Sequence
  Synthetic
ttttggatcgtgaagtaacgcaa

SEQ ID NO: 25453 - DNA, 25 bp, Artificial Sequence
  Synthetic
caggctattgctgatgaattagacg

SEQ ID NO: 25454 - DNA, 23 bp, Artificial Sequence
  Synthetic
tctttgactgctatgggagaagc

SEQ ID NO: 25455 - DNA, 24 bp, Artificial Sequence
  Synthetic
cgtaaacgtaaatcagaagcagct

SEQ ID NO: 25456 - DNA, 23 bp, Artificial Sequence
  Synthetic
ataacggctcctaaaaagctacc

SEQ ID NO: 25457 - DNA, 25 bp, Artificial Sequence
  Synthetic
agcgttaatattgtcgatgtcattg

SEQ ID NO: 25458 - DNA, 21 bp, Artificial Sequence
  Synthetic
gcagtacttgctagccaacac

SEQ ID NO: 25459 - DNA, 25 bp, Artificial Sequence
  Synthetic
ctttcgaaatcgtatcatgtttccc

SEQ ID NO: 25460 - DNA, 20 bp, Artificial Sequence
  Synthetic
tgatggtgacgatgctggac

SEQ ID NO: 25461 - DNA, 25 bp, Artificial Sequence
  Synthetic
atgcattaaggattcaagataggca

SEQ ID NO: 25462 - DNA, 23 bp, Artificial Sequence
  Synthetic
tcaagcggctctagaagtactag

SEQ ID NO: 25463 - DNA, 25 bp, Artificial Sequence
  Synthetic
atttgctgttacatgtgattgatgc

SEQ ID NO: 25464 - DNA, 25 bp, Artificial Sequence
  Synthetic
tacacgtttgaccaagaaatagagg

SEQ ID NO: 25465 - DNA, 23 bp, Artificial Sequence
  Synthetic
actgaccaaccatcttttgagga

SEQ ID NO: 25466 - DNA, 24 bp, Artificial Sequence
  Synthetic
gctcttagccaaacattttctggt

SEQ ID NO: 25467 - DNA, 25 bp, Artificial Sequence
  Synthetic
ttaccaggatttttatcaagtcggt

SEQ ID NO: 25468 - DNA, 21 bp, Artificial Sequence
  Synthetic
cagaagccttaaaagcagcgg

SEQ ID NO: 25469 - DNA, 25 bp, Artificial Sequence
  Synthetic
tcttgctcaatcatgtatcagctcg

SEQ ID NO: 25470 - DNA, 24 bp, Artificial Sequence
  Synthetic
attaccaatccagtagccattgag

SEQ ID NO: 25471 - DNA, 25 bp, Artificial Sequence
  Synthetic
cccttcgcttagaattagcggataa

SEQ ID NO: 25472 - DNA, 23 bp, Artificial Sequence
  Synthetic
acttgtctcaactgcatgatcct

SEQ ID NO: 25473 - DNA, 22 bp, Artificial Sequence
  Synthetic
acgggttgctaaaatgtatgcg

SEQ ID NO: 25474 - DNA, 20 bp, Artificial Sequence
  Synthetic
catgaccatgcgaggcatca

SEQ ID NO: 25475 - DNA, 20 bp, Artificial Sequence
  Synthetic
tcatcgacgttggtggagaa

SEQ ID NO: 25476 - DNA, 22 bp, Artificial Sequence
  Synthetic
tctaggcaatagagcacaagca

SEQ ID NO: 25477 - DNA, 25 bp, Artificial Sequence
  Synthetic
ccagttgatgtgaggacttatggat

SEQ ID NO: 25478 - DNA, 23 bp, Artificial Sequence
  Synthetic
agctttttaacgaatttccgcct

SEQ ID NO: 25479 - DNA, 23 bp, Artificial Sequence
  Synthetic
ggtcgtgtgaggcatgaaaaatg

SEQ ID NO: 25480 - DNA, 22 bp, Artificial Sequence
  Synthetic
aatcactacgagctatcacgca

SEQ ID NO: 25481 - DNA, 21 bp, Artificial Sequence
  Synthetic
tatccgctaaggtgcttaccc

SEQ ID NO: 25482 - DNA, 20 bp, Artificial Sequence
  Synthetic
atcggattggtggtgtggaa

SEQ ID NO: 25483 - DNA, 20 bp, Artificial Sequence
  Synthetic
aagagccccacaaccacaga

SEQ ID NO: 25484 - DNA, 20 bp, Artificial Sequence
  Synthetic
aagactagggcaagggacca

SEQ ID NO: 25485 - DNA, 20 bp, Artificial Sequence
  Synthetic
cgcccgcagactgtctgttg

SEQ ID NO: 25486 - DNA, 25 bp, Artificial Sequence
  Synthetic
aaatggtaaccaaaaaggatcctgt

SEQ ID NO: 25487 - DNA, 25 bp, Artificial Sequence
  Synthetic
ttttccatcatgagatttgaccact

SEQ ID NO: 25488 - DNA, 21 bp, Artificial Sequence
  Synthetic
aaatggcacctggtgtttgtg

SEQ ID NO: 25489 - DNA, 25 bp, Artificial Sequence
  Synthetic
catcactatttccaatttggacagc

SEQ ID NO: 25490 - DNA, 22 bp, Artificial Sequence
  Synthetic
gattggggcaaagtaatgacgt

SEQ ID NO: 25491 - DNA, 25 bp, Artificial Sequence
  Synthetic
ctttgatcaagttggatttaggtgc

SEQ ID NO: 25492 - DNA, 24 bp, Artificial Sequence
  Synthetic
ggatacccgtgatgccaatattga

SEQ ID NO: 25493 - DNA, 22 bp, Artificial Sequence
  Synthetic
accagcatcatttctccagagt

SEQ ID NO: 25494 - DNA, 25 bp, Artificial Sequence
  Synthetic
ttccagcaattttatagaggctgtc

SEQ ID NO: 25495 - DNA, 21 bp, Artificial Sequence
  Synthetic
aaagggcttgtcctccataca

SEQ ID NO: 25496 - DNA, 21 bp, Artificial Sequence
  Synthetic
ggaaacgagcatagttgagca

SEQ ID NO: 25497 - DNA, 25 bp, Artificial Sequence
  Synthetic
tggaatgttaatcaaagtgtcacgc

SEQ ID NO: 25498 - DNA, 25 bp, Artificial Sequence
  Synthetic
acagactctgttaaaaaagcatcgt

SEQ ID NO: 25499 - DNA, 25 bp, Artificial Sequence
  Synthetic
acacttgactttcaattgttcgaaa

SEQ ID NO: 25500 - DNA, 25 bp, Artificial Sequence
  Synthetic
ttgctgtcatcataccaatacgatg

SEQ ID NO: 25501 - DNA, 24 bp, Artificial Sequence
  Synthetic
accactcgaatactagttacttgc

SEQ ID NO: 25502 - DNA, 22 bp, Artificial Sequence
  Synthetic
caacctgtgttgttccttttgc

SEQ ID NO: 25503 - DNA, 22 bp, Artificial Sequence
  Synthetic
gctttttgagcttgagtacgca

SEQ ID NO: 25504 - DNA, 23 bp, Artificial Sequence
  Synthetic
atcaaccgtaacaaagttcacca

SEQ ID NO: 25505 - DNA, 22 bp, Artificial Sequence
  Synthetic
agacattttttcgcccttacca

SEQ ID NO: 25506 - DNA, 20 bp, Artificial Sequence
  Synthetic
tgaccctggatgagtgaagc

SEQ ID NO: 25507 - DNA, 20 bp, Artificial Sequence
  Synthetic
ggtacagcacgccagatgat

SEQ ID NO: 25508 - DNA, 24 bp, Artificial Sequence
  Synthetic
atggtcaccaaggataaccaattc

SEQ ID NO: 25509 - DNA, 25 bp, Artificial Sequence
  Synthetic
tgtcatggtattcaatttcagcctc

SEQ ID NO: 25510 - DNA, 22 bp, Artificial Sequence
  Synthetic
gattccttgcttagccaagact

SEQ ID NO: 25511 - DNA, 25 bp, Artificial Sequence
  Synthetic
aactccttttaaacaaacttgcgac

SEQ ID NO: 25512 - DNA, 23 bp, Artificial Sequence
  Synthetic
ggctcagtcgtagaatcagattg

SEQ ID NO: 25513 - DNA, 25 bp, Artificial Sequence
  Synthetic
actaagaagcaattgaatagcctgc

SEQ ID NO: 25514 - DNA, 20 bp, Artificial Sequence
  Synthetic
cccttgaccaacggaccata

SEQ ID NO: 25515 - DNA, 20 bp, Artificial Sequence
  Synthetic
ctgtgttcggcatgggtaca

SEQ ID NO: 25516 - DNA, 22 bp, Artificial Sequence
  Synthetic
tctcaaatttcctacgcccgcg

SEQ ID NO: 25517 - DNA, 22 bp, Artificial Sequence
  Synthetic
cctgctcgagttgtagctctcg

SEQ ID NO: 25518 - DNA, 21 bp, Artificial Sequence
  Synthetic
aagtcagcaccccttctcccg

SEQ ID NO: 25519 - DNA, 24 bp, Artificial Sequence
  Synthetic
ttccaatcgtccggtttagttagc

SEQ ID NO: 25520 - DNA, 23 bp, Artificial Sequence
  Synthetic
actcgactagtgagctattacgc

SEQ ID NO: 25521 - DNA, 22 bp, Artificial Sequence
  Synthetic
cacctttccctcacggtactgg

SEQ ID NO: 25522 - DNA, 21 bp, Artificial Sequence
  Synthetic
gaaaggaggtgatccagccgc

SEQ ID NO: 25523 - DNA, 20 bp, Artificial Sequence
  Synthetic
catcggcttcggcattagct

SEQ ID NO: 25524 - DNA, 24 bp, Artificial Sequence
  Synthetic
tgctgttgagaagacttgtgattt

SEQ ID NO: 25525 - DNA, 21 bp, Artificial Sequence
  Synthetic
tctgaaagggcttgacgaact

SEQ ID NO: 25526 - DNA, 23 bp, Artificial Sequence
  Synthetic
gatacgtcaaatgtaccaccacc

SEQ ID NO: 25527 - DNA, 21 bp, Artificial Sequence
  Synthetic
ttgccttctgggttagcaatg

SEQ ID NO: 25528 - DNA, 20 bp, Artificial Sequence
  Synthetic
cttagcagacgctcgtgcaa

SEQ ID NO: 25529 - DNA, 21 bp, Artificial Sequence
  Synthetic
tagcgttgaagttgttgacgt

SEQ ID NO: 25530 - DNA, 25 bp, Artificial Sequence
  Synthetic
atcaataggaccaatcaaactcagg

SEQ ID NO: 25531 - DNA, 24 bp, Artificial Sequence
  Synthetic
actgtcactggcttagattcatct

SEQ ID NO: 25532 - DNA, 24 bp, Artificial Sequence
  Synthetic
attacgaatagtggcgctactaga

SEQ ID NO: 25533 - DNA, 25 bp, Artificial Sequence
  Synthetic
acttctcatcaatggcttacctatg

SEQ ID NO: 25534 - DNA, 25 bp, Artificial Sequence
  Synthetic
aaaagcactaattctccttcgtcct

SEQ ID NO: 25535 - DNA, 23 bp, Artificial Sequence
  Synthetic
tggtcaccaccattcaaaaactc

SEQ ID NO: 25536 - DNA, 25 bp, Artificial Sequence
  Synthetic
atgtctccatcaatacaccgttaaa

SEQ ID NO: 25537 - DNA, 25 bp, Artificial Sequence
  Synthetic
ctatcactgaaaatgacaatgcgtc

SEQ ID NO: 25538 - DNA, 24 bp, Artificial Sequence
  Synthetic
aaacctcagcacattattcaagct

SEQ ID NO: 25539 - DNA, 25 bp, Artificial Sequence
  Synthetic
ttgcatctgtacaggtctatagtga

SEQ ID NO: 25540 - DNA, 21 bp, Artificial Sequence
  Synthetic
gctatggctgactcactagct

SEQ ID NO: 25541 - DNA, 25 bp, Artificial Sequence
  Synthetic
cttaaaagggcactaggaaaggaaa

SEQ ID NO: 25542 - DNA, 23 bp, Artificial Sequence
  Synthetic
attggcgaacttttccaaatggt

SEQ ID NO: 25543 - DNA, 21 bp, Artificial Sequence
  Synthetic
ccttgcccataaagccaagat

SEQ ID NO: 25544 - DNA, 25 bp, Artificial Sequence
  Synthetic
atccgtcgctttatgttgtaattgt

SEQ ID NO: 25545 - DNA, 25 bp, Artificial Sequence
  Synthetic
ggacaaccgtttttttaaaaggttg

SEQ ID NO: 25546 - DNA, 20 bp, Artificial Sequence
  Synthetic
cctttgccaaacacgagcaa

SEQ ID NO: 25547 - DNA, 23 bp, Artificial Sequence
  Synthetic
gtatgagatggctgaggtcaagg

SEQ ID NO: 25548 - DNA, 22 bp, Artificial Sequence
  Synthetic
aaaagtcccgctaatgaatccc

SEQ ID NO: 25549 - DNA, 25 bp, Artificial Sequence
  Synthetic
atcaactcctgattgattacctgtt

SEQ ID NO: 25550 - DNA, 22 bp, Artificial Sequence
  Synthetic
cctgctaagtcgggattgaagt

SEQ ID NO: 25551 - DNA, 20 bp, Artificial Sequence
  Synthetic
ccacctaaagctacccccaa

SEQ ID NO: 25552 - DNA, 22 bp, Artificial Sequence
  Synthetic
attcacacgaccaatcagacct

SEQ ID NO: 25553 - DNA, 21 bp, Artificial Sequence
  Synthetic
gtggtacgcccctacctgtcg

SEQ ID NO: 25554 - DNA, 19 bp, Artificial Sequence
  Synthetic
cagggcgccctgctactga

SEQ ID NO: 25555 - DNA, 20 bp, Artificial Sequence
  Synthetic
gggtttataccacccgcgct

SEQ ID NO: 25556 - DNA, 22 bp, Artificial Sequence
  Synthetic
tacaccccttacccgaaggcca

SEQ ID NO: 25557 - DNA, 21 bp, Artificial Sequence
  Synthetic
cggtggttgtggcctcctatt

SEQ ID NO: 25558 - DNA, 22 bp, Artificial Sequence
  Synthetic
tgcttcgatcgtgaatacgcct

SEQ ID NO: 25559 - DNA, 21 bp, Artificial Sequence
  Synthetic
tctcacggacgccttccatca

SEQ ID NO: 25560 - DNA, 21 bp, Artificial Sequence
  Synthetic
ggggccgatttccccgaggta

SEQ ID NO: 25561 - DNA, 20 bp, Artificial Sequence
  Synthetic
cggccaacgcccaacacaac

SEQ ID NO: 25562 - DNA, 21 bp, Artificial Sequence
  Synthetic
tataggcaggagacggctgct

SEQ ID NO: 25563 - DNA, 22 bp, Artificial Sequence
  Synthetic
ggtttccctgttatgaccccgc

SEQ ID NO: 25564 - DNA, 20 bp, Artificial Sequence
  Synthetic
cgatgcccccgagatgtgtg

SEQ ID NO: 25565 - DNA, 19 bp, Artificial Sequence
  Synthetic
tcgaggtgcgagctgtggt

SEQ ID NO: 25566 - DNA, 22 bp, Artificial Sequence
  Synthetic
agcttgccgaattggttgaggc

SEQ ID NO: 25567 - DNA, 20 bp, Artificial Sequence
  Synthetic
ggtgttgcaggctccccaag

SEQ ID NO: 25568 - DNA, 21 bp, Artificial Sequence
  Synthetic
gcttgctagtcgcctgtggtc

SEQ ID NO: 25569 - DNA, 21 bp, Artificial Sequence
  Synthetic
tgcggtcgcaggtttgaaagc

SEQ ID NO: 25570 - DNA, 22 bp, Artificial Sequence
  Synthetic
ctctccaccatgcccccacttg

SEQ ID NO: 25571 - DNA, 22 bp, Artificial Sequence
  Synthetic
ttccatcacttccaccgacgtg

SEQ ID NO: 25572 - DNA, 22 bp, Artificial Sequence
  Synthetic
tgacccctggtaacacgaacac

SEQ ID NO: 25573 - DNA, 22 bp, Artificial Sequence
  Synthetic
gcccagtcgcagagtgctatgg

SEQ ID NO: 25574 - DNA, 20 bp, Artificial Sequence
  Synthetic
tctgtgggtctggtgggatg

SEQ ID NO: 25575 - DNA, 22 bp, Artificial Sequence
  Synthetic
tttctgtgtctaagcactggtg

SEQ ID NO: 25576 - DNA, 25 bp, Artificial Sequence
  Synthetic
tgattatgtcattgcattgactggt

SEQ ID NO: 25577 - DNA, 22 bp, Artificial Sequence
  Synthetic
ttctgagagttggagtgttggt

SEQ ID NO: 25578 - DNA, 24 bp, Artificial Sequence
  Synthetic
actggtgttattgacattagtgct

SEQ ID NO: 25579 - DNA, 25 bp, Artificial Sequence
  Synthetic
acaagcttttttctatagtggtggt

SEQ ID NO: 25580 - DNA, 25 bp, Artificial Sequence
  Synthetic
ttctgcattgataattgtggtgagc

SEQ ID NO: 25581 - DNA, 24 bp, Artificial Sequence
  Synthetic
tgaaactgtctgtagtgtcgcata

SEQ ID NO: 25582 - DNA, 24 bp, Artificial Sequence
  Synthetic
tgatgaagagggtggttatgatgt

SEQ ID NO: 25583 - DNA, 25 bp, Artificial Sequence
  Synthetic
agcttgttagtatgaaaggtactgg

SEQ ID NO: 25584 - DNA, 24 bp, Artificial Sequence
  Synthetic
tttgactttgttgtcaatgctgct

SEQ ID NO: 25585 - DNA, 24 bp, Artificial Sequence
  Synthetic
aacttgtgttattgccaatgttcc

SEQ ID NO: 25586 - DNA, 24 bp, Artificial Sequence
  Synthetic
gaagttgactgggttgctttttac

SEQ ID NO: 25587 - DNA, 23 bp, Artificial Sequence
  Synthetic
gtgatgttggtttttgtccacac

SEQ ID NO: 25588 - DNA, 25 bp, Artificial Sequence
  Synthetic
tgtcctatagttgttggtgtttcag

SEQ ID NO: 25589 - DNA, 23 bp, Artificial Sequence
  Synthetic
tgatgacggttacatttgtggtg

SEQ ID NO: 25590 - DNA, 25 bp, Artificial Sequence
  Synthetic
agctacaattccaccttacaatctg

SEQ ID NO: 25591 - DNA, 24 bp, Artificial Sequence
  Synthetic
cataatggtgtcttcttgggagtt

SEQ ID NO: 25592 - DNA, 20 bp, Artificial Sequence
  Synthetic
tgcaagttgagagtgccaac

SEQ ID NO: 25593 - DNA, 20 bp, Artificial Sequence
  Synthetic
tgcaccacatggaccttttg

SEQ ID NO: 25594 - DNA, 25 bp, Artificial Sequence
  Synthetic
cgcaaagtctgaatttgatcatgag

SEQ ID NO: 25595 - DNA, 25 bp, Artificial Sequence
  Synthetic
tgaaactttgacatggcctcttatc

SEQ ID NO: 25596 - DNA, 25 bp, Artificial Sequence
  Synthetic
ttaactgcttgtgctttttctgttg

SEQ ID NO: 25597 - DNA, 20 bp, Artificial Sequence
  Synthetic
gggtgtgcttgtgaccgtac

SEQ ID NO: 25598 - DNA, 23 bp, Artificial Sequence
  Synthetic
tacttggaaagatggcagagtca

SEQ ID NO: 25599 - DNA, 20 bp, Artificial Sequence
  Synthetic
tgctctatgcgatgcgatgg

SEQ ID NO: 25600 - DNA, 24 bp, Artificial Sequence
  Synthetic
actgaacttttgcaatttgtcacc

SEQ ID NO: 25601 - DNA, 22 bp, Artificial Sequence
  Synthetic
agaactgttggtggtgtttctc

SEQ ID NO: 25602 - DNA, 25 bp, Artificial Sequence
  Synthetic
tggcacaagttttaacagaagttgt

SEQ ID NO: 25603 - DNA, 23 bp, Artificial Sequence
  Synthetic
atttgccttacccagatcctagt

SEQ ID NO: 25604 - DNA, 24 bp, Artificial Sequence
  Synthetic
ttgtggttcacaaactgtacttcg

SEQ ID NO: 25605 - DNA, 25 bp, Artificial Sequence
  Synthetic
gtcagtgatgcatatgctaatttgg

SEQ ID NO: 25606 - DNA, 25 bp, Artificial Sequence
  Synthetic
tgttcctttacaggttggtttttca

SEQ ID NO: 25607 - DNA, 20 bp, Artificial Sequence
  Synthetic
ttgagccaaaaccaccacac

SEQ ID NO: 25608 - DNA, 23 bp, Artificial Sequence
  Synthetic
tggtcaacttgatggtctttgtt

SEQ ID NO: 25609 - DNA, 25 bp, Artificial Sequence
  Synthetic
aattgtttgcaaaacgaaaaatggg

SEQ ID NO: 25610 - DNA, 25 bp, Artificial Sequence
  Synthetic
taaccacttgtccactttttatcca

SEQ ID NO: 25611 - DNA, 25 bp, Artificial Sequence
  Synthetic
cacctggtacaactgttttaaaacg

SEQ ID NO: 25612 - DNA, 23 bp, Artificial Sequence
  Synthetic
gttacgggtttattgccaactca

SEQ ID NO: 25613 - DNA, 25 bp, Artificial Sequence
  Synthetic
ttcctgtgtttttagtgttgtcaac

SEQ ID NO: 25614 - DNA, 24 bp, Artificial Sequence
  Synthetic
atcaaccactccgtttaacttgtt

SEQ ID NO: 25615 - DNA, 25 bp, Artificial Sequence
  Synthetic
gcacttttgtgggtattttaccacc

SEQ ID NO: 25616 - DNA, 25 bp, Artificial Sequence
  Synthetic
atgttgcactccccatttattatca

SEQ ID NO: 25617 - DNA, 23 bp, Artificial Sequence
  Synthetic
atcaacaaagcattattggtgcc

SEQ ID NO: 25618 - DNA, 25 bp, Artificial Sequence
  Synthetic
aagttgttacatctggtttgggtac

SEQ ID NO: 25619 - DNA, 23 bp, Artificial Sequence
  Synthetic
atgaccggcttgattcaattcaa

SEQ ID NO: 25620 - DNA, 24 bp, Artificial Sequence
  Synthetic
aatggtgtctttcgtgtaacttcc

SEQ ID NO: 25621 - DNA, 23 bp, Artificial Sequence
  Synthetic
ctacaggttgttgtggttgttgc

SEQ ID NO: 25622 - DNA, 25 bp, Artificial Sequence
  Synthetic
atgtccatttacgtaactggaactt

SEQ ID NO: 25623 - DNA, 25 bp, Artificial Sequence
  Synthetic
cacttcttagtggtgtacttcttgt

SEQ ID NO: 25624 - DNA, 24 bp, Artificial Sequence
  Synthetic
tcctccttcattttacatgcctct

SEQ ID NO: 25625 - DNA, 25 bp, Artificial Sequence
  Synthetic
tttggaaccaaagttctctattgct

SEQ ID NO: 25626 - DNA, 23 bp, Artificial Sequence
  Synthetic
agttcttctggtacttccactcc

SEQ ID NO: 25627 - DNA, 25 bp, Artificial Sequence
  Synthetic
agtgggtgataatgttcagattacc

SEQ ID NO: 25628 - DNA, 25 bp, Artificial Sequence
  Synthetic
ttggacagacctttattgcaaattg

SEQ ID NO: 25629 - DNA, 23 bp, Artificial Sequence
  Synthetic
atctgatttattagacgaggcgc

SEQ ID NO: 25630 - DNA, 21 bp, Artificial Sequence
  Synthetic
tgtggagattgggttttggca

SEQ ID NO: 25631 - DNA, 22 bp, Artificial Sequence
  Synthetic
acaactttggagtggattgcac

SEQ ID NO: 25632 - DNA, 25 bp, Artificial Sequence
  Synthetic
aatggggtaatgagaattggattgc

SEQ ID NO: 25633 - DNA, 24 bp, Artificial Sequence
  Synthetic
taaccctgataatcagacaaggca

SEQ ID NO: 25634 - DNA, 22 bp, Artificial Sequence
  Synthetic
tcgacgtccatcgactacaccg

SEQ ID NO: 25635 - DNA, 20 bp, Artificial Sequence
  Synthetic
agagagttgctttgcccaga

SEQ ID NO: 25636 - DNA, 24 bp, Artificial Sequence
  Synthetic
aatattgcaatatggcagtctggg

SEQ ID NO: 25637 - DNA, 24 bp, Artificial Sequence
  Synthetic
tgcaggttattgcagaaattcacc

SEQ ID NO: 25638 - DNA, 25 bp, Artificial Sequence
  Synthetic
ttaaacttaggccttgaaacagaca

SEQ ID NO: 25639 - DNA, 22 bp, Artificial Sequence
  Synthetic
ctgagcaagcccacattttcgc

SEQ ID NO: 25640 - DNA, 25 bp, Artificial Sequence
  Synthetic
taggtgacacagcatttatacaagg

SEQ ID NO: 25641 - DNA, 21 bp, Artificial Sequence
  Synthetic
atctgaacgtctactgctggt

SEQ ID NO: 25642 - DNA, 24 bp, Artificial Sequence
  Synthetic
tactgcttttgatgcaaaacagac

SEQ ID NO: 25643 - DNA, 25 bp, Artificial Sequence
  Synthetic
atcagaatgaaccatgaagcctatg

SEQ ID NO: 25644 - DNA, 23 bp, Artificial Sequence
  Synthetic
ccagaataatggcatttgctgga

SEQ ID NO: 25645 - DNA, 25 bp, Artificial Sequence
  Synthetic
aatccctacccctaaaatctgtttg

SEQ ID NO: 25646 - DNA, 20 bp, Artificial Sequence
  Synthetic
cgcggttaggacttgtttca

SEQ ID NO: 25647 - DNA, 21 bp, Artificial Sequence
  Synthetic
tttgtgtgaaacctgtgctgc

SEQ ID NO: 25648 - DNA, 24 bp, Artificial Sequence
  Synthetic
ggaattgttccaccaacaggaaag

SEQ ID NO: 25649 - DNA, 23 bp, Artificial Sequence
  Synthetic
ctgatgttacggagagtcaaacc

SEQ ID NO: 25650 - DNA, 24 bp, Artificial Sequence
  Synthetic
acaaacacaagtagggcaaacaga

SEQ ID NO: 25651 - DNA, 20 bp, Artificial Sequence
  Synthetic
acgatgcaacgtcacaatgt

SEQ ID NO: 25652 - DNA, 24 bp, Artificial Sequence
  Synthetic
tttcactatgctcgacaaaatggt

SEQ ID NO: 25653 - DNA, 22 bp, Artificial Sequence
  Synthetic
atctggtggaaggcttggatat

SEQ ID NO: 25654 - DNA, 20 bp, Artificial Sequence
  Synthetic
gggtgacccaaaatgaaggc

SEQ ID NO: 25655 - DNA, 23 bp, Artificial Sequence
  Synthetic
tgtagcagagaccgattttacca

SEQ ID NO: 25656 - DNA, 21 bp, Artificial Sequence
  Synthetic
acaacagacaaaatgtgggct

SEQ ID NO: 25657 - DNA, 24 bp, Artificial Sequence
  Synthetic
atccagactacattaaaatggcgc

SEQ ID NO: 25658 - DNA, 22 bp, Artificial Sequence
  Synthetic
gtggttctctcgtatccacaga

SEQ ID NO: 25659 - DNA, 24 bp, Artificial Sequence
  Synthetic
aacatctcagacaagttgtagcat

SEQ ID NO: 25660 - DNA, 24 bp, Artificial Sequence
  Synthetic
actttgaagcaggaattctggagt

SEQ ID NO: 25661 - DNA, 25 bp, Artificial Sequence
  Synthetic
actgtgtgaaaaatccctcaactag

SEQ ID NO: 25662 - DNA, 25 bp, Artificial Sequence
  Synthetic
aatggagacaagtccttatcaactc

SEQ ID NO: 25663 - DNA, 24 bp, Artificial Sequence
  Synthetic
tatcccaatttggtcaagagcacc

SEQ ID NO: 25664 - DNA, 24 bp, Artificial Sequence
  Synthetic
tttcccttttccctttcctattcc

SEQ ID NO: 25665 - DNA, 25 bp, Artificial Sequence
  Synthetic
tctctttgatcttccacaaggggta

SEQ ID NO: 25666 - DNA, 25 bp, Artificial Sequence
  Synthetic
agtgactggtgcttcttattttact

SEQ ID NO: 25667 - DNA, 25 bp, Artificial Sequence
  Synthetic
tcaagttcagataaaccctacacct

SEQ ID NO: 25668 - DNA, 24 bp, Artificial Sequence
  Synthetic
aatattgggacaggaacttcagct

SEQ ID NO: 25669 - DNA, 25 bp, Artificial Sequence
  Synthetic
cttggacatctattccaactttggc

SEQ ID NO: 25670 - DNA, 25 bp, Artificial Sequence
  Synthetic
tttctggaatcacattaaagcaagc

SEQ ID NO: 25671 - DNA, 21 bp, Artificial Sequence
  Synthetic
ttgcttcccatgtcagagtga

SEQ ID NO: 25672 - DNA, 25 bp, Artificial Sequence
  Synthetic
ttgaggatccagttttagcaaagaa

SEQ ID NO: 25673 - DNA, 24 bp, Artificial Sequence
  Synthetic
tagagggcctttagatctgacaat

SEQ ID NO: 25674 - DNA, 24 bp, Artificial Sequence
  Synthetic
agaagttgggaaacaaagactcaa

SEQ ID NO: 25675 - DNA, 20 bp, Artificial Sequence
  Synthetic
caggcagaagtgtgtggact

SEQ ID NO: 25676 - DNA, 25 bp, Artificial Sequence
  Synthetic
tggtcagatttttgtcagttagtgt

SEQ ID NO: 25677 - DNA, 20 bp, Artificial Sequence
  Synthetic
gcagttggcattcttggagt

SEQ ID NO: 25678 - DNA, 25 bp, Artificial Sequence
  Synthetic
gagagaagaatggatgtgtgagatg

SEQ ID NO: 25679 - DNA, 22 bp, Artificial Sequence
  Synthetic
tccatgttgctggaggaaattc

SEQ ID NO: 25680 - DNA, 25 bp, Artificial Sequence
  Synthetic
agaaccagaggattataaagaggct

SEQ ID NO: 25681 - DNA, 22 bp, Artificial Sequence
  Synthetic
ggagttcatccaagattggctc

SEQ ID NO: 25682 - DNA, 25 bp, Artificial Sequence
  Synthetic
tgctattggcatagatcctgataga

SEQ ID NO: 25683 - DNA, 20 bp, Artificial Sequence
  Synthetic
ggcaccatgcagtaccaaac

SEQ ID NO: 25684 - DNA, 24 bp, Artificial Sequence
  Synthetic
cctacagcaactgttacccttatg

SEQ ID NO: 25685 - DNA, 20 bp, Artificial Sequence
  Synthetic
cgggtacggacaatgaccaa

SEQ ID NO: 25686 - DNA, 23 bp, Artificial Sequence
  Synthetic
atgagatcagatgcacccattgg

SEQ ID NO: 25687 - DNA, 21 bp, Artificial Sequence
  Synthetic
ttgggagggaatggtagacgg

SEQ ID NO: 25688 - DNA, 20 bp, Artificial Sequence
  Synthetic
ttcttgtggccctggagaac

SEQ ID NO: 25689 - DNA, 25 bp, Artificial Sequence
  Synthetic
atggatttcctttgccatatcatgt

SEQ ID NO: 25690 - DNA, 23 bp, Artificial Sequence
  Synthetic
aaagacagtgcagcaacttagaa

SEQ ID NO: 25691 - DNA, 21 bp, Artificial Sequence
  Synthetic
aatctcgcagtggcagtttac

SEQ ID NO: 25692 - DNA, 23 bp, Artificial Sequence
  Synthetic
cattgtgacgaagagttgacaga

SEQ ID NO: 25693 - DNA, 25 bp, Artificial Sequence
  Synthetic
aattggttttctcttgaagcagact

SEQ ID NO: 25694 - DNA, 22 bp, Artificial Sequence
  Synthetic
cctcgtttggaagcaatacctt

SEQ ID NO: 25695 - DNA, 22 bp, Artificial Sequence
  Synthetic
actgggtcgtaactgcatatgg

SEQ ID NO: 25696 - DNA, 25 bp, Artificial Sequence
  Synthetic
caaggtaatacacgcataggtagag

SEQ ID NO: 25697 - DNA, 25 bp, Artificial Sequence
  Synthetic
ccaaattttaaagtatggcagcacc

SEQ ID NO: 25698 - DNA, 21 bp, Artificial Sequence
  Synthetic
tgtccctcttacagacacagg

SEQ ID NO: 25699 - DNA, 24 bp, Artificial Sequence
  Synthetic
taagcactattgacacagaaccct

SEQ ID NO: 25700 - DNA, 21 bp, Artificial Sequence
  Synthetic
tgtcaacaacgggtaaggtct

SEQ ID NO: 25701 - DNA, 25 bp, Artificial Sequence
  Synthetic
gatcctaacagatttgctctagctg

SEQ ID NO: 25702 - DNA, 25 bp, Artificial Sequence
  Synthetic
ccttaccttgtgtagaaaatcctcc

SEQ ID NO: 25703 - DNA, 24 bp, Artificial Sequence
  Synthetic
tgggtcagtaggagacagtattcc

SEQ ID NO: 25704 - DNA, 22 bp, Artificial Sequence
  Synthetic
ttaagcaacatgagtgcgactc

SEQ ID NO: 25705 - DNA, 20 bp, Artificial Sequence
  Synthetic
gtggggacatttgggtgacg

SEQ ID NO: 25706 - DNA, 24 bp, Artificial Sequence
  Synthetic
ctggggatgataaaaatgcaactg

SEQ ID NO: 25707 - DNA, 23 bp, Artificial Sequence
  Synthetic
tcctgacgtcagatgtatctgca

SEQ ID NO: 25708 - DNA, 23 bp, Artificial Sequence
  Synthetic
agaacgatcagcaaggatttacg

SEQ ID NO: 25709 - DNA, 20 bp, Artificial Sequence
  Synthetic
ttccacgcgacagatccgtc

SEQ ID NO: 25710 - DNA, 20 bp, Artificial Sequence
  Synthetic
acagagctggtcctgacgga

SEQ ID NO: 25711 - DNA, 22 bp, Artificial Sequence
  Synthetic
gctgatcctaacggaaggaggc

SEQ ID NO: 25712 - DNA, 19 bp, Artificial Sequence
  Synthetic
cctcccacgcgcgcctata

SEQ ID NO: 25713 - DNA, 20 bp, Artificial Sequence
  Synthetic
acaagacgagggctgcaacg

SEQ ID NO: 25714 - DNA, 20 bp, Artificial Sequence
  Synthetic
cggaggagagagaacggccg

SEQ ID NO: 25715 - DNA, 19 bp, Artificial Sequence
  Synthetic
ggccaaggcaacggcacga

SEQ ID NO: 25716 - DNA, 21 bp, Artificial Sequence
  Synthetic
cgatacagcgcgtcgtcgaac

SEQ ID NO: 25717 - DNA, 20 bp, Artificial Sequence
  Synthetic
gttctcggacgggtccctta

SEQ ID NO: 25718 - DNA, 23 bp, Artificial Sequence
  Synthetic
gcacgttgtctatccaatcgtaa

SEQ ID NO: 25719 - DNA, 21 bp, Artificial Sequence
  Synthetic
cgctttcctccgcatgtacaa

SEQ ID NO: 25720 - DNA, 24 bp, Artificial Sequence
  Synthetic
ttttacacagtgtcgaaatcacca

SEQ ID NO: 25721 - DNA, 22 bp, Artificial Sequence
  Synthetic
aacctgacctcgataaagcact

SEQ ID NO: 25722 - DNA, 23 bp, Artificial Sequence
  Synthetic
aatgacaaaacgtgctctctctg

SEQ ID NO: 25723 - DNA, 23 bp, Artificial Sequence
  Synthetic
gttgcctgagttttcggtattcg

SEQ ID NO: 25724 - DNA, 25 bp, Artificial Sequence
  Synthetic
ggttttgaagaagaagatgggatgt

SEQ ID NO: 25725 - DNA, 25 bp, Artificial Sequence
  Synthetic
aacgattggattttcaaagtttcca

SEQ ID NO: 25726 - DNA, 23 bp, Artificial Sequence
  Synthetic
cgaaaatagttccgcctgtttct

SEQ ID NO: 25727 - DNA, 25 bp, Artificial Sequence
  Synthetic
ggtcaagcgaagataacattctttc

SEQ ID NO: 25728 - DNA, 23 bp, Artificial Sequence
  Synthetic
cattcgactcacatcattgaagc

SEQ ID NO: 25729 - DNA, 24 bp, Artificial Sequence
  Synthetic
aggttagattcggaaaccatagct

SEQ ID NO: 25730 - DNA, 20 bp, Artificial Sequence
  Synthetic
ggctccgcccatgatttcat

SEQ ID NO: 25731 - DNA, 20 bp, Artificial Sequence
  Synthetic
gagtcgcttctagactcgcc

SEQ ID NO: 25732 - DNA, 20 bp, Artificial Sequence
  Synthetic
tatgggcgcaaagtgctgta

SEQ ID NO: 25733 - DNA, 21 bp, Artificial Sequence
  Synthetic
ttggaagcatacgtttgtggc

SEQ ID NO: 25734 - DNA, 21 bp, Artificial Sequence
  Synthetic
tttgcttttactgcagagcgt

SEQ ID NO: 25735 - DNA, 20 bp, Artificial Sequence
  Synthetic
tcggagagcgttgtggattg

SEQ ID NO: 25736 - DNA, 19 bp, Artificial Sequence
  Synthetic
acgacgtgctgcaaggccg

SEQ ID NO: 25737 - DNA, 21 bp, Artificial Sequence
  Synthetic
cagaccgctgctggacgaact

SEQ ID NO: 25738 - DNA, 22 bp, Artificial Sequence
  Synthetic
acatctgttcgacgtgatcgcc

SEQ ID NO: 25739 - DNA, 22 bp, Artificial Sequence
  Synthetic
ttgggtggtcttgactttggcg

SEQ ID NO: 25740 - DNA, 22 bp, Artificial Sequence
  Synthetic
ccctcttccctttaaccccacg

SEQ ID NO: 25741 - DNA, 24 bp, Artificial Sequence
  Synthetic
acaaagggattggctgatgattac

SEQ ID NO: 25742 - DNA, 25 bp, Artificial Sequence
  Synthetic
aactgaggaatatatctgttccagc

SEQ ID NO: 25743 - DNA, 24 bp, Artificial Sequence
  Synthetic
taatgcctttctcctcatgtctga

SEQ ID NO: 25744 - DNA, 25 bp, Artificial Sequence
  Synthetic
agaagtagcaatagatgacgaaacg

SEQ ID NO: 25745 - DNA, 24 bp, Artificial Sequence
  Synthetic
tttgtgagtggaagagaaaaacct

SEQ ID NO: 25746 - DNA, 24 bp, Artificial Sequence
  Synthetic
ggaaggcaaactagtaaaagggtc

SEQ ID NO: 25747 - DNA, 23 bp, Artificial Sequence
  Synthetic
agaagacaagcataacgggaaac

SEQ ID NO: 25748 - DNA, 25 bp, Artificial Sequence
  Synthetic
tcatcgattatgaggagctaagaga

SEQ ID NO: 25749 - DNA, 23 bp, Artificial Sequence
  Synthetic
tgcagatgcatatgtttttgtgg

SEQ ID NO: 25750 - DNA, 25 bp, Artificial Sequence
  Synthetic
attgcaatacaacttgtcaaacacc

SEQ ID NO: 25751 - DNA, 22 bp, Artificial Sequence
  Synthetic
caccatcaaaatgagcaggggt

SEQ ID NO: 25752 - DNA, 20 bp, Artificial Sequence
  Synthetic
cctacaagcgccaggagggt

SEQ ID NO: 25753 - DNA, 19 bp, Artificial Sequence
  Synthetic
ctcggagtcccagcgcgtt

SEQ ID NO: 25754 - DNA, 19 bp, Artificial Sequence
  Synthetic
cacctccctgtggcgcatc

SEQ ID NO: 25755 - DNA, 20 bp, Artificial Sequence
  Synthetic
tatccgtcctccctgggcac

SEQ ID NO: 25756 - DNA, 19 bp, Artificial Sequence
  Synthetic
ccgtccaccgtccctctca

SEQ ID NO: 25757 - DNA, 22 bp, Artificial Sequence
  Synthetic
gaagacctagagctgccggacc

SEQ ID NO: 25758 - DNA, 22 bp, Artificial Sequence
  Synthetic
gtgattctgggaaacgtgccca

SEQ ID NO: 25759 - DNA, 19 bp, Artificial Sequence
  Synthetic
gccctcctgggtacggcaa

SEQ ID NO: 25760 - DNA, 20 bp, Artificial Sequence
  Synthetic
gccgtgcttccagagaccga

SEQ ID NO: 25761 - DNA, 20 bp, Artificial Sequence
  Synthetic
caactcggcctgcgtgatcc

SEQ ID NO: 25762 - DNA, 20 bp, Artificial Sequence
  Synthetic
aagccatgacggtacacagg

SEQ ID NO: 25763 - DNA, 24 bp, Artificial Sequence
  Synthetic
ttaaccgtttcttctgccagttag

SEQ ID NO: 25764 - DNA, 23 bp, Artificial Sequence
  Synthetic
tctccgaacatgatcagaactcg

SEQ ID NO: 25765 - DNA, 24 bp, Artificial Sequence
  Synthetic
acgaaaacttttaacttcgacgga

SEQ ID NO: 25766 - DNA, 20 bp, Artificial Sequence
  Synthetic
actgcaaatcgttccgtcgt

SEQ ID NO: 25767 - DNA, 23 bp, Artificial Sequence
  Synthetic
agcaaagcaataacgaaccttgt

SEQ ID NO: 25768 - DNA, 21 bp, Artificial Sequence
  Synthetic
tatcgtcgagctgtacagacg

SEQ ID NO: 25769 - DNA, 25 bp, Artificial Sequence
  Synthetic
taccttcaaaaatacgtaaacccct

SEQ ID NO: 25770 - DNA, 20 bp, Artificial Sequence
  Synthetic
acaaacttgcaagcctgagc

SEQ ID NO: 25771 - DNA, 20 bp, Artificial Sequence
  Synthetic
ggtaggtcgcgacttgttga

SEQ ID NO: 25772 - DNA, 25 bp, Artificial Sequence
  Synthetic
caaccctgatgtaataaattccgtg

SEQ ID NO: 25773 - DNA, 23 bp, Artificial Sequence
  Synthetic
tcgggagaaaatagatcaagggc

SEQ ID NO: 25774 - DNA, 24 bp, Artificial Sequence
  Synthetic
taattcgcttaagattggcagtgg

SEQ ID NO: 25775 - DNA, 21 bp, Artificial Sequence
  Synthetic
cgtctgttgttaggaccggtt

SEQ ID NO: 25776 - DNA, 24 bp, Artificial Sequence
  Synthetic
tcttcgcatacgtaagaaactacg

SEQ ID NO: 25777 - DNA, 23 bp, Artificial Sequence
  Synthetic
gcaaagcataaattcttctggcg

SEQ ID NO: 25778 - DNA, 21 bp, Artificial Sequence
  Synthetic
tcatggttccgtcttccaagt

SEQ ID NO: 25779 - DNA, 20 bp, Artificial Sequence
  Synthetic
ccagatccgggttatagcga

SEQ ID NO: 25780 - DNA, 20 bp, Artificial Sequence
  Synthetic
ctctctcctgtgtcgatcgc

SEQ ID NO: 25781 - DNA, 20 bp, Artificial Sequence
  Synthetic
atgtgtgacgtccgcatcat

SEQ ID NO: 25782 - DNA, 20 bp, Artificial Sequence
  Synthetic
tgctcctacaagcgccagga

SEQ ID NO: 25783 - DNA, 19 bp, Artificial Sequence
  Synthetic
ggtggccgtgtacgcacct

SEQ ID NO: 25784 - DNA, 22 bp, Artificial Sequence
  Synthetic
atcgaccgactcctgctatccg

SEQ ID NO: 25785 - DNA, 19 bp, Artificial Sequence
  Synthetic
gcggttctgccagggcgtt

SEQ ID NO: 25786 - DNA, 19 bp, Artificial Sequence
  Synthetic
gggaccccgtggcgtatga

SEQ ID NO: 25787 - DNA, 20 bp, Artificial Sequence
  Synthetic
acattccatggggccaaaga

SEQ ID NO: 25788 - DNA, 24 bp, Artificial Sequence
  Synthetic
ttaaatacggactgaaaggagggc

SEQ ID NO: 25789 - DNA, 22 bp, Artificial Sequence
  Synthetic
ctccgccgagatcaaaagtcct

SEQ ID NO: 25790 - DNA, 25 bp, Artificial Sequence
  Synthetic
aggcgatcatggaaaagaacatagt

SEQ ID NO: 25791 - DNA, 22 bp, Artificial Sequence
  Synthetic
gggagaccttcactacctccag

SEQ ID NO: 25792 - DNA, 20 bp, Artificial Sequence
  Synthetic
ggccactatgtctgcacgtt

SEQ ID NO: 25793 - DNA, 24 bp, Artificial Sequence
  Synthetic
agaagtgagaataagatgctgcaa

SEQ ID NO: 25794 - DNA, 20 bp, Artificial Sequence
  Synthetic
cacgcaacaggacttgcaag

SEQ ID NO: 25795 - DNA, 20 bp, Artificial Sequence
  Synthetic
atgtggggtctgggtgttca

SEQ ID NO: 25796 - DNA, 24 bp, Artificial Sequence
  Synthetic
caggtggtagagctgtttaaatgc

SEQ ID NO: 25797 - DNA, 25 bp, Artificial Sequence
  Synthetic
gcttgccaaaatgttaaatgtacca

SEQ ID NO: 25798 - DNA, 25 bp, Artificial Sequence
  Synthetic
tgcacaaatagcagatatagatgca

SEQ ID NO: 25799 - DNA, 22 bp, Artificial Sequence
  Synthetic
gcaaacagctacagcaccatat

SEQ ID NO: 25800 - DNA, 25 bp, Artificial Sequence
  Synthetic
tacaggacacaagtcaagaactatg

SEQ ID NO: 25801 - DNA, 21 bp, Artificial Sequence
  Synthetic
gcacgctcgcctgatattgaa

SEQ ID NO: 25802 - DNA, 25 bp, Artificial Sequence
  Synthetic
aaccccatatttactgatccttcgg

SEQ ID NO: 25803 - DNA, 25 bp, Artificial Sequence
  Synthetic
tcaccttctatacctgccatatctg

SEQ ID NO: 25804 - DNA, 20 bp, Artificial Sequence
  Synthetic
tacgcttgcccgaccctaat

SEQ ID NO: 25805 - DNA, 21 bp, Artificial Sequence
  Synthetic
acaccgtgcaatgcttctaaa

SEQ ID NO: 25806 - DNA, 21 bp, Artificial Sequence
  Synthetic
tgtgtgtgatactcccttgca

SEQ ID NO: 25807 - DNA, 25 bp, Artificial Sequence
  Synthetic
atacgcttccaaacttgcttttagg

SEQ ID NO: 25808 - DNA, 22 bp, Artificial Sequence
  Synthetic
cattgcaccagctatgtgaagt

SEQ ID NO: 25809 - DNA, 25 bp, Artificial Sequence
  Synthetic
taaggtgctacagatgtcaacatcc

SEQ ID NO: 25810 - DNA, 24 bp, Artificial Sequence
  Synthetic
ctcagaggatgaggatgaggatga

SEQ ID NO: 25811 - DNA, 22 bp, Artificial Sequence
  Synthetic
gtaatcagcaaacagtgtgccg

SEQ ID NO: 25812 - DNA, 22 bp, Artificial Sequence
  Synthetic
tgccactgcaacaaatacaaga

SEQ ID NO: 25813 - DNA, 25 bp, Artificial Sequence
  Synthetic
gcatttgacaatgaagtaaccgatg

SEQ ID NO: 25814 - DNA, 22 bp, Artificial Sequence
  Synthetic
cctaaggtatcaaggggtcgag

SEQ ID NO: 25815 - DNA, 24 bp, Artificial Sequence
  Synthetic
atttggataacgacgaagacaagg

SEQ ID NO: 25816 - DNA, 22 bp, Artificial Sequence
  Synthetic
acaaactttaaagacgaggcca

SEQ ID NO: 25817 - DNA, 22 bp, Artificial Sequence
  Synthetic
actgactccaccacacagtcca

SEQ ID NO: 25818 - DNA, 24 bp, Artificial Sequence
  Synthetic
agatgaaacccaacgccaaaaatt

SEQ ID NO: 25819 - DNA, 20 bp, Artificial Sequence
  Synthetic
tttgctgctttgtgtgcctg

SEQ ID NO: 25820 - DNA, 24 bp, Artificial Sequence
  Synthetic
ccaacatctggggttcatagttat

SEQ ID NO: 25821 - DNA, 24 bp, Artificial Sequence
  Synthetic
agacattgtggctttacacagacc

SEQ ID NO: 25822 - DNA, 23 bp, Artificial Sequence
  Synthetic
acgtaggcgtcgtaaacgtattc

SEQ ID NO: 25823 - DNA, 23 bp, Artificial Sequence
  Synthetic
acagatatgtgaaaagtgcagct

SEQ ID NO: 25824 - DNA, 23 bp, Artificial Sequence
  Synthetic
ctgcataccttagtgcttttggg

SEQ ID NO: 25825 - DNA, 20 bp, Artificial Sequence
  Synthetic
ggcaactctccaggttgtct

SEQ ID NO: 25826 - DNA, 20 bp, Artificial Sequence
  Synthetic
ctgcctgcgcacctctcatg

SEQ ID NO: 25827 - DNA, 25 bp, Artificial Sequence
  Synthetic
tgtggctattcagacaggattatgc

SEQ ID NO: 25828 - DNA, 22 bp, Artificial Sequence
  Synthetic
aactccaggatctgggcaattc

SEQ ID NO: 25829 - DNA, 24 bp, Artificial Sequence
  Synthetic
acaactttaattggggagattgca

SEQ ID NO: 25830 - DNA, 22 bp, Artificial Sequence
  Synthetic
tctcttgttgtaccatgggtga

SEQ ID NO: 25831 - DNA, 25 bp, Artificial Sequence
  Synthetic
tggaaaatcacactacaggaaatgg

SEQ ID NO: 25832 - DNA, 25 bp, Artificial Sequence
  Synthetic
ggacagccatttcctagattttctt

SEQ ID NO: 25833 - DNA, 25 bp, Artificial Sequence
  Synthetic
aggaacaaggcataactgattacat

SEQ ID NO: 25834 - DNA, 25 bp, Artificial Sequence
  Synthetic
aaaagttttgcaaatggacccaatt

SEQ ID NO: 25835 - DNA, 21 bp, Artificial Sequence
  Synthetic
ggtggtggatgtcatgtctgc

SEQ ID NO: 25836 - DNA, 25 bp, Artificial Sequence
  Synthetic
aacgatttatgagtcaaaaggttgg

SEQ ID NO: 25837 - DNA, 25 bp, Artificial Sequence
  Synthetic
tatgcgaaaaacttgattgttgtgt

SEQ ID NO: 25838 - DNA, 25 bp, Artificial Sequence
  Synthetic
agatgatgaagttgatgcagaagag

SEQ ID NO: 25839 - DNA, 25 bp, Artificial Sequence
  Synthetic
acaggtaacaactagtggattttca

SEQ ID NO: 25840 - DNA, 24 bp, Artificial Sequence
  Synthetic
aaatgcgtaatatgtcaatggcag

SEQ ID NO: 25841 - DNA, 25 bp, Artificial Sequence
  Synthetic
agatgtaaaagcagaacaatcgttg

SEQ ID NO: 25842 - DNA, 24 bp, Artificial Sequence
  Synthetic
atttggaggcttaaagacacaagt

SEQ ID NO: 25843 - DNA, 22 bp, Artificial Sequence
  Synthetic
aaccttcgacgacgacaaggag

SEQ ID NO: 25844 - DNA, 25 bp, Artificial Sequence
  Synthetic
gaggagctatataaacaatgtgcca

SEQ ID NO: 25845 - DNA, 25 bp, Artificial Sequence
  Synthetic
cagatgagtctgcagtactagatgt

SEQ ID NO: 25846 - DNA, 25 bp, Artificial Sequence
  Synthetic
accttcctattttacaaccgatacc

SEQ ID NO: 25847 - DNA, 25 bp, Artificial Sequence
  Synthetic
ttcagatgacttttacttgcatcct

SEQ ID NO: 25848 - DNA, 22 bp, Artificial Sequence
  Synthetic
gaggacgatactggtgatcaca

SEQ ID NO: 25849 - DNA, 20 bp, Artificial Sequence
  Synthetic
caacaccgagtggctcactg

SEQ ID NO: 25850 - DNA, 25 bp, Artificial Sequence
  Synthetic
ttctgggacgttgatttaacagaga

SEQ ID NO: 25851 - DNA, 21 bp, Artificial Sequence
  Synthetic
ggctgcctgcccctctttgag

SEQ ID NO: 25852 - DNA, 21 bp, Artificial Sequence
  Synthetic
tactgtttgacaccatgggcg

SEQ ID NO: 25853 - DNA, 25 bp, Artificial Sequence
  Synthetic
aggcttaaacaaattactatcggga

SEQ ID NO: 25854 - DNA, 21 bp, Artificial Sequence
  Synthetic
accatcatgcattgggtaggt

SEQ ID NO: 25855 - DNA, 25 bp, Artificial Sequence
  Synthetic
aacatcactatattcccacaccagc

SEQ ID NO: 25856 - DNA, 25 bp, Artificial Sequence
  Synthetic
tggatctcaacaatttctcacaact

SEQ ID NO: 25857 - DNA, 25 bp, Artificial Sequence
  Synthetic
actttgcaaattggtcaggtagtat

SEQ ID NO: 25858 - DNA, 20 bp, Artificial Sequence
  Synthetic
ccaacccagtggtccacaac

SEQ ID NO: 25859 - DNA, 25 bp, Artificial Sequence
  Synthetic
tttgacatggaagttactgttgtca

SEQ ID NO: 25860 - DNA, 25 bp, Artificial Sequence
  Synthetic
tgctgtgtatggtatcacatctaca

SEQ ID NO: 25861 - DNA, 20 bp, Artificial Sequence
  Synthetic
aaactgcaggcccaagtgat

SEQ ID NO: 25862 - DNA, 25 bp, Artificial Sequence
  Synthetic
tggtatcagatagaggaaacctgtt

SEQ ID NO: 25863 - DNA, 25 bp, Artificial Sequence
  Synthetic
ggtttcactgacacacttaaagacc

SEQ ID NO: 25864 - DNA, 20 bp, Artificial Sequence
  Synthetic
ccaagccgacaaggtgatgg

SEQ ID NO: 25865 - DNA, 21 bp, Artificial Sequence
  Synthetic
atggatgatctgggccaaaac

SEQ ID NO: 25866 - DNA, 24 bp, Artificial Sequence
  Synthetic
tcaagtaggcttgctagatactgc

SEQ ID NO: 25867 - DNA, 25 bp, Artificial Sequence
  Synthetic
agaccctaaagtcattcaatactgc

SEQ ID NO: 25868 - DNA, 21 bp, Artificial Sequence
  Synthetic
ccttgcaaggtcctgaacatg

SEQ ID NO: 25869 - DNA, 24 bp, Artificial Sequence
  Synthetic
atacatgtgggtggaaatggtagg

SEQ ID NO: 25870 - DNA, 24 bp, Artificial Sequence
  Synthetic
tgaatgagtacatagaaacagccg

SEQ ID NO: 25871 - DNA, 24 bp, Artificial Sequence
  Synthetic
actttcctaaaggatgaactccgc

SEQ ID NO: 25872 - DNA, 24 bp, Artificial Sequence
  Synthetic
agatggagaactcattgcttttga

SEQ ID NO: 25873 - DNA, 25 bp, Artificial Sequence
  Synthetic
atgagtcaatcagatggactaagga

SEQ ID NO: 25874 - DNA, 23 bp, Artificial Sequence
  Synthetic
aaccctgctctcagaatgaaatg

SEQ ID NO: 25875 - DNA, 25 bp, Artificial Sequence
  Synthetic
caagtacagtccattatccaaaggt

SEQ ID NO: 25876 - DNA, 25 bp, Artificial Sequence
  Synthetic
gtaaaattgctcctttaatggtggc

SEQ ID NO: 25877 - DNA, 20 bp, Artificial Sequence
  Synthetic
ggcggagagcaacagctatc

SEQ ID NO: 25878 - DNA, 25 bp, Artificial Sequence
  Synthetic
cacttccaaaaagatgcaaaagtgc

SEQ ID NO: 25879 - DNA, 23 bp, Artificial Sequence
  Synthetic
cagggaacagagaagttgacaat

SEQ ID NO: 25880 - DNA, 21 bp, Artificial Sequence
  Synthetic
ggaaacggccgattttcccac

SEQ ID NO: 25881 - DNA, 25 bp, Artificial Sequence
  Synthetic
ggtgtttatgttacacatcagctga

SEQ ID NO: 25882 - DNA, 23 bp, Artificial Sequence
  Synthetic
atgattcttcaggctgacatagc

SEQ ID NO: 25883 - DNA, 20 bp, Artificial Sequence
  Synthetic
ggagacccaaatgcttcctg

SEQ ID NO: 25884 - DNA, 20 bp, Artificial Sequence
  Synthetic
ccaggaactaggcgcagctg

SEQ ID NO: 25885 - DNA, 24 bp, Artificial Sequence
  Synthetic
actggtttggaactcctctatctc

SEQ ID NO: 25886 - DNA, 21 bp, Artificial Sequence
  Synthetic
gcttttacagccagcagcgtc

SEQ ID NO: 25887 - DNA, 22 bp, Artificial Sequence
  Synthetic
aacatgcctgctacatctcggg

SEQ ID NO: 25888 - DNA, 22 bp, Artificial Sequence
  Synthetic
ctgctcttccctagaaacgggc

SEQ ID NO: 25889 - DNA, 22 bp, Artificial Sequence
  Synthetic
acgatgagaccaagtccagggt

SEQ ID NO: 25890 - DNA, 21 bp, Artificial Sequence
  Synthetic
gaccatgacctacgcgaccgt

SEQ ID NO: 25891 - DNA, 20 bp, Artificial Sequence
  Synthetic
ggggtggaggtagcaccact

SEQ ID NO: 25892 - DNA, 22 bp, Artificial Sequence
  Synthetic
ggaccaccaggacaatgtagcc

SEQ ID NO: 25893 - DNA, 19 bp, Artificial Sequence
  Synthetic
gggccgtagatgaccccga

SEQ ID NO: 25894 - DNA, 22 bp, Artificial Sequence
  Synthetic
ttgggacgactgcgactgtagg

SEQ ID NO: 25895 - DNA, 20 bp, Artificial Sequence
  Synthetic
tttgggcgcgagaaagaccg

SEQ ID NO: 25896 - DNA, 22 bp, Artificial Sequence
  Synthetic
cgtccacgccaagacaaaggag

SEQ ID NO: 25897 - DNA, 22 bp, Artificial Sequence
  Synthetic
ccctgccgcaatgctttttagg

SEQ ID NO: 25898 - DNA, 20 bp, Artificial Sequence
  Synthetic
ccagcctcggttatgcaggg

SEQ ID NO: 25899 - DNA, 20 bp, Artificial Sequence
  Synthetic
acaactcatgcgagggtgcc

SEQ ID NO: 25900 - DNA, 20 bp, Artificial Sequence
  Synthetic
gaggtgtgcgtcagggcaaa

SEQ ID NO: 25901 - DNA, 22 bp, Artificial Sequence
  Synthetic
aagctcctcgtaggtgaggtcc

SEQ ID NO: 25902 - DNA, 22 bp, Artificial Sequence
  Synthetic
accagcatgaaggggacaagct

SEQ ID NO: 25903 - DNA, 20 bp, Artificial Sequence
  Synthetic
gccctggctggtggttttca

SEQ ID NO: 25904 - DNA, 19 bp, Artificial Sequence
  Synthetic
gcgtcattgacggcggcct

SEQ ID NO: 25905 - DNA, 21 bp, Artificial Sequence
  Synthetic
cgcaggcgctgaaaaaggtag

SEQ ID NO: 25906 - DNA, 20 bp, Artificial Sequence
  Synthetic
cgggagacggtcgacgaagc

SEQ ID NO: 25907 - DNA, 22 bp, Artificial Sequence
  Synthetic
aggaaagcgtctagccaatcgc

SEQ ID NO: 25908 - DNA, 19 bp, Artificial Sequence
  Synthetic
cgacgcgctcggcaaggat

SEQ ID NO: 25909 - DNA, 22 bp, Artificial Sequence
  Synthetic
gtagccgtagaggtagcgggac

SEQ ID NO: 25910 - DNA, 21 bp, Artificial Sequence
  Synthetic
ggctaaagccgcgactaacgt

SEQ ID NO: 25911 - DNA, 21 bp, Artificial Sequence
  Synthetic
gcatcccgtcctgcgccaaat

SEQ ID NO: 25912 - DNA, 19 bp, Artificial Sequence
  Synthetic
tgattgcgcgcgaggaggt

SEQ ID NO: 25913 - DNA, 19 bp, Artificial Sequence
  Synthetic
cgcatggcgctcaaggtgc

SEQ ID NO: 25914 - DNA, 18 bp, Artificial Sequence
  Synthetic
taagggcggcgctgcaaa

SEQ ID NO: 25915 - DNA, 21 bp, Artificial Sequence
  Synthetic
acgaacgtgcagtccaacctg

SEQ ID NO: 25916 - DNA, 21 bp, Artificial Sequence
  Synthetic
cggtcaacggtgagcagcttg

SEQ ID NO: 25917 - DNA, 21 bp, Artificial Sequence
  Synthetic
cactgtcggccgaggaagaaa

SEQ ID NO: 25918 - DNA, 20 bp, Artificial Sequence
  Synthetic
ccgccagggttctacacggg

SEQ ID NO: 25919 - DNA, 19 bp, Artificial Sequence
  Synthetic
gcctggtgtgggacgacga

SEQ ID NO: 25920 - DNA, 22 bp, Artificial Sequence
  Synthetic
accctggaggttccgtttgtgc

SEQ ID NO: 25921 - DNA, 22 bp, Artificial Sequence
  Synthetic
gatgccgggggtctacacctac

SEQ ID NO: 25922 - DNA, 22 bp, Artificial Sequence
  Synthetic
gcaagaggagatagcagtgtcc

SEQ ID NO: 25923 - DNA, 22 bp, Artificial Sequence
  Synthetic
tcagcaactaccccgtggttgg

SEQ ID NO: 25924 - DNA, 19 bp, Artificial Sequence
  Synthetic
cgcgtgctctccagtcgca

SEQ ID NO: 25925 - DNA, 19 bp, Artificial Sequence
  Synthetic
aactacacccccgccccct

SEQ ID NO: 25926 - DNA, 18 bp, Artificial Sequence
  Synthetic
cgtgtactgggtgcgcga

SEQ ID NO: 25927 - DNA, 20 bp, Artificial Sequence
  Synthetic
cggcacggcggtggtgttta

SEQ ID NO: 25928 - DNA, 21 bp, Artificial Sequence
  Synthetic
aaatggatgtggagcccgagg

SEQ ID NO: 25929 - DNA, 20 bp, Artificial Sequence
  Synthetic
ccaggaggcgaagatggggc

SEQ ID NO: 25930 - DNA, 19 bp, Artificial Sequence
  Synthetic
caggagaggcatggcaggc

SEQ ID NO: 25931 - DNA, 20 bp, Artificial Sequence
  Synthetic
gaacgggggcgccttcaatt

SEQ ID NO: 25932 - DNA, 19 bp, Artificial Sequence
  Synthetic
cctgacgcggaggagacga

SEQ ID NO: 25933 - DNA, 21 bp, Artificial Sequence
  Synthetic
gagcacgctgcacagtatcgt

SEQ ID NO: 25934 - DNA, 21 bp, Artificial Sequence
  Synthetic
cacccacgatgtgaccacgga

SEQ ID NO: 25935 - DNA, 22 bp, Artificial Sequence
  Synthetic
aagggtctgcaaattggtgttg

SEQ ID NO: 25936 - DNA, 20 bp, Artificial Sequence
  Synthetic
gaactctgcggtggacagtt

SEQ ID NO: 25937 - DNA, 22 bp, Artificial Sequence
  Synthetic
cctacgagtacatgaacgggcg

SEQ ID NO: 25938 - DNA, 19 bp, Artificial Sequence
  Synthetic
gcgcctccgtccgctttga

SEQ ID NO: 25939 - DNA, 21 bp, Artificial Sequence
  Synthetic
aacgtggcccaatgcaacatg

SEQ ID NO: 25940 - DNA, 19 bp, Artificial Sequence
  Synthetic
cagccctaccccgccaact

SEQ ID NO: 25941 - DNA, 20 bp, Artificial Sequence
  Synthetic
ggcaacgccaccacctaagc

SEQ ID NO: 25942 - DNA, 22 bp, Artificial Sequence
  Synthetic
ttcgagtacgaggccatgttgc

SEQ ID NO: 25943 - DNA, 19 bp, Artificial Sequence
  Synthetic
tccggcgcaaccaggagga

SEQ ID NO: 25944 - DNA, 20 bp, Artificial Sequence
  Synthetic
gtctcgctccacatgcgccg

SEQ ID NO: 25945 - DNA, 22 bp, Artificial Sequence
  Synthetic
ctgcttaaaagcttgctgggcc

SEQ ID NO: 25946 - DNA, 18 bp, Artificial Sequence
  Synthetic
tggccttccacctcggca

SEQ ID NO: 25947 - DNA, 22 bp, Artificial Sequence
  Synthetic
tggtatccatgcccttctccca

SEQ ID NO: 25948 - DNA, 20 bp, Artificial Sequence
  Synthetic
ccggagcccacccgctgata

SEQ ID NO: 25949 - DNA, 22 bp, Artificial Sequence
  Synthetic
acagaaggaaaccaacgctggg

SEQ ID NO: 25950 - DNA, 22 bp, Artificial Sequence
  Synthetic
ctcacccattttgcctaccccg

SEQ ID NO: 25951 - DNA, 22 bp, Artificial Sequence
  Synthetic
cgtggagctaaccaacctggtc

SEQ ID NO: 25952 - DNA, 20 bp, Artificial Sequence
  Synthetic
gccttggacctggccgaaat

SEQ ID NO: 25953 - DNA, 19 bp, Artificial Sequence
  Synthetic
gccactgccgctgcaacct

SEQ ID NO: 25954 - DNA, 20 bp, Artificial Sequence
  Synthetic
ctcgcccaattgcacgccat

SEQ ID NO: 25955 - DNA, 22 bp, Artificial Sequence
  Synthetic
gggatcgagtaaagggtgacgg

SEQ ID NO: 25956 - DNA, 20 bp, Artificial Sequence
  Synthetic
aaatcggtctctgcgctcgc

SEQ ID NO: 25957 - DNA, 20 bp, Artificial Sequence
  Synthetic
gtccgcccagacccgactta

SEQ ID NO: 25958 - DNA, 22 bp, Artificial Sequence
  Synthetic
taccccgacgagttcataccga

SEQ ID NO: 25959 - DNA, 22 bp, Artificial Sequence
  Synthetic
atccagtgtcgtcataatcgca

SEQ ID NO: 25960 - DNA, 20 bp, Artificial Sequence
  Synthetic
ggggtgtactgtcatgccac

SEQ ID NO: 25961 - DNA, 21 bp, Artificial Sequence
  Synthetic
ctgctggtaggggctctaatg

SEQ ID NO: 25962 - DNA, 25 bp, Artificial Sequence
  Synthetic
taatgctgacaagtctcatgaaagg

SEQ ID NO: 25963 - DNA, 25 bp, Artificial Sequence
  Synthetic
atcaacaaataaccttcagccaaca

SEQ ID NO: 25964 - DNA, 25 bp, Artificial Sequence
  Synthetic
acaagttgcagaaactgatcaaaac

SEQ ID NO: 25965 - DNA, 24 bp, Artificial Sequence
  Synthetic
ttgctgcaaagccagaaaaaaatc

SEQ ID NO: 25966 - DNA, 22 bp, Artificial Sequence
  Synthetic
tcctgcagcttatcgactggtg

SEQ ID NO: 25967 - DNA, 20 bp, Artificial Sequence
  Synthetic
ctggaactctgttggggcat

SEQ ID NO: 25968 - DNA, 21 bp, Artificial Sequence
  Synthetic
cgaaaccagcggctgtatcca

SEQ ID NO: 25969 - DNA, 24 bp, Artificial Sequence
  Synthetic
tggaaatgtctcactcaaggttgg

SEQ ID NO: 25970 - DNA, 23 bp, Artificial Sequence
  Synthetic
agaagataaacgcaccctatgga

SEQ ID NO: 25971 - DNA, 20 bp, Artificial Sequence
  Synthetic
ggaaagccacatcaaccagc

SEQ ID NO: 25972 - DNA, 20 bp, Artificial Sequence
  Synthetic
gtgcgggaactggacttggg

SEQ ID NO: 25973 - DNA, 22 bp, Artificial Sequence
  Synthetic
atgttgggaatgatggaaccca

SEQ ID NO: 25974 - DNA, 20 bp, Artificial Sequence
  Synthetic
tggaaactcttgcagcaggg

SEQ ID NO: 25975 - DNA, 21 bp, Artificial Sequence
  Synthetic
gcggaggcaggattggaagaa

SEQ ID NO: 25976 - DNA, 20 bp, Artificial Sequence
  Synthetic
tccgcacatgtggaaaagct

SEQ ID NO: 25977 - DNA, 25 bp, Artificial Sequence
  Synthetic
atcctgtaaatacgtcactaggacc

SEQ ID NO: 25978 - DNA, 20 bp, Artificial Sequence
  Synthetic
actgggttagtatgcccgtg

SEQ ID NO: 25979 - DNA, 23 bp, Artificial Sequence
  Synthetic
aatgacggaaggtgtaaaaaccc

SEQ ID NO: 25980 - DNA, 23 bp, Artificial Sequence
  Synthetic
agtctggcggaggagcaattata

SEQ ID NO: 25981 - DNA, 24 bp, Artificial Sequence
  Synthetic
agttcaagtttggatagtgttggt

SEQ ID NO: 25982 - DNA, 20 bp, Artificial Sequence
  Synthetic
caatgggcgttgctgtggta

SEQ ID NO: 25983 - DNA, 25 bp, Artificial Sequence
  Synthetic
aatgacagcaatgaaagatggatga

SEQ ID NO: 25984 - DNA, 20 bp, Artificial Sequence
  Synthetic
tgatgatgctacagcggctg

SEQ ID NO: 25985 - DNA, 21 bp, Artificial Sequence
  Synthetic
acagaagctggctccatggta

SEQ ID NO: 25986 - DNA, 22 bp, Artificial Sequence
  Synthetic
aaggtatacacagggcctctag

SEQ ID NO: 25987 - DNA, 20 bp, Artificial Sequence
  Synthetic
tccagagcttgaagatgccg

SEQ ID NO: 25988 - DNA, 23 bp, Artificial Sequence
  Synthetic
cactccaaagaacaaccacaacc

SEQ ID NO: 25989 - DNA, 22 bp, Artificial Sequence
  Synthetic
aaagacaaggtttgacccctct

SEQ ID NO: 25990 - DNA, 22 bp, Artificial Sequence
  Synthetic
cctctcaaaacaggtcctgaca

SEQ ID NO: 25991 - DNA, 21 bp, Artificial Sequence
  Synthetic
tctactaccatggtccagccg

SEQ ID NO: 25992 - DNA, 25 bp, Artificial Sequence
  Synthetic
tatcagtgaatctgctggttacact

SEQ ID NO: 25993 - DNA, 25 bp, Artificial Sequence
  Synthetic
ccacatatgaatctagtcatctggg

SEQ ID NO: 25994 - DNA, 25 bp, Artificial Sequence
  Synthetic
aagcagagagaaaaacaacaacaca

SEQ ID NO: 25995 - DNA, 24 bp, Artificial Sequence
  Synthetic
tgtcattggtaccatagcactagg

SEQ ID NO: 25996 - DNA, 25 bp, Artificial Sequence
  Synthetic
aagggaactgtgatagatgttgatt

SEQ ID NO: 25997 - DNA, 23 bp, Artificial Sequence
  Synthetic
ttgacctataccaattgcggttt

SEQ ID NO: 25998 - DNA, 22 bp, Artificial Sequence
  Synthetic
aacctataaggcaacagcatcc

SEQ ID NO: 25999 - DNA, 25 bp, Artificial Sequence
  Synthetic
tctcattattacctggaccaagtct

SEQ ID NO: 26000 - DNA, 24 bp, Artificial Sequence
  Synthetic
acaaggggttatcagttatgctcc

SEQ ID NO: 26001 - DNA, 20 bp, Artificial Sequence
  Synthetic
gtggcttaacaactccgctc

SEQ ID NO: 26002 - DNA, 25 bp, Artificial Sequence
  Synthetic
ccaacctgcaaataggatcattaga

SEQ ID NO: 26003 - DNA, 25 bp, Artificial Sequence
  Synthetic
tcaacatgctaagactcaagaatgt

SEQ ID NO: 26004 - DNA, 25 bp, Artificial Sequence
  Synthetic
agagttactcagactggatatccca

SEQ ID NO: 26005 - DNA, 25 bp, Artificial Sequence
  Synthetic
gaattatgggagcttatcgactctt

SEQ ID NO: 26006 - DNA, 25 bp, Artificial Sequence
  Synthetic
tggtaaagggagaaattgacctact

SEQ ID NO: 26007 - DNA, 22 bp, Artificial Sequence
  Synthetic
gtgacatccagagttcctgtca

SEQ ID NO: 26008 - DNA, 25 bp, Artificial Sequence
  Synthetic
ttgtcagaaatataggtgatccagc

SEQ ID NO: 26009 - DNA, 22 bp, Artificial Sequence
  Synthetic
agaaactccagacccgttagaa

SEQ ID NO: 26010 - DNA, 24 bp, Artificial Sequence
  Synthetic
ttgaagttactcacccctgtatcg

SEQ ID NO: 26011 - DNA, 22 bp, Artificial Sequence
  Synthetic
aaagacacatcacatgcagtcc

SEQ ID NO: 26012 - DNA, 25 bp, Artificial Sequence
  Synthetic
ctgctgaggttcaacacaatatacc

SEQ ID NO: 26013 - DNA, 20 bp, Artificial Sequence
  Synthetic
atctcggagaaggtgcaggt

SEQ ID NO: 26014 - DNA, 20 bp, Artificial Sequence
  Synthetic
ccatacagccatgggacagg

SEQ ID NO: 26015 - DNA, 21 bp, Artificial Sequence
  Synthetic
gtcgtcagacctatgactgga

SEQ ID NO: 26016 - DNA, 25 bp, Artificial Sequence
  Synthetic
aaatggtcacacaacgaacaatagg

SEQ ID NO: 26017 - DNA, 25 bp, Artificial Sequence
  Synthetic
atgactaattcacaagacacagagc

SEQ ID NO: 26018 - DNA, 20 bp, Artificial Sequence
  Synthetic
gcatgaagctccgaacacaa

SEQ ID NO: 26019 - DNA, 21 bp, Artificial Sequence
  Synthetic
ccaatcctctgatgacttcgc

SEQ ID NO: 26020 - DNA, 22 bp, Artificial Sequence
  Synthetic
atgagcattggggtaacagtga

SEQ ID NO: 26021 - DNA, 24 bp, Artificial Sequence
  Synthetic
gtaatcccctgaatccatttgtca

SEQ ID NO: 26022 - DNA, 20 bp, Artificial Sequence
  Synthetic
tcgtacaggagaccagttgg

SEQ ID NO: 26023 - DNA, 21 bp, Artificial Sequence
  Synthetic
aggactacgaggtggactttg

SEQ ID NO: 26024 - DNA, 21 bp, Artificial Sequence
  Synthetic
atacggtgccatgcatgcagc

SEQ ID NO: 26025 - DNA, 22 bp, Artificial Sequence
  Synthetic
ttgttgaacaagcacagcaggc

SEQ ID NO: 26026 - DNA, 25 bp, Artificial Sequence
  Synthetic
agtgataagtcaatatgtggggact

SEQ ID NO: 26027 - DNA, 22 bp, Artificial Sequence
  Synthetic
ccaccaaagattagaagcgcac

SEQ ID NO: 26028 - DNA, 21 bp, Artificial Sequence
  Synthetic
ccttcttggccagtaactgcc

SEQ ID NO: 26029 - DNA, 25 bp, Artificial Sequence
  Synthetic
tgagcctactaaattttctgggagg

SEQ ID NO: 26030 - DNA, 21 bp, Artificial Sequence
  Synthetic
gcaacaagcttgaggaccaaa

SEQ ID NO: 26031 - DNA, 20 bp, Artificial Sequence
  Synthetic
tgtggaatacgcagccacaa

SEQ ID NO: 26032 - DNA, 24 bp, Artificial Sequence
  Synthetic
acatgcaagtgttgtggtatatgg

SEQ ID NO: 26033 - DNA, 22 bp, Artificial Sequence
  Synthetic
gtggatattggccctgtgtccc

SEQ ID NO: 26034 - DNA, 20 bp, Artificial Sequence
  Synthetic
accttgccggccatgtcatt

SEQ ID NO: 26035 - DNA, 22 bp, Artificial Sequence
  Synthetic
atgctgaccctgaggtgttgga

SEQ ID NO: 26036 - DNA, 23 bp, Artificial Sequence
  Synthetic
cgtcgtaaacgtgtaccctattc

SEQ ID NO: 26037 - DNA, 20 bp, Artificial Sequence
  Synthetic
tatccccaaggtgtctggct

SEQ ID NO: 26038 - DNA, 23 bp, Artificial Sequence
  Synthetic
gtttacgcagggaacaaatgttt

SEQ ID NO: 26039 - DNA, 25 bp, Artificial Sequence
  Synthetic
aattgtttgtaaccgttgtggatac

SEQ ID NO: 26040 - DNA, 20 bp, Artificial Sequence
  Synthetic
gcccaaggaggatcgctatg

SEQ ID NO: 26041 - DNA, 25 bp, Artificial Sequence
  Synthetic
gttgttttgtattgtgctgtactgg

SEQ ID NO: 26042 - DNA, 22 bp, Artificial Sequence
  Synthetic
gttccttgtgttcgggtagcca

SEQ ID NO: 26043 - DNA, 24 bp, Artificial Sequence
  Synthetic
tttgtgctgactactttcccttaa

SEQ ID NO: 26044 - DNA, 23 bp, Artificial Sequence
  Synthetic
aacatgtttacaaggtgggacgt

SEQ ID NO: 26045 - DNA, 21 bp, Artificial Sequence
  Synthetic
acctccaacaaagcctgaaga

SEQ ID NO: 26046 - DNA, 21 bp, Artificial Sequence
  Synthetic
aacctgactcacgctcagggc

SEQ ID NO: 26047 - DNA, 20 bp, Artificial Sequence
  Synthetic
cgaccgcgccattccattgg

SEQ ID NO: 26048 - DNA, 22 bp, Artificial Sequence
  Synthetic
atcacccgaaaactagaggaca

SEQ ID NO: 26049 - DNA, 23 bp, Artificial Sequence
  Synthetic
agttggcctaactcaccaaaaac

SEQ ID NO: 26050 - DNA, 19 bp, Artificial Sequence
  Synthetic
tgcgtggtctccggtgcct

SEQ ID NO: 26051 - DNA, 22 bp, Artificial Sequence
  Synthetic
tgggtgggtgtacgtaggttcc

SEQ ID NO: 26052 - DNA, 21 bp, Artificial Sequence
  Synthetic
gagatgctgctgtgtgaggca

SEQ ID NO: 26053 - DNA, 22 bp, Artificial Sequence
  Synthetic
tggaagcctgctcagggatttc

SEQ ID NO: 26054 - DNA, 19 bp, Artificial Sequence
  Synthetic
acgtgggctgggcggatct

SEQ ID NO: 26055 - DNA, 22 bp, Artificial Sequence
  Synthetic
tctcccggattcactgccatct

SEQ ID NO: 26056 - DNA, 22 bp, Artificial Sequence
  Synthetic
ctcttcgcctacgcacaagtgg

SEQ ID NO: 26057 - DNA, 19 bp, Artificial Sequence
  Synthetic
accagtgtcgccagtgcct

SEQ ID NO: 26058 - DNA, 21 bp, Artificial Sequence
  Synthetic
ccgagctcgggactctggtac

SEQ ID NO: 26059 - DNA, 20 bp, Artificial Sequence
  Synthetic
actggatgtgggcaaaggat

SEQ ID NO: 26060 - DNA, 20 bp, Artificial Sequence
  Synthetic
tggcgatctgggagttggcg

SEQ ID NO: 26061 - DNA, 20 bp, Artificial Sequence
  Synthetic
tagaggctgccgatgcctga

SEQ ID NO: 26062 - DNA, 21 bp, Artificial Sequence
  Synthetic
atgggagaggcaccactctgt

SEQ ID NO: 26063 - DNA, 19 bp, Artificial Sequence
  Synthetic
gcaatgccagcgcggggta

SEQ ID NO: 26064 - DNA, 19 bp, Artificial Sequence
  Synthetic
tcgggcgaagagcttccgg

SEQ ID NO: 26065 - DNA, 19 bp, Artificial Sequence
  Synthetic
cggacagtgtcgcgctgca

SEQ ID NO: 26066 - DNA, 19 bp, Artificial Sequence
  Synthetic
gcgctgggcggttgaggtt

SEQ ID NO: 26067 - DNA, 21 bp, Artificial Sequence
  Synthetic
ccctggctgaactcaccgaca

SEQ ID NO: 26068 - DNA, 20 bp, Artificial Sequence
  Synthetic
ggccaccatcccgtgacagg

SEQ ID NO: 26069 - DNA, 20 bp, Artificial Sequence
  Synthetic
ggtatccacacggagcaggc

SEQ ID NO: 26070 - DNA, 19 bp, Artificial Sequence
  Synthetic
ctccagcggcccaaaggga

SEQ ID NO: 26071 - DNA, 19 bp, Artificial Sequence
  Synthetic
accagccaccagacgagca

SEQ ID NO: 26072 - DNA, 20 bp, Artificial Sequence
  Synthetic
cggttgaaggagcccacgtt

SEQ ID NO: 26073 - DNA, 21 bp, Artificial Sequence
  Synthetic
cgtcgcctataccgcatctgc

SEQ ID NO: 26074 - DNA, 19 bp, Artificial Sequence
  Synthetic
agagacacaagcccccccg

SEQ ID NO: 26075 - DNA, 19 bp, Artificial Sequence
  Synthetic
cgcaccgtagcccgcgaaa

SEQ ID NO: 26076 - DNA, 19 bp, Artificial Sequence
  Synthetic
gcagcactacgtggcggga

SEQ ID NO: 26077 - DNA, 20 bp, Artificial Sequence
  Synthetic
aaaagctcagggcatccgcg

SEQ ID NO: 26078 - DNA, 22 bp, Artificial Sequence
  Synthetic
atcctgctgctcctgctcatcc

SEQ ID NO: 26079 - DNA, 22 bp, Artificial Sequence
  Synthetic
cggtggaggtaaaggtgttgcg

SEQ ID NO: 26080 - DNA, 22 bp, Artificial Sequence
  Synthetic
gtgtacctggggcacctcaacc

SEQ ID NO: 26081 - DNA, 22 bp, Artificial Sequence
  Synthetic
atctggatcccttgacctcggc

SEQ ID NO: 26082 - DNA, 20 bp, Artificial Sequence
  Synthetic
ttccttgcaggcgaagaggc

SEQ ID NO: 26083 - DNA, 19 bp, Artificial Sequence
  Synthetic
gacgagtgcagcaccaggt

SEQ ID NO: 26084 - DNA, 18 bp, Artificial Sequence
  Synthetic
accgcgttgtcggagctg

SEQ ID NO: 26085 - DNA, 22 bp, Artificial Sequence
  Synthetic
agctagaggatttgcgattgct

SEQ ID NO: 26086 - DNA, 22 bp, Artificial Sequence
  Synthetic
agacgctgactctagtgtgccc

SEQ ID NO: 26087 - DNA, 20 bp, Artificial Sequence
  Synthetic
ccggtggaggatcaggagga

SEQ ID NO: 26088 - DNA, 25 bp, Artificial Sequence
  Synthetic
atggattgttagacagacgttggta

SEQ ID NO: 26089 - DNA, 22 bp, Artificial Sequence
  Synthetic
agtgttctatggacctgcagac

SEQ ID NO: 26090 - DNA, 25 bp, Artificial Sequence
  Synthetic
gaggaggacagatggaaatatttgc

SEQ ID NO: 26091 - DNA, 22 bp, Artificial Sequence
  Synthetic
aggccatagaggtacagctggc

SEQ ID NO: 26092 - DNA, 21 bp, Artificial Sequence
  Synthetic
gtatccccagtcccagcccca

SEQ ID NO: 26093 - DNA, 24 bp, Artificial Sequence
  Synthetic
gatagcattgccagggtatatgtc

SEQ ID NO: 26094 - DNA, 20 bp, Artificial Sequence
  Synthetic
cacacctaacacccccactt

SEQ ID NO: 26095 - DNA, 22 bp, Artificial Sequence
  Synthetic
gccgtcttggatatcaccccct

SEQ ID NO: 26096 - DNA, 20 bp, Artificial Sequence
  Synthetic
ttgatgagttacccgccgcc

SEQ ID NO: 26097 - DNA, 22 bp, Artificial Sequence
  Synthetic
atgtctatgtcacgcggactaa

SEQ ID NO: 26098 - DNA, 25 bp, Artificial Sequence
  Synthetic
atcctgattatctgaagatggctgc

SEQ ID NO: 26099 - DNA, 22 bp, Artificial Sequence
  Synthetic
atggatccccagttgttagagg

SEQ ID NO: 26100 - DNA, 20 bp, Artificial Sequence
  Synthetic
cttgtgtgtagcccccagtt

SEQ ID NO: 26101 - DNA, 25 bp, Artificial Sequence
  Synthetic
ccttcaattggcagatctaaaacga

SEQ ID NO: 26102 - DNA, 20 bp, Artificial Sequence
  Synthetic
gccagggtgtgtaaggagtt

SEQ ID NO: 26103 - DNA, 20 bp, Artificial Sequence
  Synthetic
tgcatgttggcagttcatgg

SEQ ID NO: 26104 - DNA, 25 bp, Artificial Sequence
  Synthetic
agcaaaacaagctataatgatggcc

SEQ ID NO: 26105 - DNA, 21 bp, Artificial Sequence
  Synthetic
gacgagggggaagtcgaagga

SEQ ID NO: 26106 - DNA, 20 bp, Artificial Sequence
  Synthetic
tggcatagggacaggcaaag

SEQ ID NO: 26107 - DNA, 25 bp, Artificial Sequence
  Synthetic
gtagtggtagtaatactcctgcagt

SEQ ID NO: 26108 - DNA, 25 bp, Artificial Sequence
  Synthetic
aactagaaagaccaaggttctctga

SEQ ID NO: 26109 - DNA, 25 bp, Artificial Sequence
  Synthetic
attaccagcaataataacaccaggc

SEQ ID NO: 26110 - DNA, 24 bp, Artificial Sequence
  Synthetic
gtagtgatcgccttctaacagttg

SEQ ID NO: 26111 - DNA, 24 bp, Artificial Sequence
  Synthetic
tttcagggtagtactgatagcaga

SEQ ID NO: 26112 - DNA, 23 bp, Artificial Sequence
  Synthetic
gtttacagcacgataggtcctca

SEQ ID NO: 26113 - DNA, 25 bp, Artificial Sequence
  Synthetic
gtttactttcctactcctagtggct

SEQ ID NO: 26114 - DNA, 25 bp, Artificial Sequence
  Synthetic
attgtctcagacatctcttggaagg

SEQ ID NO: 26115 - DNA, 22 bp, Artificial Sequence
  Synthetic
gtgtgttactgactcacagggt

SEQ ID NO: 26116 - DNA, 25 bp, Artificial Sequence
  Synthetic
ggatactttagagcgccttgtacag

SEQ ID NO: 26117 - DNA, 25 bp, Artificial Sequence
  Synthetic
tagacgatgatgtggatgaagttga

SEQ ID NO: 26118 - DNA, 20 bp, Artificial Sequence
  Synthetic
gagccgagctctgaaaccaa

SEQ ID NO: 26119 - DNA, 25 bp, Artificial Sequence
  Synthetic
agcagactcatttgatctatcacaa

SEQ ID NO: 26120 - DNA, 22 bp, Artificial Sequence
  Synthetic
actgctgcagaagttggaagca

SEQ ID NO: 26121 - DNA, 24 bp, Artificial Sequence
  Synthetic
aaaagggtgtacgtattgctttgg

SEQ ID NO: 26122 - DNA, 20 bp, Artificial Sequence
  Synthetic
tgggcttggcattggaacag

SEQ ID NO: 26123 - DNA, 21 bp, Artificial Sequence
  Synthetic
tatcagaggtcacaggggttg

SEQ ID NO: 26124 - DNA, 25 bp, Artificial Sequence
  Synthetic
actcatgtgggttatacagaagaca

SEQ ID NO: 26125 - DNA, 22 bp, Artificial Sequence
  Synthetic
atgatttggcagagattgggga

SEQ ID NO: 26126 - DNA, 24 bp, Artificial Sequence
  Synthetic
cctgatggagttctggtagatgac

SEQ ID NO: 26127 - DNA, 24 bp, Artificial Sequence
  Synthetic
ttaagcacagaccaaaataccgtt

SEQ ID NO: 26128 - DNA, 25 bp, Artificial Sequence
  Synthetic
atggattaatcagtgaccaaaagga

SEQ ID NO: 26129 - DNA, 23 bp, Artificial Sequence
  Synthetic
ttgactagcagcgaatcaaacat

SEQ ID NO: 26130 - DNA, 22 bp, Artificial Sequence
  Synthetic
tctgcatttttgttaccccacc

SEQ ID NO: 26131 - DNA, 25 bp, Artificial Sequence
  Synthetic
atcactatatgtgtcagcctcattg

SEQ ID NO: 26132 - DNA, 25 bp, Artificial Sequence
  Synthetic
actcagctcccttgataataagaga

SEQ ID NO: 26133 - DNA, 25 bp, Artificial Sequence
  Synthetic
aatggacatatatcggagttgatgg

SEQ ID NO: 26134 - DNA, 20 bp, Artificial Sequence
  Synthetic
cactgaagagtgcacatgcg

SEQ ID NO: 26135 - DNA, 22 bp, Artificial Sequence
  Synthetic
ggcatcaaaggaggattcgtcc

SEQ ID NO: 26136 - DNA, 23 bp, Artificial Sequence
  Synthetic
acagccatttactgtttgatggg

SEQ ID NO: 26137 - DNA, 25 bp, Artificial Sequence
  Synthetic
aacagatatacatgtaaccgcttgc

SEQ ID NO: 26138 - DNA, 21 bp, Artificial Sequence
  Synthetic
attgacctgcaatgctacgag

SEQ ID NO: 26139 - DNA, 23 bp, Artificial Sequence
  Synthetic
gtgtcgtgaagaaattcggaatg

SEQ ID NO: 26140 - DNA, 25 bp, Artificial Sequence
  Synthetic
cggagcaagtacaaaagttaaaacg

SEQ ID NO: 26141 - DNA, 22 bp, Artificial Sequence
  Synthetic
acaatgggcctatgatagcgat

SEQ ID NO: 26142 - DNA, 22 bp, Artificial Sequence
  Synthetic
aattagagctcagtgacccaga

SEQ ID NO: 26143 - DNA, 22 bp, Artificial Sequence
  Synthetic
tggcagtatctgaaaccaaagc

SEQ ID NO: 26144 - DNA, 22 bp, Artificial Sequence
  Synthetic
gttaccttcgctgatgatgctg

SEQ ID NO: 26145 - DNA, 20 bp, Artificial Sequence
  Synthetic
caccagcaccacagcaacca

SEQ ID NO: 26146 - DNA, 22 bp, Artificial Sequence
  Synthetic
caacctccagagattccagccc

SEQ ID NO: 26147 - DNA, 24 bp, Artificial Sequence
  Synthetic
gatcctccagtaatacttttgcga

SEQ ID NO: 26148 - DNA, 22 bp, Artificial Sequence
  Synthetic
tagaggaacctacaccaccaag

SEQ ID NO: 26149 - DNA, 22 bp, Artificial Sequence
  Synthetic
gctgtagaagaacctccagaca

SEQ ID NO: 26150 - DNA, 22 bp, Artificial Sequence
  Synthetic
gatgctactattgtccaaggcc

SEQ ID NO: 26151 - DNA, 25 bp, Artificial Sequence
  Synthetic
atcctgaacgaaggaattatccaga

SEQ ID NO: 26152 - DNA, 24 bp, Artificial Sequence
  Synthetic
acattcagaggacagacatctact

SEQ ID NO: 26153 - DNA, 25 bp, Artificial Sequence
  Synthetic
acaacaggacatccattgtttaaca

SEQ ID NO: 26154 - DNA, 22 bp, Artificial Sequence
  Synthetic
attacctgcagcaagtcaacag

SEQ ID NO: 26155 - DNA, 25 bp, Artificial Sequence
  Synthetic
cagaaaaactgtctttggatttgga

SEQ ID NO: 26156 - DNA, 24 bp, Artificial Sequence
  Synthetic
tttcagtgtgattttcaatcggct

SEQ ID NO: 26157 - DNA, 25 bp, Artificial Sequence
  Synthetic
tttcctgggaaaataaaagtggtgc

SEQ ID NO: 26158 - DNA, 25 bp, Artificial Sequence
  Synthetic
gctggtacaacaattctatttctgc

SEQ ID NO: 26159 - DNA, 25 bp, Artificial Sequence
  Synthetic
attgtcaccttatagagttgacagc

SEQ ID NO: 26160 - DNA, 21 bp, Artificial Sequence
  Synthetic
tgctcttagtcctcgtttgga

SEQ ID NO: 26161 - DNA, 21 bp, Artificial Sequence
  Synthetic
atctgaacagtggacgtttgc

SEQ ID NO: 26162 - DNA, 25 bp, Artificial Sequence
  Synthetic
tgacaatgaacaaattttgcccttt

SEQ ID NO: 26163 - DNA, 21 bp, Artificial Sequence
  Synthetic
cacaccactgagcctagtttg

SEQ ID NO: 26164 - DNA, 22 bp, Artificial Sequence
  Synthetic
atcccgcctttgatgctgatgt

SEQ ID NO: 26165 - DNA, 24 bp, Artificial Sequence
  Synthetic
tctcagttcattaccaatgcttca

SEQ ID NO: 26166 - DNA, 24 bp, Artificial Sequence
  Synthetic
atacattcgcctatacaagatggc

SEQ ID NO: 26167 - DNA, 23 bp, Artificial Sequence
  Synthetic
aggatgtgaatggtgatcacaga

SEQ ID NO: 26168 - DNA, 20 bp, Artificial Sequence
  Synthetic
tcaacagaagccacctgcag

SEQ ID NO: 26169 - DNA, 23 bp, Artificial Sequence
  Synthetic
tttcagcaactattggtttccga

SEQ ID NO: 26170 - DNA, 23 bp, Artificial Sequence
  Synthetic
atgcccaagttacagaggattca

SEQ ID NO: 26171 - DNA, 24 bp, Artificial Sequence
  Synthetic
tctaacaatgcggtggttgaaaat

SEQ ID NO: 26172 - DNA, 25 bp, Artificial Sequence
  Synthetic
gaactttcaaagatggtacaatggg

SEQ ID NO: 26173 - DNA, 21 bp, Artificial Sequence
  Synthetic
cttccgcgacatggtttatcg

SEQ ID NO: 26174 - DNA, 22 bp, Artificial Sequence
  Synthetic
tggtggaggaacagtttctagg

SEQ ID NO: 26175 - DNA, 25 bp, Artificial Sequence
  Synthetic
tgagcatcctgcagtaataaatgtt

SEQ ID NO: 26176 - DNA, 22 bp, Artificial Sequence
  Synthetic
ttttacagtgagaccgaaagcg

SEQ ID NO: 26177 - DNA, 25 bp, Artificial Sequence
  Synthetic
ttaccagaacaaaatgaaaacaggg

SEQ ID NO: 26178 - DNA, 23 bp, Artificial Sequence
  Synthetic
agatgctgtttgtaaatggcctg

SEQ ID NO: 26179 - DNA, 24 bp, Artificial Sequence
  Synthetic
tcgcatataaatgtgatgaaccca

SEQ ID NO: 26180 - DNA, 22 bp, Artificial Sequence
  Synthetic
ggtcaaattccttttccccacc

SEQ ID NO: 26181 - DNA, 20 bp, Artificial Sequence
  Synthetic
cgcttttgttgctggctgtc

SEQ ID NO: 26182 - DNA, 20 bp, Artificial Sequence
  Synthetic
tagagggcattggagagggt

SEQ ID NO: 26183 - DNA, 25 bp, Artificial Sequence
  Synthetic
gctcgaagaattatcattcgtttgc

SEQ ID NO: 26184 - DNA, 23 bp, Artificial Sequence
  Synthetic
gtagtgagctgggtaaagatggc

SEQ ID NO: 26185 - DNA, 25 bp, Artificial Sequence
  Synthetic
tggtacagtgggcatatgataatga

SEQ ID NO: 26186 - DNA, 22 bp, Artificial Sequence
  Synthetic
ggcccagcagaaagttccatcc

SEQ ID NO: 26187 - DNA, 21 bp, Artificial Sequence
  Synthetic
aaaaggtcctgcaaatcccct

SEQ ID NO: 26188 - DNA, 21 bp, Artificial Sequence
  Synthetic
acgcgtattacctgaagggac

SEQ ID NO: 26189 - DNA, 23 bp, Artificial Sequence
  Synthetic
atatatctcctgcacaaccagcc

SEQ ID NO: 26190 - DNA, 20 bp, Artificial Sequence
  Synthetic
cagtgccacggctaacacaa

SEQ ID NO: 26191 - DNA, 23 bp, Artificial Sequence
  Synthetic
accttcattaggggaacattggg

SEQ ID NO: 26192 - DNA, 25 bp, Artificial Sequence
  Synthetic
tacggtgaccaggtatttttctttg

SEQ ID NO: 26193 - DNA, 22 bp, Artificial Sequence
  Synthetic
tcaaactggtttactggagcgt

SEQ ID NO: 26194 - DNA, 20 bp, Artificial Sequence
  Synthetic
atccggacctcatgccagat

SEQ ID NO: 26195 - DNA, 22 bp, Artificial Sequence
  Synthetic
tgactgactcaaacgttcttgg

SEQ ID NO: 26196 - DNA, 20 bp, Artificial Sequence
  Synthetic
gatcgccagaatgcaactga

SEQ ID NO: 26197 - DNA, 22 bp, Artificial Sequence
  Synthetic
tcagttgctcacaaatcttgcc

SEQ ID NO: 26198 - DNA, 20 bp, Artificial Sequence
  Synthetic
aaaagtatctccgcggggga

SEQ ID NO: 26199 - DNA, 22 bp, Artificial Sequence
  Synthetic
aatacggagggaaggacttcag

SEQ ID NO: 26200 - DNA, 23 bp, Artificial Sequence
  Synthetic
aatttgaaaatacaggcgagcgc

SEQ ID NO: 26201 - DNA, 23 bp, Artificial Sequence
  Synthetic
gagcaattgaacagctcagagga

SEQ ID NO: 26202 - DNA, 25 bp, Artificial Sequence
  Synthetic
aaaacgaaagtatttaggcagtccg

SEQ ID NO: 26203 - DNA, 20 bp, Artificial Sequence
  Synthetic
acgccaccacagcaaataca

SEQ ID NO: 26204 - DNA, 22 bp, Artificial Sequence
  Synthetic
aacagatgacagtgacattgca

SEQ ID NO: 26205 - DNA, 22 bp, Artificial Sequence
  Synthetic
ttttacgaggcacaccaaaaca

SEQ ID NO: 26206 - DNA, 22 bp, Artificial Sequence
  Synthetic
attgtcccgactctgtgtctag

SEQ ID NO: 26207 - DNA, 20 bp, Artificial Sequence
  Synthetic
tttgtgtgcctgtgtgtctg

SEQ ID NO: 26208 - DNA, 20 bp, Artificial Sequence
  Synthetic
gtgtactatggtcgcccacc

SEQ ID NO: 26209 - DNA, 21 bp, Artificial Sequence
  Synthetic
tccacaaactggggaggtatc

SEQ ID NO: 26210 - DNA, 22 bp, Artificial Sequence
  Synthetic
ttgtggctttacacagacctgc

SEQ ID NO: 26211 - DNA, 25 bp, Artificial Sequence
  Synthetic
aacatgttccctattttcttgcaga

SEQ ID NO: 26212 - DNA, 22 bp, Artificial Sequence
  Synthetic
ttcccaaggtgtctgcatttca

SEQ ID NO: 26213 - DNA, 25 bp, Artificial Sequence
  Synthetic
catgactatatctgcaaccacacaa

SEQ ID NO: 26214 - DNA, 24 bp, Artificial Sequence
  Synthetic
aaaagccttgctataacctgtcaa

SEQ ID NO: 26215 - DNA, 20 bp, Artificial Sequence
  Synthetic
cggcggtgattgtttgtgtc

SEQ ID NO: 26216 - DNA, 20 bp, Artificial Sequence
  Synthetic
tggttgttgcacaccactgt

SEQ ID NO: 26217 - DNA, 23 bp, Artificial Sequence
  Synthetic
tgcaaacatctgcaacacaatga

SEQ ID NO: 26218 - DNA, 20 bp, Artificial Sequence
  Synthetic
aacggccatacaagctacca

SEQ ID NO: 26219 - DNA, 25 bp, Artificial Sequence
  Synthetic
ctcagaggatgaggatgaaacagac

SEQ ID NO: 26220 - DNA, 20 bp, Artificial Sequence
  Synthetic
ggaggtgttcgggatggttt

SEQ ID NO: 26221 - DNA, 25 bp, Artificial Sequence
  Synthetic
aatggtacagtgggcatttgataat

SEQ ID NO: 26222 - DNA, 25 bp, Artificial Sequence
  Synthetic
aatgcattagatggcaatcctatgt

SEQ ID NO: 26223 - DNA, 24 bp, Artificial Sequence
  Synthetic
acaaagacgtggtcaaaactagat

SEQ ID NO: 26224 - DNA, 24 bp, Artificial Sequence
  Synthetic
tccaaagggcataatgcaattgaa

SEQ ID NO: 26225 - DNA, 25 bp, Artificial Sequence
  Synthetic
atggtagcattggggtattttttgg

SEQ ID NO: 26226 - DNA, 23 bp, Artificial Sequence
  Synthetic
aacaacatctgtggacagtacac

SEQ ID NO: 26227 - DNA, 23 bp, Artificial Sequence
  Synthetic
gctagaaaaactggcatacgtgt

SEQ ID NO: 26228 - DNA, 24 bp, Artificial Sequence
  Synthetic
gacctactgaggcaaaggtatacc

SEQ ID NO: 26229 - DNA, 20 bp, Artificial Sequence
  Synthetic
gcacaccatgtggtacccaa

SEQ ID NO: 26230 - DNA, 23 bp, Artificial Sequence
  Synthetic
aggtactgtaggcgatgctattc

SEQ ID NO: 26231 - DNA, 23 bp, Artificial Sequence
  Synthetic
aacatgttttggtctgtttgtgc

SEQ ID NO: 26232 - DNA, 24 bp, Artificial Sequence
  Synthetic
aagaacgttactgttacacatgcc

SEQ ID NO: 26233 - DNA, 21 bp, Artificial Sequence
  Synthetic
gttacccaggggatttcaacg

SEQ ID NO: 26234 - DNA, 20 bp, Artificial Sequence
  Synthetic
gatgcggcagagcagacaaa

SEQ ID NO: 26235 - DNA, 25 bp, Artificial Sequence
  Synthetic
agtgaattggaatatggtaactgca

SEQ ID NO: 26236 - DNA, 22 bp, Artificial Sequence
  Synthetic
ggtaccaccatagcaatgagca

SEQ ID NO: 26237 - DNA, 25 bp, Artificial Sequence
  Synthetic
ttcatgactcaaatgtcaagaacct

SEQ ID NO: 26238 - DNA, 25 bp, Artificial Sequence
  Synthetic
actgtcaatttattcaacagtggcg

SEQ ID NO: 26239 - DNA, 20 bp, Artificial Sequence
  Synthetic
gagaacgccagaatgccact

SEQ ID NO: 26240 - DNA, 24 bp, Artificial Sequence
  Synthetic
taaacggaaagtggatgagagaac

SEQ ID NO: 26241 - DNA, 21 bp, Artificial Sequence
  Synthetic
ggtcaggatgatcaaacgtgg

SEQ ID NO: 26242 - DNA, 24 bp, Artificial Sequence
  Synthetic
ggaagctttccactagaggagttc

SEQ ID NO: 26243 - DNA, 20 bp, Artificial Sequence
  Synthetic
cagcaggacgagcaagcttt

SEQ ID NO: 26244 - DNA, 20 bp, Artificial Sequence
  Synthetic
agttgcgtgtatcgtcccaa

SEQ ID NO: 26245 - DNA, 25 bp, Artificial Sequence
  Synthetic
ttcagttttatgctgcaaaatgtcg

SEQ ID NO: 26246 - DNA, 25 bp, Artificial Sequence
  Synthetic
agggctaatagatgatgcaacattt

SEQ ID NO: 26247 - DNA, 20 bp, Artificial Sequence
  Synthetic
accgtttcgatgctgtgcaa

SEQ ID NO: 26248 - DNA, 25 bp, Artificial Sequence
  Synthetic
acgttatggaccgctatttattacc

SEQ ID NO: 26249 - DNA, 20 bp, Artificial Sequence
  Synthetic
aagacgaggctagggatccg

SEQ ID NO: 26250 - DNA, 20 bp, Artificial Sequence
  Synthetic
gctggtgctgaggtgtttgt

SEQ ID NO: 26251 - DNA, 23 bp, Artificial Sequence
  Synthetic
gcatctgctaacattaatggcag

SEQ ID NO: 26252 - DNA, 22 bp, Artificial Sequence
  Synthetic
atttgcatccaagtcacagacg

SEQ ID NO: 26253 - DNA, 22 bp, Artificial Sequence
  Synthetic
caccccttgtaaaggtgaacac

SEQ ID NO: 26254 - DNA, 23 bp, Artificial Sequence
  Synthetic
gtccttagcatctagtgactccc

SEQ ID NO: 26255 - DNA, 25 bp, Artificial Sequence
  Synthetic
ttttgggtggttgatttatcagaca

SEQ ID NO: 26256 - DNA, 25 bp, Artificial Sequence
  Synthetic
gtattactcatgtgttttgcaacgt

SEQ ID NO: 26257 - DNA, 20 bp, Artificial Sequence
  Synthetic
cttgaagcagtagtccttct

SEQ ID NO: 26258 - DNA, 25 bp, Artificial Sequence
  Synthetic
catatctataagcaataattggctc

SEQ ID NO: 26259 - DNA, 18 bp, Artificial Sequence
  Synthetic
tccaaacatacaggggtg

SEQ ID NO: 26260 - DNA, 23 bp, Artificial Sequence
  Synthetic
aaatgtatagcttctttggactt

SEQ ID NO: 26261 - DNA, 18 bp, Artificial Sequence
  Synthetic
ccggtggtgctactagcg

SEQ ID NO: 26262 - DNA, 20 bp, Artificial Sequence
  Synthetic
gcttcagcttcaagtcttgc

SEQ ID NO: 26263 - DNA, 23 bp, Artificial Sequence
  Synthetic
ttataatgagtccaaatgtccat

SEQ ID NO: 26264 - DNA, 19 bp, Artificial Sequence
  Synthetic
ataaaattggcgggctctg

SEQ ID NO: 26265 - DNA, 22 bp, Artificial Sequence
  Synthetic
tcctagcctacttaatcgaatt

SEQ ID NO: 26266 - DNA, 25 bp, Artificial Sequence
  Synthetic
gtcaaaagactcattatatggatct

SEQ ID NO: 26267 - DNA, 21 bp, Artificial Sequence
  Synthetic
tgtaatcctcatcctgttgag

SEQ ID NO: 26268 - DNA, 23 bp, Artificial Sequence
  Synthetic
gcagccaatatggtctattaaat

SEQ ID NO: 26269 - DNA, 19 bp, Artificial Sequence
  Synthetic
ccgtaacataccggtttga

SEQ ID NO: 26270 - DNA, 18 bp, Artificial Sequence
  Synthetic
tttggcgcctttttagca

SEQ ID NO: 26271 - DNA, 22 bp, Artificial Sequence
  Synthetic
aggcagtactaattcttcaaga

SEQ ID NO: 26272 - DNA, 24 bp, Artificial Sequence
  Synthetic
ctacttgtaccttctaaactatca

SEQ ID NO: 26273 - DNA, 20 bp, Artificial Sequence
  Synthetic
agagcttattttcacagcct

SEQ ID NO: 26274 - DNA, 18 bp, Artificial Sequence
  Synthetic
cagttcctgcagtgcatc

SEQ ID NO: 26275 - DNA, 20 bp, Artificial Sequence
  Synthetic
tgtctcaggtgatgttgtgg

SEQ ID NO: 26276 - DNA, 21 bp, Artificial Sequence
  Synthetic
cgatatctccagcatttaagc

SEQ ID NO: 26277 - DNA, 18 bp, Artificial Sequence
  Synthetic
gaatgactgcagagccag

SEQ ID NO: 26278 - DNA, 18 bp, Artificial Sequence
  Synthetic
tgctaaacgtttcggtgg

SEQ ID NO: 26279 - DNA, 18 bp, Artificial Sequence
  Synthetic
atctctgaagcgggtgac

SEQ ID NO: 26280 - DNA, 19 bp, Artificial Sequence
  Synthetic
cgagtttgcattgttccac

SEQ ID NO: 26281 - DNA, 21 bp, Artificial Sequence
  Synthetic
cagatacagtttaccagttgg

SEQ ID NO: 26282 - DNA, 18 bp, Artificial Sequence
  Synthetic
gcgattcggatctggtag

SEQ ID NO: 26283 - DNA, 20 bp, Artificial Sequence
  Synthetic
acaaggctttgctatatccc

SEQ ID NO: 26284 - DNA, 18 bp, Artificial Sequence
  Synthetic
ttgttagtcccctgagca

SEQ ID NO: 26285 - DNA, 20 bp, Artificial Sequence
  Synthetic
cgggcatagagtgggttgat

SEQ ID NO: 26286 - DNA, 18 bp, Artificial Sequence
  Synthetic
tttggggatacgttggcg

SEQ ID NO: 26287 - DNA, 20 bp, Artificial Sequence
  Synthetic
tccctgttgcatagttgacc

SEQ ID NO: 26288 - DNA, 18 bp, Artificial Sequence
  Synthetic
aggtcaatatgcgtccgc

SEQ ID NO: 26289 - DNA, 17 bp, Artificial Sequence
  Synthetic
aacacaccccagtggcc

SEQ ID NO: 26290 - DNA, 18 bp, Artificial Sequence
  Synthetic
aatagggtcgctggtccg

SEQ ID NO: 26291 - DNA, 20 bp, Artificial Sequence
  Synthetic
cggatgtttcctgaagcagt

SEQ ID NO: 26292 - DNA, 20 bp, Artificial Sequence
  Synthetic
gtagataaggccggaagcgg

SEQ ID NO: 26293 - DNA, 19 bp, Artificial Sequence
  Synthetic
ctgcctcgtagatgccaag

SEQ ID NO: 26294 - DNA, 18 bp, Artificial Sequence
  Synthetic
tagcacagcagcacacac

SEQ ID NO: 26295 - DNA, 17 bp, Artificial Sequence
  Synthetic
tgtcgccacaagcagtg

SEQ ID NO: 26296 - DNA, 16 bp, Artificial Sequence
  Synthetic
gtgcccgctccgtgat

SEQ ID NO: 26297 - DNA, 18 bp, Artificial Sequence
  Synthetic
ctgctttggctacaccgc

SEQ ID NO: 26298 - DNA, 18 bp, Artificial Sequence
  Synthetic
acctgaacaacccccgtc

SEQ ID NO: 26299 - DNA, 20 bp, Artificial Sequence
  Synthetic
cccctatagtaagcaacggc

SEQ ID NO: 26300 - DNA, 18 bp, Artificial Sequence
  Synthetic
cgccactggacacgtatc

SEQ ID NO: 26301 - DNA, 18 bp, Artificial Sequence
  Synthetic
tgaacattccgccgatgg

SEQ ID NO: 26302 - DNA, 18 bp, Artificial Sequence
  Synthetic
ccgagaccacgaaagtcg

SEQ ID NO: 26303 - DNA, 18 bp, Artificial Sequence
  Synthetic
atttccacgggaggcgaa

SEQ ID NO: 26304 - DNA, 20 bp, Artificial Sequence
  Synthetic
cgcatcgatccgttcttgac

SEQ ID NO: 26305 - DNA, 18 bp, Artificial Sequence
  Synthetic
tgggttcaggggcgaatc

SEQ ID NO: 26306 - DNA, 16 bp, Artificial Sequence
  Synthetic
gtgccgtggaaaccgc

SEQ ID NO: 26307 - DNA, 20 bp, Artificial Sequence
  Synthetic
ggcaggatttacgcagaaga

SEQ ID NO: 26308 - DNA, 20 bp, Artificial Sequence
  Synthetic
ccacgtacaacctctcggta

SEQ ID NO: 26309 - DNA, 19 bp, Artificial Sequence
  Synthetic
gagtacctggtcattgccg

SEQ ID NO: 26310 - DNA, 17 bp, Artificial Sequence
  Synthetic
tgatccacgtccgcctc

SEQ ID NO: 26311 - DNA, 20 bp, Artificial Sequence
  Synthetic
taagcacctcataacgatgt

SEQ ID NO: 26312 - DNA, 21 bp, Artificial Sequence
  Synthetic
acttcttcaaccatttccatt

SEQ ID NO: 26313 - DNA, 21 bp, Artificial Sequence
  Synthetic
cacatcctgtaacatcagaaa

SEQ ID NO: 26314 - DNA, 19 bp, Artificial Sequence
  Synthetic
tattgttgtgttcagtgcc

SEQ ID NO: 26315 - DNA, 18 bp, Artificial Sequence
  Synthetic
tactgatccctcctggtg

SEQ ID NO: 26316 - DNA, 18 bp, Artificial Sequence
  Synthetic
atctcccctgtggcattt

SEQ ID NO: 26317 - DNA, 22 bp, Artificial Sequence
  Synthetic
caaatgtcctacaaagggattt

SEQ ID NO: 26318 - DNA, 18 bp, Artificial Sequence
  Synthetic
gtgggccatagcttcaag

SEQ ID NO: 26319 - DNA, 18 bp, Artificial Sequence
  Synthetic
cacagtgacattccgctc

SEQ ID NO: 26320 - DNA, 18 bp, Artificial Sequence
  Synthetic
atgtttcacgctgctgag

SEQ ID NO: 26321 - DNA, 20 bp, Artificial Sequence
  Synthetic
tctggtacaatgctctttgt

SEQ ID NO: 26322 - DNA, 22 bp, Artificial Sequence
  Synthetic
tgtatttattgctcccaaagga

SEQ ID NO: 26323 - DNA, 18 bp, Artificial Sequence
  Synthetic
ctgctgcataccctgatc

SEQ ID NO: 26324 - DNA, 21 bp, Artificial Sequence
  Synthetic
tgtgtgttatgatgtctctgg

SEQ ID NO: 26325 - DNA, 18 bp, Artificial Sequence
  Synthetic
actatctcctgtgctccg

SEQ ID NO: 26326 - DNA, 22 bp, Artificial Sequence
  Synthetic
tgtgctataccaaaatgaacaa

SEQ ID NO: 26327 - DNA, 20 bp, Artificial Sequence
  Synthetic
ttgagttgttcagcatatgc

SEQ ID NO: 26328 - DNA, 20 bp, Artificial Sequence
  Synthetic
ttcactttcctcattcctga

SEQ ID NO: 26329 - DNA, 18 bp, Artificial Sequence
  Synthetic
tttttccgggtggctagt

SEQ ID NO: 26330 - DNA, 18 bp, Artificial Sequence
  Synthetic
aaggacacattggcacat

SEQ ID NO: 26331 - DNA, 25 bp, Artificial Sequence
  Synthetic
ctactataaattgactttgtggctt

SEQ ID NO: 26332 - DNA, 24 bp, Artificial Sequence
  Synthetic
tgtctatgttgacagatattgtga

SEQ ID NO: 26333 - DNA, 21 bp, Artificial Sequence
  Synthetic
atgaatatgatggctgcaatt

SEQ ID NO: 26334 - DNA, 21 bp, Artificial Sequence
  Synthetic
tccaggttttttgtttggtat

SEQ ID NO: 26335 - DNA, 20 bp, Artificial Sequence
  Synthetic
tgtgataggtactcggatgt

SEQ ID NO: 26336 - DNA, 18 bp, Artificial Sequence
  Synthetic
gcactgcatgttgtttga

SEQ ID NO: 26337 - DNA, 22 bp, Artificial Sequence
  Synthetic
tcacaataggtaacaactgttt

SEQ ID NO: 26338 - DNA, 20 bp, Artificial Sequence
  Synthetic
actgttcattgtgtcacaaa

SEQ ID NO: 26339 - DNA, 22 bp, Artificial Sequence
  Synthetic
aaatccaatgatagatgggttg

SEQ ID NO: 26340 - DNA, 20 bp, Artificial Sequence
  Synthetic
tcttcattgtccctcagttt

SEQ ID NO: 26341 - DNA, 22 bp, Artificial Sequence
  Synthetic
cagctatcattttctctgctaa

SEQ ID NO: 26342 - DNA, 23 bp, Artificial Sequence
  Synthetic
ttctctgctttataaaagggtaa

SEQ ID NO: 26343 - DNA, 24 bp, Artificial Sequence
  Synthetic
ggctagtatcaaagtgataatttg

SEQ ID NO: 26344 - DNA, 18 bp, Artificial Sequence
  Synthetic
gtcgtcctggcaattccg

SEQ ID NO: 26345 - DNA, 20 bp, Artificial Sequence
  Synthetic
tggggataggctgacgtcta

SEQ ID NO: 26346 - DNA, 20 bp, Artificial Sequence
  Synthetic
agaaagagcaaccaggaagg

SEQ ID NO: 26347 - DNA, 18 bp, Artificial Sequence
  Synthetic
tgcgttgtggggagtttg

SEQ ID NO: 26348 - DNA, 20 bp, Artificial Sequence
  Synthetic
ccaccatggagaaatacgct

SEQ ID NO: 26349 - DNA, 19 bp, Artificial Sequence
  Synthetic
gtcttggagggtagtgcca

SEQ ID NO: 26350 - DNA, 19 bp, Artificial Sequence
  Synthetic
gaagcaatcagtggggcag

SEQ ID NO: 26351 - DNA, 20 bp, Artificial Sequence
  Synthetic
gcagggtcgtgaaagaacac

SEQ ID NO: 26352 - DNA, 18 bp, Artificial Sequence
  Synthetic
gaggccacatcccgtaga

SEQ ID NO: 26353 - DNA, 18 bp, Artificial Sequence
  Synthetic
cggctatcttccgcgcta

SEQ ID NO: 26354 - DNA, 20 bp, Artificial Sequence
  Synthetic
aagccgttgatgatgtcacc

SEQ ID NO: 26355 - DNA, 20 bp, Artificial Sequence
  Synthetic
cacaaggtcttggtccacat

SEQ ID NO: 26356 - DNA, 19 bp, Artificial Sequence
  Synthetic
ggtggagaggagttgtccg

SEQ ID NO: 26357 - DNA, 18 bp, Artificial Sequence
  Synthetic
atgtggcatccgtggagt

SEQ ID NO: 26358 - DNA, 19 bp, Artificial Sequence
  Synthetic
gacagacacgtcaagaccg

SEQ ID NO: 26359 - DNA, 19 bp, Artificial Sequence
  Synthetic
taactgtagtctcggcggg

SEQ ID NO: 26360 - DNA, 17 bp, Artificial Sequence
  Synthetic
ggtgctcgtgacgacct

SEQ ID NO: 26361 - DNA, 20 bp, Artificial Sequence
  Synthetic
agacctcgagtttctgccag

SEQ ID NO: 26362 - DNA, 18 bp, Artificial Sequence
  Synthetic
cacgaggaccttccccag

SEQ ID NO: 26363 - DNA, 17 bp, Artificial Sequence
  Synthetic
tgcagtcgcctcaggag

SEQ ID NO: 26364 - DNA, 19 bp, Artificial Sequence
  Synthetic
caggaaggggagtacaggg

SEQ ID NO: 26365 - DNA, 20 bp, Artificial Sequence
  Synthetic
agggatcagtgagcatggac

SEQ ID NO: 26366 - DNA, 19 bp, Artificial Sequence
  Synthetic
gcgaatctccgagacttcc

SEQ ID NO: 26367 - DNA, 20 bp, Artificial Sequence
  Synthetic
ggggcatggaagaataggac

SEQ ID NO: 26368 - DNA, 18 bp, Artificial Sequence
  Synthetic
ttttgacgccgctgcttt

SEQ ID NO: 26369 - DNA, 18 bp, Artificial Sequence
  Synthetic
aggagcttcccatcacgg

SEQ ID NO: 26370 - DNA, 20 bp, Artificial Sequence
  Synthetic
cagctagttgtcagtacgcc

SEQ ID NO: 26371 - DNA, 20 bp, Artificial Sequence
  Synthetic
tgtgggggcaaacatgatta

SEQ ID NO: 26372 - DNA, 18 bp, Artificial Sequence
  Synthetic
tggacagaagcctagcgc

SEQ ID NO: 26373 - DNA, 22 bp, Artificial Sequence
  Synthetic
catgaaacagacttctaagtgc

SEQ ID NO: 26374 - DNA, 21 bp, Artificial Sequence
  Synthetic
tagtatgtgtgaacttccctc

SEQ ID NO: 26375 - DNA, 20 bp, Artificial Sequence
  Synthetic
ctactttctctggtgccata

SEQ ID NO: 26376 - DNA, 23 bp, Artificial Sequence
  Synthetic
cccttcattatgtattcagtagc

SEQ ID NO: 26377 - DNA, 19 bp, Artificial Sequence
  Synthetic
gtccgtaagagcatgtctc

SEQ ID NO: 26378 - DNA, 18 bp, Artificial Sequence
  Synthetic
aaggttctgcacaccttc

SEQ ID NO: 26379 - DNA, 20 bp, Artificial Sequence
  Synthetic
tcacactgaaattcgctttc

SEQ ID NO: 26380 - DNA, 18 bp, Artificial Sequence
  Synthetic
gttctcgccattttccgt

SEQ ID NO: 26381 - DNA, 18 bp, Artificial Sequence
  Synthetic
gcacaaggaagttgcaaa

SEQ ID NO: 26382 - DNA, 20 bp, Artificial Sequence
  Synthetic
cttgtttgtcaggttgtgtt

SEQ ID NO: 26383 - DNA, 18 bp, Artificial Sequence
  Synthetic
cactgtcctccacatcct

SEQ ID NO: 26384 - DNA, 20 bp, Artificial Sequence
  Synthetic
ttgggccttatcaaacagcc

SEQ ID NO: 26385 - DNA, 21 bp, Artificial Sequence
  Synthetic
gcatttatgttggaggtcact

SEQ ID NO: 26386 - DNA, 23 bp, Artificial Sequence
  Synthetic
ccaatgttctatttggtcctcta

SEQ ID NO: 26387 - DNA, 20 bp, Artificial Sequence
  Synthetic
ctactgtttgtccacgtctt

SEQ ID NO: 26388 - DNA, 19 bp, Artificial Sequence
  Synthetic
gaaaaaatgatgctgctgc

SEQ ID NO: 26389 - DNA, 18 bp, Artificial Sequence
  Synthetic
tgtccataaaggcgggat

SEQ ID NO: 26390 - DNA, 25 bp, Artificial Sequence
  Synthetic
ataagtataactaggatgcaggtaa

SEQ ID NO: 26391 - DNA, 18 bp, Artificial Sequence
  Synthetic
acatttgttcccgcctta

SEQ ID NO: 26392 - DNA, 20 bp, Artificial Sequence
  Synthetic
gggtggtatctacaactgtt

SEQ ID NO: 26393 - DNA, 18 bp, Artificial Sequence
  Synthetic
ttgacatgcaatggcctg

SEQ ID NO: 26394 - DNA, 16 bp, Artificial Sequence
  Synthetic
gagcgccggacaaagg

SEQ ID NO: 26395 - DNA, 16 bp, Artificial Sequence
  Synthetic
agggctagcgctacgg

SEQ ID NO: 26396 - DNA, 20 bp, Artificial Sequence
  Synthetic
aacatagggaggggggattt

SEQ ID NO: 26397 - DNA, 19 bp, Artificial Sequence
  Synthetic
tgctggtgatggagggaag

SEQ ID NO: 26398 - DNA, 18 bp, Artificial Sequence
  Synthetic
gaggcgttctacgaaggc

SEQ ID NO: 26399 - DNA, 18 bp, Artificial Sequence
  Synthetic
tgacatagggggcatggc

SEQ ID NO: 26400 - DNA, 19 bp, Artificial Sequence
  Synthetic
ggaactggctgatttcggg

SEQ ID NO: 26401 - DNA, 18 bp, Artificial Sequence
  Synthetic
aggctggacaagtcaggg

SEQ ID NO: 26402 - DNA, 20 bp, Artificial Sequence
  Synthetic
tgccaggagaatgtcatcca

SEQ ID NO: 26403 - DNA, 20 bp, Artificial Sequence
  Synthetic
cgcagctgcactaatgattg

SEQ ID NO: 26404 - DNA, 20 bp, Artificial Sequence
  Synthetic
tggtttggcagagtagtcca

SEQ ID NO: 26405 - DNA, 19 bp, Artificial Sequence
  Synthetic
tgcaggacaggggtgatta

SEQ ID NO: 26406 - DNA, 22 bp, Artificial Sequence
  Synthetic
atagggttttaagaatgccatt

SEQ ID NO: 26407 - DNA, 16 bp, Artificial Sequence
  Synthetic
tccgacgggtcttggg

SEQ ID NO: 26408 - DNA, 18 bp, Artificial Sequence
  Synthetic
attagggcagggtggctg

SEQ ID NO: 26409 - DNA, 24 bp, Artificial Sequence
  Synthetic
aatattgaggtgtgaaacttcttg

SEQ ID NO: 26410 - DNA, 16 bp, Artificial Sequence
  Synthetic
tcctgccagccactcc

SEQ ID NO: 26411 - DNA, 18 bp, Artificial Sequence
  Synthetic
ttggaaggcgaggtggag

SEQ ID NO: 26412 - DNA, 16 bp, Artificial Sequence
  Synthetic
tccaggggggaaagcg

SEQ ID NO: 26413 - DNA, 20 bp, Artificial Sequence
  Synthetic
tccaaacacgtagactgggt

SEQ ID NO: 26414 - DNA, 20 bp, Artificial Sequence
  Synthetic
gaggaaggagggtggaatgt

SEQ ID NO: 26415 - DNA, 24 bp, Artificial Sequence
  Synthetic
gagatgcaaattatgaaaggaaga

SEQ ID NO: 26416 - DNA, 19 bp, Artificial Sequence
  Synthetic
acggcttgacaaacatggg

SEQ ID NO: 26417 - DNA, 19 bp, Artificial Sequence
  Synthetic
cggacgtagttcaggaggc

SEQ ID NO: 26418 - DNA, 20 bp, Artificial Sequence
  Synthetic
ttcattgccatcatccattt

SEQ ID NO: 26419 - DNA, 20 bp, Artificial Sequence
  Synthetic
ggcgtattttgacttggttt

SEQ ID NO: 26420 - DNA, 18 bp, Artificial Sequence
  Synthetic
ttgttccaccagcaactg

SEQ ID NO: 26421 - DNA, 19 bp, Artificial Sequence
  Synthetic
ctgcctaagaatgtccacc

SEQ ID NO: 26422 - DNA, 20 bp, Artificial Sequence
  Synthetic
attgactgttcgtctcttcc

SEQ ID NO: 26423 - DNA, 20 bp, Artificial Sequence
  Synthetic
cttggagtcatgtctggtaa

SEQ ID NO: 26424 - DNA, 19 bp, Artificial Sequence
  Synthetic
tcagggccattaatctccc

SEQ ID NO: 26425 - DNA, 19 bp, Artificial Sequence
  Synthetic
tctactttgctttggtggg

SEQ ID NO: 26426 - DNA, 19 bp, Artificial Sequence
  Synthetic
tgatgcttaatgctggtcc

SEQ ID NO: 26427 - DNA, 19 bp, Artificial Sequence
  Synthetic
tcacactgaagttcgcttt

SEQ ID NO: 26428 - DNA, 21 bp, Artificial Sequence
  Synthetic
tcccattctcattactgcttc

SEQ ID NO: 26429 - DNA, 20 bp, Artificial Sequence
  Synthetic
ccactttcccttttctgagt

SEQ ID NO: 26430 - DNA, 18 bp, Artificial Sequence
  Synthetic
tatggtgttggccaatgc

SEQ ID NO: 26431 - DNA, 21 bp, Artificial Sequence
  Synthetic
cgatagcccttctttttaact

SEQ ID NO: 26432 - DNA, 18 bp, Artificial Sequence
  Synthetic
catcgccaggaacattcg

SEQ ID NO: 26433 - DNA, 21 bp, Artificial Sequence
  Synthetic
gaagaggccttattttctcaa

SEQ ID NO: 26434 - DNA, 20 bp, Artificial Sequence
  Synthetic
aggtcctgtagaatctgtcc

SEQ ID NO: 26435 - DNA, 20 bp, Artificial Sequence
  Synthetic
ctcccctatggcacctatat

SEQ ID NO: 26436 - DNA, 18 bp, Artificial Sequence
  Synthetic
gaatcgtgtgcgcgaaag

SEQ ID NO: 26437 - DNA, 16 bp, Artificial Sequence
  Synthetic
tgggctggggtggttt

SEQ ID NO: 26438 - DNA, 16 bp, Artificial Sequence
  Synthetic
gttcaccgcgtcgtgc

SEQ ID NO: 26439 - DNA, 20 bp, Artificial Sequence
  Synthetic
gacggattcctgaggctaca

SEQ ID NO: 26440 - DNA, 19 bp, Artificial Sequence
  Synthetic
ggtcggaccatccacccat

SEQ ID NO: 26441 - DNA, 20 bp, Artificial Sequence
  Synthetic
gacgcgttaatcgaactttc

SEQ ID NO: 26442 - DNA, 19 bp, Artificial Sequence
  Synthetic
cggccgctgaaaaaagagt

SEQ ID NO: 26443 - DNA, 18 bp, Artificial Sequence
  Synthetic
ggtcggtccaggtcaacg

SEQ ID NO: 26444 - DNA, 20 bp, Artificial Sequence
  Synthetic
cgttatagcgccgtctttcg

SEQ ID NO: 26445 - DNA, 18 bp, Artificial Sequence
  Synthetic
ccaggctgtgggtctcgt

SEQ ID NO: 26446 - DNA, 17 bp, Artificial Sequence
  Synthetic
tacgcggtgccgttcac

SEQ ID NO: 26447 - DNA, 18 bp, Artificial Sequence
  Synthetic
cggatccgtcagccagta

SEQ ID NO: 26448 - DNA, 18 bp, Artificial Sequence
  Synthetic
tcttcctcagagacggcc

SEQ ID NO: 26449 - DNA, 17 bp, Artificial Sequence
  Synthetic
catgacgcgttcgggac

SEQ ID NO: 26450 - DNA, 20 bp, Artificial Sequence
  Synthetic
tggagcctcggtttggatac

SEQ ID NO: 26451 - DNA, 18 bp, Artificial Sequence
  Synthetic
tctcggacgagggctatg

SEQ ID NO: 26452 - DNA, 16 bp, Artificial Sequence
  Synthetic
gcagcggctcatcagg

SEQ ID NO: 26453 - DNA, 19 bp, Artificial Sequence
  Synthetic
atacgtggtgtgcacgttg

SEQ ID NO: 26454 - DNA, 15 bp, Artificial Sequence
  Synthetic
tacgcggcgacagct

SEQ ID NO: 26455 - DNA, 17 bp, Artificial Sequence
  Synthetic
tcgatgggtccgcttca

SEQ ID NO: 26456 - DNA, 19 bp, Artificial Sequence
  Synthetic
agtacgactcgtaggccgt

SEQ ID NO: 26457 - DNA, 16 bp, Artificial Sequence
  Synthetic
aatgcgggcaggcgtg

SEQ ID NO: 26458 - DNA, 17 bp, Artificial Sequence
  Synthetic
gacagttgagcgcgtcg

SEQ ID NO: 26459 - DNA, 19 bp, Artificial Sequence
  Synthetic
ggcggtgtttccagcattt

SEQ ID NO: 26460 - DNA, 20 bp, Artificial Sequence
  Synthetic
tgtgctagaccgtaccgaat

SEQ ID NO: 26461 - DNA, 17 bp, Artificial Sequence
  Synthetic
gccgatttttcgccgca

SEQ ID NO: 26462 - DNA, 19 bp, Artificial Sequence
  Synthetic
cggataatctcctgggcca

SEQ ID NO: 26463 - DNA, 18 bp, Artificial Sequence
  Synthetic
cacgctgatgtcctcggg

SEQ ID NO: 26464 - DNA, 19 bp, Artificial Sequence
  Synthetic
cgacgccatcaccgagaac

SEQ ID NO: 26465 - DNA, 19 bp, Artificial Sequence
  Synthetic
cgcccaccatgaaggattt

SEQ ID NO: 26466 - DNA, 18 bp, Artificial Sequence
  Synthetic
tccaccagctggactacg

SEQ ID NO: 26467 - DNA, 18 bp, Artificial Sequence
  Synthetic
ttcatgacgcccaagtgg

SEQ ID NO: 26468 - DNA, 18 bp, Artificial Sequence
  Synthetic
aatcgcccctcacgtcag

SEQ ID NO: 26469 - DNA, 18 bp, Artificial Sequence
  Synthetic
gcgtacgccgtgtaccac

SEQ ID NO: 26470 - DNA, 18 bp, Artificial Sequence
  Synthetic
cgaccgggatcacgacga

SEQ ID NO: 26471 - DNA, 18 bp, Artificial Sequence
  Synthetic
gtacctggtgtcgcggtc

SEQ ID NO: 26472 - DNA, 20 bp, Artificial Sequence
  Synthetic
ccgtgagtgttacttcccca

SEQ ID NO: 26473 - DNA, 16 bp, Artificial Sequence
  Synthetic
tctccatcgccagcgc

SEQ ID NO: 26474 - DNA, 20 bp, Artificial Sequence
  Synthetic
ctttgatttgagcgtgctgc

SEQ ID NO: 26475 - DNA, 17 bp, Artificial Sequence
  Synthetic
tacccaagctggccgag

SEQ ID NO: 26476 - DNA, 18 bp, Artificial Sequence
  Synthetic
cactggcagaccttggtc

SEQ ID NO: 26477 - DNA, 19 bp, Artificial Sequence
  Synthetic
ttacggtctggatctcgcg

SEQ ID NO: 26478 - DNA, 19 bp, Artificial Sequence
  Synthetic
tgtcgctgctgatctgacg

SEQ ID NO: 26479 - DNA, 16 bp, Artificial Sequence
  Synthetic
gcctggcttacgggga

SEQ ID NO: 26480 - DNA, 17 bp, Artificial Sequence
  Synthetic
cgcgccaacgagttgac

SEQ ID NO: 26481 - DNA, 17 bp, Artificial Sequence
  Synthetic
cgccacatccagcatgt

SEQ ID NO: 26482 - DNA, 20 bp, Artificial Sequence
  Synthetic
gcaactctagcattttggcg

SEQ ID NO: 26483 - DNA, 20 bp, Artificial Sequence
  Synthetic
gcgtttcctcttcctcttcg

SEQ ID NO: 26484 - DNA, 18 bp, Artificial Sequence
  Synthetic
cgttgatccgcccgtcta

SEQ ID NO: 26485 - DNA, 18 bp, Artificial Sequence
  Synthetic
acagctcgcgaagtgtct

SEQ ID NO: 26486 - DNA, 16 bp, Artificial Sequence
  Synthetic
tgcgctagcgtcacgg

SEQ ID NO: 26487 - DNA, 16 bp, Artificial Sequence
  Synthetic
acttcgcacgggcacg

SEQ ID NO: 26488 - DNA, 17 bp, Artificial Sequence
  Synthetic
ctttgcgactctgggcc

SEQ ID NO: 26489 - DNA, 18 bp, Artificial Sequence
  Synthetic
cggagtgctgacgaagtg

SEQ ID NO: 26490 - DNA, 20 bp, Artificial Sequence
  Synthetic
gaatgtcctgggctaagcag

SEQ ID NO: 26491 - DNA, 17 bp, Artificial Sequence
  Synthetic
ttgagaaacagcggcgg

SEQ ID NO: 26492 - DNA, 18 bp, Artificial Sequence
  Synthetic
gtcggacgcgattgatgg

SEQ ID NO: 26493 - DNA, 19 bp, Artificial Sequence
  Synthetic
gctccggcagtaacagtag

SEQ ID NO: 26494 - DNA, 20 bp, Artificial Sequence
  Synthetic
tacagcaaaggtacgacggt

SEQ ID NO: 26495 - DNA, 16 bp, Artificial Sequence
  Synthetic
agggggaggggcgaat

SEQ ID NO: 26496 - DNA, 17 bp, Artificial Sequence
  Synthetic
agcagcaacagtcgcag

SEQ ID NO: 26497 - DNA, 19 bp, Artificial Sequence
  Synthetic
ggattgcgaccccgaagtg

SEQ ID NO: 26498 - DNA, 18 bp, Artificial Sequence
  Synthetic
ctcatcgaccccgtgacg

SEQ ID NO: 26499 - DNA, 19 bp, Artificial Sequence
  Synthetic
catacgcaaggcatcgtgg

SEQ ID NO: 26500 - DNA, 19 bp, Artificial Sequence
  Synthetic
aacgcaggagattctggcc

SEQ ID NO: 26501 - DNA, 18 bp, Artificial Sequence
  Synthetic
aagccgtcccgaacatca

SEQ ID NO: 26502 - DNA, 20 bp, Artificial Sequence
  Synthetic
agggaaaaaaaggtggggcc

SEQ ID NO: 26503 - DNA, 16 bp, Artificial Sequence
  Synthetic
tctcacggcggcagtc

SEQ ID NO: 26504 - DNA, 17 bp, Artificial Sequence
  Synthetic
acgtctggcaccctacc

SEQ ID NO: 26505 - DNA, 19 bp, Artificial Sequence
  Synthetic
tctggatgaccgtatgggc

SEQ ID NO: 26506 - DNA, 16 bp, Artificial Sequence
  Synthetic
accgctgcccgtctac

SEQ ID NO: 26507 - DNA, 18 bp, Artificial Sequence
  Synthetic
acgtctacctggcctacc

SEQ ID NO: 26508 - DNA, 16 bp, Artificial Sequence
  Synthetic
cgggtgacggcgacat

SEQ ID NO: 26509 - DNA, 16 bp, Artificial Sequence
  Synthetic
acaggcggttgagcgc

SEQ ID NO: 26510 - DNA, 16 bp, Artificial Sequence
  Synthetic
gccttcccaagcggca

SEQ ID NO: 26511 - DNA, 16 bp, Artificial Sequence
  Synthetic
atcgtcccgtagcccg

SEQ ID NO: 26512 - DNA, 16 bp, Artificial Sequence
  Synthetic
agcctgcgactgctgc

SEQ ID NO: 26513 - DNA, 20 bp, Artificial Sequence
  Synthetic
gtcgtcgtggttgatgttga

SEQ ID NO: 26514 - DNA, 18 bp, Artificial Sequence
  Synthetic
ctgccacggtagcacctg

SEQ ID NO: 26515 - DNA, 17 bp, Artificial Sequence
  Synthetic
ataccgcccggagagtc

SEQ ID NO: 26516 - DNA, 20 bp, Artificial Sequence
  Synthetic
gcctgggaaactcaagtctt

SEQ ID NO: 26517 - DNA, 19 bp, Artificial Sequence
  Synthetic
atgtttgccggcttcgagg

SEQ ID NO: 26518 - DNA, 18 bp, Artificial Sequence
  Synthetic
tcccgggcgtctccatag

SEQ ID NO: 26519 - DNA, 19 bp, Artificial Sequence
  Synthetic
taaacatcaagggccgctg

SEQ ID NO: 26520 - DNA, 17 bp, Artificial Sequence
  Synthetic
actgccaggtgcttcgg

SEQ ID NO: 26521 - DNA, 16 bp, Artificial Sequence
  Synthetic
ggccgagcgcaaacac

SEQ ID NO: 26522 - DNA, 19 bp, Artificial Sequence
  Synthetic
acaatcagctgcaggtgca

SEQ ID NO: 26523 - DNA, 20 bp, Artificial Sequence
  Synthetic
acgcaccaagtcaaatccac

SEQ ID NO: 26524 - DNA, 17 bp, Artificial Sequence
  Synthetic
ggtgcgacgacccttct

SEQ ID NO: 26525 - DNA, 19 bp, Artificial Sequence
  Synthetic
tgataccgcggaatcaacg

SEQ ID NO: 26526 - DNA, 20 bp, Artificial Sequence
  Synthetic
tgatcgacatgaagaccgcc

SEQ ID NO: 26527 - DNA, 18 bp, Artificial Sequence
  Synthetic
gccctggatcgtacccat

SEQ ID NO: 26528 - DNA, 19 bp, Artificial Sequence
  Synthetic
acctcaagacgctgctagt

SEQ ID NO: 26529 - DNA, 18 bp, Artificial Sequence
  Synthetic
ggtaacgcgcatctcagc

SEQ ID NO: 26530 - DNA, 16 bp, Artificial Sequence
  Synthetic
tgtgccacccggtgct

SEQ ID NO: 26531 - DNA, 17 bp, Artificial Sequence
  Synthetic
tgctttccccgagctcc

SEQ ID NO: 26532 - DNA, 20 bp, Artificial Sequence
  Synthetic
gtaccagatgttcaccgtgg

SEQ ID NO: 26533 - DNA, 19 bp, Artificial Sequence
  Synthetic
agaggctcggcaattctcg

SEQ ID NO: 26534 - DNA, 17 bp, Artificial Sequence
  Synthetic
acgtcgaacgcgatcgg

SEQ ID NO: 26535 - DNA, 19 bp, Artificial Sequence
  Synthetic
gtgttcctgataggcccgg

SEQ ID NO: 26536 - DNA, 16 bp, Artificial Sequence
  Synthetic
acaccaaccaggcggc

SEQ ID NO: 26537 - DNA, 20 bp, Artificial Sequence
  Synthetic
tcaacgtggtctcttacgtg

SEQ ID NO: 26538 - DNA, 17 bp, Artificial Sequence
  Synthetic
agttttgggggcggagg

SEQ ID NO: 26539 - DNA, 17 bp, Artificial Sequence
  Synthetic
cttggatcacgtcggcg

SEQ ID NO: 26540 - DNA, 18 bp, Artificial Sequence
  Synthetic
ccacctcctgcatctcca

SEQ ID NO: 26541 - DNA, 19 bp, Artificial Sequence
  Synthetic
ttcaggtggatcctccgtc

SEQ ID NO: 26542 - DNA, 16 bp, Artificial Sequence
  Synthetic
acgtcgaaaccccggc

SEQ ID NO: 26543 - DNA, 18 bp, Artificial Sequence
  Synthetic
gcaagccgtggtaaccgt

SEQ ID NO: 26544 - DNA, 16 bp, Artificial Sequence
  Synthetic
agcgccgacaactccg

SEQ ID NO: 26545 - DNA, 18 bp, Artificial Sequence
  Synthetic
cgtagctcatttgcgccg

SEQ ID NO: 26546 - DNA, 16 bp, Artificial Sequence
  Synthetic
ttttccccgccggtgg

SEQ ID NO: 26547 - DNA, 17 bp, Artificial Sequence
  Synthetic
agccactaccgcagagc

SEQ ID NO: 26548 - DNA, 17 bp, Artificial Sequence
  Synthetic
tcagagacgcgttccgc

SEQ ID NO: 26549 - DNA, 17 bp, Artificial Sequence
  Synthetic
cagacgcagacaggtgc

SEQ ID NO: 26550 - DNA, 20 bp, Artificial Sequence
  Synthetic
ccgttgccgtagaagaagtt

SEQ ID NO: 26551 - DNA, 18 bp, Artificial Sequence
  Synthetic
tttctgggctactccgcc

SEQ ID NO: 26552 - DNA, 20 bp, Artificial Sequence
  Synthetic
gctggaggtccatacggatt

SEQ ID NO: 26553 - DNA, 18 bp, Artificial Sequence
  Synthetic
aagctgctgttcaccacg

SEQ ID NO: 26554 - DNA, 20 bp, Artificial Sequence
  Synthetic
acgctctttgacaccatcac

SEQ ID NO: 26555 - DNA, 16 bp, Artificial Sequence
  Synthetic
agaggtcctcgcaggc

SEQ ID NO: 26556 - DNA, 16 bp, Artificial Sequence
  Synthetic
ggtctgcgtgggcgaa

SEQ ID NO: 26557 - DNA, 20 bp, Artificial Sequence
  Synthetic
gtgtgatccatgagttcggc

SEQ ID NO: 26558 - DNA, 20 bp, Artificial Sequence
  Synthetic
ggcgattgtaggtaacgagc

SEQ ID NO: 26559 - DNA, 16 bp, Artificial Sequence
  Synthetic
tgcaccacctcggggt

SEQ ID NO: 26560 - DNA, 20 bp, Artificial Sequence
  Synthetic
gactcttggcgatggtcatg

SEQ ID NO: 26561 - DNA, 16 bp, Artificial Sequence
  Synthetic
ttgcctggacgcctgg

SEQ ID NO: 26562 - DNA, 20 bp, Artificial Sequence
  Synthetic
cctgctgtacaacaatccgg

SEQ ID NO: 26563 - DNA, 18 bp, Artificial Sequence
  Synthetic
ctctcatcgtgccgcaga

SEQ ID NO: 26564 - DNA, 19 bp, Artificial Sequence
  Synthetic
tgcttactgtgtgaagcgg

SEQ ID NO: 26565 - DNA, 16 bp, Artificial Sequence
  Synthetic
acgccacaggccgtag

SEQ ID NO: 26566 - DNA, 18 bp, Artificial Sequence
  Synthetic
aggtgacgcgacctcctg

SEQ ID NO: 26567 - DNA, 19 bp, Artificial Sequence
  Synthetic
gctacggctgctgatacga

SEQ ID NO: 26568 - DNA, 16 bp, Artificial Sequence
  Synthetic
cgctcggcagctcctt

SEQ ID NO: 26569 - DNA, 18 bp, Artificial Sequence
  Synthetic
ctacggaccgtctgtcga

SEQ ID NO: 26570 - DNA, 24 bp, Artificial Sequence
  Synthetic
ttgtctctctttatctttcttgtg

SEQ ID NO: 26571 - DNA, 21 bp, Artificial Sequence
  Synthetic
caagtcatgattcgtaactgc

SEQ ID NO: 26572 - DNA, 20 bp, Artificial Sequence
  Synthetic
cgcttcgtaattctgacgca

SEQ ID NO: 26573 - DNA, 19 bp, Artificial Sequence
  Synthetic
aagatgtgggccgagaact

SEQ ID NO: 26574 - DNA, 16 bp, Artificial Sequence
  Synthetic
aagccgccgttcaagc

SEQ ID NO: 26575 - DNA, 18 bp, Artificial Sequence
  Synthetic
tggtggacgagacgagac

SEQ ID NO: 26576 - DNA, 17 bp, Artificial Sequence
  Synthetic
aaacccaagccggtcgg

SEQ ID NO: 26577 - DNA, 16 bp, Artificial Sequence
  Synthetic
tacgctagcggggctg

SEQ ID NO: 26578 - DNA, 20 bp, Artificial Sequence
  Synthetic
taacgtgggtttcaggggaa

SEQ ID NO: 26579 - DNA, 17 bp, Artificial Sequence
  Synthetic
actgcagaccgtacggg

SEQ ID NO: 26580 - DNA, 16 bp, Artificial Sequence
  Synthetic
ttctgcaccgccgacg

SEQ ID NO: 26581 - DNA, 18 bp, Artificial Sequence
  Synthetic
acccagcactccatcgac

SEQ ID NO: 26582 - DNA, 18 bp, Artificial Sequence
  Synthetic
catacgccacagcatgcg

SEQ ID NO: 26583 - DNA, 15 bp, Artificial Sequence
  Synthetic
tgtgcactgccgcga

SEQ ID NO: 26584 - DNA, 18 bp, Artificial Sequence
  Synthetic
aggccgtggaaaaccacc

SEQ ID NO: 26585 - DNA, 18 bp, Artificial Sequence
  Synthetic
caggcatgggtctgtcga

SEQ ID NO: 26586 - DNA, 18 bp, Artificial Sequence
  Synthetic
gagactggcagggacacg

SEQ ID NO: 26587 - DNA, 18 bp, Artificial Sequence
  Synthetic
ctggccgtcctgttcctg

SEQ ID NO: 26588 - DNA, 16 bp, Artificial Sequence
  Synthetic
accgttgacgtgggcg

SEQ ID NO: 26589 - DNA, 18 bp, Artificial Sequence
  Synthetic
gcgacagacatccccctg

SEQ ID NO: 26590 - DNA, 20 bp, Artificial Sequence
  Synthetic
gttcagtgttggatcagact

SEQ ID NO: 26591 - DNA, 16 bp, Artificial Sequence
  Synthetic
ctcgcgggtttgggga

SEQ ID NO: 26592 - DNA, 16 bp, Artificial Sequence
  Synthetic
gaaggcaccgcgacag

SEQ ID NO: 26593 - DNA, 16 bp, Artificial Sequence
  Synthetic
accccagcaacggcct

SEQ ID NO: 26594 - DNA, 20 bp, Artificial Sequence
  Synthetic
gattgctgacgctggaaacc

SEQ ID NO: 26595 - DNA, 17 bp, Artificial Sequence
  Synthetic
cagagaacgcagcgcac

SEQ ID NO: 26596 - DNA, 18 bp, Artificial Sequence
  Synthetic
tcctcctggtgcctgtgg

SEQ ID NO: 26597 - DNA, 17 bp, Artificial Sequence
  Synthetic
gggccgcccaaacatct

SEQ ID NO: 26598 - DNA, 20 bp, Artificial Sequence
  Synthetic
cccttgagtttgatggtgcc

SEQ ID NO: 26599 - DNA, 17 bp, Artificial Sequence
  Synthetic
cgggactttgacagccg

SEQ ID NO: 26600 - DNA, 18 bp, Artificial Sequence
  Synthetic
tctcctttacggggctgg

SEQ ID NO: 26601 - DNA, 17 bp, Artificial Sequence
  Synthetic
gggcctgaagcgatgga

SEQ ID NO: 26602 - DNA, 17 bp, Artificial Sequence
  Synthetic
tacgatcctccggcgct

SEQ ID NO: 26603 - DNA, 17 bp, Artificial Sequence
  Synthetic
caggctggaacgcaacg

SEQ ID NO: 26604 - DNA, 19 bp, Artificial Sequence
  Synthetic
ccacagacgccgtttgcta

SEQ ID NO: 26605 - DNA, 19 bp, Artificial Sequence
  Synthetic
ttgagtgccagtacagcgc

SEQ ID NO: 26606 - DNA, 16 bp, Artificial Sequence
  Synthetic
gtgacgccggttgtcc

SEQ ID NO: 26607 - DNA, 19 bp, Artificial Sequence
  Synthetic
tttcctgtgcaccgtcatc

SEQ ID NO: 26608 - DNA, 19 bp, Artificial Sequence
  Synthetic
tggatgattttgcgcgaca

SEQ ID NO: 26609 - DNA, 19 bp, Artificial Sequence
  Synthetic
gaagatcgtcctctcgccg

SEQ ID NO: 26610 - DNA, 20 bp, Artificial Sequence
  Synthetic
ccgacaggtaagatgtggct

SEQ ID NO: 26611 - DNA, 16 bp, Artificial Sequence
  Synthetic
tcctccgggttcctgc

SEQ ID NO: 26612 - DNA, 19 bp, Artificial Sequence
  Synthetic
gcagcacacgcaactagtc

SEQ ID NO: 26613 - DNA, 25 bp, Artificial Sequence
  Synthetic
caatgaaatggaagtctgaatacat

SEQ ID NO: 26614 - DNA, 23 bp, Artificial Sequence
  Synthetic
tcggattttatcttgttagcttt

SEQ ID NO: 26615 - DNA, 19 bp, Artificial Sequence
  Synthetic
aaggctggagaagttaggt

SEQ ID NO: 26616 - DNA, 19 bp, Artificial Sequence
  Synthetic
tgctatcgatctgagctct

SEQ ID NO: 26617 - DNA, 18 bp, Artificial Sequence
  Synthetic
catccatggctgcacaag

SEQ ID NO: 26618 - DNA, 21 bp, Artificial Sequence
  Synthetic
cctacttcaagaacacagtac

SEQ ID NO: 26619 - DNA, 18 bp, Artificial Sequence
  Synthetic
aaggttctgcacaccttc

SEQ ID NO: 26620 - DNA, 20 bp, Artificial Sequence
  Synthetic
gaatcagcctcccttcattg

SEQ ID NO: 26621 - DNA, 20 bp, Artificial Sequence
  Synthetic
atgccatatcatcagatggg

SEQ ID NO: 26622 - DNA, 18 bp, Artificial Sequence
  Synthetic
gtgctgctgtttggaatt

SEQ ID NO: 26623 - DNA, 25 bp, Artificial Sequence
  Synthetic
ttcttatagcccaatatctacttct

SEQ ID NO: 26624 - DNA, 18 bp, Artificial Sequence
  Synthetic
gaggctcagagttcactc

SEQ ID NO: 26625 - DNA, 21 bp, Artificial Sequence
  Synthetic
tcgtaaagagacggaacataa

SEQ ID NO: 26626 - DNA, 18 bp, Artificial Sequence
  Synthetic
gttccctatcagcggcag

SEQ ID NO: 26627 - DNA, 19 bp, Artificial Sequence
  Synthetic
caggtgctcaaagtccatt

SEQ ID NO: 26628 - DNA, 20 bp, Artificial Sequence
  Synthetic
tcaccctatttaccaccttg

SEQ ID NO: 26629 - DNA, 20 bp, Artificial Sequence
  Synthetic
tttacttctccaccaccgca

SEQ ID NO: 26630 - DNA, 21 bp, Artificial Sequence
  Synthetic
tgcattcgacatctaaaagca

SEQ ID NO: 26631 - DNA, 20 bp, Artificial Sequence
  Synthetic
caaaacgtcgcatagtttga

SEQ ID NO: 26632 - DNA, 18 bp, Artificial Sequence
  Synthetic
tagcacaatgggacgaag

SEQ ID NO: 26633 - DNA, 20 bp, Artificial Sequence
  Synthetic
agcattcgaagccaagtgat

SEQ ID NO: 26634 - DNA, 19 bp, Artificial Sequence
  Synthetic
cactaacccggaacatgaa

SEQ ID NO: 26635 - DNA, 19 bp, Artificial Sequence
  Synthetic
tttccatgcctttccttct

SEQ ID NO: 26636 - DNA, 19 bp, Artificial Sequence
  Synthetic
cgcgtccgacaaatgatga

SEQ ID NO: 26637 - DNA, 20 bp, Artificial Sequence
  Synthetic
ggacaaaaccctcgtccatt

SEQ ID NO: 26638 - DNA, 19 bp, Artificial Sequence
  Synthetic
agttattgtggcgcagatg

SEQ ID NO: 26639 - DNA, 18 bp, Artificial Sequence
  Synthetic
aacgatcggtacccttcc

SEQ ID NO: 26640 - DNA, 22 bp, Artificial Sequence
  Synthetic
tgatcaaatggaagaaagccta

SEQ ID NO: 26641 - DNA, 20 bp, Artificial Sequence
  Synthetic
cggtgaagtagttaccagcg

SEQ ID NO: 26642 - DNA, 19 bp, Artificial Sequence
  Synthetic
gcgccttcacatgagctat

SEQ ID NO: 26643 - DNA, 19 bp, Artificial Sequence
  Synthetic
ttaagaaaggctgcacaag

SEQ ID NO: 26644 - DNA, 24 bp, Artificial Sequence
  Synthetic
gagttgtatatagtaggacacaat

SEQ ID NO: 26645 - DNA, 20 bp, Artificial Sequence
  Synthetic
tcttgtcaaacatgccttac

SEQ ID NO: 26646 - DNA, 18 bp, Artificial Sequence
  Synthetic
ctgctttctggtgcgagg

SEQ ID NO: 26647 - DNA, 20 bp, Artificial Sequence
  Synthetic
gcggacatgcttttctctct

SEQ ID NO: 26648 - DNA, 16 bp, Artificial Sequence
  Synthetic
tcccctgccagagcgt

SEQ ID NO: 26649 - DNA, 21 bp, Artificial Sequence
  Synthetic
ggaacgaaattggactaaacg

SEQ ID NO: 26650 - DNA, 19 bp, Artificial Sequence
  Synthetic
gcaacgcctcatttcccat

SEQ ID NO: 26651 - DNA, 18 bp, Artificial Sequence
  Synthetic
gcctgcgaattcaacaag

SEQ ID NO: 26652 - DNA, 19 bp, Artificial Sequence
  Synthetic
acacagaaactgtacagcc

SEQ ID NO: 26653 - DNA, 20 bp, Artificial Sequence
  Synthetic
cgtggcaactattgaacgct

SEQ ID NO: 26654 - DNA, 20 bp, Artificial Sequence
  Synthetic
aagactcctctccgtgtctg

SEQ ID NO: 26655 - DNA, 15 bp, Artificial Sequence
  Synthetic
aaatccgcggcgcag

SEQ ID NO: 26656 - DNA, 23 bp, Artificial Sequence
  Synthetic
cattgtctctactatgttgaact

SEQ ID NO: 26657 - DNA, 16 bp, Artificial Sequence
  Synthetic
gccggtcgctgcatct

SEQ ID NO: 26658 - DNA, 18 bp, Artificial Sequence
  Synthetic
ctgttatagcgtgccacg

SEQ ID NO: 26659 - DNA, 24 bp, Artificial Sequence
  Synthetic
cttgcaaatttttaaaagcctgag

SEQ ID NO: 26660 - DNA, 20 bp, Artificial Sequence
  Synthetic
gactgtccgtaacatcatcc

SEQ ID NO: 26661 - DNA, 20 bp, Artificial Sequence
  Synthetic
agcaaatgggtttcctgacc

SEQ ID NO: 26662 - DNA, 18 bp, Artificial Sequence
  Synthetic
atggtttggccttcgttg

SEQ ID NO: 26663 - DNA, 18 bp, Artificial Sequence
  Synthetic
aaaatcaaccccgcaacc

SEQ ID NO: 26664 - DNA, 18 bp, Artificial Sequence
  Synthetic
gtccatgaccgaactcct

SEQ ID NO: 26665 - DNA, 18 bp, Artificial Sequence
  Synthetic
cgtctacagtggtgcgac

SEQ ID NO: 26666 - DNA, 19 bp, Artificial Sequence
  Synthetic
tcgcgcacccagtatacat

SEQ ID NO: 26667 - DNA, 20 bp, Artificial Sequence
  Synthetic
ccgggagaaaaaaccactgt

SEQ ID NO: 26668 - DNA, 24 bp, Artificial Sequence
  Synthetic
cttttttatcggacgtacttttac

SEQ ID NO: 26669 - DNA, 20 bp, Artificial Sequence
  Synthetic
ttgtacaacgcgacgtactg

SEQ ID NO: 26670 - DNA, 20 bp, Artificial Sequence
  Synthetic
ggttctgttgtgtgcgttac

SEQ ID NO: 26671 - DNA, 18 bp, Artificial Sequence
  Synthetic
actccgaggcatcctgac

SEQ ID NO: 26672 - DNA, 20 bp, Artificial Sequence
  Synthetic
ttgtgaagcattaggagcgc

SEQ ID NO: 26673 - DNA, 20 bp, Artificial Sequence
  Synthetic
gcttaaacacaagatgcgtg

SEQ ID NO: 26674 - DNA, 19 bp, Artificial Sequence
  Synthetic
cctactgcgctaagaggaa

SEQ ID NO: 26675 - DNA, 22 bp, Artificial Sequence
  Synthetic
cgatattgacataggtatccac

SEQ ID NO: 26676 - DNA, 19 bp, Artificial Sequence
  Synthetic
tgtgccatgggaaaaaagt

SEQ ID NO: 26677 - DNA, 20 bp, Artificial Sequence
  Synthetic
ttcatttggggttagcaaac

SEQ ID NO: 26678 - DNA, 19 bp, Artificial Sequence
  Synthetic
cacagctgtttggcctata

SEQ ID NO: 26679 - DNA, 18 bp, Artificial Sequence
  Synthetic
gtgtacgcccccagtttc

SEQ ID NO: 26680 - DNA, 20 bp, Artificial Sequence
  Synthetic
cctgaggactttgtagcata

SEQ ID NO: 26681 - DNA, 20 bp, Artificial Sequence
  Synthetic
ggccctaattgcgacttcaa

SEQ ID NO: 26682 - DNA, 22 bp, Artificial Sequence
  Synthetic
ggaataattctttctccggaaa

SEQ ID NO: 26683 - DNA, 18 bp, Artificial Sequence
  Synthetic
tcaggagctcatgggacg

SEQ ID NO: 26684 - DNA, 18 bp, Artificial Sequence
  Synthetic
aaatggaaaccaggcagg

SEQ ID NO: 26685 - DNA, 20 bp, Artificial Sequence
  Synthetic
tgctttgtcgctgtagatgt

SEQ ID NO: 26686 - DNA, 25 bp, Artificial Sequence
  Synthetic
gacctaaaccttcaaaaattttagg

SEQ ID NO: 26687 - DNA, 20 bp, Artificial Sequence
  Synthetic
cgctgttgtagttcgttgga

SEQ ID NO: 26688 - DNA, 18 bp, Artificial Sequence
  Synthetic
tgtccgttcgtcaaaacc

SEQ ID NO: 26689 - DNA, 18 bp, Artificial Sequence
  Synthetic
ggttcaaatttgcgcagg

SEQ ID NO: 26690 - DNA, 19 bp, Artificial Sequence
  Synthetic
ctgcctgactctcccaaga

SEQ ID NO: 26691 - DNA, 20 bp, Artificial Sequence
  Synthetic
gaatcgccactccatcatgg

SEQ ID NO: 26692 - DNA, 23 bp, Artificial Sequence
  Synthetic
agtatttattgaacagagcttct

SEQ ID NO: 26693 - DNA, 20 bp, Artificial Sequence
  Synthetic
cgaggcaaaagtacagtggt

SEQ ID NO: 26694 - DNA, 18 bp, Artificial Sequence
  Synthetic
cttcttcaggcggtacag

SEQ ID NO: 26695 - DNA, 18 bp, Artificial Sequence
  Synthetic
gaaggagaaactgcctcg

SEQ ID NO: 26696 - DNA, 19 bp, Artificial Sequence
  Synthetic
agggttacattatggccag

SEQ ID NO: 26697 - DNA, 23 bp, Artificial Sequence
  Synthetic
agcttttagtaatacctgaaaca

SEQ ID NO: 26698 - DNA, 18 bp, Artificial Sequence
  Synthetic
atcaaggtcactgactgc

SEQ ID NO: 26699 - DNA, 18 bp, Artificial Sequence
  Synthetic
aacaacagaaggaggacg

SEQ ID NO: 26700 - DNA, 18 bp, Artificial Sequence
  Synthetic
aataggtaccgagcccac

SEQ ID NO: 26701 - DNA, 18 bp, Artificial Sequence
  Synthetic
catactgggttctgctgc

SEQ ID NO: 26702 - DNA, 20 bp, Artificial Sequence
  Synthetic
tcttgtgttaagtgtgaggg

SEQ ID NO: 26703 - DNA, 20 bp, Artificial Sequence
  Synthetic
gacaaggctaaggaaccgtt

SEQ ID NO: 26704 - DNA, 21 bp, Artificial Sequence
  Synthetic
agttgttaagttccagtttgt

SEQ ID NO: 26705 - DNA, 23 bp, Artificial Sequence
  Synthetic
taacagtattggtagacactgat

SEQ ID NO: 26706 - DNA, 18 bp, Artificial Sequence
  Synthetic
tacaaagggggaaaggga

SEQ ID NO: 26707 - DNA, 23 bp, Artificial Sequence
  Synthetic
taattatgcatcatcgagcaatt

SEQ ID NO: 26708 - DNA, 18 bp, Artificial Sequence
  Synthetic
tacatggtcatgagcggt

SEQ ID NO: 26709 - DNA, 18 bp, Artificial Sequence
  Synthetic
cagacggtatcgctacag

SEQ ID NO: 26710 - DNA, 23 bp, Artificial Sequence
  Synthetic
ttgaacatttggaaaatcgctta

SEQ ID NO: 26711 - DNA, 21 bp, Artificial Sequence
  Synthetic
ttgtgcaagttgtatgttctg

SEQ ID NO: 26712 - DNA, 18 bp, Artificial Sequence
  Synthetic
cgtgttttgcgatgttcg

SEQ ID NO: 26713 - DNA, 19 bp, Artificial Sequence
  Synthetic
tctggtaaggcattatggc

SEQ ID NO: 26714 - DNA, 20 bp, Artificial Sequence
  Synthetic
acatctagcctcatctgcca

SEQ ID NO: 26715 - DNA, 19 bp, Artificial Sequence
  Synthetic
cacagcgtcttgggttgtt

SEQ ID NO: 26716 - DNA, 20 bp, Artificial Sequence
  Synthetic
atgggtgtgctcatagctca

SEQ ID NO: 26717 - DNA, 18 bp, Artificial Sequence
  Synthetic
tggtggggtgaaatcctg

SEQ ID NO: 26718 - DNA, 18 bp, Artificial Sequence
  Synthetic
ccattatagcccctgtgg

SEQ ID NO: 26719 - DNA, 23 bp, Artificial Sequence
  Synthetic
tcaaatctaacataggtgaacaa

SEQ ID NO: 26720 - DNA, 22 bp, Artificial Sequence
  Synthetic
tgttaaggaaatgttttggctc

SEQ ID NO: 26721 - DNA, 21 bp, Artificial Sequence
  Synthetic
tgagctgtagtttctcaagtc

SEQ ID NO: 26722 - DNA, 18 bp, Artificial Sequence
  Synthetic
taatgtgtccgacttgcg

SEQ ID NO: 26723 - DNA, 20 bp, Artificial Sequence
  Synthetic
ctctgcccttatcttcaaga

SEQ ID NO: 26724 - DNA, 20 bp, Artificial Sequence
  Synthetic
catccctctttctcacagaa

SEQ ID NO: 26725 - DNA, 22 bp, Artificial Sequence
  Synthetic
ggtagtctggtatgaatcttct

SEQ ID NO: 26726 - DNA, 19 bp, Artificial Sequence
  Synthetic
cttggacaaaacagctgtt

SEQ ID NO: 26727 - DNA, 20 bp, Artificial Sequence
  Synthetic
atcacaccctatagctgaac

SEQ ID NO: 26728 - DNA, 21 bp, Artificial Sequence
  Synthetic
gcattatcccagttgactttc

SEQ ID NO: 26729 - DNA, 21 bp, Artificial Sequence
  Synthetic
agatcgacagtatgagaacaa

SEQ ID NO: 26730 - DNA, 23 bp, Artificial Sequence
  Synthetic
gcagcatacaatgtaattcttac

SEQ ID NO: 26731 - DNA, 23 bp, Artificial Sequence
  Synthetic
gttagaaatgtttgaatcgtcat

SEQ ID NO: 26732 - DNA, 22 bp, Artificial Sequence
  Synthetic
gaattttcagcttcatcttcga

SEQ ID NO: 26733 - DNA, 20 bp, Artificial Sequence
  Synthetic
gttgctgcttgatgacttac

SEQ ID NO: 26734 - DNA, 25 bp, Artificial Sequence
  Synthetic
gcattttcttttctgatattttccc

SEQ ID NO: 26735 - DNA, 18 bp, Artificial Sequence
  Synthetic
gtcgaaggaggaggagta

SEQ ID NO: 26736 - DNA, 19 bp, Artificial Sequence
  Synthetic
ttcggtctctcctcctcct

SEQ ID NO: 26737 - DNA, 22 bp, Artificial Sequence
  Synthetic
gtcagtgctatcaaatgcaata

SEQ ID NO: 26738 - DNA, 20 bp, Artificial Sequence
  Synthetic
ggattatacccagttgaccc

SEQ ID NO: 26739 - DNA, 24 bp, Artificial Sequence
  Synthetic
ctcttgtatctccactatctactg

SEQ ID NO: 26740 - DNA, 24 bp, Artificial Sequence
  Synthetic
acaaatacattcagatcagatgac

SEQ ID NO: 26741 - DNA, 18 bp, Artificial Sequence
  Synthetic
gcatcaaaggcgggattt

SEQ ID NO: 26742 - DNA, 24 bp, Artificial Sequence
  Synthetic
gataattcaatagcatcagcagta

SEQ ID NO: 26743 - DNA, 20 bp, Artificial Sequence
  Synthetic
gtagtacctataccaagcgg

SEQ ID NO: 26744 - DNA, 18 bp, Artificial Sequence
  Synthetic
tggtagagcatctcccat

SEQ ID NO: 26745 - DNA, 21 bp, Artificial Sequence
  Synthetic
tcaacaacccaaaaagacaaa

SEQ ID NO: 26746 - DNA, 23 bp, Artificial Sequence
  Synthetic
ggaaatttgaagaggatatgtcc

SEQ ID NO: 26747 - DNA, 16 bp, Artificial Sequence
  Synthetic
actgctgccgtgcgac

SEQ ID NO: 26748 - DNA, 21 bp, Artificial Sequence
  Synthetic
cttactgaacgacatcgaaat

SEQ ID NO: 26749 - DNA, 20 bp, Artificial Sequence
  Synthetic
actacattaacggtctccat

SEQ ID NO: 26750 - DNA, 16 bp, Artificial Sequence
  Synthetic
cgtcgcgcgaattcgg

SEQ ID NO: 26751 - DNA, 24 bp, Artificial Sequence
  Synthetic
gttcttgagtagtcatatgttctt

SEQ ID NO: 26752 - DNA, 19 bp, Artificial Sequence
  Synthetic
gtcttccttccgtaagtct

SEQ ID NO: 26753 - DNA, 20 bp, Artificial Sequence
  Synthetic
tgttggcattcattccattt

SEQ ID NO: 26754 - DNA, 21 bp, Artificial Sequence
  Synthetic
tcgctctaaattcttggagac

SEQ ID NO: 26755 - DNA, 19 bp, Artificial Sequence
  Synthetic
tttcttctatggcctctcc

SEQ ID NO: 26756 - DNA, 22 bp, Artificial Sequence
  Synthetic
gcaaaacacacaattaatttgc

SEQ ID NO: 26757 - DNA, 19 bp, Artificial Sequence
  Synthetic
tttctacttcacacagcgg

SEQ ID NO: 26758 - DNA, 22 bp, Artificial Sequence
  Synthetic
ggtcactatttggaaatgttgt

SEQ ID NO: 26759 - DNA, 19 bp, Artificial Sequence
  Synthetic
ccatgtcatacccactgtc

SEQ ID NO: 26760 - DNA, 18 bp, Artificial Sequence
  Synthetic
tggtttgaaacagccgtc

SEQ ID NO: 26761 - DNA, 18 bp, Artificial Sequence
  Synthetic
taccaagtaatgctgccc

SEQ ID NO: 26762 - DNA, 25 bp, Artificial Sequence
  Synthetic
gcatattgctatttaaaaatgctcg

SEQ ID NO: 26763 - DNA, 25 bp, Artificial Sequence
  Synthetic
cagtactgttttcttcataaagttc

SEQ ID NO: 26764 - DNA, 18 bp, Artificial Sequence
  Synthetic
ttctacagttttgccccg

SEQ ID NO: 26765 - DNA, 23 bp, Artificial Sequence
  Synthetic
actttaaacaattggattcacct

SEQ ID NO: 26766 - DNA, 23 bp, Artificial Sequence
  Synthetic
atgtacagttgtattacaccaat

SEQ ID NO: 26767 - DNA, 20 bp, Artificial Sequence
  Synthetic
catcattgctgtgtggtaac

SEQ ID NO: 26768 - DNA, 21 bp, Artificial Sequence
  Synthetic
tccccttcatatacagggtta

SEQ ID NO: 26769 - DNA, 19 bp, Artificial Sequence
  Synthetic
aaacagggcctgtaggtaa

SEQ ID NO: 26770 - DNA, 19 bp, Artificial Sequence
  Synthetic
cagttttgttagcccgttt

SEQ ID NO: 26771 - DNA, 20 bp, Artificial Sequence
  Synthetic
acatttgttccttccgtaga

SEQ ID NO: 26772 - DNA, 18 bp, Artificial Sequence
  Synthetic
atgttggtactgcgtgtg

SEQ ID NO: 26773 - DNA, 23 bp, Artificial Sequence
  Synthetic
aacagtaagagcaaaaaaatgtg

SEQ ID NO: 26774 - DNA, 16 bp, Artificial Sequence
  Synthetic
aggcctttcgcgaccc

SEQ ID NO: 26775 - DNA, 19 bp, Artificial Sequence
  Synthetic
tcttccacgaggttgcgac

SEQ ID NO: 26776 - DNA, 20 bp, Artificial Sequence
  Synthetic
cgaaagaagtgccaagagga

SEQ ID NO: 26777 - DNA, 20 bp, Artificial Sequence
  Synthetic
ccccaccatcaaatccacat

SEQ ID NO: 26778 - DNA, 20 bp, Artificial Sequence
  Synthetic
caacccctgcaaagaggaat

SEQ ID NO: 26779 - DNA, 16 bp, Artificial Sequence
  Synthetic
atcccgcatggccgag

SEQ ID NO: 26780 - DNA, 18 bp, Artificial Sequence
  Synthetic
cctgaagcaatcggtggg

SEQ ID NO: 26781 - DNA, 18 bp, Artificial Sequence
  Synthetic
atcaagccggtggagagg

SEQ ID NO: 26782 - DNA, 16 bp, Artificial Sequence
  Synthetic
gacaacgatggcgccg

SEQ ID NO: 26783 - DNA, 20 bp, Artificial Sequence
  Synthetic
gccctaagatggccagaaga

SEQ ID NO: 26784 - DNA, 20 bp, Artificial Sequence
  Synthetic
gtctccacccctttgatgtt

SEQ ID NO: 26785 - DNA, 19 bp, Artificial Sequence
  Synthetic
gattgacaggtcccttcgg

SEQ ID NO: 26786 - DNA, 16 bp, Artificial Sequence
  Synthetic
ggtgcgtgtaggtgcg

SEQ ID NO: 26787 - DNA, 18 bp, Artificial Sequence
  Synthetic
atgtcgtatgcccctccg

SEQ ID NO: 26788 - DNA, 20 bp, Artificial Sequence
  Synthetic
ctctgtagtaggctacggca

SEQ ID NO: 26789 - DNA, 20 bp, Artificial Sequence
  Synthetic
gcagtgtcaaacatgcctga

SEQ ID NO: 26790 - DNA, 18 bp, Artificial Sequence
  Synthetic
tctgtagaggaggggcgt

SEQ ID NO: 26791 - DNA, 20 bp, Artificial Sequence
  Synthetic
cctaaggccttctgcttgaa

SEQ ID NO: 26792 - DNA, 18 bp, Artificial Sequence
  Synthetic
ttttgccaaggcccacac

SEQ ID NO: 26793 - DNA, 17 bp, Artificial Sequence
  Synthetic
acacgtgattgcctcgc

SEQ ID NO: 26794 - DNA, 18 bp, Artificial Sequence
  Synthetic
acctgccagatctgctcc

SEQ ID NO: 26795 - DNA, 20 bp, Artificial Sequence
  Synthetic
ttgtgatcccactacgaacg

SEQ ID NO: 26796 - DNA, 20 bp, Artificial Sequence
  Synthetic
agacccccacaagaggttag

SEQ ID NO: 26797 - DNA, 20 bp, Artificial Sequence
  Synthetic
gccaaagcggtagaaacaac

SEQ ID NO: 26798 - DNA, 20 bp, Artificial Sequence
  Synthetic
tgaattgctcagggggctaa

SEQ ID NO: 26799 - DNA, 20 bp, Artificial Sequence
  Synthetic
tggccatgattgttgttgga

SEQ ID NO: 26800 - DNA, 18 bp, Artificial Sequence
  Synthetic
atgactttgcgggcttcg

SEQ ID NO: 26801 - DNA, 16 bp, Artificial Sequence
  Synthetic
agcgtcacctggggga

SEQ ID NO: 26802 - DNA, 18 bp, Artificial Sequence
  Synthetic
ggtcgggcatgagacatg

SEQ ID NO: 26803 - DNA, 21 bp, Artificial Sequence
  Synthetic
ttgattttcgtgagatccact

SEQ ID NO: 26804 - DNA, 19 bp, Artificial Sequence
  Synthetic
cataacacacaacagcgtt

SEQ ID NO: 26805 - DNA, 22 bp, Artificial Sequence
  Synthetic
tactgtgtaacctgatcttcct

SEQ ID NO: 26806 - DNA, 20 bp, Artificial Sequence
  Synthetic
gtgatccagaccaatgtgta

SEQ ID NO: 26807 - DNA, 25 bp, Artificial Sequence
  Synthetic
gaagtataagagaagtttgatacca

SEQ ID NO: 26808 - DNA, 20 bp, Artificial Sequence
  Synthetic
gggactttttgtgtgtgttt

SEQ ID NO: 26809 - DNA, 22 bp, Artificial Sequence
  Synthetic
taaggcacactaaaccttgatg

SEQ ID NO: 26810 - DNA, 23 bp, Artificial Sequence
  Synthetic
cctttcctcttcttaattactgg

SEQ ID NO: 26811 - DNA, 20 bp, Artificial Sequence
  Synthetic
acttgggtaataagggcttc

SEQ ID NO: 26812 - DNA, 18 bp, Artificial Sequence
  Synthetic
agtgaacccgacaccaaa

SEQ ID NO: 26813 - DNA, 20 bp, Artificial Sequence
  Synthetic
actttctgaaccatccatca

SEQ ID NO: 26814 - DNA, 20 bp, Artificial Sequence
  Synthetic
catcaaagtgcttgggatct

SEQ ID NO: 26815 - DNA, 23 bp, Artificial Sequence
  Synthetic
tgcaaacatatatctaggtcaaa

SEQ ID NO: 26816 - DNA, 21 bp, Artificial Sequence
  Synthetic
accaaagatcttaccagtagc

SEQ ID NO: 26817 - DNA, 25 bp, Artificial Sequence
  Synthetic
cccttgtacttagagaataatgatt

SEQ ID NO: 26818 - DNA, 19 bp, Artificial Sequence
  Synthetic
cacatcaggatcacaaccc

SEQ ID NO: 26819 - DNA, 23 bp, Artificial Sequence
  Synthetic
atgtatatctttcatgggcataa

SEQ ID NO: 26820 - DNA, 20 bp, Artificial Sequence
  Synthetic
tcgaccgaaatccacgaaag

SEQ ID NO: 26821 - DNA, 19 bp, Artificial Sequence
  Synthetic
gcataaaagcgctcgtggt

SEQ ID NO: 26822 - DNA, 19 bp, Artificial Sequence
  Synthetic
atcgtcaagcactgcgtac

SEQ ID NO: 26823 - DNA, 18 bp, Artificial Sequence
  Synthetic
cactgccaagctggacac

SEQ ID NO: 26824 - DNA, 18 bp, Artificial Sequence
  Synthetic
gaacgcctgcagatcgac

SEQ ID NO: 26825 - DNA, 21 bp, Artificial Sequence
  Synthetic
gcttcaaattttgcactaagc

SEQ ID NO: 26826 - DNA, 18 bp, Artificial Sequence
  Synthetic
gtcacgaaaaagcagtcg

SEQ ID NO: 26827 - DNA, 18 bp, Artificial Sequence
  Synthetic
ttaaggagctctgcgtcc

SEQ ID NO: 26828 - DNA, 25 bp, Artificial Sequence
  Synthetic
gagtcttctgttaattgattgtcat

SEQ ID NO: 26829 - DNA, 19 bp, Artificial Sequence
  Synthetic
tccatctaatgcatttcgc

SEQ ID NO: 26830 - DNA, 18 bp, Artificial Sequence
  Synthetic
agtgcttgcctcctcctg

SEQ ID NO: 26831 - DNA, 18 bp, Artificial Sequence
  Synthetic
taatggattagcaggccc

SEQ ID NO: 26832 - DNA, 18 bp, Artificial Sequence
  Synthetic
atcaccaccttggacaca

SEQ ID NO: 26833 - DNA, 19 bp, Artificial Sequence
  Synthetic
gcaacaggaaggacgtctg

SEQ ID NO: 26834 - DNA, 20 bp, Artificial Sequence
  Synthetic
tctgatataaatctcgcgcc

SEQ ID NO: 26835 - DNA, 18 bp, Artificial Sequence
  Synthetic
taagcggcttacacgaat

SEQ ID NO: 26836 - DNA, 21 bp, Artificial Sequence
  Synthetic
cacatggtttagctaaatccc

SEQ ID NO: 26837 - DNA, 24 bp, Artificial Sequence
  Synthetic
tactccatctttacaaaacatgtg

SEQ ID NO: 26838 - DNA, 18 bp, Artificial Sequence
  Synthetic
aagttcgtttccccatgc

SEQ ID NO: 26839 - DNA, 22 bp, Artificial Sequence
  Synthetic
ggagtactggatgtataggtat

SEQ ID NO: 26840 - DNA, 21 bp, Artificial Sequence
  Synthetic
acaaagtaaagtgtgccaaat

SEQ ID NO: 26841 - DNA, 19 bp, Artificial Sequence
  Synthetic
gctggatgggatggttcca

SEQ ID NO: 26842 - DNA, 18 bp, Artificial Sequence
  Synthetic
gcagtaagtgcggtcagc

SEQ ID NO: 26843 - DNA, 16 bp, Artificial Sequence
  Synthetic
accacaacgcgcctgc

SEQ ID NO: 26844 - DNA, 20 bp, Artificial Sequence
  Synthetic
tggaaatagggagggggtac

SEQ ID NO: 26845 - DNA, 18 bp, Artificial Sequence
  Synthetic
cttctgagcatgctcccg

SEQ ID NO: 26846 - DNA, 20 bp, Artificial Sequence
  Synthetic
ggttgtaggaaacaggtgca

SEQ ID NO: 26847 - DNA, 18 bp, Artificial Sequence
  Synthetic
tttactgtggcggtcagc

SEQ ID NO: 26848 - DNA, 16 bp, Artificial Sequence
  Synthetic
cgggggcaaaaaccgc

SEQ ID NO: 26849 - DNA, 20 bp, Artificial Sequence
  Synthetic
tggtcaacattagacgcgtt

SEQ ID NO: 26850 - DNA, 18 bp, Artificial Sequence
  Synthetic
gcacctggtatatgccgg

SEQ ID NO: 26851 - DNA, 16 bp, Artificial Sequence
  Synthetic
actgcacaacgccggg

SEQ ID NO: 26852 - DNA, 16 bp, Artificial Sequence
  Synthetic
aaggtggacggtggcg

SEQ ID NO: 26853 - DNA, 17 bp, Artificial Sequence
  Synthetic
gttggcggccttagctg

SEQ ID NO: 26854 - DNA, 18 bp, Artificial Sequence
  Synthetic
attggcgtcaggattgcc

SEQ ID NO: 26855 - DNA, 18 bp, Artificial Sequence
  Synthetic
gtctcccccgtggtgaat

SEQ ID NO: 26856 - DNA, 20 bp, Artificial Sequence
  Synthetic
catccacacacatctgagct

SEQ ID NO: 26857 - DNA, 16 bp, Artificial Sequence
  Synthetic
agcgaccgcggttagc

SEQ ID NO: 26858 - DNA, 17 bp, Artificial Sequence
  Synthetic
tggtgagctcggcagtc

SEQ ID NO: 26859 - DNA, 19 bp, Artificial Sequence
  Synthetic
tgtgaccttggtccagtcg

SEQ ID NO: 26860 - DNA, 19 bp, Artificial Sequence
  Synthetic
tcctcaagcaatgctagcg

SEQ ID NO: 26861 - DNA, 21 bp, Artificial Sequence
  Synthetic
ttaaaaaatccgttggtcgtc

SEQ ID NO: 26862 - DNA, 23 bp, Artificial Sequence
  Synthetic
caaacatctttgaattgtttcca

SEQ ID NO: 26863 - DNA, 20 bp, Artificial Sequence
  Synthetic
attgaagtttggtttacgcg

SEQ ID NO: 26864 - DNA, 19 bp, Artificial Sequence
  Synthetic
catacgaaactgtgcaagc

SEQ ID NO: 26865 - DNA, 22 bp, Artificial Sequence
  Synthetic
ggaatacgttcaattaaagctc

SEQ ID NO: 26866 - DNA, 19 bp, Artificial Sequence
  Synthetic
cgatgtacggcaaatcaat

SEQ ID NO: 26867 - DNA, 18 bp, Artificial Sequence
  Synthetic
taggccaacgttttccac

SEQ ID NO: 26868 - DNA, 18 bp, Artificial Sequence
  Synthetic
agtaaatttgggacgccg

SEQ ID NO: 26869 - DNA, 20 bp, Artificial Sequence
  Synthetic
aagccagtttttcattggtg

SEQ ID NO: 26870 - DNA, 21 bp, Artificial Sequence
  Synthetic
aaggctgttatcatctgatcg

SEQ ID NO: 26871 - DNA, 20 bp, Artificial Sequence
  Synthetic
agccctgaattaaaaaaggc

SEQ ID NO: 26872 - DNA, 20 bp, Artificial Sequence
  Synthetic
atgttacaaaatacgcacgc

SEQ ID NO: 26873 - DNA, 17 bp, Artificial Sequence
  Synthetic
tcggtggcgctgtatgc

SEQ ID NO: 26874 - DNA, 17 bp, Artificial Sequence
  Synthetic
acaccgtgtgtacccgc

SEQ ID NO: 26875 - DNA, 19 bp, Artificial Sequence
  Synthetic
gataattcccccggtgtcg

SEQ ID NO: 26876 - DNA, 16 bp, Artificial Sequence
  Synthetic
tcggacagcgttcccg

SEQ ID NO: 26877 - DNA, 22 bp, Artificial Sequence
  Synthetic
cagtatttgtctacagccttct

SEQ ID NO: 26878 - DNA, 18 bp, Artificial Sequence
  Synthetic
gcctgatgtaccatttgc

SEQ ID NO: 26879 - DNA, 21 bp, Artificial Sequence
  Synthetic
catcctatttgttcctgaagg

SEQ ID NO: 26880 - DNA, 19 bp, Artificial Sequence
  Synthetic
agccaaaactcttgcctta

SEQ ID NO: 26881 - DNA, 25 bp, Artificial Sequence
  Synthetic
tgtattgatagataactatgtctgg

SEQ ID NO: 26882 - DNA, 23 bp, Artificial Sequence
  Synthetic
aggagtttacataattgccttac

SEQ ID NO: 26883 - DNA, 18 bp, Artificial Sequence
  Synthetic
actcaggaatccaggtgg

SEQ ID NO: 26884 - DNA, 20 bp, Artificial Sequence
  Synthetic
ctgacatttatcacagctgg

SEQ ID NO: 26885 - DNA, 18 bp, Artificial Sequence
  Synthetic
attcctgcttgattcccg

SEQ ID NO: 26886 - DNA, 20 bp, Artificial Sequence
  Synthetic
aaatgccagtctctttctcc

SEQ ID NO: 26887 - DNA, 18 bp, Artificial Sequence
  Synthetic
ttctggggcttgttccat

SEQ ID NO: 26888 - DNA, 19 bp, Artificial Sequence
  Synthetic
tctgtcgagtaacgcctat

SEQ ID NO: 26889 - DNA, 18 bp, Artificial Sequence
  Synthetic
tacttcttgtgggttggg

SEQ ID NO: 26890 - DNA, 21 bp, Artificial Sequence
  Synthetic
tgtccgtgaaattgacagatc

SEQ ID NO: 26891 - DNA, 20 bp, Artificial Sequence
  Synthetic
cacttctccaattgtccctc

SEQ ID NO: 26892 - DNA, 20 bp, Artificial Sequence
  Synthetic
ggtatctttccacagccagg

SEQ ID NO: 26893 - DNA, 19 bp, Artificial Sequence
  Synthetic
ggaaaacccacctcctcct

SEQ ID NO: 26894 - DNA, 18 bp, Artificial Sequence
  Synthetic
tgcaggatctgagggctc

SEQ ID NO: 26895 - DNA, 20 bp, Artificial Sequence
  Synthetic
gcctcgaacatctccgtgtc

SEQ ID NO: 26896 - DNA, 17 bp, Artificial Sequence
  Synthetic
ccatggccatcaacgcc

SEQ ID NO: 26897 - DNA, 16 bp, Artificial Sequence
  Synthetic
agggcctttctggggc

SEQ ID NO: 26898 - DNA, 17 bp, Artificial Sequence
  Synthetic
ttaagcacctgggcccg

SEQ ID NO: 26899 - DNA, 16 bp, Artificial Sequence
  Synthetic
aacagccaggtcgcgg

SEQ ID NO: 26900 - DNA, 20 bp, Artificial Sequence
  Synthetic
aagttacatcaccaacccgg

SEQ ID NO: 26901 - DNA, 18 bp, Artificial Sequence
  Synthetic
cggcgtatctcatcaccg

SEQ ID NO: 26902 - DNA, 20 bp, Artificial Sequence
  Synthetic
ccgctagagtacgagatcga

SEQ ID NO: 26903 - DNA, 16 bp, Artificial Sequence
  Synthetic
aagggagacgcgtggc

SEQ ID NO: 26904 - DNA, 18 bp, Artificial Sequence
  Synthetic
gcaaaacagggccgagag

SEQ ID NO: 26905 - DNA, 18 bp, Artificial Sequence
  Synthetic
cctggcccatgatgcagg

SEQ ID NO: 26906 - DNA, 19 bp, Artificial Sequence
  Synthetic
cgaacctttagccccgagg

SEQ ID NO: 26907 - DNA, 20 bp, Artificial Sequence
  Synthetic
ggcggctttacgaccactac

SEQ ID NO: 26908 - DNA, 19 bp, Artificial Sequence
  Synthetic
catgaactacgggccggac

SEQ ID NO: 26909 - DNA, 17 bp, Artificial Sequence
  Synthetic
cgttgccaggttctgcc

SEQ ID NO: 26910 - DNA, 16 bp, Artificial Sequence
  Synthetic
cgaaacagccgcctgg

SEQ ID NO: 26911 - DNA, 18 bp, Artificial Sequence
  Synthetic
caccggagctctcggtaa

SEQ ID NO: 26912 - DNA, 20 bp, Artificial Sequence
  Synthetic
aaaagagtggtttgccgtgg

SEQ ID NO: 26913 - DNA, 18 bp, Artificial Sequence
  Synthetic
ccagaccctgcagctaca

SEQ ID NO: 26914 - DNA, 17 bp, Artificial Sequence
  Synthetic
ccgtagtctccgcgaga

SEQ ID NO: 26915 - DNA, 17 bp, Artificial Sequence
  Synthetic
accggggaaacaggcac

SEQ ID NO: 26916 - DNA, 16 bp, Artificial Sequence
  Synthetic
tcagcctcgcagaccc

SEQ ID NO: 26917 - DNA, 18 bp, Artificial Sequence
  Synthetic
gcttcatggagggcagcc

SEQ ID NO: 26918 - DNA, 19 bp, Artificial Sequence
  Synthetic
cggatctggtggccatagg

SEQ ID NO: 26919 - DNA, 16 bp, Artificial Sequence
  Synthetic
gttggtcgggttgccc

SEQ ID NO: 26920 - DNA, 16 bp, Artificial Sequence
  Synthetic
agccccggatcctcgt

SEQ ID NO: 26921 - DNA, 18 bp, Artificial Sequence
  Synthetic
gagggcgggttcatcctg

SEQ ID NO: 26922 - DNA, 16 bp, Artificial Sequence
  Synthetic
tcctggagtcggcgac

SEQ ID NO: 26923 - DNA, 16 bp, Artificial Sequence
  Synthetic
atcgcgatcgggggag

SEQ ID NO: 26924 - DNA, 16 bp, Artificial Sequence
  Synthetic
tccaatccggacgccc

SEQ ID NO: 26925 - DNA, 20 bp, Artificial Sequence
  Synthetic
gggctacgtgtacttcgagg

SEQ ID NO: 26926 - DNA, 16 bp, Artificial Sequence
  Synthetic
acagcttcgcccagcc

SEQ ID NO: 26927 - DNA, 18 bp, Artificial Sequence
  Synthetic
ctttcccaacggcaagcc

SEQ ID NO: 26928 - DNA, 18 bp, Artificial Sequence
  Synthetic
gtacgtatggcgctgagc

SEQ ID NO: 26929 - DNA, 17 bp, Artificial Sequence
  Synthetic
ggcaggtcacacatggc

SEQ ID NO: 26930 - DNA, 19 bp, Artificial Sequence
  Synthetic
gcaccatcgagctgtacaa

SEQ ID NO: 26931 - DNA, 16 bp, Artificial Sequence
  Synthetic
tgctccgccgtgatcg

SEQ ID NO: 26932 - DNA, 16 bp, Artificial Sequence
  Synthetic
tgcgaacggcgtcctc

SEQ ID NO: 26933 - DNA, 20 bp, Artificial Sequence
  Synthetic
ccaacaatctgtcgacagga

SEQ ID NO: 26934 - DNA, 16 bp, Artificial Sequence
  Synthetic
atacaggcgggcggac

SEQ ID NO: 26935 - DNA, 18 bp, Artificial Sequence
  Synthetic
ttccaggtacacgcacgc

SEQ ID NO: 26936 - DNA, 19 bp, Artificial Sequence
  Synthetic
gttcaggtcccggaactcg

SEQ ID NO: 26937 - DNA, 17 bp, Artificial Sequence
  Synthetic
tggggcacaccggaatc

SEQ ID NO: 26938 - DNA, 20 bp, Artificial Sequence
  Synthetic
cgacaggaaggcaaacagaa

SEQ ID NO: 26939 - DNA, 17 bp, Artificial Sequence
  Synthetic
tcgtgcaggtccccaac

SEQ ID NO: 26940 - DNA, 20 bp, Artificial Sequence
  Synthetic
tggaaaagaagacaaccggc

SEQ ID NO: 26941 - DNA, 16 bp, Artificial Sequence
  Synthetic
agacgctgcagcaggg

SEQ ID NO: 26942 - DNA, 19 bp, Artificial Sequence
  Synthetic
ctgccggggtaaaatccac

SEQ ID NO: 26943 - DNA, 17 bp, Artificial Sequence
  Synthetic
atacaacggctcggccc

SEQ ID NO: 26944 - DNA, 16 bp, Artificial Sequence
  Synthetic
cggtccaacagcaccg

SEQ ID NO: 26945 - DNA, 16 bp, Artificial Sequence
  Synthetic
tccgtcagggtctcgc

SEQ ID NO: 26946 - DNA, 18 bp, Artificial Sequence
  Synthetic
gcaggcggttgttatcgc

SEQ ID NO: 26947 - DNA, 19 bp, Artificial Sequence
  Synthetic
caaaagataggtcgccggg

SEQ ID NO: 26948 - DNA, 17 bp, Artificial Sequence
  Synthetic
gcccacgatgacgccaa

SEQ ID NO: 26949 - DNA, 16 bp, Artificial Sequence
  Synthetic
ataactccgcgcggcc

SEQ ID NO: 26950 - DNA, 16 bp, Artificial Sequence
  Synthetic
tagtggtcggcgtggg

SEQ ID NO: 26951 - DNA, 16 bp, Artificial Sequence
  Synthetic
cccaccacaacacggc

SEQ ID NO: 26952 - DNA, 16 bp, Artificial Sequence
  Synthetic
acggacgagatcgccc

SEQ ID NO: 26953 - DNA, 18 bp, Artificial Sequence
  Synthetic
gaacgcagctgtcttcgc

SEQ ID NO: 26954 - DNA, 17 bp, Artificial Sequence
  Synthetic
tgggtcgtgccatccga

SEQ ID NO: 26955 - DNA, 17 bp, Artificial Sequence
  Synthetic
aacacgcttcaccccgg

SEQ ID NO: 26956 - DNA, 19 bp, Artificial Sequence
  Synthetic
tgtacgtgtgctttcgggc

SEQ ID NO: 26957 - DNA, 18 bp, Artificial Sequence
  Synthetic
tcgcaggagccgtagtcc

SEQ ID NO: 26958 - DNA, 20 bp, Artificial Sequence
  Synthetic
cgagtcgaaatcccacacag

SEQ ID NO: 26959 - DNA, 18 bp, Artificial Sequence
  Synthetic
aaggtcgctgaggctctg

SEQ ID NO: 26960 - DNA, 21 bp, Artificial Sequence
  Synthetic
caatttcttgcaggtcaacac

SEQ ID NO: 26961 - DNA, 19 bp, Artificial Sequence
  Synthetic
gccattctgctcgacacag

SEQ ID NO: 26962 - DNA, 23 bp, Artificial Sequence
  Synthetic
gaacagtataatgccatcattgt

SEQ ID NO: 26963 - DNA, 18 bp, Artificial Sequence
  Synthetic
cagatcgttgtccagtgc

SEQ ID NO: 26964 - DNA, 21 bp, Artificial Sequence
  Synthetic
tgatacctcagaaaatgcaca

SEQ ID NO: 26965 - DNA, 18 bp, Artificial Sequence
  Synthetic
atgttttggtccgcgtac

SEQ ID NO: 26966 - DNA, 19 bp, Artificial Sequence
  Synthetic
acagactcgtggtcaatgt

SEQ ID NO: 26967 - DNA, 16 bp, Artificial Sequence
  Synthetic
ttaggggctggggcga

SEQ ID NO: 26968 - DNA, 18 bp, Artificial Sequence
  Synthetic
aacatcgggtggacaatc

SEQ ID NO: 26969 - DNA, 16 bp, Artificial Sequence
  Synthetic
acacggggtgccatgg

SEQ ID NO: 26970 - DNA, 20 bp, Artificial Sequence
  Synthetic
atcgctcctgtataggcaca

SEQ ID NO: 26971 - DNA, 20 bp, Artificial Sequence
  Synthetic
agcctacctgaacaccagag

SEQ ID NO: 26972 - DNA, 25 bp, Artificial Sequence
  Synthetic
gcagttaataaatctatttcctgca

SEQ ID NO: 26973 - DNA, 18 bp, Artificial Sequence
  Synthetic
gaccacctctttgccatc

SEQ ID NO: 26974 - DNA, 18 bp, Artificial Sequence
  Synthetic
agcagctgtgtttgctta

SEQ ID NO: 26975 - DNA, 21 bp, Artificial Sequence
  Synthetic
cacaatatctaatggggcatc

SEQ ID NO: 26976 - DNA, 20 bp, Artificial Sequence
  Synthetic
aaattctcaggggtaaggtc

SEQ ID NO: 26977 - DNA, 21 bp, Artificial Sequence
  Synthetic
gaaacaaaaacttcctgccaa

SEQ ID NO: 26978 - DNA, 19 bp, Artificial Sequence
  Synthetic
cgcctaaatccttgcgctt

SEQ ID NO: 26979 - DNA, 18 bp, Artificial Sequence
  Synthetic
aaaggccccaatacctcc

SEQ ID NO: 26980 - DNA, 22 bp, Artificial Sequence
  Synthetic
gatttgtagcttcatcttcctc

SEQ ID NO: 26981 - DNA, 25 bp, Artificial Sequence
  Synthetic
cttttctagcatagtataaagtcac

SEQ ID NO: 26982 - DNA, 20 bp, Artificial Sequence
  Synthetic
gcagcaggtgtaataggttt

SEQ ID NO: 26983 - DNA, 19 bp, Artificial Sequence
  Synthetic
aaaatctggatctggtgca

SEQ ID NO: 26984 - DNA, 23 bp, Artificial Sequence
  Synthetic
actttctgcaagattatccacta

SEQ ID NO: 26985 - DNA, 23 bp, Artificial Sequence
  Synthetic
ctaactttaggaacttctacagc

SEQ ID NO: 26986 - DNA, 19 bp, Artificial Sequence
  Synthetic
atcatgtgctacgtccatg

SEQ ID NO: 26987 - DNA, 18 bp, Artificial Sequence
  Synthetic
ctcaaactcaaaccgtgc

SEQ ID NO: 26988 - DNA, 20 bp, Artificial Sequence
  Synthetic
tgatatcacgcaaagtaggt

SEQ ID NO: 26989 - DNA, 18 bp, Artificial Sequence
  Synthetic
gatctgccatggcgatag

SEQ ID NO: 26990 - DNA, 19 bp, Artificial Sequence
  Synthetic
gtcttctgtaacctgctgg

SEQ ID NO: 26991 - DNA, 20 bp, Artificial Sequence
  Synthetic
actacaccgtaacagttcaa

SEQ ID NO: 26992 - DNA, 21 bp, Artificial Sequence
  Synthetic
catctgcagctaaagcataat

SEQ ID NO: 26993 - DNA, 18 bp, Artificial Sequence
  Synthetic
tcgaaacgctctgtcaga

SEQ ID NO: 26994 - DNA, 20 bp, Artificial Sequence
  Synthetic
gaggtttccgaagacgagga

SEQ ID NO: 26995 - DNA, 20 bp, Artificial Sequence
  Synthetic
agtttgcaggaccttgaaca

SEQ ID NO: 26996 - DNA, 18 bp, Artificial Sequence
  Synthetic
atcaggagggcatgtacc

SEQ ID NO: 26997 - DNA, 20 bp, Artificial Sequence
  Synthetic
tgtctagagggacaccaaat

SEQ ID NO: 26998 - DNA, 23 bp, Artificial Sequence
  Synthetic
aaggtgtaatttctaataaggct

SEQ ID NO: 26999 - DNA, 21 bp, Artificial Sequence
  Synthetic
ccataaagttctctgggtctt

SEQ ID NO: 27000 - DNA, 18 bp, Artificial Sequence
  Synthetic
cgtatatttccgctgggc

SEQ ID NO: 27001 - DNA, 20 bp, Artificial Sequence
  Synthetic
cttcacgaaacacatcatcc

SEQ ID NO: 27002 - DNA, 24 bp, Artificial Sequence
  Synthetic
cattctgcctattatcattaccag

SEQ ID NO: 27003 - DNA, 21 bp, Artificial Sequence
  Synthetic
ggccatttgcaagtttgatta

SEQ ID NO: 27004 - DNA, 20 bp, Artificial Sequence
  Synthetic
agctgacaacatgtatgagg

SEQ ID NO: 27005 - DNA, 18 bp, Artificial Sequence
  Synthetic
actcccggtacatgagtg

SEQ ID NO: 27006 - DNA, 18 bp, Artificial Sequence
  Synthetic
aatttgctgctcattgcc

SEQ ID NO: 27007 - DNA, 20 bp, Artificial Sequence
  Synthetic
tcctttctgctgaataaagc

SEQ ID NO: 27008 - DNA, 21 bp, Artificial Sequence
  Synthetic
ttgttatggccgttttctcat

SEQ ID NO: 27009 - DNA, 24 bp, Artificial Sequence
  Synthetic
ccacatcaattaaatcttgtcttg

SEQ ID NO: 27010 - DNA, 23 bp, Artificial Sequence
  Synthetic
ttttcaggtaaatcaagcaatga

SEQ ID NO: 27011 - DNA, 21 bp, Artificial Sequence
  Synthetic
cgcaactggtatctatttgga

SEQ ID NO: 27012 - DNA, 20 bp, Artificial Sequence
  Synthetic
ctgtcatcgaataagcgtct

SEQ ID NO: 27013 - DNA, 22 bp, Artificial Sequence
  Synthetic
tttagtatcttgcaatggttgt

SEQ ID NO: 27014 - DNA, 23 bp, Artificial Sequence
  Synthetic
ccaagtctattatagccactctt

SEQ ID NO: 27015 - DNA, 18 bp, Artificial Sequence
  Synthetic
atcccacctgcgaaggag

SEQ ID NO: 27016 - DNA, 18 bp, Artificial Sequence
  Synthetic
aatacctgttgtgccctc

SEQ ID NO: 27017 - DNA, 25 bp, Artificial Sequence
  Synthetic
caatttcacctgtaatattagcatc

SEQ ID NO: 27018 - DNA, 18 bp, Artificial Sequence
  Synthetic
aatctggatcaggagccg

SEQ ID NO: 27019 - DNA, 23 bp, Artificial Sequence
  Synthetic
ctactgtatgcccagataaaatt

SEQ ID NO: 27020 - DNA, 22 bp, Artificial Sequence
  Synthetic
tttcatagtagggatggtctac

SEQ ID NO: 27021 - DNA, 23 bp, Artificial Sequence
  Synthetic
gctttgttaaataaaggatgacc

SEQ ID NO: 27022 - DNA, 21 bp, Artificial Sequence
  Synthetic
agttcttaaaatttgctgccc

SEQ ID NO: 27023 - DNA, 20 bp, Artificial Sequence
  Synthetic
agcatttgtaggtggcaata

SEQ ID NO: 27024 - DNA, 22 bp, Artificial Sequence
  Synthetic
tcttgcaaatcaactaaccaaa

SEQ ID NO: 27025 - DNA, 19 bp, Artificial Sequence
  Synthetic
cgccaaaataccagagacg

SEQ ID NO: 27026 - DNA, 23 bp, Artificial Sequence
  Synthetic
caaattaacaggcaataccaaat

SEQ ID NO: 27027 - DNA, 19 bp, Artificial Sequence
  Synthetic
agacagatcacaggcaatt

SEQ ID NO: 27028 - DNA, 19 bp, Artificial Sequence
  Synthetic
aagtccccaatagctctgt

SEQ ID NO: 27029 - DNA, 23 bp, Artificial Sequence
  Synthetic
ccaaataaatctttgaatttgcc

SEQ ID NO: 27030 - DNA, 23 bp, Artificial Sequence
  Synthetic
acattaaatctattcctccaaca

SEQ ID NO: 27031 - DNA, 18 bp, Artificial Sequence
  Synthetic
aagggtatgacatcagcg

SEQ ID NO: 27032 - DNA, 21 bp, Artificial Sequence
  Synthetic
gtctggatttctggtttgaac

SEQ ID NO: 27033 - DNA, 23 bp, Artificial Sequence
  Synthetic
ctggattataaactttgggatct

SEQ ID NO: 27034 - DNA, 21 bp, Artificial Sequence
  Synthetic
tcccaatgttctcctattgtg

SEQ ID NO: 27035 - DNA, 23 bp, Artificial Sequence
  Synthetic
gcagattttttagaaactgaagt

SEQ ID NO: 27036 - DNA, 18 bp, Artificial Sequence
  Synthetic
aggttgtaaagcgtccag

SEQ ID NO: 27037 - DNA, 20 bp, Artificial Sequence
  Synthetic
atcttcccatgttctaggtg

SEQ ID NO: 27038 - DNA, 18 bp, Artificial Sequence
  Synthetic
tgtcaaagttgctccacg

SEQ ID NO: 27039 - DNA, 18 bp, Artificial Sequence
  Synthetic
aatagggatcgagctggg

SEQ ID NO: 27040 - DNA, 20 bp, Artificial Sequence
  Synthetic
catgcgagtcttcacaccat

SEQ ID NO: 27041 - DNA, 18 bp, Artificial Sequence
  Synthetic
tatggtggaattgcccag

SEQ ID NO: 27042 - DNA, 23 bp, Artificial Sequence
  Synthetic
ctatgaaatttggtagcattgca

SEQ ID NO: 27043 - DNA, 25 bp, Artificial Sequence
  Synthetic
gtcctcaaatttataaattggtgag

SEQ ID NO: 27044 - DNA, 21 bp, Artificial Sequence
  Synthetic
gtctgtcatctgtagtgagaa

SEQ ID NO: 27045 - DNA, 20 bp, Artificial Sequence
  Synthetic
tcctgtgtacatgagtgaaa

SEQ ID NO: 27046 - DNA, 23 bp, Artificial Sequence
  Synthetic
cccagcactagtataagtatcag

SEQ ID NO: 27047 - DNA, 25 bp, Artificial Sequence
  Synthetic
gacttgaaaggttaattttccaatc

SEQ ID NO: 27048 - DNA, 20 bp, Artificial Sequence
  Synthetic
aaaagggacactaaacctgg

SEQ ID NO: 27049 - DNA, 18 bp, Artificial Sequence
  Synthetic
tctggggtagttagtgcg

SEQ ID NO: 27050 - DNA, 18 bp, Artificial Sequence
  Synthetic
agtacgagctaccctcaa

SEQ ID NO: 27051 - DNA, 20 bp, Artificial Sequence
  Synthetic
tgctctccctaaactggtaa

SEQ ID NO: 27052 - DNA, 22 bp, Artificial Sequence
  Synthetic
ttgtgacatttgttctaaccac

SEQ ID NO: 27053 - DNA, 22 bp, Artificial Sequence
  Synthetic
aatgttttggatcaggaggtaa

SEQ ID NO: 27054 - DNA, 18 bp, Artificial Sequence
  Synthetic
tgtgctgtgcatgcaaat

SEQ ID NO: 27055 - DNA, 25 bp, Artificial Sequence
  Synthetic
ggatctactagtttgtatttgtctt

SEQ ID NO: 27056 - DNA, 19 bp, Artificial Sequence
  Synthetic
tttttcctgttgtgcacaa

SEQ ID NO: 27057 - DNA, 21 bp, Artificial Sequence
  Synthetic
gtctagggtcattgtcattga

SEQ ID NO: 27058 - DNA, 24 bp, Artificial Sequence
  Synthetic
gaaatctgaatacatgaagcatac

SEQ ID NO: 27059 - DNA, 19 bp, Artificial Sequence
  Synthetic
tgggtcctcaatgcttaat

SEQ ID NO: 27060 - DNA, 18 bp, Artificial Sequence
  Synthetic
tgatgtacacccccttca

SEQ ID NO: 27061 - DNA, 25 bp, Artificial Sequence
  Synthetic
cttagaagcatatctcctatctcaa

SEQ ID NO: 27062 - DNA, 18 bp, Artificial Sequence
  Synthetic
ttcctccactcctttggg

SEQ ID NO: 27063 - DNA, 20 bp, Artificial Sequence
  Synthetic
ccattatccttttgtctgcc

SEQ ID NO: 27064 - DNA, 18 bp, Artificial Sequence
  Synthetic
ctaagatctgcatggccc

SEQ ID NO: 27065 - DNA, 19 bp, Artificial Sequence
  Synthetic
cgatatacacgctgcttgt

SEQ ID NO: 27066 - DNA, 21 bp, Artificial Sequence
  Synthetic
gttcttctgttgggttttgtc

SEQ ID NO: 27067 - DNA, 19 bp, Artificial Sequence
  Synthetic
cccactcactatcagttgg

SEQ ID NO: 27068 - DNA, 20 bp, Artificial Sequence
  Synthetic
tgtcaggcaatattccgatc

SEQ ID NO: 27069 - DNA, 24 bp, Artificial Sequence
  Synthetic
attgatatgtgttaactagcactg

SEQ ID NO: 27070 - DNA, 19 bp, Artificial Sequence
  Synthetic
acaggagaattgcctctca

SEQ ID NO: 27071 - DNA, 23 bp, Artificial Sequence
  Synthetic
aattgttactctatcacctttca

SEQ ID NO: 27072 - DNA, 18 bp, Artificial Sequence
  Synthetic
actcctctgcacactgta

SEQ ID NO: 27073 - DNA, 19 bp, Artificial Sequence
  Synthetic
actattacatgcggcactt

SEQ ID NO: 27074 - DNA, 18 bp, Artificial Sequence
  Synthetic
cgctctgcgtctgtgctt

SEQ ID NO: 27075 - DNA, 24 bp, Artificial Sequence
  Synthetic
ccaacactttaatgtattctgagg

SEQ ID NO: 27076 - DNA, 18 bp, Artificial Sequence
  Synthetic
aattgcaggccttactgg

SEQ ID NO: 27077 - DNA, 23 bp, Artificial Sequence
  Synthetic
ttgtacttgaacatctatctgag

SEQ ID NO: 27078 - DNA, 19 bp, Artificial Sequence
  Synthetic
gaagataaagccgtccagt

SEQ ID NO: 27079 - DNA, 24 bp, Artificial Sequence
  Synthetic
gcaaatttattaggatcaggtaac

SEQ ID NO: 27080 - DNA, 23 bp, Artificial Sequence
  Synthetic
ataaaaagctgattttgtttggg

SEQ ID NO: 27081 - DNA, 18 bp, Artificial Sequence
  Synthetic
gtcgtcctggcaattccg

SEQ ID NO: 27082 - DNA, 16 bp, Artificial Sequence
  Synthetic
agatgggcgcgccttg

SEQ ID NO: 27083 - DNA, 19 bp, Artificial Sequence
  Synthetic
ccacatgtttgcggaaccc

SEQ ID NO: 27084 - DNA, 20 bp, Artificial Sequence
  Synthetic
accttcaaccaattgcctga

SEQ ID NO: 27085 - DNA, 19 bp, Artificial Sequence
  Synthetic
gcatagtgccagcagtagg

SEQ ID NO: 27086 - DNA, 18 bp, Artificial Sequence
  Synthetic
gggcacaggagctggtta

SEQ ID NO: 27087 - DNA, 20 bp, Artificial Sequence
  Synthetic
atgaggacgacatactccca

SEQ ID NO: 27088 - DNA, 15 bp, Artificial Sequence
  Synthetic
aggtgcatgcgggca

SEQ ID NO: 27089 - DNA, 19 bp, Artificial Sequence
  Synthetic
gtcccagcagcaccaagtc

SEQ ID NO: 27090 - DNA, 18 bp, Artificial Sequence
  Synthetic
aagtgacctagcccccag

SEQ ID NO: 27091 - DNA, 19 bp, Artificial Sequence
  Synthetic
ggcgaggagttgtcggtaa

SEQ ID NO: 27092 - DNA, 17 bp, Artificial Sequence
  Synthetic
cgtagcgagcaccgtga

SEQ ID NO: 27093 - DNA, 18 bp, Artificial Sequence
  Synthetic
tctaccacctgcgtcacg

SEQ ID NO: 27094 - DNA, 20 bp, Artificial Sequence
  Synthetic
ggagtgtttaggtaggcacg

SEQ ID NO: 27095 - DNA, 20 bp, Artificial Sequence
  Synthetic
acttccaggtctgcagacat

SEQ ID NO: 27096 - DNA, 20 bp, Artificial Sequence
  Synthetic
ccacatgtgtttcctccaga

SEQ ID NO: 27097 - DNA, 19 bp, Artificial Sequence
  Synthetic
ccggcaaggatgtcaacaa

SEQ ID NO: 27098 - DNA, 18 bp, Artificial Sequence
  Synthetic
tctcgcagccatgaggac

SEQ ID NO: 27099 - DNA, 19 bp, Artificial Sequence
  Synthetic
gcacactagggctggtagt

SEQ ID NO: 27100 - DNA, 20 bp, Artificial Sequence
  Synthetic
cagtgagcattgacgtgact

SEQ ID NO: 27101 - DNA, 18 bp, Artificial Sequence
  Synthetic
tcgtatccgggcatttgc

SEQ ID NO: 27102 - DNA, 20 bp, Artificial Sequence
  Synthetic
ggggcattgagctaaaggat

SEQ ID NO: 27103 - DNA, 18 bp, Artificial Sequence
  Synthetic
tgcagatcccatcacggt

SEQ ID NO: 27104 - DNA, 19 bp, Artificial Sequence
  Synthetic
gatgttggctgccctacac

SEQ ID NO: 27105 - DNA, 20 bp, Artificial Sequence
  Synthetic
tgatgatgttgcccaaccac

SEQ ID NO: 27106 - DNA, 20 bp, Artificial Sequence
  Synthetic
accttgggcaatgagtttgg

SEQ ID NO: 27107 - DNA, 23 bp, Artificial Sequence
  Synthetic
ctttttcaattgctatgccattt

SEQ ID NO: 27108 - DNA, 23 bp, Artificial Sequence
  Synthetic
tttgctctgtttagttcatttcc

SEQ ID NO: 27109 - DNA, 20 bp, Artificial Sequence
  Synthetic
ctcctcttttgccttctctc

SEQ ID NO: 27110 - DNA, 18 bp, Artificial Sequence
  Synthetic
agagtaagtctggcagcc

SEQ ID NO: 27111 - DNA, 20 bp, Artificial Sequence
  Synthetic
gagaaagcactgttgaaact

SEQ ID NO: 27112 - DNA, 19 bp, Artificial Sequence
  Synthetic
tcatcttcttggcttgtcc

SEQ ID NO: 27113 - DNA, 24 bp, Artificial Sequence
  Synthetic
gctgttgaaattcaaataaagcag

SEQ ID NO: 27114 - DNA, 19 bp, Artificial Sequence
  Synthetic
aagatcgtctcctggaaca

SEQ ID NO: 27115 - DNA, 18 bp, Artificial Sequence
  Synthetic
cagttgctcgccaattag

SEQ ID NO: 27116 - DNA, 19 bp, Artificial Sequence
  Synthetic
aatcaaattggtctgcagc

SEQ ID NO: 27117 - DNA, 19 bp, Artificial Sequence
  Synthetic
aacatatacacaggctccc

SEQ ID NO: 27118 - DNA, 23 bp, Artificial Sequence
  Synthetic
atgtttcttttccaaatggtgat

SEQ ID NO: 27119 - DNA, 21 bp, Artificial Sequence
  Synthetic
gtggttctagagtaagagctg

SEQ ID NO: 27120 - DNA, 19 bp, Artificial Sequence
  Synthetic
ccccaacccatttaaacac

SEQ ID NO: 27121 - DNA, 20 bp, Artificial Sequence
  Synthetic
attatagctgatgcctctgg

SEQ ID NO: 27122 - DNA, 19 bp, Artificial Sequence
  Synthetic
ttcaaattgaacagcccga

SEQ ID NO: 27123 - DNA, 24 bp, Artificial Sequence
  Synthetic
ttcctaattcaggtggtaaactag

SEQ ID NO: 27124 - DNA, 25 bp, Artificial Sequence
  Synthetic
gatctattaaagcaaacttgttagg

SEQ ID NO: 27125 - DNA, 20 bp, Artificial Sequence
  Synthetic
gagcatgtggttcaggtatg

SEQ ID NO: 27126 - DNA, 18 bp, Artificial Sequence
  Synthetic
gtcctcaataccggatgg

SEQ ID NO: 27127 - DNA, 18 bp, Artificial Sequence
  Synthetic
tgtttgttttgacagccg

SEQ ID NO: 27128 - DNA, 18 bp, Artificial Sequence
  Synthetic
tatgaggcccatgcaact

SEQ ID NO: 27129 - DNA, 21 bp, Artificial Sequence
  Synthetic
atagactcaggtactccttcc

SEQ ID NO: 27130 - DNA, 21 bp, Artificial Sequence
  Synthetic
ctgtttctgcctgtgttaaat

SEQ ID NO: 27131 - DNA, 18 bp, Artificial Sequence
  Synthetic
ccccacttccaccactat

SEQ ID NO: 27132 - DNA, 25 bp, Artificial Sequence
  Synthetic
ttgtaataaatagcacattctaggc

SEQ ID NO: 27133 - DNA, 22 bp, Artificial Sequence
  Synthetic
gttactgatgcttcttcacaaa

SEQ ID NO: 27134 - DNA, 18 bp, Artificial Sequence
  Synthetic
aatgccctccagtttctg

SEQ ID NO: 27135 - DNA, 20 bp, Artificial Sequence
  Synthetic
gcaagtagtctggatgttcc

SEQ ID NO: 27136 - DNA, 25 bp, Artificial Sequence
  Synthetic
ccaatttatttaataaaggatggcc

SEQ ID NO: 27137 - DNA, 21 bp, Artificial Sequence
  Synthetic
aacttcacttttgttagcctg

SEQ ID NO: 27138 - DNA, 19 bp, Artificial Sequence
  Synthetic
tgtgctcgttgtaaccaat

SEQ ID NO: 27139 - DNA, 22 bp, Artificial Sequence
  Synthetic
tgtagcttttcgttttcctaat

SEQ ID NO: 27140 - DNA, 22 bp, Artificial Sequence
  Synthetic
taaaaaacaatggaatggttgg

SEQ ID NO: 27141 - DNA, 19 bp, Artificial Sequence
  Synthetic
tcccgaaaagcaaagtcat

SEQ ID NO: 27142 - DNA, 20 bp, Artificial Sequence
  Synthetic
cgtgttcttgatgatctgca

SEQ ID NO: 27143 - DNA, 18 bp, Artificial Sequence
  Synthetic
ttgtacgcacaaccgaag

SEQ ID NO: 27144 - DNA, 18 bp, Artificial Sequence
  Synthetic
agttgattcgcctcgttc

SEQ ID NO: 27145 - DNA, 25 bp, Artificial Sequence
  Synthetic
ctttctctaggtaatatatgtggac

SEQ ID NO: 27146 - DNA, 19 bp, Artificial Sequence
  Synthetic
tcctcaaagtccaccttct

SEQ ID NO: 27147 - DNA, 24 bp, Artificial Sequence
  Synthetic
ctgtatttatgtacactcccttca

SEQ ID NO: 27148 - DNA, 18 bp, Artificial Sequence
  Synthetic
cttggcctactgcagttc

SEQ ID NO: 27149 - DNA, 18 bp, Artificial Sequence
  Synthetic
aaggttctgcacaccttc

SEQ ID NO: 27150 - DNA, 21 bp, Artificial Sequence
  Synthetic
gcatcctttgtcattgtgttc

SEQ ID NO: 27151 - DNA, 20 bp, Artificial Sequence
  Synthetic
aattgtgaaggagagctctg

SEQ ID NO: 27152 - DNA, 23 bp, Artificial Sequence
  Synthetic
ctctcttgttgatttgttgaagt

SEQ ID NO: 27153 - DNA, 19 bp, Artificial Sequence
  Synthetic
acctatctactcctgcctg

SEQ ID NO: 27154 - DNA, 18 bp, Artificial Sequence
  Synthetic
cccctgtgacatcggtat

SEQ ID NO: 27155 - DNA, 22 bp, Artificial Sequence
  Synthetic
atttccttatgactgacaaacg

SEQ ID NO: 27156 - DNA, 22 bp, Artificial Sequence
  Synthetic
tcaataaatgggatacggagag

SEQ ID NO: 27157 - DNA, 23 bp, Artificial Sequence
  Synthetic
agaaacaacagctaacttttctg

SEQ ID NO: 27158 - DNA, 18 bp, Artificial Sequence
  Synthetic
gccttaacagctgatcgc

SEQ ID NO: 27159 - DNA, 23 bp, Artificial Sequence
  Synthetic
atctgatatgtcactttcagatc

SEQ ID NO: 27160 - DNA, 19 bp, Artificial Sequence
  Synthetic
ttgcctttttttccctctg

SEQ ID NO: 27161 - DNA, 20 bp, Artificial Sequence
  Synthetic
aactacagcatgtcttgttg

SEQ ID NO: 27162 - DNA, 19 bp, Artificial Sequence
  Synthetic
cttgtagccagtctaagcg

SEQ ID NO: 27163 - DNA, 22 bp, Artificial Sequence
  Synthetic
tggtgctaaaaagatttctctg

SEQ ID NO: 27164 - DNA, 20 bp, Artificial Sequence
  Synthetic
tctgagggtggtatctctgg

SEQ ID NO: 27165 - DNA, 19 bp, Artificial Sequence
  Synthetic
tttgtatatcaggggggca

SEQ ID NO: 27166 - DNA, 24 bp, Artificial Sequence
  Synthetic
aatattatcagatgctgaagcttc

SEQ ID NO: 27167 - DNA, 19 bp, Artificial Sequence
  Synthetic
gtaactaaggaagcaggcc

SEQ ID NO: 27168 - DNA, 19 bp, Artificial Sequence
  Synthetic
cgatgcagcaagagaactt

SEQ ID NO: 27169 - DNA, 18 bp, Artificial Sequence
  Synthetic
ttggtgatcggttgggta

SEQ ID NO: 27170 - DNA, 22 bp, Artificial Sequence
  Synthetic
ccaaactagtctctcagtttct

SEQ ID NO: 27171 - DNA, 25 bp, Artificial Sequence
  Synthetic
cctcaataactgtgttaactaattc

SEQ ID NO: 27172 - DNA, 21 bp, Artificial Sequence
  Synthetic
attcacatgtatattcaggcc

SEQ ID NO: 27173 - DNA, 18 bp, Artificial Sequence
  Synthetic
aacttcaaaattcgcgcg

SEQ ID NO: 27174 - DNA, 24 bp, Artificial Sequence
  Synthetic
cataatcactgagtttgagttcag

SEQ ID NO: 27175 - DNA, 22 bp, Artificial Sequence
  Synthetic
tgtttgaaattttcctttgagg

SEQ ID NO: 27176 - DNA, 20 bp, Artificial Sequence
  Synthetic
gaccacttggctgttttgga

SEQ ID NO: 27177 - DNA, 19 bp, Artificial Sequence
  Synthetic
cccagtatctgcttctcag

SEQ ID NO: 27178 - DNA, 19 bp, Artificial Sequence
  Synthetic
cccatttgaatgcctgtca

SEQ ID NO: 27179 - DNA, 25 bp, Artificial Sequence
  Synthetic
ccatcagtcattatagtaaaacatg

SEQ ID NO: 27180 - DNA, 25 bp, Artificial Sequence
  Synthetic
gtatcctatttgataatccaggttt

SEQ ID NO: 27181 - DNA, 20 bp, Artificial Sequence
  Synthetic
caatcagtcattgccacaac

SEQ ID NO: 27182 - DNA, 18 bp, Artificial Sequence
  Synthetic
gtcataggtttggcgacc

SEQ ID NO: 27183 - DNA, 25 bp, Artificial Sequence
  Synthetic
agtaattgtaaaagagagctctgta

SEQ ID NO: 27184 - DNA, 19 bp, Artificial Sequence
  Synthetic
tcaagtcaatgcttgcaag

SEQ ID NO: 27185 - DNA, 20 bp, Artificial Sequence
  Synthetic
cctgcttctattccctcatg

SEQ ID NO: 27186 - DNA, 20 bp, Artificial Sequence
  Synthetic
gtggcatcggtatgggtatc

SEQ ID NO: 27187 - DNA, 20 bp, Artificial Sequence
  Synthetic
tcttgcagtgaagtgttcag

SEQ ID NO: 27188 - DNA, 18 bp, Artificial Sequence
  Synthetic
ttcaacggtttctggcac

SEQ ID NO: 27189 - DNA, 24 bp, Artificial Sequence
  Synthetic
catctatttcatcgttttcttcct

SEQ ID NO: 27190 - DNA, 18 bp, Artificial Sequence
  Synthetic
tctgtatccacctccagc

SEQ ID NO: 27191 - DNA, 25 bp, Artificial Sequence
  Synthetic
ctatattgctattgtcacttgtacc

SEQ ID NO: 27192 - DNA, 25 bp, Artificial Sequence
  Synthetic
ggctcctaaaaatgttataaactct

SEQ ID NO: 27193 - DNA, 23 bp, Artificial Sequence
  Synthetic
gttcaatagctttatgtgcttta

SEQ ID NO: 27194 - DNA, 19 bp, Artificial Sequence
  Synthetic
cgtgttgtacccttccttt

SEQ ID NO: 27195 - DNA, 19 bp, Artificial Sequence
  Synthetic
gagtccacagtgtccaggt

SEQ ID NO: 27196 - DNA, 23 bp, Artificial Sequence
  Synthetic
tctttgtgtttcactatggtatg

SEQ ID NO: 27197 - DNA, 21 bp, Artificial Sequence
  Synthetic
gcaatagtaacatgggcaata

SEQ ID NO: 27198 - DNA, 23 bp, Artificial Sequence
  Synthetic
ctaatctactaaagcgaacagtc

SEQ ID NO: 27199 - DNA, 21 bp, Artificial Sequence
  Synthetic
cagaagatatagtgggcgaat

SEQ ID NO: 27200 - DNA, 19 bp, Artificial Sequence
  Synthetic
taagttctaaaggggggca

SEQ ID NO: 27201 - DNA, 18 bp, Artificial Sequence
  Synthetic
caggtgaagcaggcatac

SEQ ID NO: 27202 - DNA, 22 bp, Artificial Sequence
  Synthetic
atcatattcctcaacatgtctg

SEQ ID NO: 27203 - DNA, 20 bp, Artificial Sequence
  Synthetic
aaaccacagacataagccaa

SEQ ID NO: 27204 - DNA, 19 bp, Artificial Sequence
  Synthetic
actgatgtgtcctgttgac

SEQ ID NO: 27205 - DNA, 18 bp, Artificial Sequence
  Synthetic
agtcataggtctgtcggc

SEQ ID NO: 27206 - DNA, 19 bp, Artificial Sequence
  Synthetic
aagaaagttcggtgtcctg

SEQ ID NO: 27207 - DNA, 19 bp, Artificial Sequence
  Synthetic
cggcttgaatcccttcatg

SEQ ID NO: 27208 - DNA, 19 bp, Artificial Sequence
  Synthetic
tgctggaccaagatcattg

SEQ ID NO: 27209 - DNA, 18 bp, Artificial Sequence
  Synthetic
gcatcaattcgggctctg

SEQ ID NO: 27210 - DNA, 17 bp, Artificial Sequence
  Synthetic
tccagggaagcggtcac

SEQ ID NO: 27211 - DNA, 16 bp, Artificial Sequence
  Synthetic
tgccgcctgtagcacg

SEQ ID NO: 27212 - DNA, 19 bp, Artificial Sequence
  Synthetic
cgagggagaatggttcacc

SEQ ID NO: 27213 - DNA, 19 bp, Artificial Sequence
  Synthetic
tgatgtccagcctaggagg

SEQ ID NO: 27214 - DNA, 18 bp, Artificial Sequence
  Synthetic
ctcctgggcagctcatca

SEQ ID NO: 27215 - DNA, 19 bp, Artificial Sequence
  Synthetic
cactgggattccgggaatc

SEQ ID NO: 27216 - DNA, 19 bp, Artificial Sequence
  Synthetic
accaacatggcaagaacca

SEQ ID NO: 27217 - DNA, 16 bp, Artificial Sequence
  Synthetic
tggcgccagaaagggc

SEQ ID NO: 27218 - DNA, 20 bp, Artificial Sequence
  Synthetic
ctgccaacactagcatgact

SEQ ID NO: 27219 - DNA, 20 bp, Artificial Sequence
  Synthetic
acacacttcagcagcaatgt

SEQ ID NO: 27220 - DNA, 20 bp, Artificial Sequence
  Synthetic
gcacaccattcactctctga

SEQ ID NO: 27221 - DNA, 18 bp, Artificial Sequence
  Synthetic
ttctcacgacccaaacgc

SEQ ID NO: 27222 - DNA, 20 bp, Artificial Sequence
  Synthetic
acgatagccggttttacccg

SEQ ID NO: 27223 - DNA, 18 bp, Artificial Sequence
  Synthetic
gggtcgcagtggcaaaca

SEQ ID NO: 27224 - DNA, 19 bp, Artificial Sequence
  Synthetic
cacatcaccggctggaatt

SEQ ID NO: 27225 - DNA, 19 bp, Artificial Sequence
  Synthetic
taccacgtgacaccagcct

SEQ ID NO: 27226 - DNA, 16 bp, Artificial Sequence
  Synthetic
ccgccaagcaaggggt

SEQ ID NO: 27227 - DNA, 19 bp, Artificial Sequence
  Synthetic
cgtagctagcagccatggg

SEQ ID NO: 27228 - DNA, 16 bp, Artificial Sequence
  Synthetic
aggagcagagcagccg

SEQ ID NO: 27229 - DNA, 18 bp, Artificial Sequence
  Synthetic
agacggttgacccagtcg

SEQ ID NO: 27230 - DNA, 18 bp, Artificial Sequence
  Synthetic
atccacaagtacagcgcg

SEQ ID NO: 27231 - DNA, 18 bp, Artificial Sequence
  Synthetic
ggcaaatcaccggcgaag

SEQ ID NO: 27232 - DNA, 19 bp, Artificial Sequence
  Synthetic
tctcggcaagaacagtcgt

SEQ ID NO: 27233 - DNA, 19 bp, Artificial Sequence
  Synthetic
ccctcccacaacctaaggg

SEQ ID NO: 27234 - DNA, 18 bp, Artificial Sequence
  Synthetic
caaagcatgcacccggac

SEQ ID NO: 27235 - DNA, 19 bp, Artificial Sequence
  Synthetic
ggcttccgcatatccgtac

SEQ ID NO: 27236 - DNA, 18 bp, Artificial Sequence
  Synthetic
gcgaggcaagagcttcag

SEQ ID NO: 27237 - DNA, 18 bp, Artificial Sequence
  Synthetic
agcacgcaaacacacaat

SEQ ID NO: 27238 - DNA, 22 bp, Artificial Sequence
  Synthetic
agctccagaataatatcttgca

SEQ ID NO: 27239 - DNA, 20 bp, Artificial Sequence
  Synthetic
agtttttgcaattgctcctc

SEQ ID NO: 27240 - DNA, 20 bp, Artificial Sequence
  Synthetic
aacctactccaaacgactct

SEQ ID NO: 27241 - DNA, 18 bp, Artificial Sequence
  Synthetic
tatgaactgtcccgcgat

SEQ ID NO: 27242 - DNA, 19 bp, Artificial Sequence
  Synthetic
caaatttggcctggttgtt

SEQ ID NO: 27243 - DNA, 24 bp, Artificial Sequence
  Synthetic
tgttacatcatccaatagagctat

SEQ ID NO: 27244 - DNA, 18 bp, Artificial Sequence
  Synthetic
attgaaacgctcgctgag

SEQ ID NO: 27245 - DNA, 20 bp, Artificial Sequence
  Synthetic
tcggtttgttgtggctgttt

SEQ ID NO: 27246 - DNA, 18 bp, Artificial Sequence
  Synthetic
gtgtggtgcaggaggagg

SEQ ID NO: 27247 - DNA, 18 bp, Artificial Sequence
  Synthetic
tttagctctgttgcggac

SEQ ID NO: 27248 - DNA, 22 bp, Artificial Sequence
  Synthetic
cgccatagcaaatacaaaatgt

SEQ ID NO: 27249 - DNA, 19 bp, Artificial Sequence
  Synthetic
tgacccgtgttggaggaat

SEQ ID NO: 27250 - DNA, 18 bp, Artificial Sequence
  Synthetic
catatcccgctggtgttg

SEQ ID NO: 27251 - DNA, 18 bp, Artificial Sequence
  Synthetic
ttttacgtttgcgcctgt

SEQ ID NO: 27252 - DNA, 20 bp, Artificial Sequence
  Synthetic
tcattttctgcacatggaac

SEQ ID NO: 27253 - DNA, 21 bp, Artificial Sequence
  Synthetic
ccattattatgaccttgggct

SEQ ID NO: 27254 - DNA, 23 bp, Artificial Sequence
  Synthetic
ttccttgaatactgtgtaaaagt

SEQ ID NO: 27255 - DNA, 23 bp, Artificial Sequence
  Synthetic
actatctctgttatgttcctttc

SEQ ID NO: 27256 - DNA, 20 bp, Artificial Sequence
  Synthetic
ttgttgttcaaagtggttcc

SEQ ID NO: 27257 - DNA, 20 bp, Artificial Sequence
  Synthetic
tgagttctgaggatgttctt

SEQ ID NO: 27258 - DNA, 24 bp, Artificial Sequence
  Synthetic
acatttatatatagcacgggtcta

SEQ ID NO: 27259 - DNA, 23 bp, Artificial Sequence
  Synthetic
tgacttgcctatttatttgtgac

SEQ ID NO: 27260 - DNA, 18 bp, Artificial Sequence
  Synthetic
gttcgtttgttgcttggc

SEQ ID NO: 27261 - DNA, 23 bp, Artificial Sequence
  Synthetic
ttcagttttcttgtcatcagttg

SEQ ID NO: 27262 - DNA, 20 bp, Artificial Sequence
  Synthetic
tcataatcctctgctgtgtc

SEQ ID NO: 27263 - DNA, 20 bp, Artificial Sequence
  Synthetic
tatagtaaccggtgctggtt

SEQ ID NO: 27264 - DNA, 24 bp, Artificial Sequence
  Synthetic
tggtagaactaagctttctaattc

SEQ ID NO: 27265 - DNA, 25 bp, Artificial Sequence
  Synthetic
gttaagtcagtacctttattactgt

SEQ ID NO: 27266 - DNA, 18 bp, Artificial Sequence
  Synthetic
gctgaggagaggtggtaa

SEQ ID NO: 27267 - DNA, 18 bp, Artificial Sequence
  Synthetic
atgcttcagaaacgcagc

SEQ ID NO: 27268 - DNA, 21 bp, Artificial Sequence
  Synthetic
ttcaattgagtaggtgctcta

SEQ ID NO: 27269 - DNA, 25 bp, Artificial Sequence
  Synthetic
ctcataaagattcattaggttttcc

SEQ ID NO: 27270 - DNA, 18 bp, Artificial Sequence
  Synthetic
cgtcgtcgtcgtcgtaac

SEQ ID NO: 27271 - DNA, 21 bp, Artificial Sequence
  Synthetic
taatagtgtcatgtgcaaaca

SEQ ID NO: 27272 - DNA, 22 bp, Artificial Sequence
  Synthetic
aacttgctgtacaaaacgtcta

SEQ ID NO: 27273 - DNA, 18 bp, Artificial Sequence
  Synthetic
cacctttgcaacaggctt

SEQ ID NO: 27274 - DNA, 22 bp, Artificial Sequence
  Synthetic
tactagtctccatactaatcgc

SEQ ID NO: 27275 - DNA, 18 bp, Artificial Sequence
  Synthetic
tactgtcctgttggtggt

SEQ ID NO: 27276 - DNA, 21 bp, Artificial Sequence
  Synthetic
tcttgcataaagctgttcctt

SEQ ID NO: 27277 - DNA, 23 bp, Artificial Sequence
  Synthetic
ctgaagttaatatttcgcgtatt

SEQ ID NO: 27278 - DNA, 19 bp, Artificial Sequence
  Synthetic
tttgtgctacgtttgcagt

SEQ ID NO: 27279 - DNA, 19 bp, Artificial Sequence
  Synthetic
tgtgttctgttgactgtgt

SEQ ID NO: 27280 - DNA, 18 bp, Artificial Sequence
  Synthetic
ggccttgggttagtttgt

SEQ ID NO: 27281 - DNA, 23 bp, Artificial Sequence
  Synthetic
gctcttattagatagcctctctt

SEQ ID NO: 27282 - DNA, 21 bp, Artificial Sequence
  Synthetic
tgaaagaaagctcagtgtctt

SEQ ID NO: 27283 - DNA, 23 bp, Artificial Sequence
  Synthetic
cattgaaatacttcaggtcaatg

SEQ ID NO: 27284 - DNA, 21 bp, Artificial Sequence
  Synthetic
gaatctatccactcctgcttg

SEQ ID NO: 27285 - DNA, 21 bp, Artificial Sequence
  Synthetic
tcctctatggcacctatatgt

SEQ ID NO: 27286 - DNA, 20 bp, Artificial Sequence
  Synthetic
cagggggttacaaagtcttc

SEQ ID NO: 27287 - DNA, 18 bp, Artificial Sequence
  Synthetic
attctggcatcaatccgg

SEQ ID NO: 27288 - DNA, 22 bp, Artificial Sequence
  Synthetic
acaagcactgtagctctaattc

SEQ ID NO: 27289 - DNA, 19 bp, Artificial Sequence
  Synthetic
gacacaacacagtctaacg

SEQ ID NO: 27290 - DNA, 22 bp, Artificial Sequence
  Synthetic
ttttcagcttcatcttcaatcc

SEQ ID NO: 27291 - DNA, 18 bp, Artificial Sequence
  Synthetic
tgtcgtacgatgtggaag

SEQ ID NO: 27292 - DNA, 21 bp, Artificial Sequence
  Synthetic
aatgtcccatagagtacgtag

SEQ ID NO: 27293 - DNA, 18 bp, Artificial Sequence
  Synthetic
tgagttggccttccagac

SEQ ID NO: 27294 - DNA, 24 bp, Artificial Sequence
  Synthetic
ctacttcaaattcttcgttagagg

SEQ ID NO: 27295 - DNA, 23 bp, Artificial Sequence
  Synthetic
acaaacctattacctaattgggt

SEQ ID NO: 27296 - DNA, 24 bp, Artificial Sequence
  Synthetic
cttactcttattgtaccttctgag

SEQ ID NO: 27297 - DNA, 21 bp, Artificial Sequence
  Synthetic
actttgatatctccaccatct

SEQ ID NO: 27298 - DNA, 25 bp, Artificial Sequence
  Synthetic
gtttgtttaggatctatagacaagt

SEQ ID NO: 27299 - DNA, 19 bp, Artificial Sequence
  Synthetic
tcaggccataagctgattg

SEQ ID NO: 27300 - DNA, 22 bp, Artificial Sequence
  Synthetic
caactgaaacaatacacaacaa

SEQ ID NO: 27301 - DNA, 20 bp, Artificial Sequence
  Synthetic
cccattgctatcagactcag

SEQ ID NO: 27302 - DNA, 19 bp, Artificial Sequence
  Synthetic
gttgttctctccgttgggc

SEQ ID NO: 27303 - DNA, 18 bp, Artificial Sequence
  Synthetic
ccttcagcaacccatgaa

SEQ ID NO: 27304 - DNA, 21 bp, Artificial Sequence
  Synthetic
gcactactatttcaggaccaa

SEQ ID NO: 27305 - DNA, 19 bp, Artificial Sequence
  Synthetic
ctgtagtggccacaaatgt

SEQ ID NO: 27306 - DNA, 19 bp, Artificial Sequence
  Synthetic
aattgaactgaatcgcctg

SEQ ID NO: 27307 - DNA, 19 bp, Artificial Sequence
  Synthetic
acctttaatgctgctccac

SEQ ID NO: 27308 - DNA, 21 bp, Artificial Sequence
  Synthetic
aatcatctgtactcagcactc

SEQ ID NO: 27309 - DNA, 22 bp, Artificial Sequence
  Synthetic
gcaagtagaacaaagttcacat

SEQ ID NO: 27310 - DNA, 21 bp, Artificial Sequence
  Synthetic
gttgcaagaggattatgtctc

SEQ ID NO: 27311 - DNA, 22 bp, Artificial Sequence
  Synthetic
cataacaaaatggtcctttcca

SEQ ID NO: 27312 - DNA, 19 bp, Artificial Sequence
  Synthetic
ctgagaaagaagcagttgc

SEQ ID NO: 27313 - DNA, 25 bp, Artificial Sequence
  Synthetic
cattgttattttcagttccagtttc

SEQ ID NO: 27314 - DNA, 19 bp, Artificial Sequence
  Synthetic
atgactcactagctgtagc

SEQ ID NO: 27315 - DNA, 21 bp, Artificial Sequence
  Synthetic
ggattaccatctaaacccgtt

SEQ ID NO: 27316 - DNA, 23 bp, Artificial Sequence
  Synthetic
acataataacatgctcttgtctt

SEQ ID NO: 27317 - DNA, 19 bp, Artificial Sequence
  Synthetic
atagtttcggagttccagg

SEQ ID NO: 27318 - DNA, 23 bp, Artificial Sequence
  Synthetic
ttaacccttttactggtattcat

SEQ ID NO: 27319 - DNA, 19 bp, Artificial Sequence
  Synthetic
ggaccagaaacagtgacat

SEQ ID NO: 27320 - DNA, 18 bp, Artificial Sequence
  Synthetic
tctgctcctcctcaaagg

SEQ ID NO: 27321 - DNA, 23 bp, Artificial Sequence
  Synthetic
attgcaggttcaatattagaagt

SEQ ID NO: 27322 - DNA, 20 bp, Artificial Sequence
  Synthetic
gtagttccaataccaagcgg

SEQ ID NO: 27323 - DNA, 18 bp, Artificial Sequence
  Synthetic
tctcccattgttcctgct

SEQ ID NO: 27324 - DNA, 18 bp, Artificial Sequence
  Synthetic
cagcttgttcaggacagg

SEQ ID NO: 27325 - DNA, 23 bp, Artificial Sequence
  Synthetic
gatggacagtctaaaatctgttt

SEQ ID NO: 27326 - DNA, 18 bp, Artificial Sequence
  Synthetic
taccactcccggtcattg

SEQ ID NO: 27327 - DNA, 16 bp, Artificial Sequence
  Synthetic
cccgtctggtccacca

SEQ ID NO: 27328 - DNA, 20 bp, Artificial Sequence
  Synthetic
gaggaaatgctggcaggttc

SEQ ID NO: 27329 - DNA, 16 bp, Artificial Sequence
  Synthetic
tgtggcctcccgttcc

SEQ ID NO: 27330 - DNA, 19 bp, Artificial Sequence
  Synthetic
gccataaacgccgactacg

SEQ ID NO: 27331 - DNA, 17 bp, Artificial Sequence
  Synthetic
ctttgcggacgagctgc

SEQ ID NO: 27332 - DNA, 16 bp, Artificial Sequence
  Synthetic
gcccggcctgacgatt

SEQ ID NO: 27333 - DNA, 16 bp, Artificial Sequence
  Synthetic
aacctccccggctgga

SEQ ID NO: 27334 - DNA, 17 bp, Artificial Sequence
  Synthetic
accacaccccccagtac

SEQ ID NO: 27335 - DNA, 16 bp, Artificial Sequence
  Synthetic
cgagccacgccagaac

SEQ ID NO: 27336 - DNA, 17 bp, Artificial Sequence
  Synthetic
acagggccgagagaacg

SEQ ID NO: 27337 - DNA, 15 bp, Artificial Sequence
  Synthetic
agccgtcaagcgcgt

SEQ ID NO: 27338 - DNA, 16 bp, Artificial Sequence
  Synthetic
tgcagcaccatggccg

SEQ ID NO: 27339 - DNA, 20 bp, Artificial Sequence
  Synthetic
ggggcgataacatctgcatt

SEQ ID NO: 27340 - DNA, 17 bp, Artificial Sequence
  Synthetic
accttccccaacgcgag

SEQ ID NO: 27341 - DNA, 18 bp, Artificial Sequence
  Synthetic
gatacgtcccgctcagga

SEQ ID NO: 27342 - DNA, 18 bp, Artificial Sequence
  Synthetic
cgcatcgatccggagatc

SEQ ID NO: 27343 - DNA, 17 bp, Artificial Sequence
  Synthetic
agccacttccccgactg

SEQ ID NO: 27344 - DNA, 16 bp, Artificial Sequence
  Synthetic
accttccgtcccctgc

SEQ ID NO: 27345 - DNA, 16 bp, Artificial Sequence
  Synthetic
cccaagattcggcgcg

SEQ ID NO: 27346 - DNA, 18 bp, Artificial Sequence
  Synthetic
tccccctcgcacatcctc

SEQ ID NO: 27347 - DNA, 16 bp, Artificial Sequence
  Synthetic
tggaggagcaagcggc

SEQ ID NO: 27348 - DNA, 20 bp, Artificial Sequence
  Synthetic
gccgagatttacaaggacca

SEQ ID NO: 27349 - DNA, 16 bp, Artificial Sequence
  Synthetic
tttaaccgcgagcgcc

SEQ ID NO: 27350 - DNA, 20 bp, Artificial Sequence
  Synthetic
gagcggctcaagatctttcg

SEQ ID NO: 27351 - DNA, 15 bp, Artificial Sequence
  Synthetic
tacgcgcgccaaacc

SEQ ID NO: 27352 - DNA, 16 bp, Artificial Sequence
  Synthetic
gaggccgctgttggtg

SEQ ID NO: 27353 - DNA, 17 bp, Artificial Sequence
  Synthetic
gcgaatgtgtgcggagg

SEQ ID NO: 27354 - DNA, 16 bp, Artificial Sequence
  Synthetic
agtgtcacgcgggagg

SEQ ID NO: 27355 - DNA, 17 bp, Artificial Sequence
  Synthetic
gtgcgcctggattcgct

SEQ ID NO: 27356 - DNA, 19 bp, Artificial Sequence
  Synthetic
gtgctcagcccctgcttta

SEQ ID NO: 27357 - DNA, 20 bp, Artificial Sequence
  Synthetic
catcatcagctcaagacggg

SEQ ID NO: 27358 - DNA, 20 bp, Artificial Sequence
  Synthetic
cggtgttttacctgctgcag

SEQ ID NO: 27359 - DNA, 17 bp, Artificial Sequence
  Synthetic
gttgcgcgccatccaac

SEQ ID NO: 27360 - DNA, 20 bp, Artificial Sequence
  Synthetic
atgcaaacagcctgtacgac

SEQ ID NO: 27361 - DNA, 20 bp, Artificial Sequence
  Synthetic
tgttttgggggatgtccgtg

SEQ ID NO: 27362 - DNA, 19 bp, Artificial Sequence
  Synthetic
ggtttcggtccgttgtgac

SEQ ID NO: 27363 - DNA, 20 bp, Artificial Sequence
  Synthetic
cgagagcgtgtttatcctgg

SEQ ID NO: 27364 - DNA, 18 bp, Artificial Sequence
  Synthetic
gtttttctcgggggacgc

SEQ ID NO: 27365 - DNA, 17 bp, Artificial Sequence
  Synthetic
tcatcccgccgaccttg

SEQ ID NO: 27366 - DNA, 18 bp, Artificial Sequence
  Synthetic
tgtggcctcgaataccga

SEQ ID NO: 27367 - DNA, 18 bp, Artificial Sequence
  Synthetic
tgagtcttcggacctcgc

SEQ ID NO: 27368 - DNA, 16 bp, Artificial Sequence
  Synthetic
acgaccacctgctccg

SEQ ID NO: 27369 - DNA, 17 bp, Artificial Sequence
  Synthetic
ggaatagtggcgctggc

SEQ ID NO: 27370 - DNA, 19 bp, Artificial Sequence
  Synthetic
ctcaagaaccccaccaacc

SEQ ID NO: 27371 - DNA, 18 bp, Artificial Sequence
  Synthetic
caccttcggtgggggcta

SEQ ID NO: 27372 - DNA, 16 bp, Artificial Sequence
  Synthetic
tgccatcgcgtggtgc

SEQ ID NO: 27373 - DNA, 16 bp, Artificial Sequence
  Synthetic
tgggggactgcatcgg

SEQ ID NO: 27374 - DNA, 16 bp, Artificial Sequence
  Synthetic
tggcctgggactgggt

SEQ ID NO: 27375 - DNA, 17 bp, Artificial Sequence
  Synthetic
aagcgcgtggacatcct

SEQ ID NO: 27376 - DNA, 17 bp, Artificial Sequence
  Synthetic
gccctgagtcagtgcca

SEQ ID NO: 27377 - DNA, 19 bp, Artificial Sequence
  Synthetic
tcatgcaggagacgtaccg

SEQ ID NO: 27378 - DNA, 19 bp, Artificial Sequence
  Synthetic
accgagggcttcaaggagg

SEQ ID NO: 27379 - DNA, 18 bp, Artificial Sequence
  Synthetic
ggattacctccgttcgcg

SEQ ID NO: 27380 - DNA, 17 bp, Artificial Sequence
  Synthetic
atggccgggcagaagtt

SEQ ID NO: 27381 - DNA, 17 bp, Artificial Sequence
  Synthetic
cttgatggcggcctgct

SEQ ID NO: 27382 - DNA, 20 bp, Artificial Sequence
  Synthetic
ggtgaacgtcttttcgcact

SEQ ID NO: 27383 - DNA, 20 bp, Artificial Sequence
  Synthetic
agctttttttcgtccacacg

SEQ ID NO: 27384 - DNA, 16 bp, Artificial Sequence
  Synthetic
gcagcagctggaaggc

SEQ ID NO: 27385 - DNA, 16 bp, Artificial Sequence
  Synthetic
tcggggcccatgaacc

SEQ ID NO: 27386 - DNA, 16 bp, Artificial Sequence
  Synthetic
atccagcggggccaga

SEQ ID NO: 27387 - DNA, 16 bp, Artificial Sequence
  Synthetic
ggcgaggtgggcttct

SEQ ID NO: 27388 - DNA, 19 bp, Artificial Sequence
  Synthetic
gcagggcacatatgatcgc

SEQ ID NO: 27389 - DNA, 19 bp, Artificial Sequence
  Synthetic
cctacgttctggccctggt

SEQ ID NO: 27390 - DNA, 18 bp, Artificial Sequence
  Synthetic
gaaccttaccaccccggc

SEQ ID NO: 27391 - DNA, 16 bp, Artificial Sequence
  Synthetic
agcaagacccggggga

SEQ ID NO: 27392 - DNA, 20 bp, Artificial Sequence
  Synthetic
gaccggcaagtttccaaagc

SEQ ID NO: 27393 - DNA, 16 bp, Artificial Sequence
  Synthetic
ccttgagggcgggcat

SEQ ID NO: 27394 - DNA, 17 bp, Artificial Sequence
  Synthetic
cgcttcccaggttgcag

SEQ ID NO: 27395 - DNA, 18 bp, Artificial Sequence
  Synthetic
aggacatccgcgacgaaa

SEQ ID NO: 27396 - DNA, 19 bp, Artificial Sequence
  Synthetic
ttgtgtttggagccaaggc

SEQ ID NO: 27397 - DNA, 19 bp, Artificial Sequence
  Synthetic
cgcttctggtccacgagag

SEQ ID NO: 27398 - DNA, 19 bp, Artificial Sequence
  Synthetic
ggtgacgcaggtactcgtg

SEQ ID NO: 27399 - DNA, 16 bp, Artificial Sequence
  Synthetic
tgtgcgttcgatgcgg

SEQ ID NO: 27400 - DNA, 17 bp, Artificial Sequence
  Synthetic
tcgtgcgtctgcgtgtc

SEQ ID NO: 27401 - DNA, 18 bp, Artificial Sequence
  Synthetic
tttgccgacaccgtggtg

SEQ ID NO: 27402 - DNA, 16 bp, Artificial Sequence
  Synthetic
acgacgcccccgaaga

SEQ ID NO: 27403 - DNA, 19 bp, Artificial Sequence
  Synthetic
gggaagtcacgaggtacgg

SEQ ID NO: 27404 - DNA, 17 bp, Artificial Sequence
  Synthetic
tcaccaccatccgcgtg

SEQ ID NO: 27405 - DNA, 18 bp, Artificial Sequence
  Synthetic
cacagagggccactcacg

SEQ ID NO: 27406 - DNA, 16 bp, Artificial Sequence
  Synthetic
cccgacgcctcgtgaa

SEQ ID NO: 27407 - DNA, 20 bp, Artificial Sequence
  Synthetic
ctccacaaaatctcggtcca

SEQ ID NO: 27408 - DNA, 17 bp, Artificial Sequence
  Synthetic
tgcaggcggttgctgtc

SEQ ID NO: 27409 - DNA, 16 bp, Artificial Sequence
  Synthetic
tgttggtgccggtggg

SEQ ID NO: 27410 - DNA, 19 bp, Artificial Sequence
  Synthetic
gcctgcgtagttcaagagg

SEQ ID NO: 27411 - DNA, 18 bp, Artificial Sequence
  Synthetic
tcctctccgtgggggtct

SEQ ID NO: 27412 - DNA, 16 bp, Artificial Sequence
  Synthetic
ggcgcggaccaggtaa

SEQ ID NO: 27413 - DNA, 18 bp, Artificial Sequence
  Synthetic
acgtacgccgaggctatg

SEQ ID NO: 27414 - DNA, 16 bp, Artificial Sequence
  Synthetic
ttgctgatcccccgcc

SEQ ID NO: 27415 - DNA, 17 bp, Artificial Sequence
  Synthetic
caaaatccgccggggtg

SEQ ID NO: 27416 - DNA, 19 bp, Artificial Sequence
  Synthetic
ttggggagaagcaggtgtc

SEQ ID NO: 27417 - DNA, 16 bp, Artificial Sequence
  Synthetic
tgtcgtcggggtcgtc

SEQ ID NO: 27418 - DNA, 17 bp, Artificial Sequence
  Synthetic
gcgtgtatgggcatgcc

SEQ ID NO: 27419 - DNA, 18 bp, Artificial Sequence
  Synthetic
atcgtgcgcactaggtcc

SEQ ID NO: 27420 - DNA, 17 bp, Artificial Sequence
  Synthetic
agaacaacgccctgccc

SEQ ID NO: 27421 - DNA, 20 bp, Artificial Sequence
  Synthetic
acaaaacttacgacaggcca

SEQ ID NO: 27422 - DNA, 16 bp, Artificial Sequence
  Synthetic
tgacacaggcgctcgg

SEQ ID NO: 27423 - DNA, 16 bp, Artificial Sequence
  Synthetic
tggtcgaggggggctt

SEQ ID NO: 27424 - DNA, 16 bp, Artificial Sequence
  Synthetic
aggatcgccgggtggt

SEQ ID NO: 27425 - DNA, 19 bp, Artificial Sequence
  Synthetic
cctggcggtgaatgtagtc

SEQ ID NO: 27426 - DNA, 20 bp, Artificial Sequence
  Synthetic
tctggatgcggggaaaactc

SEQ ID NO: 27427 - DNA, 19 bp, Artificial Sequence
  Synthetic
cctcctcctccagtccaat

SEQ ID NO: 27428 - DNA, 18 bp, Artificial Sequence
  Synthetic
tccggatagccaggcctg

SEQ ID NO: 27429 - DNA, 18 bp, Artificial Sequence
  Synthetic
ctggggtgaggggacact

SEQ ID NO: 27430 - DNA, 16 bp, Artificial Sequence
  Synthetic
tcacacggccgggcta

SEQ ID NO: 27431 - DNA, 18 bp, Artificial Sequence
  Synthetic
ggtcccccacaaagcgaa

SEQ ID NO: 27432 - DNA, 18 bp, Artificial Sequence
  Synthetic
gagccgttgtacgccaga

SEQ ID NO: 27433 - DNA, 16 bp, Artificial Sequence
  Synthetic
ccaccaggaccaccga

SEQ ID NO: 27434 - DNA, 16 bp, Artificial Sequence
  Synthetic
accgactgttggcggc

SEQ ID NO: 27435 - DNA, 20 bp, Artificial Sequence
  Synthetic
gtgatgggggggaagagaga

SEQ ID NO: 27436 - DNA, 20 bp, Artificial Sequence
  Synthetic
tgatttacccaggtgttgtt

SEQ ID NO: 27437 - DNA, 22 bp, Artificial Sequence
  Synthetic
ttgagttctcagtatgttgttc

SEQ ID NO: 27438 - DNA, 24 bp, Artificial Sequence
  Synthetic
ccaaattttgattgaaagataccc

SEQ ID NO: 27439 - DNA, 18 bp, Artificial Sequence
  Synthetic
caccgagaagctactgtc

SEQ ID NO: 27440 - DNA, 20 bp, Artificial Sequence
  Synthetic
accactgaacaaatggcact

SEQ ID NO: 27441 - DNA, 20 bp, Artificial Sequence
  Synthetic
aggcctgttaataggaagtt

SEQ ID NO: 27442 - DNA, 18 bp, Artificial Sequence
  Synthetic
atgcctcaaggtcggtcg

SEQ ID NO: 27443 - DNA, 20 bp, Artificial Sequence
  Synthetic
cacaagagttgcctgaactt

SEQ ID NO: 27444 - DNA, 20 bp, Artificial Sequence
  Synthetic
aggtgtccttgttgggattg

SEQ ID NO: 27445 - DNA, 19 bp, Artificial Sequence
  Synthetic
tcctaagtgacgggttctt

SEQ ID NO: 27446 - DNA, 23 bp, Artificial Sequence
  Synthetic
atgttttaacctttcgactttgt

SEQ ID NO: 27447 - DNA, 21 bp, Artificial Sequence
  Synthetic
ctgtctaagaatgtccaccat

SEQ ID NO: 27448 - DNA, 21 bp, Artificial Sequence
  Synthetic
atcttctggttgcttttctga

SEQ ID NO: 27449 - DNA, 18 bp, Artificial Sequence
  Synthetic
ccatcacactgtcgatgt

SEQ ID NO: 27450 - DNA, 23 bp, Artificial Sequence
  Synthetic
atgatccattgataggtattgac

SEQ ID NO: 27451 - DNA, 18 bp, Artificial Sequence
  Synthetic
tgctttgctttggtggag

SEQ ID NO: 27452 - DNA, 22 bp, Artificial Sequence
  Synthetic
cttttgcaaggttactcagttc

SEQ ID NO: 27453 - DNA, 19 bp, Artificial Sequence
  Synthetic
gtgcaacacatctcacaca

SEQ ID NO: 27454 - DNA, 19 bp, Artificial Sequence
  Synthetic
gcatcttagaagcattcgc

SEQ ID NO: 27455 - DNA, 19 bp, Artificial Sequence
  Synthetic
ttggggcaaagaaacgaaa

SEQ ID NO: 27456 - DNA, 18 bp, Artificial Sequence
  Synthetic
tttgtcacaatcctcccg

SEQ ID NO: 27457 - DNA, 23 bp, Artificial Sequence
  Synthetic
tgctttctgattagttctttcca

SEQ ID NO: 27458 - DNA, 24 bp, Artificial Sequence
  Synthetic
cttttttaatgactgcaacaacag

SEQ ID NO: 27459 - DNA, 19 bp, Artificial Sequence
  Synthetic
actggtactagagccgacc

SEQ ID NO: 27460 - DNA, 19 bp, Artificial Sequence
  Synthetic
ctgtgactctaggtgttgt

SEQ ID NO: 27461 - DNA, 24 bp, Artificial Sequence
  Synthetic
gctatattttcatcttgtcctgta

SEQ ID NO: 27462 - DNA, 21 bp, Artificial Sequence
  Synthetic
taactctaacgcgaccactat

SEQ ID NO: 27463 - DNA, 25 bp, Artificial Sequence
  Synthetic
cctcatcatcaaattgtatttcact

SEQ ID NO: 27464 - DNA, 19 bp, Artificial Sequence
  Synthetic
cctcaacagtttcctgagg

SEQ ID NO: 27465 - DNA, 18 bp, Artificial Sequence
  Synthetic
agctgtgtttgttttggg

SEQ ID NO: 27466 - DNA, 24 bp, Artificial Sequence
  Synthetic
gaaaatctggatatttacaggtgc

SEQ ID NO: 27467 - DNA, 21 bp, Artificial Sequence
  Synthetic
gctcttttctaacacgtttgt

SEQ ID NO: 27468 - DNA, 20 bp, Artificial Sequence
  Synthetic
tgaaaaatatttgccagccc

SEQ ID NO: 27469 - DNA, 20 bp, Artificial Sequence
  Synthetic
aaacacttgagtcagccata

SEQ ID NO: 27470 - DNA, 19 bp, Artificial Sequence
  Synthetic
attgtgacacttggagtct

SEQ ID NO: 27471 - DNA, 19 bp, Artificial Sequence
  Synthetic
gtctttttgcaccaacagt

SEQ ID NO: 27472 - DNA, 20 bp, Artificial Sequence
  Synthetic
agtcgtgagtaaccgtgtct

SEQ ID NO: 27473 - DNA, 21 bp, Artificial Sequence
  Synthetic
gtctagtcactggtaagtctg

SEQ ID NO: 27474 - DNA, 21 bp, Artificial Sequence
  Synthetic
tagctgtctcactttcttctg

SEQ ID NO: 27475 - DNA, 18 bp, Artificial Sequence
  Synthetic
tgagctggtgttcgtaaa

SEQ ID NO: 27476 - DNA, 20 bp, Artificial Sequence
  Synthetic
tccttctgatgtagcagaca

SEQ ID NO: 27477 - DNA, 22 bp, Artificial Sequence
  Synthetic
gctcgtttaccatttaacaaac

SEQ ID NO: 27478 - DNA, 19 bp, Artificial Sequence
  Synthetic
tctcacaaatggacgtctg

SEQ ID NO: 27479 - DNA, 20 bp, Artificial Sequence
  Synthetic
actgatactagcttccacag

SEQ ID NO: 27480 - DNA, 20 bp, Artificial Sequence
  Synthetic
tgctagtgctggagagaacc

SEQ ID NO: 27481 - DNA, 18 bp, Artificial Sequence
  Synthetic
cgtggtttgttcctgccg

SEQ ID NO: 27482 - DNA, 18 bp, Artificial Sequence
  Synthetic
gactccaacaggctctct

SEQ ID NO: 27483 - DNA, 20 bp, Artificial Sequence
  Synthetic
cccgaacttcttttcctcca

SEQ ID NO: 27484 - DNA, 22 bp, Artificial Sequence
  Synthetic
ttttggtccctgttttatgtct

SEQ ID NO: 27485 - DNA, 20 bp, Artificial Sequence
  Synthetic
tttgccatgatgtgtcctgg

SEQ ID NO: 27486 - DNA, 18 bp, Artificial Sequence
  Synthetic
gccttggtccatctttcc

SEQ ID NO: 27487 - DNA, 20 bp, Artificial Sequence
  Synthetic
ctggtagggtaaatgcagta

SEQ ID NO: 27488 - DNA, 18 bp, Artificial Sequence
  Synthetic
ttggccatagttcacagc

SEQ ID NO: 27489 - DNA, 21 bp, Artificial Sequence
  Synthetic
ggattttctcttcctggtgta

SEQ ID NO: 27490 - DNA, 21 bp, Artificial Sequence
  Synthetic
catatcctgcttttccctctt

SEQ ID NO: 27491 - DNA, 25 bp, Artificial Sequence
  Synthetic
gggttagttcttttataatgctatg

SEQ ID NO: 27492 - DNA, 18 bp, Artificial Sequence
  Synthetic
acctacccaccatgccac

SEQ ID NO: 27493 - DNA, 19 bp, Artificial Sequence
  Synthetic
ttccacagtagttcaccag

SEQ ID NO: 27494 - DNA, 18 bp, Artificial Sequence
  Synthetic
cttcacctgccgtaaagc

SEQ ID NO: 27495 - DNA, 25 bp, Artificial Sequence
  Synthetic
gcacaaatatctatactttgtgtag

SEQ ID NO: 27496 - DNA, 18 bp, Artificial Sequence
  Synthetic
tacatcccgctctgaagt

SEQ ID NO: 27497 - DNA, 23 bp, Artificial Sequence
  Synthetic
acaatatactaagcaagcacttg

SEQ ID NO: 27498 - DNA, 18 bp, Artificial Sequence
  Synthetic
gaggttgtggaactcgag

SEQ ID NO: 27499 - DNA, 22 bp, Artificial Sequence
  Synthetic
ttacatcttaatagggcaaagc

SEQ ID NO: 27500 - DNA, 18 bp, Artificial Sequence
  Synthetic
ggtttgcttcacctcctg

SEQ ID NO: 27501 - DNA, 24 bp, Artificial Sequence
  Synthetic
gtccgatttttatctatgtcaatg

SEQ ID NO: 27502 - DNA, 21 bp, Artificial Sequence
  Synthetic
tgatatttgcctctaggtagc

SEQ ID NO: 27503 - DNA, 19 bp, Artificial Sequence
  Synthetic
cctcgcgaatgcttggaaa

SEQ ID NO: 27504 - DNA, 25 bp, Artificial Sequence
  Synthetic
catatctattgccaatttataggtc

SEQ ID NO: 27505 - DNA, 24 bp, Artificial Sequence
  Synthetic
cctgttattcactatatggtatcc

SEQ ID NO: 27506 - DNA, 20 bp, Artificial Sequence
  Synthetic
tgcttctaactggcagcttt

SEQ ID NO: 27507 - DNA, 19 bp, Artificial Sequence
  Synthetic
atcacaccagtcacattga

SEQ ID NO: 27508 - DNA, 24 bp, Artificial Sequence
  Synthetic
ctctgagaagattaggtagttgtc

SEQ ID NO: 27509 - DNA, 21 bp, Artificial Sequence
  Synthetic
ttttgtcatcagagtggaacc

SEQ ID NO: 27510 - DNA, 21 bp, Artificial Sequence
  Synthetic
cttttattaccttgctcctgc

SEQ ID NO: 27511 - DNA, 19 bp, Artificial Sequence
  Synthetic
acctgcaatcattccttcc

SEQ ID NO: 27512 - DNA, 24 bp, Artificial Sequence
  Synthetic
ctcatcttcactgtttattatccc

SEQ ID NO: 27513 - DNA, 19 bp, Artificial Sequence
  Synthetic
ctagaagcagcagttgagt

SEQ ID NO: 27514 - DNA, 24 bp, Artificial Sequence
  Synthetic
ttgtatatgagacccatacaactg

SEQ ID NO: 27515 - DNA, 20 bp, Artificial Sequence
  Synthetic
cccaattgtcctcattgcct

(The sequence listing continues in the following parts.)

What is claimed is:

1. A single reaction composition for detecting the presence of a target polynucleotide in a crude or unprocessed sample, comprising:
    a DNA isolation solution capable of isolating target RNA from the crude or unprocessed sample comprising a cell or virus containing a target RNA;
    one or more thermostable Cas proteins possessing collateral activity;
    at least one guide polynucleotide comprising a sequence capable of binding the target RNA and designed to form a CRISPR-Cas complex with the one or more Cas proteins;
    isothermal amplification reagents comprising optimized loop-mediated isothermal amplification (LAMP) primers and amplification reagents; and
    a detection construct comprising a polynucleotide component, wherein the one or more Cas proteins exhibit collateral nuclease activity and cleave the polynucleotide component of the detection construct once activated by the target RNA, thereby generating a detectable signal.

2. The composition of claim 1, wherein at least one of the one or more Cas proteins is a Type V Cas.

3. The composition of claim 2, wherein the at least one of the one or more Cas proteins is a Cas12b is selected from the group consisting of SEQ ID NOs: 61644-61954.

4. The composition of claim 3, wherein the Cas12b is *Brevibacillus* sp. SYSU G02855 (Br) Cas12b or *Alicyclobacillus acidiphilus* (Aap) Cas 12b.

5. The composition of claim 4, wherein the at least one guide polynucleotide comprises a sequence selected from SEQ ID NOs: 61957-61961 and 61970-61972.

6. The composition of claim 1, wherein the optimized LAMP primers are selected from SEQ ID NOs: 1-40, 499 and 61,983-61,988.

7. The composition of claim 1, wherein the at least one guide polynucleotide is selected from SEQ ID NOs: 40,500-61,643 and SEQ ID NO: 61,989.

8. The composition of claim 7, wherein the at least one guide polynucleotide comprises a spacer specific for the N gene or S gene of SARS-CoV-2.

9. The composition of claim 1, further comprising one or more additional additives selected from the group consisting of glycine, taurine, histidine, and combinations thereof.

10. The composition of claim 1, further comprising RNA binding beads.

11. The composition of claim 1, wherein the at least one guide polynucleotide is an optimized guide polynucleotide.

12. The composition of claim 1, further comprising reverse transcriptase.

13. A method for detecting coronavirus in a sample, the method comprising;
    distributing a crude or unprocessed sample comprising a cell or virus containing a target RNA or set of said samples into individual discrete volumes, each individual discrete volume comprising the composition of claim 1;
    incubating the crude or unprocessed sample or set of said samples in the composition of claim 1 at conditions sufficient to isolate the target RNA of the cell or virus via reagents of the DNA isolation solution;
    amplifying the isolated target RNA using isothermal amplification, wherein, optionally, isolation of the target RNA from the composition of claim 1 between the incubating and amplifying steps is omitted; and
    detecting amplified target RNA by binding of the CRISPR-Cas complex to the amplified target RNA, wherein binding of the amplified target RNA activates cleavage of the detection construct thereby generating a detectable signal.

* * * * *